United States Patent 8,877,916 (PROMOTER, PROMOTER CONTROL ELEMENTS, AND COMBINATIONS, AND USES THEREOF) - sequence listing, part 17

SEQ ID NO: 25959 - DNA, 3003 bp, Unknown
  misc_feature (1)..( 3003): 2750-1469P.txt file - cDNA_ID_2709393; gDNA_ID_2214565; Annot_ID_134946
cattgataatttcgtagtcacagccgataacgtttcggccagaaccaaactgaacttgaccggctataccagtaaagtttactttcagaagtttctcaagtagtaactccccactgttgaaaaatttgattttctccaagtgcagtttggttccccgtgcatgaagtaacttttcggagtaagaaaacgttatgttgattccttcattcagcaattcctcgatgccatgcgcaatcatccacactgtatcataggcatgtaatgcgtaggcattcattgatctgttgctctgcagtttatgcgtgaaatgttccatctttacggattctgggatatgttgacgaagccccactactccttcaaggcgttttagagtacctttgtcactcaaagaatctaaggtaacagagagccagtctgtggcgagccatacgtattcatgggtcatcatctgcagcttttgcgctatatcaaaaattctgagcaatgggtccggaccaaaatgaagaatataaactcgaggaccgatggacttggatttgttcaaagcattagtaaggaatttttcatcagaatgaactgagagcggcactttataggaaattctggatcttttcttgtacagttcatcatctagagcagaaactccatttcttccgagctcatcatccgagtaaactgagatcacttctttccatccataaaaattgataagatccacaagggcagacatttggtgggcatcattaggtgtagtccgaagaaagaagggaaattggagggcagagagagttggatcagttgctgcaaatgagacaagaggaaagtggagcccttttgcaatatcggaaattgtatgagcaacagaggatgaaattggaccgatcatagccaccacttctttctcaagcaattcaaaagctgcaaaacaaaaaccactgaagcttaaaccaggcccttagtggtaaaaccaaagttttgtttccacttatgtacaggaaacacaggtcctagtaacagcctgtttagggtatgcggtctatattgttctatgcattattagcattcggaacccaaaatatgtaccaataaaaaacggattaaaacgtaaatcgatgtgccaatcatttccaactatcacaaaatgaaatattgttgctactgatgtgcattgaccgctttctataatatgtttgatatactgtatcagccatggatgagtgtcacaagtgtttgaaacacaaaagaactagaagaacagtcacggtacctccaaaggacccacgaaagacattgcaggcagaatcctccattaatagccgtagctccgtttctttgagaaagcttttatcattgttcacatcggaaacagctgcctctagagctacttttgcagctcttccgataaccgaatcaaaagcaaaaacagcaccgatgttcaccagttgaggtctttggcaatccattggaaccaccagaatgaccacaatcagtgccgtaatagcgacagatgggtcaatgcccagtcccatggagataatgcaatcaaagtaaggaccacttcagatagtttgtgttggaactagaaccatctcatttaaatctagcaactcttcattcagcattgaggatgagaagattagagaactaagcaaggtaaagtttccaactttgacctgtagagtcaatgcgattagaagacgaatcaagatctaagcgaagagcaatcacaagtcaaaccaaattgattattttagctgaaaactagcaacaatgtggatatgaagacttatatacacaaactcatccggacagaagaaaaatctgaaaaagagtttttacaaattcattgaaattaacaacagtgagacattctctttacctctttgagctaccttctggttctctctgcggaatatacgcaaacactttgtaggcataagttaaaaaagggaaattttacgacaacgcaacgaatttttaacaagagaagtcaagaactatcttttttaaaaaaccatgatttgacaggagattactaaaggaagagaaacaaaactagagagatcaaatcatgcccagaaattcatccatcattcttcttcttctgagaacaaaatagaagagagaaattgaaaaacgtgtgactgaagtgcttttttgattcgagctcacaaagtcctatctagtctatatactctatagtcacagcagccgtttgtttgtatttttgttttcagtggggcccatcattattgggccctacatgtaacggcccattttgttaagtttatttaagattagattacaatataaatattttaattgccatgtgttaatcattttatttcttctcaaaagtttattctcttaagttaatttgtcaatgaaatgttaatagtatttcattttatttttgcataaagagagacccgtagcaaggcaaaatttgagttggcgttttttattcataataaagatttttaggcggcaaaaaactattacataatgagattttatcacttattcatctaataatatttaattaaattacatatgtgtttttttctagctatgtcatttatttttacaatttatataaaattttgatatgtttccatgtatatatatattttaataaatgaaaactcaatccagaaaacataaattttgattttattttaaattatatgtttttatttataatttgttatctcttttatacattaaggtgtttttgcaataatacagtcttaatttttaaaaattacaattaagccctaaactttgtaaatgttccaaattaggaaggaaataaagaaaggagacaacttaaggttctcttattaaatgccattccctttctttcttacaagtcacaacctctctctctctctctctctctctctctctctctctgcgtctttctctttctctctgtctgaagttgagaacacgaaccactgaaaaacccgcgaaagactcgagcacgaaccaacaatg

SEQ ID NO: 25960 - DNA, 3003 bp, Unknown
  misc_feature (1)..( 3003): 2750-1469P.txt file - cDNA_ID_2709413; gDNA_ID_2214566; Annot_ID_134966
tatgtttttatcaagaaccacagccatcttcttctcctcgtcaacaaagaaactcccacccgaataagagaaggaattaccagtgagaggtttcatgtcaacctttaagaacaacttgttccacgacactgcattgggctcaaccttgctgctaatccatatcttcaaggtatacggcgaagaagaccgctgacacaagaccgcaatctggttatccccaacgctagatagagccacagtatcaccaaagtaaggctgaaatggcagaggcagaggcggtctaaatctctccgttgtgaaatcaaaacacagcaagaaataagaaggatcttgtcctccatatggaacaaccttgtctcgtgcaaaccagtaactgtttccatcgatagacaaaccacggtgaacaaaatctatctcccaatccggattcacatcaagaacctcccatgaatcagactcaaaactgtagatttcaaactcacaaagtaagtgtctccttccatactcaccgtcatccacaaatctcaaaactttatgattcttcatcacatcgtagcccagagcatacctatcccatttgttgaaagagtttctgggtttgatccaaattgtttgcccaacacaagggttccaaacaacaaccctagatatgtctttagtggtgcataacaagaaaccctcgcagtgaaaaatgttagatatgtcgacttgtgcaccaccgtctaagctaacaagttgacctaaacgctctatgggattagggtttagtagattgagactgaataaagaaaccctaaaatcgagcatcatcacaacatgaaactccttactctgcttcttctttgcttcttctttatcgatgtgcttccttgtaaaagacatatctttggataaagtgttcaactttttgcatgtgaatcgtactcttctcagagatgtcactggaaacttcgagagcacctcctccgccacatcctttggaagatccgagagcatcgtcgttgattgtttttgcatatcgaagaaattttactttaccttttactctgatttcttcagagattatgagagaacgaacacttcagaaatgttagatgtttctaaattgggcttgggctttaaagtattacccaaaggctattaaagtcgttttttccaatttgggctcctgatttattagtatgggagggcttagttttgggctttaaagtatgccccaatgcctaataatgtctagctagttcttcgttatactaaagaacgaattttggaaattcttgaattacgattgtacccttatattaatttcatcttttgtcttattcttatttatgcaaaagttatgcaaaagttttaagaaattagcagccaagcctaaagaatcattgagagtttataagggtgatttggtaattgagtagtttattagctaatttgatttcagtggcacgtggtaaattactggtggtttaaaactattgtacgtggacgattcttagccaacgaactagtacactctagtgcgaacaggtacatgattaaattcgtggacatccaatcatatctcgtccaagataagaccaaaacatatgaggtcattactcactaataaacatttaaacttttgttttgtcaacgaatagtgtgtttttcttttgtcattccaatttttttctgttttcttttcactattcacttttggtccataatattttatgggtatataagataatcgtttttgtcttcatacatggtaacatggatgtttatatatgtaatagtgttaaaaagaaaaagtggtcggttatacttaacttattatgatagagctttgaaaacaaacaacacgagatggagaaattagtcattcaacaaaagaaaaggacgaacgcagtgacttaacatgaaactgtgagcggcccaaaatcatttatgtaatggacccttaacttttcatgcacacgatttttctcatttatatgtttttctgctctctttttttcctctttatcattactttaatttattttatgttcttttttcgaagcaccataattgtatgctttcaccaaataatccaaatttagaatcattaatatgtcaaaaaagaattgcatatattcaataaaacgtaatgctaagtagtacaatgcatgtattatacaaaatgtaatgatatagatccaacgtatatatcaaagtggaccaaaatatatcttatgtattagacgagtttactatgcaaaatttatgattctattccgcatggagcgtgctaatactacttcgaacccctttgagaccaatatgtgattctatattctatctagtacaaattatgagaagtatatacgtacgatgagagtataaaacatttcaatatttgtatagagaggacaccacttggttgacttgacccacgataagatattgaagaaaccaaacttgtatagtacgaattcgaaatcgtaattgatgatgcgattcgacaagtccaggggctccctcccacgcgcaatgggcccagcaaccacgtgtggccactagagagaataaaccattagcccacgtgatcttgggcccaatcaatctctccctcacattaaacgacaaaacaaaagctcttctgggttaaattgataaatatcaaaactttaaaggtaatttgctaaaatcgccacacaaaaaaagtcgcagaaaatatatgaggaaacaaaaagcgaagacgacaaaaaaaaaaaaaactctgatttttttttgttatctctctctatctgagaggcacacattttgcttcgtcttcttcaatttattttattggtttctccacttatctccgatctcaattctccccattttcttcttcctcaagttcaaaattcttgagaatttagctctaccagaattcgtctccgataactagtggatgatgattcaccctaaatccttccttgtctcaaggtaattctgagaaatttctcaaattcaaaatcaaacggcatg

SEQ ID NO: 25961 - DNA, 3003 bp, Unknown
  misc_feature (1)..( 3003): 2750-1469P.txt file - cDNA_ID_2709421; gDNA_ID_2214566; Annot_ID_134962
tagaaaaaaagagtttcattgctcggtgctttcccggcgatggttctccgattcaccagacttgagtctcatccggtggaggttgtggaagattcacgtgtccttagcttattattattggtctgacacgtcttaagcttatctcttttttgtgacgtaaaagtctgttgtggacctcatatgtagactgtcttgagccttttatgttgtaacactgagcctcagtatattaaaaataaatctttctctgaaaaaaaaaaaaaaaaagttaaaaacctacgctaaaaaattctaggtcttggaaaagagtatttgggccaaatgatcacattaattagttatgggctgaaataacattctgaagttttatgaggaccgagagaactaagtttaagaaaaatgttgaaaaaagcgtattagcagagggacaaacgctttttagggttttagatttcctctgagagagaattttcgaaagcttgagagagatttccaactacgttagccatggcgagcaccaaagttcaaaggattatgacccaacctatcgtacgtttcttcttcgattcctttgttccatctctttattgtttctatcgaaacctaattttgtatcttgctttttgttttccggtggcggcggctccagaacttgatttttaggtttcttcaaagtgtaagttgttcaatttcttctgatttgctctctgaggttttaggttattagtagttcgtctactgatttgttccctggtcttttgtgtttgtgatgcagaaagctaggatccagatttggctatttgagcagaaagatttgaggattgaaggaagaatcactgtaagttgatgttgaagctccgttatcatgaattgattagattcctggctttgtttataggacattcgagggttatgctaactttaggagagtttgaaatgcattagcagtgtgactatctctctaatttagtctgtgtttgaactgttgcatttgttgtgaattgaaaagggatagttgtcactgttactactactgcacaaagaactgataagagcctgccaatagaaactagtttgattagctagctgttcttaggttgagtatgattgtgtcattctcttcggcttaaaacttattgtctcctacagcctacttggctttgggtgttacttgtttcagtttgttgctatgcttgtagttgtatgtcctctatgattttcgagttatgattcaagcattcaagcttttcttagtttgattctatgataatttggagaaacttgagattttgtgatggtgtcattctcattggcttaaaggtttgagttgtctacttgacttttgttgttccatgttgcagtctacttgacttttgttgttcctcgagttaagatcctagcttttctgaggttgattatatgtatggaggaacatgatatttgtgatagtgtcactctactcggttttaaacttagatttttgtctacttgaatttgggtgtattattgattcttctaggagaatccatcaaaccttgcttatccgtcgtcctttgcagggttttgacgaatacatgaatctagttttggatgaggctgaagaagtgagcatcaagaagaacaccaggaaaccacttggtgagttatcctgaactcactctttgataacaagtctcagatctgtctgcttatggtttgataactcgtgttaatacctattttcaggaaggattttactcaaaggagacaacataactctgatgatgaacacgtaagtaacacaatctctactctgtcttctctctttatgatgtatagcagcttgatttgtcacataacaaaagattgaaacaaaatcctttctatgttaacaggggaaagtgatgtctgtctcaaacaactctcttcgatgaccttcaagcttatgttaaatatctgttgagttcttcctcagcttaattggtacttgacgataccttcttttcttcaatgtcgtataatatattgcaatgtagtgagtgacaaaggagcttgatcgaatctagtggattggttggttaaaacttcaaaaaagagatttggtcccttttggttaaatctagtgttatgtaatttggctgatctttgttgcaactttttaacctctgtttaaatttcaaaccttaaaaaagtaaaaccaattgattttgattataaaaaaaattgtatcatttttgtttgtttggtgaactgaccgagttggccattctcagggctcaagtagattgaaagtttaattatactaatagaccaatcagaatataatctgttaaagttaacataaaaatacagaaatctatgtgaacattaacttttcattgcaattagatgtttttatatccatgttgattgttgaatcttatccctaatcttgctattggtgaaatgaatgtatttttactattaaagtctttttttaataacaaataattggactttatacaacaaagtattattatttaattatcaactttagaatatagcatgtgccaaaaatacatacactagccgccggcccaagaatgtcgtccaataaacgaaaagcaaaagtgacggcaatccaagcctactgtgatcttgtccgcacccgataactatctttaattactaaaactagtcaaagtactcgactaatcacaaaactagacaagtgtttcaagtaaattaatttttgatcttttcattttatctctctctctttttcttctatccaaaacaccatttttgaggtatttttctctctccttcgaatcgaattttcaggtttctctttccgtttgtttgaagaagcttttaagtagaattcataaaatcttgcttagcttctgggtttgatttgtttgtggtaaagttttgattttttttttagtttgagagctggatttgtgattctttctctgggttggtgaagttttttacttgcttcgatcttatagatcagagcttctagcagcgtaaaaaatg

SEQ ID NO: 25962 - DNA, 3003 bp, Unknown; identical to SEQ ID NO: 25961
  misc_feature (1)..( 3003): 2750-1469P.txt file - cDNA_ID_2709421; gDNA_ID_2214566; Annot_ID_186015

SEQ ID NO: 25963 - DNA, 3000 bp, Unknown; identical to SEQ ID NO: 12686
  misc_feature (1)..( 3000): 2750-1469P.txt file - cDNA_ID_2709429; gDNA_ID_2214566; Annot_ID_134959

SEQ ID NO: 25964 - DNA, 3000 bp, Unknown; identical to SEQ ID NO: 12686
  misc_feature (1)..( 3000): 2750-1469P.txt file - cDNA_ID_2709429; gDNA_ID_2214566; Annot_ID_186011

SEQ ID NO: 25965 - DNA, 3003 bp, Unknown
  misc_feature (1)..( 3003): 2750-1469P.txt file - cDNA_ID_2709433; gDNA_ID_2214566; Annot_ID_134957
gaaattgttaaaaaaaaaaacgtacagacatctcttacacttaaatatttctgatggaaacactaaaataaaatattttgatcgtagaaatataactaatatttacttattttttctttttttttaggttttaaaattctcattatgttggttttagtatgtttttattttatttttaattgcataattaattaagatatttttttgtacaagataatgccacgcaagcattttacgggactttttttccttcgcatgcaaagtccggcggctcattttacacgataatgaggatttgctcatgtttctacgaatttaacaaaaaccgaaaattgcctttaaatgaaaaagggagagtcaaaaaaaaggaaaaaggaatattcaaaatagaaaagtagaaaagagaataatataaaaataattatctcaagaggctatagataaagtgggacccaagcaaatcttttagacaacgtggctgatcctatcgggccccacaaagacaatggttatgtggaatttggatatgtctccttttttttttttgctctcccacgctcttatcttgtatttagttagaaatctgaaacaattccctcaaaaaaaaaacaacactattcgccactcatttcatattcaaactttaaaaaactgaataaattttaataagaaaatttttaaccttttgaacaagagttttttttgttatattttgataatttttcctaacttcaaccaattaaattataatagacaacaaaatttaccgttttgttatttataacttacatgcatattgtccaattttaaacgtgaacgacatgatggtaacgttagttacattgtagtctcagttaaattcaaaacatttgattatttataacccacacacgcataatatccattttaaacgtgatttatacatgatgatgacattagttacatagtagtgttcgttaattacaaaaaaaaaaaaaaattggacgtttttcttgtttagaactcacaagcgtatattgtccagtctaaatttataaaatagtggtgacattagttacataatagtctttcgtcaaaaacaattttttgaccacttttatcattcataattcacacactcatattgtccaatttaaacgtgaactaaatatggtggtaacattagttacttagtaatcttcgttaaataaaaaaagttcaaccgttttatcatttttaacccacacatatatttaacgtgaattatatcacgagttacataatagtctccgttaaatttggaatttagctcaaatttgttgtaagtgaattgcttgttaccaatgtcgtcagtaaaacataacggtaaatgtttctattttgtattataactattttaacataaaagatataaagaaagatttctatgtataatacattatttcgatatatagatttaaattatagttataaatatattttttgcttgatatctctgtaaattaataagacggaatttaaaataattacaataaataaattttaagcaaattagatgttagttaaaagttagatgagaaaacactgtagcatatgaagaaaaaaaaacacaaaaaagtataattagatgtgaagcattaaaaatgttcccattgagatgacgccacgtgtcacaatctgaggtcggcggtcgatgttataccgttgaaatgaggaagaaacggaaaaaaagtttgaaacgttcctaggagggaatggatgacgtgtcataatatgattggagtacatagctgccgttgatcgcgaaagtaatgccaagtcatcagtcgcacatgcctcgtgacttttcttatctttctcttcccaccctaacacgccacgtttcctctacatgtttgccacgtggcttttcactatccacccaccaatattcctaacactaaaattagattaaaatttatttactatgggatatgaaattatgaattgtgaagttatgtgattatggttaggctgatgctacgtaatttgttactctttagtagcagtacaaatgtactttacaaaaagatttggtgtgtttcaagcatatcatacaattctttttatttttacagtacatatccctattttacaataaaaatatcgtattttatttatcaaaatgttgttttgctaataatatttagtaaaataattttaacaatagtaagaaaaagcttgaaaaatcaaattttgtaaatttccccttctacttgttagtaattaatagaaatagataaatattagtttcttttgattttatttttcccaaattcactagcatttgtggaaaattgatgtgagtacaaaactgatgtgatttttctttgttattcctcaaaaatataatttttcaaccttcaattttaagttttttgatggatatgagcagcttttgtcaaatctattaaataaaaagacgtgtgccacaaattatccacatcagcaataagtttttttttaaaacaacatatatatggaaaaataatagctgtaaaatatttatttcccatttaggttaaaaaagtagaaatataattggagataagagacgaaacagctcacagcaaactaatcagtaattagggttatagctttttaaagatttgtttccttttatttcatttttcaaagacaaaagtcggtttgagttaaccacacgcgcttatctaacggttcagatataccaatcatatccatctcgagaaaatcgagaccgtccaaaaattgtgttgattttttaaactttaattttgtttcctctttcgttttcgttcttatcctcaccgaaaaaatttccgttttttcttccttcttaaattccacaatatggacgctctcttccttcttcttcttcgtaaaactatccttctttttcttctctccttgttatgaaatctgagaaacccagaaacaatatttgatttcttcatttacccaattttaaagttttgatttttttttcttctcttcttcgttatg

SEQ ID NO: 25966 - DNA, 3003 bp, Unknown; identical to SEQ ID NO: 25965
  misc_feature (1)..( 3003): 2750-1469P.txt file - cDNA_ID_2709433; gDNA_ID_2214566; Annot_ID_186009

SEQ ID NO: 25967 - DNA, 3000 bp, Unknown; identical to SEQ ID NO: 12447
  misc_feature (1)..( 3000): 2750-1469P.txt file - cDNA_ID_2709449; gDNA_ID_2214552; Annot_ID_134694

SEQ ID NO: 25968 - DNA, 3000 bp, Unknown; identical to SEQ ID NO: 12708
  misc_feature (1)..( 3000): 2750-1469P.txt file - cDNA_ID_2709461; gDNA_ID_2214567; Annot_ID_134987

SEQ ID NO: 25969 - DNA, 3000 bp, Unknown; identical to SEQ ID NO: 12708
  misc_feature (1)..( 3000): 2750-1469P.txt file - cDNA_ID_2709461; gDNA_ID_2214567; Annot_ID_186059

SEQ ID NO: 25970 - DNA, 3000 bp, Unknown; identical to SEQ ID NO: 12709
  misc_feature (1)..( 3000): 2750-1469P.txt file - cDNA_ID_2709464; gDNA_ID_2214567; Annot_ID_134986

SEQ ID NO: 25971 - DNA, 3000 bp, Unknown
  misc_feature (1)..( 3000): 2750-1469P.txt file - cDNA_ID_2709476; gDNA_ID_2214567; Annot_ID_134978
tcaatgaaatataaatgttctacgtcatcattaaaaaactatgatactaatctcgtttcctattgatattaatatttcaatatataagaacaataactctaacaagaataatgactgaatcttagtatgaaaataactttactcggtatcaaacgacgtaaagaaagggaaaaaaaagcatgaaaaagatgaaacctgtcatttacaacttctattttatgtctacttttatttttattttcaaaagaagaacaaagaagagatctttcaaattgtctctacattttatcttctcttttacttttccctaacgattttgttgtatgtagtatatatctttaataatcagtcgtttcgtatataaatgcgaacatctttttcagaaagagattgcctaaaatggcgtatatgttgtattattaccctaaaaacaaataatctttaacgttagttgatcatgcatgaaatcatcagcaaaccttttcataatcccactcatctcttttgtgctcttgtccttctccattttgttgttatcttctctctttttttcttcattttgaccatatatcatttctcaataatttttcgaatttatcatgaaaaacgtagaacttctacatgtcaaaagcttagatacactgaaaccatgtattttagtggtttatgctacaatcgtgtctatgtgttactattattaataaaatttatataatgcatattgttaaacaaaaagttgacgaaattatgacagaaaaaaatgacgaaacaatttcttttaactctttatccacaaatatctgattttttttttttttttttttttttttttttttttttttactagggaagcaatgaattgctctttttttctctcctggtgtcaatgcttcaattatgaacgttaactaatttattgctttatgagcttctttctcgtccaaacattcttaaaaacaatagtgaaagtctcgattacgaattcaatatgactacgttcaatttcatatatcgctttccattctaattttttaagatttggcataggtgtactaatcatttgcttcatctgccgaacaaattttcataattacttttttaaagaacgcatatgcggttataatttgtaccactcttaactttgcatatgaatttacttaattacttatgcacccattaatcaatggaagcccgaggtaatatgcaacctgattaaaaaatattacgttattattctgatggtccgtacatacaaatattactttttataattttcctatgtatcctttgtatatgaattgaaaagcattttagagaaataatttctatttagtaacaaattaatgagttattacccataaattattcttacgtctccatcaaaaagtgagtttagccttgaaagttctgtgtcgacgtcgttatgttataaaacaataaatacgaactcttaatcgttcgttgtcatataaaattaagaaaaaaatacaacatcatcattttttttattttttttgtcaaacttacaacatcatcatttctatcaaaaatttatgttaaaaaacaaattatgaaataaataattatttcacaacgaaaaataataataacaaatataattattttcaaaacaactttaaatttaatttctatatatagtatttggtataggtctatatatgatcgtgacgtgtgaaatataattgaggaacggtggatgattcttgaaaacaatgtggaagatatttaattcagtatgatgcttaaaaaaactcataacgttagctatgttttgttgaatattacatcacataaacgtatgggtgtgcacttagagcgagccggtgattataggtttgttttttttggtaaaaaattattgagagattattgattataggttttgaagctatcgatctgagctagagattaaggaacgaatccctctatgaacatttaaaccttgttctttttgcttattaactgagagattaggatcctaaaatctatacaacactagagatcattatccaaaagattttacttagtcccatttgcggtcacatttaattccctaaaagcatgaaaattctatcccatttgttttttccactagacttgggactcaaagcgtaatttataactatcttacgttagagagcattatttacgaccattatttaggctgaactcattatagacatcgatcaagctctagtgttaaatacattttctttgtgggattaatctttaaaggccttgtaatcacttactatttcgtaagttatgaagatttgggaaccggattatggctttgggaagttaagtcctatgactcaagcttacctttttagggttgtgtataggttctcgataaatgtttcagattagttcatttgtttttttgtttataaaaactacataatataaaacgtggaaagaaagtgataatgacaagaaataaaagtaagaaaggtggtggtgtgagaatcagattcgatgtcaactaattgaaagagagtacgcagctttttcttcacaattatatatattttgtggaaaagcttaccatacattcacaaagcattcgagatttgatttttatagaaaagtatttacataaagtattttctaaatcggtttctattttgtatgctttcagttttattttgtgttggggaagtgatccatgcattgagcttggagattgatggattggtaattaagcctattaagttaagcaggcctgtttctaaaatgggccctaataagcccaaactacaaaaagcaccgatatatcccacgttagatacatgtccacgtggactcctatgactggatgtaatctccaccacgcgcgatcaccagcttcgtctctcattttcattttccaatttattttcaaaaaaagataaatccagaaaaaaatttacaaaataaaaaaataaaaatctctatcttcttcttcgtctcttctcatcctcctctcaagctccaatg

SEQ ID NO: 25972 - DNA, 3003 bp, Unknown
  misc_feature (1)..( 3003): 2750-1469P.txt file - cDNA_ID_2709490; gDNA_ID_2214567; Annot_ID_134979
attttatatgacaacgaacgattaagagttcgtatttattgttttataacataacgacgtcgacacagaactttcaaggctaaactcactttttgatggagacgtaagaataatttatgggtaataactcattaatttgttactaaatagaaattatttctctaaaatgcttttcaattcatatacaaaggatacataggaaaattataaaaagtaatatttgtatgtacggaccatcagaataataacgtaatattttttaatcaggttgcatattacctcgggcttccattgattaatgggtgcataagtaattaagtaaattcatatgcaaagttaagagtggtacaaattataaccgcatatgcgttctttaaaaaagtaattatgaaaatttgttcggcagatgaagcaaatgattagtacacctatgccaaatcttaaaaaattagaatggaaagcgatatatgaaattgaacgtagtcatattgaattcgtaatcgagactttcactattgtttttaagaatgtttggacgagaaagaagctcataaagcaataaattagttaacgttcataattgaagcattgacaccaggagagaaaaaaagagcaattcattgcttccctagtaaaaaaaaaaaaaaaaaaaaaaaaaaaaaaaaaaaaaatcagatatttgtggataaagagttaaaagaaattgtttcgtcatttttttctgtcataatttcgtcaactttttgtttaacaatatgcattatataaattttattaataatagtaacacatagacacgattgtagcataaaccactaaaatacatggtttcagtgtatctaagcttttgacatgtagaagttctacgtttttcatgataaattcgaaaaattattgagaaatgatatatggtcaaaatgaagaaaaaaagagagaagataacaacaaaatggagaaggacaagagcacaaaagagatgagtgggattatgaaaaggtttgctgatgatttcatgcatgatcaactaacgttaaagattatttgtttttagggtaataatacaacatatacgccattttaggcaatctctttctgaaaaagatgttcgcatttatatacgaaacgactgattattaaagatatatactacatacaacaaaatcgttagggaaaagtaaaagagaagataaaatgtagagacaatttgaaagatctcttctttgttcttcttttgaaaataaaaataaaagtagacataaaatagaagttgtaaatgacaggtttcatctttttcatgcttttttttccctttctttacgtcgtttgataccgagtaaagttattttcatactaagattcagtcattattcttgttagagttattgttcttatatattgaaatattaatatcaataggaaacgagattagtatcatagttttttaatgatgacgtagaacatttatatttcattgaatagttaatagtagacaatcaatggttgttttattgtgaatttggttcacccctttcatttgttttattgcaagattacaagcttatatatgtttgcaatcaacaagataattaatatattcaaaaaagattcatataagagataaaaccatcgccatgaagatatctaatgaacgaagacgaaaacgacagatcagggacaagcctactcttgagtcttgacccacaaagataccctaattaagctttcatgattacggatctatatgataatgaaccctattaagcaaagttaatttatacttagccatcaacgtacatatatatttccaataataaatgcaaataaaaatgataattatgacaaattaaccaaaagttaagttagcaatggaccttggcgttttaaatattggcatggttagcaaatagcatacaaatatatgaaatgatagcctgaaaatctagtaatattatttttattttagtttataaggctcatccattactttttataaaaatgcctttattctgtttactgaaaaaaaaatcttttaacatagttttgtcaatttaaaattctgactgacacaaaaatgtaagtgtaaccaaaacagaaaagtgcgatataatattaaaaatatatagttactgataaaaagtcatactatttagttcagcattttacaatttcaaaataacaagattcccaacataaaaattgctgaaccagaaagcacgactatagctagatctaatgactagaatgaccaaagatatgattttcatttgtgagaaaaaaagaaagaaagaaagagttaaatttgtttgattgcacaactttttcgaaagtccctcttatcactaaaccaattctgaaatgttcacaaacttgttttacttaatggtaaagataaagctaaaatagtattttattaataaacacattgcttaaagcaaatcaaggtctttgactcttttggttgtcacttagaattaatgtcttcaattatctattcatctaggtccctcttatttcttcatacttagaccttgtaaatcatatgtatacatatgtggtattttctaacaaaaatcatatattatagatattattcgacagagggaaccttataggcgaagaaacgtccctccactcaaaccctaaaaagagaatcacaaaaataataatattaatacataagcatatacaaataatgcatgagagtggaaaatatatataagaaaagaaataaagcataagaacatgacccatgtttagaaaagcattatgttctcactttatctttgtgctccttcactatcatcatcttctctctaaacctctatcttctctctttctcttttggttctgtgctcgatctcctcacatctctctttaacctttggttcccttctttcgtttttatatgattctcccaccatttttgttcttttgagttttaaagatccatcaaactttattaaagaaagaagaacaaagagataaaagggaagaagaacaatg

SEQ ID NO: 25973 - DNA, 3000 bp, Unknown; identical to SEQ ID NO: 12705
  misc_feature (1)..( 3000): 2750-1469P.txt file - cDNA_ID_2709492; gDNA_ID_2214567; Annot_ID_134976

SEQ ID NO: 25974 - DNA, 3000 bp, Unknown; identical to SEQ ID NO: 12705
  misc_feature (1)..( 3000): 2750-1469P.txt file - cDNA_ID_2709492; gDNA_ID_2214567; Annot_ID_186048

SEQ ID NO: 25975 - DNA, 3003 bp, Unknown
  misc_feature (1)..( 3003): 2750-1469P.txt file - cDNA_ID_2709504; gDNA_ID_2214568; Annot_ID_135011
atcaacacgtccggtaaacacattccatagcggccgttcaaactataacacatcaaacatagaaactcagggagttagaattgattattggtttcatttgataagaaagacatctaaaactaacatatgcgactagtaaaatactaaatttttgatttctaatcatgaaattttttagacgagtttgttcatatgtattacttcataagagacggcatctcgggcggctaaagtgagaatgtcagcgcaagagacggtgttagggcatcgtttttcgagaatatacttgatctcatcgatgatttcaaacccggaaagcgagagattaggtctcgcttccttctcggacactgcttttccagcaaccgaatctaaaagcagcgatgcgtcgcacccctaaaaatcatccacatcagacttatctttataagaaagatgttcacataaagaaaaaaccctacatgcacatcataccctaacaaagcagtcatggtaatgaaccctcagtaacttgggagccaggctacggtttgcttcgactttcttccacactatctgcctcacgatatcctcggctccagggcagctattgtgatagaagttcatcttcagcttaccttcccatcttccttttcttatcttatggccattattattgaatcctttaccatcaacacaaagtaatttcacaaccaaaaacaaaacaagtggaaataaaaaccgaatctctaaactcttattagccatgtgatcgactttagatttgatattttcttttaagtgtttcttccttttgtatatgaggaatgcacttggcagagttgctttatatagaaactgaggctccatacttcatatatgcccgttgagtttctaatattttttagcaattgaataattattgaaataataatatgtctgggtggccaagcaaagttccctgtatgtgttgtgaaaatgaaggattaattattaagttgcaagtcaacataattatttagaagtatttataattcccgcaaataataatttagcttcattagttgaactataacgtgaacatccattatgcagatatttatagatttcactgctatctccatttattcacgcatttctttttttgttattcttttaaactttcattgtcctaatgaaagtttaaccttctttgtcagtggccggccattatcttaaattcttaatccttccatcttgcaataacttggtgtttttatatatagtatcaaaggagtaaacggattgtaaatttcacaatttgaagcttttacatatcatacatacactcacaaaagaaattcaatatccatggtctatttaacattaattcaacaaaaaaaaaatcatggtccaaatcaaaatctttttccatatgcaatgggaattttgggaaaaaaatcaaaattttgttcacatatagttgaaacgtttgttcaaaattttctgtctcttttaaccttttagttgacgcaatcgtcttttgtctacggctatatttgagacgaaaacgttaagttgaaaagtcaaacgaagtcgtcgcttccaaaggcaccaatcgttttaatctattttctcgggctcatatggcctaagtccacaaggtaaaggcccacttattattttaaaggcccaactcccaactctagtatgcgttgatttagcatataatttttttttctccaaagaagcaaagacacagaaattcacaagttattaatgaatttatactatttacattataacctctataaattaatactcgataaattaataacttttataaattaataaaaatttttggtcatgagttgggaccagtgtaaaaaattacacaaatcgataaattaataagataaataattattttaaaatccctatgtaaatatatggtcttattaataacataaattaatagttgtaaaaaattcttaaaatatatatatatatatatatatatatataagttatactcactctattcctttttgttgtatatatatatatatatatatatatatatatatatataagttatactcactctattcctttttgttgtatatatatatatatatatatatataagttatattcactctattcctttttgtttgattgtttagaaaaaaaaattgtttctaaaagattgattttttaagttttccatgtaatatttattggttagtattgacgaattgtaattttcaagaaaaatagttaattattattggtttaaagttataaaaaactgtaaaaaactaaaaataatacatttataatcaacatttaatatgttttcttaatatgtgtgttttttctaaacaatcaaacaaaaaagaacagagggagtatgttagaaatattagtaaaatatgaatctgctattatttttatttttattatactaattcttagtaatgttcaattttaataattttactacatcgaaaacacttttttgttattttatagacacaataatttagtcttatttgcaattatttctagaaaaataatgattataaataaaacaaaattaatttaaacataatatttttttaaaattacaaaattagtctaaactctctataaattaataattattaatttattgataaattaatacctctataaattaatagaaatttatggtcccaacatcattaatttatagagattttactatggaataagaagcaaatctaaaaaatttataaattaatatcaatatttatgctattacttcttcattttttaaagtcttgktatttacttaagtaagcctaaatttttaataatgatcttatcttatgtaattgattaaaaaatcgtatagtagactattcaacaaaacgtgaatcatagtgttgttaccaaaacccattagtgtagcgacaactgtcctttcacatccttatacaaattctcttccctccggtcatctcggaaacttgtatcatcgacaaaacataaatactaatg

SEQ ID NO: 25976 - DNA, 3003 bp, Unknown; identical to SEQ ID NO: 25975
  misc_feature (1)..( 3003): 2750-1469P.txt file - cDNA_ID_2709504; gDNA_ID_2214568; Annot_ID_186093

SEQ ID NO: 25977 - DNA, 3003 bp, Unknown
  misc_feature (1)..( 3003): 2750-1469P.txt file - cDNA_ID_2709513; gDNA_ID_2214568; Annot_ID_135007
aaaaaaatgcttcgtatttgaactttacgaagactactgttatcagtttattgtaagtttacttatctatgttttgtatttggattttcataaacacaccaatgtgacgtagaaatctgatttgcatgatttgtatttggatttaatccgctaatttttttagctatttaactattttcatcataaattacaatttattttcttataaatttccttaaaatcagtacttattccaccatattatgcaattttcttataaatttaaatttacatgtagaaaataaaacaaataagctaagcgcgtttatattttttttacgaattcaaaacatccaaattcaaaaacgaatataactttttccctttagtcgacactaaactcatcacaaatttgaaatagtaggagaccatccttaaatcccaaacaaaaatactttatattgatgtcgcttgaattgtcaaaacttccatctaaataatgagaaagaaacaaactacaggaaagaaatttcagtgaaaagttgacgtggacaagttagatttcgaagttctgatctaatccaatgatatttggtgagccacaaaaccattatccaaaaagacaatgtacattccgacccaaccacaagctcatcacgatccacaaatgtcgccacgtctctcgccgacatcatagaagtgtactaaccgtgtggtgtccagatgccatgtctcctgcttagaagtttccgcgacagaagattcacttcttcatctttttaaaaaaaaatgcagaatcattttcgatatcttacatgggtcactttttaatagttattgttctgttactttttttttccttacattaattaatactttatcgaatgtttgtttaagccgttttgggtaagctatttgttatgaacaataaagttgtcggaacaaagaatggagaaccttaaatgaagcctttgtatttcacgcaattgttttttacttttaagcagccctataccaattttttcacgtgttttaaacattcttgtttatagtaacaatttgagtctttttgcttcttcttttttaattacagcacgtattagcagcaaaatgatattattgacttatagtcatgtgactcatgtaaaaaataaaaattcaaaacaagaagatgttataaaaatatggatgaagatgaattgtatacatagaattaatattacaatgaatccgaatgtgtttagataagttgtaaattacaaaattgcgtagaaaaaaaaaaaatgttttgctatcagtatatccgtaatactttttatgaacggtcccatctctaggaaaaatgagtaatataattcatgaagcaattcattttcattttatttacagaaaaaaataatggtcgtcgctcgattattaagtgggacatttgtttttttttttggtattattaagtgatgcatcatctgttgtagtcttgtagaactctataatccgccaaatgcttcgcttcaaatatattcttgtatttatcttggtgtccaatcctactctgccatggacgggcctagctacgtaaattagatgggtctaccacggacaccacgtggacaagatttaatgttcatggttcatggaggtcgatcgtcttcccaaaaaaacagtcatttgatcctgtgttaataaaagtggatgatattcatgttaatatttattaaattatatggtttctcattctccattcttcatatcgtaattcttgctccacatatgaaacatttcaaatgttgggaataaaaggtttttttcagaaaatataataatcgtggtaaattcaatcccatcgcaagctctcctattggggttgggaaaatctttgaaaattttctttcaggctgtgtttagttccatggccaccttaatgaccagtatctttaaatacggcaagagttttaaatttgaaaagaaaaacaaaaacgtaaaatttcaagtattagacaacgtacattcttaaataggtgattgttgactccttgattaggagagctttcagatacattcgccccatttcactgtcatgtcatttgtatatactgttgctcgtcaaataatctgattctttgtttcaatttgtaatagcatttaaattacttttatttttctgcgttaaacttttcgactaaaggtcggtccaatttgcattttaaattactcttatattttctgcgttaaatgtatgagcgacgactctttcattttaagtagtctttttcattactttgcaacatctatcagtgtctgttattttgcattttttttggtcttttaagaactgaaatctaagaatctacgctaattacatgaatacaaccattctatcatttttctgtaattatggtgatatgaggaaaaaaataaataatggttgacagttatactaaacctaaacatattcgggtattaaagttacttggttagaaagaaaaattaaaaacccaaaatttatattttaaaatttctctttaaaggtttagctccggctatgaggatattgcgcacaacacaaagcctcgtatcaagtagtctacatgaaatgtttgcccattgtaattttgtaaactagcttgtttgttcgtgggtaaaataacttaataggaaaataccagcaaaaaaaggcgagaggaattagtgatttttccccccaacaaaattgttgcaaaataaccaaatcaaaatcaattgaaagcatattctttagacatcaatagagtcttcatagactaatcacaatcataaacacctgtagtgttcccttattttacgaactttttaataaataaaaaagaagaagataaattaattaacctcattgcaaaagaggaaaaacctaaagccacagctttccataaatagacccactcaccatctctgcacatcacccacatcttctaacagtctctcactttctctcttctctctctctctttcttttttgagtccgtgaaggctaagtctgaaagaatg

SEQ ID NO: 25978 - DNA, 3003 bp, Unknown
  misc_feature (1)..( 3003): 2750-1469P.txt file - cDNA_ID_2709531; gDNA_ID_2214568; Annot_ID_134997
gttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaatttgtacagtacctttgttttgggtatagacaattacattttaagtcagttgatctgtatcaaatactacacttacaaaatcacaaagtaaaggcagcaattaattttgctttgaattgaaaagctttgagagagtaatcaaatgcttaaatcacgaaaacttacaaatttcaaaattttgtctctccataaattctcttaataaaggctgttgtttttccaatttgaaaattctatttttcaaaatcaagaacaggctatggaatttcaagaagctggttcatcatcaagtagaatcatcttcctctgtttcctctcctatctaaaatctctttagtcttcagaaactgattatactttgtgcagcagcaagagtaaagattgactttgtgcagccgatggcacacaaagagagcaaatggaaccatcgcaaaagcttggcctgggacactgctttttccaccaaccctggtttcttcctatttcctatagattggttttgtgtagaaacaaaatgttaaattatatgattccaatgattttaccactttggtttgtaggagtgttagatcctgaagaattgtttgggagcttaaagattgacgagaatgagattgaagttgaagtaaatcataatcacacacttccttcgaaaaccgatgctcgtccaagttttgcttgggacaatgctttttttaccgatccaggtctcatctttttacttcaaagttctttaccctacttgattagtcaattatttcacactattccactattcctctcatatataacaatcaaaccttataatttagctttgactctgtatattcaaggctgacattgtctatatttatgctaaggtgttcttgatgctgaggagttgtgtcttgtgaacaatggtttcaccagtaacacgcagcttcgtaagtctgctgatacgacgacaactcaaggaagcagattttctgtggccagcattgagtttgatctgttccacgacctgagagcctctttacgtaattcaccgaatgtgaagcagacagtaactcaagagacccatcgtaagttaccagatggtataaaggtaaacggaaaacctcagaaactgtttcaatcatttgctttcatctaaattttacttattaattggttttgtttgtcaagaggactaaaggatacaaacagaaagttcaacctttgagtctcattcctcaaccaaaagtgtcttcttcttcttcttcttctttttctttatcatccatctccaaatctttgactcctagtcaagctatacgcgagaagaaatgtgttgcaagtgaactcggtgaggacatgattgatgatacatcttattctttcttcaaaacgagaagaaaatcaaaacatctttaaaagttgcacatctttgttttattttgaagagaggaataaggaaaaacacaagaatcatggttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcatgttgagttggataagtcaactgtcttcttttcttttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgttttacaccatgcacgtgttatctaacaaagaaaatatggtacacctaatggctaatgcaaaggacaacacaatgaaactaacttgactctgtgttatacaaacccatagacatctgcatacatcctagtatttgtataaattggactcaaattcctgaggacaatcatagcaaacaatcacatcatcgcaatatacataaacaaaagaggaagaaaaatggcaaccgagtggtgtagttatattggttcgtctttcatcctcaatttctacttttcattctttgatattggtaccgccctttatcgattttctttaatcttttctcttctcgctcacgtcaaatcgtttactattatttaattctcatgtgtcagtttcacatagcacattcttgaggaaattaattataatttggagcatgcattgtttatcgattgacacagatttatgtttcatctattgtttgaataacaatggattacacaacaaatccccaatatatgatatttggagagccatatagtattagtagggatatatagtttgattccataataaccgttggacctactgttttaccaaatg

SEQ ID NO: 25979 - DNA, 3003 bp, Unknown
  misc_feature (1)..( 3003): 2750-1469P.txt file - cDNA_ID_2709537; gDNA_ID_2214568; Annot_ID_134995
aagcctggactatggagaacttgagctacatgaatctcatgtttgtggagtcaggattctagagcatattggctacaaggagcatgtatgcataagctaagcttgggcctcgataaacctagactatgcatgggacccttgggttgtggaaagcttggatttaggagagcttctgggatgtgtatgtgtagaaaaatccatgtgtattttgtagaaaaatccatgtgtattttgtagaaaaattcatgtgtatgatgatcacactagtcactaacacgtgtaatagacctctacaagatgatcacactagtcactaaacggtctattagcttaaaatactcttgtaaaattttgttaatcatatgactttttctaaaatttgtatatatcataagtgctttaatttatttattttggcagcaaaacaggcctgctttaatttattaatttgtacttcacttattattttatttatttgaaatggtccattatccattatttgctaatttttggttttcctgattcttgcttggaagagcttcaaggcggaggactaggtcggggtgctccttctcccctcaaccatttgttgtctacacgttgccacttgccacacgtgtttttctcttagaaatcgttatcacaatctgttcttttgaactttaaatcaaaaaatttggctgacaaaaaaaaattgaaacattacaaattgaaatataggatactattttcattcataactttaggcatcagtaacacagaaattatgaaggcaaacgattattattttacatgattgattactaaccaaccacgactcgtctatagctttttcattatgaatatagaaattatacaagtctagccggatttgggggttttgacgacgatacggtttccatcaacaaaaactctgacccggtcgcacctgaagtctgcggtcaccggactcccatccaaaatcacggcagcattgacggtggggttctctctctctatcaccacggccgcatagtcaccatttgttcccgtaagctccggccacgagttcttccctgcgatcacgttacgttagatcggtcaatcatttacgtttgggattttggagatcaagaagctcatatttgagtaaatgaaaacaaaagaactagaaacatcaccatggattgaccatatgtaacataattaaccttctaacagactttagaaaatgtaatcatatatgttatagctattgaattacaattttaaatgccttgaatccatatctaattgaacattagctaactatttacaaacatataaaactttaattatgaactatacaatacaaatacaaaaacttactaggacattcggtcgacatttttcttcactcttgtatatatttatgtagtcttctgatgtatttgtatgctcacctttagagatttgagtcccatttatagaatcggatacgtacgttacgtcttggtgtcggtgtcgtcggtgaggttgcagattcaaaagtcaaactttgacgaaaccagcttttaatagccccttcgttgacattattaatttgtttggtaaaagctttgacacttctgattttgttttataaagctttgaaatgtacatatttatatcacgatgttcaaaccttatcgagaacaagataaggtttctaaggctaagataatgtcgaaatttgaaaaacaaacgaaggtgaaaaatatttctagcgtcgactgaattctgtttgcatgcaaaaaaacgcttctgccaaatttggcacttagccgacaaaaatgaccaaactgtccttcataaaattcatgtataaaaatactataatcaattgttgtcacacacacaaacaacgataatgtcaattatgttgaattgttgacgtacataaaatttgacaaacaacatcacaacttagtcatatagttttttttttgttcccgtttgataatcttgtcatatagttaatattcaatttgatatgtatatacagtttaaaacacgtatatacagttcaacttagtcatagtttttcttttggtctgtttaagattggtaaaagcacgtatccggaataaagatttaggtattaattggtaacaactctatatgcgggtttcgaacaaaattacaaaatcacatattatatgagaccaagtcaccatcacacttaaatatttgtggttgagaattaattagtgtttagttttgtgtatgtttcacactgcccaatgttacaaacttgtgtgtgtcaagaagacgaggccgcctgaaaacaaaacatgtaagcccattgaaacagacaccaaaagacatatggtctataagcctctccttgtgctggagctggacacaaattctttaagaccgaggttttcaaacgtaggcccaaataaatagaaccaaatccagttagaagcccaataaaatgttaattacttatctttgtattttaatttttgttctttaaagtttaggattttttacataagtaaaagaatttgttctttaggcactttgaatccacattgtcgttggtattgttattagagtatcttaattttctatgatttatttacgtagataattcattgaaaaattaaatgaatttatgtttaaattctcatctaattattatacaatagattgaaaaagtcacccttagtcaaattgttcatatagttttcttaaattgtctaattaattaccaaattaatccttgtctgaaaacttttacaaaagctaatacagaacaaatacaaaaaaacgtgtaatcatatcatataaacaccagtcgcagcgtttcgtagaaaaattcgatttctctaaagccctaaaactaaaacgactatccccaattccaagttctagggtttccatcttccccaatctgtacgccattttcgatttccttttttgttgtttactttagcttcatcgaccatgtttaggtttcaaattgagtgtttgttctgtttctgtagagtataaatg

SEQ ID NO: 25980 - DNA, 3000 bp, Unknown; identical to SEQ ID NO: 12730
  misc_feature (1)..( 3000): 2750-1469P.txt file - cDNA_ID_2709542; gDNA_ID_2214568; Annot_ID_135005

SEQ ID NO: 25981 - DNA, 3003 bp, Unknown
  misc_feature (1)..( 3003): 2750-1469P.txt file - cDNA_ID_2709550; gDNA_ID_2214569; Annot_ID_135028
ttaaatgtgacaattaacaggtaacaacacgctggaaaaccagcagagatattaaatccggttaaggcttaatatttactgcttacatttccagtgacaatatagagaatctaacattaaattatatgaacatgagattaataaactcactatagtaaaataagcaggagacatcacgtgaagcgtcggattgtttgtcataatgtcttcatcgtacggcaacgcgatgaattgaaacagaagacatcacgtgaaccagtgctacatggttaactcaatcattaacggcgtatattttcttgtattgattcttctccggatcgttaactatgctcccgatttaacaccgtcagttcagtatttatacggcgcaataaattacgataatgtagcctcttgagagaatgttttgcgggttggactttggagaagaaaacaatcatataacctatctatataaaatcgagtagaacgagaaataaaattattgtaaagcgagagtgcattaggattatgtggtctaattatgaaagaaaaaagattatgccaataatgatgatatcgaataaacaccagcacgatggttttctaataatccacaactaaacaaacgtaaggcctttatttatctatttttatgttaatcttgaactatcgaagcacgacttgagctatctatgagttattacaaaaatatgatgtcgtcagtttgtcaccgagggcttattaattagataaattacaaaccaatttttgtccttcatataatttcatttaacggatcatgaaaattaagaatcaatacgatacaaaatgcataattgtgtatttgacgtgataaaagaacaacgaaccaatgcacatgtaaccatgtgataacgtatcccccgaaaacaaaaaaaaatagccaagacactacagcgaagtcgtcttttgtgatgtcgattctatatcgtcgcccccacttacaacgacgtcgtataggtttaatcatcaatcatggtttcatttataaacaatccaacaaaaaaaactttgtatacgttctaattgataaaacaaaattaaaaaagagagggatggatcctaacactgagttacagagacattagagacaaatttgcttgtgacttaactaggtcaatataaaacaaaatcaaagaaagttccaaaaaacgacactgactcgtatgtcccccattcttacttgtcacccatctaatctaaccatctcctaggcagcttcacgagccgtagtctaatctaaaatcttatcattagacatttctatatatattttaatttctttacctttttacaccactgtagaaaaccacgaattttactccataagttgatatcattttcatttacgtctccgtcactctttctccctatccactaaacacagatcccaaaaaagaaataaacgagtaaaaaatgtaaagaaacgtccctttgtttctacgcgattttctgtaaattttccttcgttttctcgcagtttctttctcaccaaacaaacccttatatcactctatctctttctttctctcacattcaaagcttcttcttcttaactctacccctaacgtcctctcatcttctctggcagaacagaaaacgatgactaacttctcccgatccaaatccaccggaactatcgggttcccggagtttaaacccactcgacccggtccagacaaatacgagaacatccacaacgatgacgacgagtacgaagaaggacatagcactacgagtacagactactacgacgcttcaacgccgttgagctcacacgcgtcaagatccgggaacgggtccggctcgggtcagttaacggtcgtagaccttcttgcggcggttctgaggaagtcgttggtgatgtcgtgtgcgatggagagaggggaagatgacgtggtggcgtctatggatataggttggccgacggaggttaagcacgtgagtcacgtgacttttgatcggttcaatggttttcttggtcttccttctgagctcgaaccggaggttcctcctcgagctcctagcgccaggtccgttattaattaattattatcccaaagatgagtaatattccaaacaaaaaatgaatttaatattttattccatatatattgaaaaaagattatgatatgaggaattaaataaatattttcctagctggaaatctgtatatggcatgttactgtgttgggtagaatcattaagatggttgttgtttggatttaaatgcatgattacgacactcgtttcttcacaaaagaagattctctttttgtttttttttctctcttcaaagattttcaatggtatgtaaagtcaataaccatttattcaaacaatgaaactatttagacataaatttggtctttaatcaactcatgaagtagtggttgaatgacacatcctggaattggggattagtgtttaagctttcacaacataatgatattatttttgggctttccctagagattggtttgtatgatgatacatggagctctaataagtttggtttgtatagaagatacaaacttttgggtcctatggagatatactaacagaaacacgattacacaacaaatttctcataaaaaaaaaagtaaacaatttgtaaaatcgaatttttcccctaatatgtacggctaaaagaatggaaatcatgaatttttcaaaaagatataattggtcttcttgaattgtgaaacttatggctttccgtacgtagatggatttgtgaagtaaaagagtgactgattatttttgatgatacttgtgagtttcactaagttggtgactttgtatatgatataatgattggttctttctaacgattgagcttatatgttttctctagatttatttctataagagtaaaatataggtttttatatgatctaacatattggtttttctatgagtaaagatttcttattttaattcagtgtaagtgtatttggagtatcggcgaagtcaatg

SEQ ID NO: 25982 - DNA, 11 bp, Unknown
  misc_feature (1)..( 11): 2750-1469P.txt file - cDNA_ID_2709550; gDNA_ID_1564439; Annot_ID_149458
tcggtctaatg

SEQ ID NO: 25983 - DNA, 3003 bp, Unknown
  misc_feature (1)..( 3003): 2750-1469P.txt file - cDNA_ID_2709559; gDNA_ID_2214570; Annot_ID_135036
tacctcacccagccaaccaaaattaccaaaagcctacacttatcaagttatctaaaatgctaagcaaacccctaagtaccaaatatgcttcgtttttttgtaactgtaatattttcttaaggcttgtgggagattgtgggtaatgactgtcccactttgaagaaagaatggatgtggaagtagactacaggacacttacagtctccagctatatgaaaaagcatggcgaatctttctgttctgcttctgaaggtgatagtgcagactgatccttgtcttgcggcttaaaatatcaaactcagcctgctcccatgtatactgccaaatgaatatggacaatcgttagtacggttatctctagtaagttcgatatttatggctctgacacccttttttaccgaatgaagtacaagaatgaactattaccgtgaaattagggaatttccgttgaagcttcaactgtccctcagcagaagcacctccatataaatccatcacgaagataccacctttcttagacaaagcgtcacgtgcattcttgaagtaagaaaccaactccgagcgtttgtggagacaacaacaactaaaattaaaagcacacacaatatccctctttggcaacgaatcaggtccatctttctctaaagattcgacaacactcggatcagccaaatcttcattatcatcaccatcatccaagctgatattttgtatcagctcatgggatttagatttcacttgcttagcctcaagaggagttaaaacattcccatggaaaagcgacattcttgaatacacgtcagaaccaagtttactaatgttgttatccatacaccattctaacgcctcaagatcaaaatcaagccctatagcagtccgtctagtgtcagtcttcagccactccgcactattccaacaatcaatgtaaaaacttattcaagcaagaaaaccaaaagctacattattttgtaccatttagtgaaacacacaacaaccttaaaagagcagtgccgcagaaatcttcttggaaatggaaaggttgtcttccaccaacatacattaaaaagaacttctgcaagtaacttatgtctccttttggtgactgcaacaaacaaaaagcaatgaaaagacaagaacaacaaatgttaaagcttagtgcttgatgatagaacaagaacagtgaaacacaaacaatacaatttgttaaatcttagtgcttctttatacaagagatacagagaactctctccctaagaaaatttaagtacttttaactgatttcataaaaccagtaagaaccactcaatgaaacttagaaggccaagcacagaattgcagttacctgaacggattgttggtaaaggagaaactttgaaggcaaatccgatgattcgtttccatcattttcttcttcttcttcgtcagagttttcttcatcttcttcgtcgacggaggcaacagccggcgggtgttgatcgtagaaatcttcagcatcattcgaatattcacctttgtggcgacgtcgattaggttttttctctcgtttccccatttgtcgtcgttctcagtccaaattctcaatccagagaatagagcagagcagagcagtcgaggaagaagagaaaagcgttgactttgtgtttagtgtgtctttagactgaagagtgccctaaactatgccacgtaggccctattgctctcggtttagtgttttttttgggtcaaataccggtttttagtggttcggatggtatttatcatgtggggttttttttttttttttttttactatggtttagaaaaacttggttaattatcacctaaaatagtgttttggtgtttcgttggagatgactagacgcataggtaacaaatagtactttgaaaatctcaatagatcttgcaatgatctcctcttattataagtttatgatggataatgtatttcttacttgaagatatgtgtttcttgccaataactattgattatcttgtgtttaagacaataatatattaccatttttgtattgcctaatcgcttccacactaatgaacatattctttgaacttgaaaatttccttttttctttaatgcattgtcaactagtgaaaaattcattcgttcgttttatcattgagacataatcaataatcttgctagttgggtatcaatagaacctgttcgctttggttgacaattacgattcgctgctgaaactccggtctttgcgtttgcaatgtgcacaagtgactccaaatgttttgaatgaataaaaggaatgtcctttctgcaacttaaatgttctttgttgcaagtttaattttggtcactattttttgctacaattgcattcaaagtagatttactaatttgtgttgatgttaaggtttgtttttgaaataatatttctagtttgttttcttaaggttgataacaagaaaacttatcatggtcatgctttatattgtcactatttgaattttttttcaaatttgcctcctattagaaggaccttgtacttaatatatttgaatggtgggattttgatgtatctctctacgtggatttttttgtttttcttctgctttttaatacaatttgttttctttttcaaaccatttaatacaaaattattggaaaaaataagcatatattaaaaaacggcaagcgttttcgttatcattcatcaaaacattgagccaattcttcacaacttccaaaaacgcctcaccgtttcattcttctaccaacctacgctccgctgttttcaagaccttttcgtcttcgtcgtcaaatctagcttttttcttcatcgctttgcataatccattccttcttctctcttctccatctccttcctccgatcttcgtctccaattcggaatcttcctatcacaatttcaaggctcctttaacccttgatcatcaccgattcaatcaattcggaatcacaatttcaaatcgagagaatttcaatttctcttgtaaaaccctaaattatg

SEQ ID NO: 25984 - DNA, 3000 bp, Unknown; identical to SEQ ID NO: 12757
  misc_feature (1)..( 3000): 2750-1469P.txt file - cDNA_ID_2709566; gDNA_ID_2214570; Annot_ID_135035

SEQ ID NO: 25985 - DNA, 3003 bp, Unknown
  misc_feature (1)..( 3003): 2750-1469P.txt file - cDNA_ID_2709603; gDNA_ID_2214571; Annot_ID_135077
taaaatatttagataaaatgaaaaagtgtacattgctattagaattcaattattatttgaaaaattatatatgttttttatattcgcctatttaaacggggtttatctaatatatatatatatatatatatatatatatatatatatatatatatatatgatcttataaagaaataattaaaagatagagaggaatggacgagaaagcaacatgacagttctctcttattaactttcactcctcttcttcttattaatactgagatccaccagaaaagggttattgctattgattgatgaagatgatccattgctttacgagtacgattataacttctaagcttttttatatggtttcccatagatattcttagctttaactgaccaaggtagttatatgttgtagtcggaatagccattaatatctcaggtgcatcgcagcactgtaaacgccttgcaagcctggacaggtggacagtcatggtctagaagaagatcatgttcatagcttttttggagactttggcttttatagaaatcaaggaataagaaagtattttaaagtatagaggctttaggtattttaagtcatgctagaagtgaacaattggcatgggaggctgctcaattgaatcttgtaggagagataaaggaaagagaagtacttccaatgttttctccaataattttgtgccagacgagttgtttttaggaagatgcaaaagtagtacttttaaggcaaaatgtcacaggaggaggagtctctcaccgattcacttggaaatggaagccttattatatgagccatgaataataatatcctatcaagacggataaattatcagctttttgaaatacattgtgtagaacttgtcttaatagtggaattccttgagaattaaaccattttctctaatcttttcgatgaatttgcttcgagttaagttttttatttattttcaaagctaattatttctcgttcttgtaacttcaagttgattgtttagccaagacctcataaacctttactttcagaagtttcttatgtacacactctttctcctaattggattaccaatcaaaaagtgaatttttaactagtacaagattgaaaaaagaaacatttatataatatccgtttagattgaaagaatttttcttttgttaatctttatctcttttttatatttcgatataagccgtttctcggaaaattaaaaattctaagccgtttatatggccataagtaatgaggcagctctaagcccgaaatagccggtggccacacatattcacttgggacttggcccttttaaaacacctaatttcatgccttttcccgctaaacttgccactttctcctaaccaactcatttcttcatataaaaccaacaacatcacacaaaaagagccctcatttattcacctttcttttcccttaaatataatctttataaaaaaaattaaaaattaaaaaaaggaagtaaattgaaaaaacaaaattggtcccctgtcttcttttgttcactggacccttttcttggcttcgctaaatcatactatctctatcttctcaccgacactttcttcttctttgatcatatcatatttatcttcactacaaaaaaaacaagtaaaataaagccaatcttcttaaatatctccagaagatctatcagcatttacgtattcaggtcctccaatgtaagtttcttttttactttcttattctatttgtgtcaatctggtttcattagtcgtggcagctgggcaggtacaaatgctgatggcacatggcatcaaaactatcaatttatttatgtcctaaagacaaaatttaatgataaaatacaaaggatttaggtgatactatgttgtctcttaatgctcatcgtgtatctcttaaaaatccaaaatcttcttattttccttatatttaattaaatgtgtcttgaattttcaagtgtgtctctctctcaatactctggagtttttgtttgtttgtatctgatagttgttacaacatcaattttctgattattctatctttcaacttccctataaaataattatttagagaacaacataaagtttgtattttaaaaatatttaatagccattgattacttttgtaattgcgttttctattagttcttctcacaaagaaaaaggaagaaaaaaaagaagttgtgagagcaaaaaaaaaatggcagtggataaagtgattgtgaagcagaggaacattatattggttggaattccaattgatgaaagtggcgtagaggttttaaaatgggcacttgaagaagttgcaaaacatggagattgtgttgttgttgtccatgtttgttttacttattgtaagctcttcttcttctccttcttgttttgttcttttgaagttactaaattttgatttatggatcttatttttgagttatgattgatacagaccgtgccttgaaaagcaagtcatcgctggatcggtacttaaaaccatacattgaattctgctcaacaaagaaggtatctttcgatctttttgccgcgtcgaaagacacacttttttagcaatgtgtaacagagaatatttggtttttgagaacagattgagctcaaaggagaagtgttaaagggaaattcagttctaggggttttagttaaagaagcaaagagatacaacgccatgtcagttgttgttggagttaaacaacaaagtaaattaaggtgagatcacaaaatctttaagcagagacttatataattttcttgataatctcttactgattttagatattttttcattagtctaaaaatagctaaaggctgcgcaaaagagcttccttcaaccaccgatattttggccatccacagagggaatatagtctttagacgttccaaccattaccaactacctcttggttcgttggttctctttacaaccataatctttgaatctatatatataacattcttcaaactcgaacctgttgaccagaaatg

SEQ ID NO: 25986 - DNA, 3000 bp, Unknown
  misc_feature (1)..( 3000): 2750-1469P.txt file - cDNA_ID_2709634; gDNA_ID_2214572; Annot_ID_135091
aatctgatgcatcaaatctgatgcatcaaatctgatgcatctagcaaaatgagagctcaaattgtaagatcagcaaacaaaaatacatcaaatctgatgcatctagcaaaacctttatggtgtttgatcacctcttacgtgcccttatttactttaaactgtataagaaaaagaaaaaacctcgaatgagactatacattacattggttgttgtgtagaacagtcaaatatcaaatttatatcatgcagacaaaaatgtcaaagctataaaatactcctatttttttagccacacagcctaactataaaactcaaattaattccaaggaaaaactagtataggaaatcaaagaaccatgatttaaggtcgatatgaaaaaatatagagatttggtaccttttggtcgtgccctacttctcttcaacaatgacaagagccaataaatatgaaacaatgaaaattatttagcatataaatgggtacttatggccacttggaaaagtatgtcgggaaaacatggagctgaaccggatacatcgtacatacattgatatttgatacataccaaggttatgttcaacttggagagagcggtcaaaagattcgagaaaaaaagaagaagattatattgaagttttaacatctaattgaagcttggaacatgttacatgtgtaaccggaaacatcagtttttggattgtggcttaacttgattgcactagaccggattactttattaaatttgaatatataaacgtaaaataaatttataaatgattataatggttattatgtgtcagattattaaagagatgtgcctccatctcttgctttctctcagtgctacaatcatgtgtgcttcgctctttttttcatagcttcttgttgatattctcaaacttctcttcatacttagaggttttaattcactctttcaatctagttctctttgttttgtgtctttttgataaacaccaaaacaattaagtaacttagagagaataaatttatgaactatacattttgttattggatcaaaggataatttcttacaacatctcacacacatacatatagtggtttctctacttgccatacacttgcatccatacttctactaacctagaccttacttctagacataattatcccatggttcacttacacaagcaacctaacaactacaacaattattatacttattctttagctatgctttagactaacaaaacatcactatttcttctttgggcctaacttaactaatagctcaacgctaaaaatattacaaaacacacaaagcccaactccttcttcttgttgacttttggcctttatttttgtgtcgttggcttctattcaggacatcattttttttttgataaaaggtgaaattttataccatttttgatttgtgacagagattacacggaacactagaaacggaataaagcaacctacaaaacttaaaaacaacatcactgcttccattgcttctcttcacggtatcttcttcttcttcgcttctgcttcttctcttttcttcatctacttcgaaacaacaacaaaaacatgtcgtgcataacaaaatctctgaactaaatatttctacacaaaaaataaatatttttttttgaatttaatgttaaattatattcaaagacaaataaactgtttatacataaaaatgcaaacttttcttaaattgaattaaaagtgtatcctatctatccttgattttgatcttgcattgaagcaaaccacacatggattcctcttgtgtacttctcttcacctctcacccttagcatgcttaatcgattccttatgtttttgtctattagcctgattagcttctccgtcatcgatggagtctctcctttctcctctcatttctttctctccagataaaaaaataaacattctattctctaatatcgtcaaaacttcatacgactatccttaaatcaatactttcgagtttggtttgttaaaaatgatggttttgttaaaaacaacaacaaaaacatgatgtaatattataaatctaaaagatcaataatattactaagatacattttataggctgattaaaacgatgaaaattgacaaattcatgcaaaagtttaaaactttaacatcatataagagaagaacaaaacaaatgatgtttacacttaacatgattttgtgatttttaaatcgacattaacttttttgaaactttgttgtttgttttttaataattaccatgttattttactgtatatgtatatctaaagaaaatctgtaacgcttttaaacaaacaaaaatggagaatatcaattcaatgacatatgtttactttactgtagaggaatctttaaattatagccgaataatttagttaagagatcttttcataaaattaattactagcttgaaggaggtttcataaaattaattacatgaagaaggcgtttaaaataaatatgccaattatattaaaatcccattataaaaaattattattctcatcttttattcctctacatatataaaaaaaataacctttctctttctcattacaattaggagaatataatttgacaaattaaccactttgactaagcaacttcaacactttcgccatcctaatccacatggtcataactcataagtcataaaccttttagtggaactagattttctccatgacatcttactggattagatcaaagatatttttaaggaacaaatcattaatttatattataaatcaaaggagaaaaataaagaataaggaaaatgcatagaaatgccactaaccatccacttctatggctatttccgcgaatcaatgcaaagtcattcatttattcccaacttgccccatatgttttctttttcttaatcacagattcttcttttttatttttaatccatagaacaaaaaaaatataacctttaaattttctctcatttcttcatcttcctctccacaaaacccattttaatg

SEQ ID NO: 25987 - DNA, 3000 bp, Unknown; identical to SEQ ID NO: 25986
  misc_feature (1)..( 3000): 2750-1469P.txt file - cDNA_ID_2709634; gDNA_ID_2214572; Annot_ID_186218

SEQ ID NO: 25988 - DNA, 479 bp, Unknown; identical to SEQ ID NO: 13022
  misc_feature (1)..( 479): 2750-1469P.txt file - cDNA_ID_2709642; gDNA_ID_2214590; Annot_ID_135405

SEQ ID NO: 25989 - DNA, 3000 bp, Unknown; identical to SEQ ID NO: 12823
  misc_feature (1)..( 3000): 2750-1469P.txt file - cDNA_ID_2709644; gDNA_ID_2214573; Annot_ID_135125

SEQ ID NO: 25990 - DNA, 3003 bp, Unknown
  misc_feature (1)..( 3003): 2750-1469P.txt file - cDNA_ID_2709670; gDNA_ID_2214573; Annot_ID_135117
tagatttgactgttactgagcagctagctgtccaaatcgtgccaaagcggcaaactcgtacctatcttattaaaactaacgttacaatattgtcttattttattttattagtgtaaaactgtcgttatctttttttgttgacaaatgaaaacatttcttttcggaggaatgaggatggttgatattttttattgagagataccacaaaataacatgttttggatacttaagtatctagcaagattgtttgaccaaaaaaaaaaaagtatctagcaagatttttacaaaaaaaaagtatatctagcaagagaaaaagtcacattattcggatgtaattcagtacttgtcctccataatcaatcgaacaaaaacaaattgttcagaatcagtcacatacttgaggtggcaaaatatttaattagcaaacgagtaagaagtggcaaagtattataaaaggaaaatatttgaattaagcaacaaaaatacaagttaaattttgattaaaccaaatatatatctctcaagtatattactcactcattactaactgactatatctgaaaagttcataaaattttacgtatgccatttcgatttcgattgaaaacatgagagcacaacttaaattacgagagattatcaagaaataagtaagcttatatgtggaacattatcacataggtatcctgagcaacatgggcatatagtaatctaaatagtaattagaaagtcactggaacataaatgtggacacgacttcaatagtatgagtgggttacacgaaaacccaaaattctcattaacgtgaaaaaataggcatataatacccaaaagaaatgcattatataagactaacgtggagaagtaggcatataaaacgtttggtatggctgttatatctgttttccagaactttatactatacgcttcaatatataagacctagatgattctatttacccattcttacaagagatcacatgatccacataaatctgtatacgtaatactatttgtttgttttatgacgcctgtccctttcaattttgtttaatagttaaaataaatgttgaacaaattcttatatctatataaacaaatgttatcaaagagaaccagttctggcagctaatttggtcgaacatgattgagggcctgttcctgtttgctagaaaatataatataaactttcgaatataactaacgaaaaatatccaagaatatctgtttttcgatgatctcttcattgtcccttattatcgaaattagtcgtagttaatctttgtttgtagtcatcagtgatatagatttgatcaaatcatgatcgttttgaaatcgttagcaatagtgacaagttatagtgataacaatatattgcatcgattgaattatgctatagcaactgcaaaccagttaacaaagtattttgatggtcgttgttgctagcgaccgcaaacaaacaaacaaaaactatcatataattttgcatattaccttttgagcatgcgaatattacctttcaaaatctaaaaacctttatgtattgctagattaggatgtatataagtcaatgcccagaagctgaaatcacaattaccggaaaaagcaaaacatgtagcaaacactttataacttattcacatagagcgcttgcaagagaccattctaagctaagtgtttgtgcttgagtcttagaaaactgaatttcatatcgtcattgtcacgtacaaggaacttacaagctataagcaaacatttttaatttctttctatgttattatatcttcaatcttttaaatgtcttctctcgaaattttagttttcaagtggtacaacaatactctatcatctaactttccagttgctaccagttgacgaactatgaattgagcaaacatatagcaagttaactagcatcagagacgtccaaactatgaattgcttaaggctgctacggctagaattgaccaacactattctatatatatatatatatattttgttgcctccaacatcaatctatgcatacaaaaatatgttctggtaagacttataattgtttgctataattttgaccagactttgtaagtgtgtttattatgattaaagaagacttggtaaaaatataagtctgatatggcttacgtaattgtgctatgatcacgacatacttacttaaaaatctctatgactacgacagactaacatcaaaccatgcatgggagagttataagttataacattgttttactattagttacacaaaaatagtcaaatagcaacatatttttcagcacgggatatgtgactattcgtgaataacatacaaatattggccgcaaactacatctgtgactgtaaccatgacaacaaaaaccggctggtaaatttggcccattcaatcacgaactacaaactcgtggccatggtcactatatcatcaatatgtgaattttgctgcaaaaataattgaattcttttttttctaactaaatgttatttgaggagaaaaaaaagattgatgggctattaattttatctattttcaaaattttattatatgagataacgttttatattgacatcaaattatgtaaggaaattctatcctatcttaaaaagatattactttttgaaagaataaaatctagttttgataagacacaactggcgtaaataaatgcaaaataactaactggattataataatttggtaatccaattattaaacaagtccaaattgcaaaacctaaaaaaacaaaaaaaaaagacacgtaggaaaatgttgaaaagaacacgctgcgtctgacttggtctccaatctctcgcattgttgcactctgtttttgtttggtctctctccatgcgatcttattcttctccaaccagtaatatcgtttgaaacctgaacaagaccctaattttagcctaattcaaaactcaaaatccgatcatcgagagaccttgtgaaattttggagaagaagaaagaatctcggcgatg

SEQ ID NO: 25991 - DNA, 3000 bp, Unknown; identical to SEQ ID NO: 12803
  misc_feature (1)..( 3000): 2750-1469P.txt file - cDNA_ID_2709682; gDNA_ID_2214573; Annot_ID_135104

SEQ ID NO: 25992 - DNA, 3000 bp, Unknown; identical to SEQ ID NO: 12183
  misc_feature (1)..( 3000): 2750-1469P.txt file - cDNA_ID_2709684; gDNA_ID_2214536; Annot_ID_134371

SEQ ID NO: 25993 - DNA, 507 bp, Unknown
  misc_feature (1)..( 507): 2750-1469P.txt file - cDNA_ID_2709688; gDNA_ID_2214573; Annot_ID_135130
tcctctagggtttaaggtttgattttcagacaaaagtataatcaatcattctgtaacttaaggtttgatattcagacaaaagtacaatcaattcggcgattggtctcagaagatgcattcttgttctcatactcacttcgtatctttcaagcttcctcatttcttcgcgcctaaggtctcttctctcattctttatctcttttgtgtgtgctttgtcgccaattaagaagaaaagtttaaaactttggattttcttaacagagttttgtggtgtcttcacggagagaattaagagtgttcgcagtggcaactaccgtcgaggaggcgtccggtaacataccagcggctccgatttctctacctcaagggtcatggaaacaggttttgaattgcatataaaattagaaatcttttcgagaagttgctatcaaagtctgaaaatttgagtgttttgtttagatagctggtggagttacagctgctaaagggtttaaagctgctggtatg

SEQ ID NO: 25994 - DNA, 3000 bp, Unknown; identical to SEQ ID NO: 12824
  misc_feature (1)..( 3000): 2750-1469P.txt file - cDNA_ID_2709695; gDNA_ID_2214573; Annot_ID_135126

SEQ ID NO: 25995 - DNA, 3003 bp, Unknown
  misc_feature (1)..( 3003): 2750-1469P.txt file - cDNA_ID_2709731; gDNA_ID_2214575; Annot_ID_135170
ctttaggtagtcttgaaaacggtagccacttggatacaagagctttggagctggagatattatggcatcaccagccggattgtaaaacgtagcaatcgacagtctacttccatgcttcactgtcattacacggtgaacaacactcttgtacctcccattactcagtatctctagttgatcaccggtattgacaaaaatggtattgttcttggatggcggtataggaacccacttcccatctttaaagaactcaagaccaggcacttgatcatcctgcaggagtaatatgattcccccagcatccgtatgttctctcagccctctcataagctcaggacgtgggcattctgggtatttagccacttttgttccaaaagctggaccttttggaccagaaaaggcattcattatgtcttcctgatcaagaccaagattctcacacatgagcttggagagtctctctgcaaacttgtgcagttgacaaacatattcatccatcgtcttgctgcaaatatcaatttcaccctctcacattgtttagttaaataagcaaacaggtaaaaatggtagagcctttggtactattcaattcttaattactttacctgagttcctctgaaatgtttgggatctgacagatatttgaagttggtttatgtgagatgaagaaactgctttcccaatctgcatctgaggttttgccttcactcaaagccttgaccatctctgactggtaaaacttctctttcaaatgctcctcatagtgagagttaatcatcttcttcactttctccatcaactctttatcaattccatgattatcaacctgaaaattcactaactctttaaggatatacagtagacatatcttagaaaacactgccttgtgcataaagatgttatacataccatgaagaatccccacttatcacatgcatgatcaagaagtgacatggtcttgcttctcttctctccatccaactctgcaaaatcaataactggaatctccatctctctctctttgatcaaaaccatctcttttttatttactttttctcacacacagatttgttgaatgcaatctagaaagagtatttataggcataagtgaaaattaaatctctgtttctcttgtgtgttaggaggcatagttgcctacttggaggcaaaaacaatagtttctttcaacactattctgttaactcattgaatttgaagcatcattacgtttaatgaataaaaaattgtataagaatctgctttggaaatgtaaaatgaacaataggattgaagaaaagtccaagttcagtccatacaaccatgtgatcacaagtttttgaatttttcataatttcttaatggttttgggtcactcccattgtgtttccttgtaacatcatttatgtgaagtttctttcttcttcacaaggaaagttttttttttttttttttttttttcttatccctactcatattcgatggacctagccatcatgtctaattgtgtattatgtttttcttttcactgattttttttttctttaaaacttcactaaactacccatctaagcgtcattggcgtacttgtaaaatgtgttattctggtgtcaccaaatttggatatgcgtggtgttgtgtttagcaaggagctctataacactcatcaaatgataatatgacccttttttggtatgaagaaatctacttggcctaaagctacagtatcgaattgttacttgagaatagatttgtgaaaaggtacagtatcgaattgtttattttgagattaccggagtactacacaccatttgcaatagaaaaagaaataatgtgggtctaagcggaattaagcgaaagaattggcccctcctatgggcgctctcggttttgaatatatatttttgtgtgtcatattttataacaccttgtaaagaatttgggattgtgtttaaagaatgttatcattttactttttggggtcgaatatttcggatatcgttagttagtgtagctctagtctatataaatcagcaccgacaaatatattttttatgtggtgtaaaattcaaccatgacggccccttagagcgtaaacgggccaagacctaatctacaaagacttttcagttatatataactttgtttcgtttagtttgactgtttgaggaagaaatggtaatgttattgaatcttttgttttggtcatttggtgttgtaatatgttacataattcgaaatgatggtttatcgttaacacggactttaaatatcattaacatgcgtgtatttgagattacaacgaattgattcaacatttcaacttttaacatgttggagttaattattcaaaaagttaataccttgtcaagatatctaaacgttttcaaatttcatgctattgatattagttagggtcataagacctctttagagtcttcatatattgttttagtaaccccattaaaccttctgcttcaccaagagcctttctttccaatttaggtacattttcttttaagtatgagaatttggtaaacttaaactccaaactaaacaagccaaaagagaccaaacattacaatgaaccctaaacaaaaattataaaaatgttaaagtgtaatacgcaatttgcaaattcagcaactatcacctttactttgttcactttgttgtataaatgatttttgttctcactccctgaaccacgcgctaacggtggcgcgtgttcttaacacactttttagtttccagaatcgatggagactttaattaacattttgcccttaagcaaacaataaacaataataaaaaaataaaattaatttccctctctctctcaatctttgtgctttctcgttctccaaccaccggaaagagagagagagagagatctttgtgtgcttcttctacttcttcttcttctctctatcgctccgccgcgccacattcactgagatgcggcggtgtaaaaacaacactgacaaattctctgtgataacgatg

SEQ ID NO: 25996 - DNA, 3000 bp, Unknown; identical to SEQ ID NO: 12840
  misc_feature (1)..( 3000): 2750-1469P.txt file - cDNA_ID_2709735; gDNA_ID_2214575; Annot_ID_135168

SEQ ID NO: 25997 - DNA, 3000 bp, Unknown; identical to SEQ ID NO: 12840
  misc_feature (1)..( 3000): 2750-1469P.txt file - cDNA_ID_2709735; gDNA_ID_2214575; Annot_ID_186326

SEQ ID NO: 25998 - DNA, 3003 bp, Unknown
  misc_feature (1)..( 3003): 2750-1469P.txt file - cDNA_ID_2709741; gDNA_ID_2214575; Annot_ID_135162
attagtttttttcaagtcaaatgtaatctcaatttacttccaaaacaaaacaaaataaattaatgtgttgaatttttaatgcacatcatatatttggatctctaattaatttctttgactgcattctgcaaacattatctataaatacttatttgatagtgtaatttttattcatccttaaattactcaatcaatttttatttctaaaagaacaaattattgttatggaaccactaggagatcgtcgtccttgctgcgtatgtatcaccaaaaatagaaattgtcctagattctgcgaatatgcggaatactttccatatgagttgtatactttttttaaaaactttttttccttactattatcttctgctaaacattttacttgatattaattaattttaattttcaggcgaagtcattatgaaagtactaatgaattgtttggcacaccaaagatcattaagatgatgaggcatgctcctgaagaaaaaaaacaaatgcttgcaacttccataatcatggaaggtaatgcttggacaaatgatcctgtaagtggtggatttggtatggtgcaaaagatcatgtggaagattatgttacacaaagcctaccttcatgaactcgaggagaagattaaggaagagaaggaaaaaatcgagcttcatctttaagtgatacattgtagcatatattatttatgcatcaaataatgattatttaatataaaatcatatttaagatgaatattaaattaccgtcgagcaagttaataccttatatttcttattcatatttcttgtgattaaattgtttgtgtatttagatgatcataaatgaaactttgaaatctagagaaacatattgtacatataataaagtaaaagtataaaaaattgataattttaaaaatacgagaacttctcgtttcttgttctaagtaaaataacattccaatatagaattagggtttagttgcctttggaaaattgctttgtaaaaagctagatattatgtttcgtttagtatatctttgactcatgatatttgacatttgattaaaaatcatgtttgccttacatgcataatatcttaaatgcttgtatcacatgtctctaactaccacgaaaaactttgtgtataaaaaattcaaatctttaatttttggacgacaaattcattagcgttactaatttcattgtacctatcagttttatgacgataataatacaatttatttcgtcccaaaaaaaataatatttatttattaagttaataggaaaataggtgtaaatatacaaatatgtatatgtaatatgcaattagagaatatatgaaacaccactatactatcaacattaatattagtaagatgagaaacataaattagatgatttgagtcaatatttttccctagtaatcttagtaatagttttttttttcttttatttgcatagttcatatacatatttgtatacatatatgttgtgcagatctaaaatttttgtttaatacctattttgcacctctaccaaataaattgtgttagaattttaaaaaattcataatcacaacaaaatttctaacactatttaatttgttgatcataaaaaatctgaatttttatgcacaaaacgtttcttaatagtcaaaactagtgatataagaagtgcaatgccaagaattatagagatttgaagcgaaattttaaaatgacatgattatacataacttttaagttctaaactataatcataataaaaaaaattaagatattaaatagagcgaacagacgtttaggtttttttcggatttaccatattcatcagattaatccatgctggattgagaaaaagcctcaagcttggaacaactacatgtaaatcataacctcgagatattttaaggctttcaatgtcccaaagaaagttatttggtgtcgaatccatgagtgaaaattgagcttttcacatagaacaaagagggatatgaaatagtacaattttatgttttaaataaagaagataaaatgaaaggtaaattttataggtttagccagcagagaacaaatgaaatgaatgttttaagtttagacaccaagaacaaacttagggttcaagtctaagcttagtcatatacttctgaacaatattggactttattgttcaagtattaaacaaacattgaaatcttcttaaatcacttttcaaaatgcaacgaggatctattctttttttttttttcagaagaagctacaagaaagaacaacaagtttggatatgaattataaagttagtaatccatgtaagagacgcttatattaattaatttatactgttaattatttcatccgtaatttttattattattcaataaagtatttattttactgaattaaaaaataataattatgggtgtttggatattcggtcgggtattttgggtttgagtttttcgggtttagaattttaagatccgttcgagtaattcaagattccgggtcgggtttggttcggtttcgggtttagttatatattgaaatatcaaaattttgtgtccgaatctattaaattatttgaaaatttcaaaaattccctaaacaacccgagtagttttgcttgaatatatttaaaaatacataaaagtaactaaaatatccgaaaaatcataatattgtctatatgtaaatataaatataaatattttagttatatttatatttaagatatgtttgggtaccagttcgggttcgggtttttcaggttttgaagtttagattcagtcggatatttgaaaatttcaggttcgaatttagattgggatttttggattgggatttttggatcgggttcagatcggttttttcggattcaggtattatgtccaaagtaaaaatggtaaacggtggttgttttgtttgtatttgtaaagcagaagagagagagatatagagacactgaaagcaaagaccaaaaaagaaaaattaaaaagagagagaggaaaatg

SEQ ID NO: 25999 - DNA, 3003 bp, Unknown; identical to SEQ ID NO: 25998
  misc_feature (1)..( 3003): 2750-1469P.txt file - cDNA_ID_2709741; gDNA_ID_2214575; Annot_ID_186320

SEQ ID NO: 26000 - DNA, 3003 bp, Unknown
  misc_feature (1)..( 3003): 2750-1469P.txt file - cDNA_ID_2709757; gDNA_ID_2214575; Annot_ID_135158
aaaattatccggctttatatcacgatgaagatacgacttagaatgaatgaactcgagacgatttatctgacacaagataaacccaacagtgagagagttacattaagaatgacaagacaccaatccaaagcataattaccatttgatcagcaagcataagaacagtcttcaagctaaactgcctcttgcaataactaaacaaatcttcaagacttggaccaagcaaatccatgactaagacattgtagtccccctcaacaccataccatttcatatttggaatcccagctacattaacgaacatacacaagaaatgaataaccaaatgagaattcaataacaatagagataaacatttcattgcatacttccaccctgaagaactctatatatcctcgactcatatgacaattgcggatgcgcagtcttcacactttcctgcacacacacaaaaaaaactaagttttgatgatccaagttgggactttgaagagatgaaacactcacaagcttaatagcaacttcttcgttagtctgaacatcagttcctgcaatcaaaacagtctcatcaaacgactattgaagagattttatatgtatagagaggggaggaacgaaccgaggtaaatctctccgaaagagccgctcccaattttgcggccaaggcgaaacttgttcccaacacgaggttccatacccaattgaaaaaaccctaactttgtggttttatctatctactacgtcgagcggatttctcgatttctcatgcggaggagagtgaagtgcgatgatcaaaactagggcttttgcgaagaagaggggaagaatcgagcaggttgaaattggaagtgagtaggtgaggaaatttagggagattccatggtgttttggttaagcaaccagaagcaagcaagatgaagaagactgcgcgtgtgtgtgtgtctcgcttagcctgttgcttttggtcttttctattccttttctcaatttattaaatatctttattcggtgaaaaaaatatacagtatatttcttagaaactttataataagaataaggattttgtttttatattttcctaaattccataaatctcttaagtttacaaattcatatatcttttaacatttaaacaaataaccagacttctagtaatatatataaatttatttagggagtgttattggtttgtgatgtattcgaagtttcagtgacttaaaatgttatgaagaatttgttgttattcaataaagatttttcaattttttgttaaagtttggtgttattagtttaagatttgtaaaaagtaatataaaatcttcataaatgtagagttattggattcatatttttataaagttattaaattttttgtgtaattcatttaaaacaaagaatctatgattattataatgaattaaattattgtgttattggtttatgactttctacccttttttttataaaataaagttgtgaaaaatatcataccctttttttttacaaaataaagttgtgaaaaatatcataaaaataaagaaattgtttgagaaactttacaaaattattaaaaactaatcaacaagtttattaatgaccttaaaccaaaataggtacatataatattagatagatcatgcaaatgcgtttggtggttatgttacttttgtatcatttgattggcatgatgttctacatttttttaccatttctctattcttaagtcgaaatctttaggaccaaataagcatttttccctaaactaacaaagcagcatctcactagatgttttccaatcagatttgcttactatagtgtgctaatatgaaatttgagtgactcatgacaatgcatcaatccagattaagcattaacatgtgatcagctagcattcatgagaatatgagaattgtcttcgagctaaaagaaagtagactcttttttcacttgagaaactcatgacatactttttttttatatacatttgttttttgatgattaggttaaacttttgtaataaataaatttttagttaaataaataaacttctatcatcaaaagactcgtgagtttcttcctatgttgcaatgaaatggaaacgaaaacgcgaatacgaaacgtttcggaaacgagaaacgattttttcttaaaattagggattggaaacgattttttcttaaaattagggattggaaacgtatacacatacatacatatatatatatatatatatataacattaacataaaactatattaaagaaaaaatggtttaaacaatacaagtccaaaacatcaatattaaataaataaactaaaattctaaaagataaaaattaaaaggttcaagttcaaatagttaatttagaccaacattttcattttcattagtttcatcaaagataatataaagctcttttcaaatctggtttatcaaaagaaatatcttaaaactcaaagtcttccaaaattagttatatgtattaataattttaataattttaattttagttattaaattttcaaagttgaaaaaaatttgtcgtatgtctatttgggaaacatgagtttctatctttaaaacgtaagtttccatcgtgtttccaaacataaatttttaaaaaacgcgtttccgttacgtttttcatgtttccggagagtttctgttttcgtaacgtttcggaaatgggaaatagacctcggggcgagtttccatgcaacctagatttcttctaaccaatagaaatgctcttaaaagcctttttttaaaaaaaatcaacagaaatgctcttaaatgttaaaaacaaatattcatgccaaattttgatgtaaaaatttgttattttcgctttagttgtgtcttatttcggtctggtcattttctcaaagcccttttagttatttatatatatattctctgtctcgtatttgtccccaaaaatctagggttttaaggtttcttatccttcctcttcctccgccagattcttttcttgcgaagatg

SEQ ID NO: 26001 - DNA, 3003 bp, Unknown
  misc_feature (1)..( 3003): 2750-1469P.txt file - cDNA_ID_2709761; gDNA_ID_2214575; Annot_ID_135171
tgctctacatggccagataactgtaggaactcttattcttcaggtatctctacctgataactctcaaaactatagcttctctattatcattttcacacgtttttttgtttttcctattattctaaaactgcatatccttttgatccgaaatatgattcaaatccaattccaataggtagtatgttgcatgcagcaagtacttttgttagaactttaatttactgtttcatgaatcaccaggattgtgctgtgggcttgctgtttgctctcctgccagttcttggtggcacatctggtgtccttcaaggagtgttgtccatggcgaaatcgtatgtatttttctcttccacgaatttctatgaaactatcgacaataccctgcttccattgttcacttgttacaataaaacctagtttttggttacactttctttttgactgggttttaatatctttccaggttggctattttgattgcgtttttgggagctttgtttgtattatcccgtacctgggtaccttggtttctaaaacttatgacaagcctttcttctcaggtatagacacatttcttacctgctccagttttggtctttaaattgtttatcaactcaagcgtttttcaatctttgacagactaatgagctctatcagttggccgctgtagcattttgtttacttgtcgcttgggttagtctgatccctttgttcttcttagctattggctgtttgcacatttgtgactctcgaattttcatttcttaaatccagtatcgttttggcttcttcagtgtagtgacaagctcggtctaagtctggagttgggttcctttgcggcaggagtgatgatctcaacaactgatctcgctcagcatactcttgaacaggcaagaagtcaagtttgactgtttcgaactagagggtctctacccatatattttggccactctcttattttgaaagtgtctttcttgcttatatactatcttggtttcctgatgaaatacgtttcctttctttggcacattctaccaaagtttttcatataaacctgttctgatcgcttctgtttccttgcaggtggaacccatccgcaatttttttgcagcactgttccttgctagtatcggcatgttgatacatatgcacttcttgtggaaccatgttgacattctgctagcagctgtgttactggtgatagtgataaagacggtggtagttgctatcgttgttaaagtctttggatacaataacaaaactgcagtacttgtaagaagcgaacccttttttttttccttctttctcatcattcgaaagaagccttaaggttttcttgtctgtaggttggtatgtcccttgcacagattggggaatttgcttttgttctgctaagtcgagcatctaatcttcacctaattgaggtaagctctctatgattattgatgcttagttatattatatgttagcatatatctttgaaaccgtgtgtgaccataatagatttctcataatttgcttttggtggagcgataagtaacaatgaaggggttttgtgtttatttgcagagcaaattgtacctcctgcttctgggaacaactgctttaagcctggtatggtctatttcctcatcatatttataataagttcatattcaaaaacgaataaacgaatattgacacggacgttgctttatcaatgaataacagtagaatttacatactccagtatcaatattgtataattactaaacaaattaaatgatgtaacaggtaacaacaccattgctattcaagttgataccagcagttgtacatttaggagtgctcttacggtggttctctcccgacagctcaaccgaggtaaatacaaatcatcgtcgtgtgtgtctctctcaatgactttggctcaaactcaactatgaactataatcttcatctgtacagattggtttcaaaggagagttgtatcactcagagagtgcaaagcgtatatcactgatgatccaaggttctcttcacgactcttgaagtgttgatggtatgttcacagcataacacgcaacatgaagccacatttggtctcaaggtaggcaaaggcaatgaatgggagcttccgaatgtatagatgctttgagatatcagaagagaacccccagaggaacctgtataaaatctctctacacgaagataattacagagacttgtaacttcacttcaattttttgttttgggattcttttttgagtaaaaaggtaggaagaggttatattttagtttgtttactttcttctcatgtgctctgaaacaaaataagaaacatctccaacgtattgtagtgattaccaaccgataaaaagctaaagaatttttgagttagtcgattacaaagtataaacacaaatttgaattgatacaccaaagatttctttaacatttcgtgggaggccgagtattatttggctttagcttcgaaccaagactctctggagatagaagctctggctaaatacatgacggactgagaggactacgggggctatcttaatttccttttatatgaatttttctatgttaatttaactttttagatattgatttccattgtaattaaaacgctgtttgtcctaattttattttatatatatattgtataggttccattaaccctacgatcaaaacagtttcatacaaactcgcctcatcttgttctctaagatcaacgtgtctgatcaagcttgatctgcttctcttttttttttgtttttgtaattattcttgcttgattcgatcaacgtgtctgagctttgattcaagtgggggtttggaggtatgtgagcgtcaaatcttcaagttttaattctggaattaggtttctcttagtgggttttttttttgtatcatccgagtgttgttgtttgaatataaatataaatccaaccactagaacatgttttacttactttggttttgttttacctccagatatataccgccatcgccatg

SEQ ID NO: 26002 - DNA, 3003 bp, Unknown; identical to SEQ ID NO: 16608
  misc_feature (1)..( 3003): 2750-1469P.txt file - cDNA_ID_2709775; gDNA_ID_2214575; Annot_ID_135153

SEQ ID NO: 26003 - DNA, 3003 bp, Unknown
  misc_feature (1)..( 3003): 2750-1469P.txt file - cDNA_ID_2709779; gDNA_ID_2214623; Annot_ID_135918
tccaatccttaaggatgaaaagtcaagagttgtttggtcctacttccaataattatgcactcacactactctaaaccttttcacataaccatgcaatgtctatatctatccatgtgtacattgttgtatattatattctctgtcttgtaatttatatattagttgtgtaatttttttggtggcccaaccattcccaaatcaaacttttaaacaactctctttcacttttgtttaatgttattttaggtgtgaaaaggctaattcttctctgttctctctaggtgtttcatggattacaccttttatattactttaaccatcttagaatttgccttgttcttgcatgtgctatgattgaattcaatcaatgggtgatgagaaaattgacccaatagaataataaattaacattgataatcgtcgaatggttcggtgagatttgcacatccaaattttccacacacaaaaaagaatgttatgttttttatagtccaaaatccagttgggttacattatcttacatgtatgtacaaagttttataatattaataaaaaaacaagcaaagagaattattgaatgttttgattgtggtaaaagccatgaatcatggacctccacagtcaattactcattcaatttctcttggagctatttgtctctgccagactcatttaatgtattattttcatttgcttccactttctctcatacatgtattagtactaaccattttgatttttgagacttgaactctcggttagacattttatccatccatgcaattgtgtttatcgatcaatgatcatcagtaggataataaaaggctttattagtgaatatagtaaaattgtttcactgataaaaccttttggaatgtgtttacttgattattttgatcaatgatcataacctaggtagctttttgtattattcttctagtcaatatataggtaatataagcaactcgtgtgtctttgacaagctggtgactgaatattatattttaattaccgtctaatcaaacactaaaccatttttaaaatcgttaaagcgaattttggcatatatgcagagaattccacgtttttataataatttagagaatgtgcataaatgagaagaaaatgcaaagcacaataggctacattttaaaggtcaatgacctcactttgtgtgtagattttattatttgattgtttttttcgttgggtatagaaatgtctgatttatgtgtggaataaagacgacgactttgttaaattataaattattaaattttgttctcttaattaatactcaatcggctttttcttatttttttattattatggctgataccacgtaaaccacgagtaagtatgtagtacaaatcaattactttctaatactacataaaaattatatactagtacttaatttcttacaagaaatacatacatcatttaaaaacagtatttgatgttaatataagtagttaatagtagaatagctgataaaataacgtgatttatgtccacaattcgttgattaaaatattgaatccatggttggaaaaaactggcgaaatcagtaattattgtcggctaccatatagggacatgatggttttggttcgtcttccatgtacaccaaatcagcaatgagaaaaagaaaaatggggaaaataaataattcttgttataaatattatcctaagatttattatcacttattatgggagtgaaaaagaaaacaataagaaggaaaatgaatgggaaatgggagaaaatgtaaaggaattaggggaatgaagtcaaaacggtggtccaaaagacataacgaaggaccattgtaaaattgtgtgatttatttgaaatcagaaagtttaacacgaaaccctaaaaaaacaaaacaaaaaacaaaaataggaataataattatgctatatggtcaaagctaagcagttgggctattttcatttaaatttattcgttttggtctaaaacctatcgtgaaaaaagtgagaaagtaaagtttgaggtactgtggaggaaacttcttcatttgggtaaatcccaaatccctataaggtaaatattatgtgttcttacaaaatttggtttttctatgacaagtatattcttttgaccagctaagctaacaaatgtatgttcaattggttatatatcgatcggggcaagggtaatactcgaatctatgttcttttcatgcaagttatgtatgtagccttgtgtagttctctggtacgttgatatgcaatgattctctcgaaaactatttaaaaaaattatttaagataataatgaatggggtcacgagtcaagactaatgtaaccaaagtcaaatggattttcgtatgattactacttttgtaaccaaagtcaaatggattttcgtatgattactacaagcttgtaggtcaaaaaacacatgtcacctctctgtttagtataataaaccaattttataacatcattctttttatttgctagtttaatcgtctaaataagtgacccaaccataaaccatatcagattatgaaattttgactttacgatagtttacgtatcctcaaattcctcacgtatatgtcatgaacaattcttaaacaacaaaattataactctcttttaattaatgtagttttttcgtaagaactcaaattgatatttaacaaaaaaaatgaatgaaacatttctcaagttttaataattattttttggaattttgcaaaacatatatagagagataataataagtatgaatgaatccaaaaagagacaaaaagaatagatggaaaaagagacagtcatctttaagaaagaagccaaaaacaaaaacttgctcttttaatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatg

SEQ ID NO: 26004 - DNA, 3003 bp, Unknown
  misc_feature (1)..( 3003): 2750-1469P.txt file - cDNA_ID_2709779; gDNA_ID_2214623; Annot_ID_187726
accaaagtcaaatggattttcgtatgattactacttttgtaaccaaagtcaaatggattttcgtatgattactacaagcttgtaggtcaaaaaacacatgtcacctctctgtttagtataataaaccaattttataacatcattctttttatttgctagtttaatcgtctaaataagtgacccaaccataaaccatatcagattatgaaattttgactttacgatagtttacgtatcctcaaattcctcacgtatatgtcatgaacaattcttaaacaacaaaattataactctcttttaattaatgtagttttttcgtaagaactcaaattgatatttaacaaaaaaaatgaatgaaacatttctcaagttttaataattattttttggaattttgcaaaacatatatagagagataataataagtatgaatgaatccaaaaagagacaaaaagaatagatggaaaaagagacagtcatctttaagaaagaagccaaaaacaaaaacttgctcttttaatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgtaagtttattatactttttttctcttcaaatcttttgtgaaaaaaaccaaacttttgtgtgtttgtttgcttcaaacatcctaaagttacgatataactagaaaaattggacttttctcattcttttgtctcaatcatcgtaaaaaatcagtttttgaataaaatcttcacacttttgttactttgtttcattcttatcttcaaagtttggatttttatgctaaaaaaaaggtttgaagtttccttattgtgttgtttatcttcatcatcgtaatgaatcatctttgtcaagttaccgagtcaaaaccttcacgcttttgttgttttgtttcattcataaagtttgagtttttgttttttttcataaagaatcatcatagtcacctttttgatattttgttgggtttgatgaaacaggagcaacaccaaaacttgttcttaagatgatggatgtgaagggacttaccatttcacatgtcaaaagccaccttcaggtaaatagtaattaattttaccaaaaacatcaattttgttttcttctttattcatatttcattcataacaccttgttttgattgttttgaacatatatataaacagatgtatagaggaggttcaaagctcactttggagaaaccaggtattatttttttccttataattatgaaatgaatcaatgatgatatttggaaaaagaatgggaccgttgattttaatttgaactgttaacatcaaacacataataatggatggaatttaattattttactgtatctgtttgtagtatgtactattggtctagtgtcatgattcataagacaaatgtcataaatacatttatatatttttcaagagtaatagaacagaaaataagagaatattcattaactagtttttattgtttcttacacagaagaaagctcatcatcttcaataagaagaagacaagacagtgaagaagattattatcttcatgacaacttgtctttacacacaaggaatgattgtcttttgggttttcactcttttcctctttcttcacattcttcatttaggtatttatttttatttataattgttttctgacaaagttttttaattttatttcagtaaaaaaaaaaaaaaagtgttttgcttttttgtttgtctgtatttgaattgtccttttactttggtgcagaggaggaggaggaggaagaacaaaagagcagcagacttcagagtctggtggttatgatgatgatgctgactttcttcacatcaagaagatgaacgatacgacgacgtttttgtcacatcatttccccaaggtataaataaatttctcttttgtcaaccggtttggaaatttaatgttgcaaaacaaaatcaagtccggttatgagttctaaccggtctgattgagactggtcaaatccaaagggattgagtccggtttaagtactacttgtcattgaatctaattagtttcatataaatggcatttaaccggttttagtccggtttggtaactaattttgtcttttggttcattagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaacagagccaaacgcagtgttttgatctttgaaggataacccctaaacgcagcgtttctatatcaagatcctacggtttagaatgttcattgttattttggtcggcaatcctacggtagaaaaaataatctcgcagataaaacccattaaacgctgcgtttcatcgttggagggtaaactcattaaacgccgcgttttacattcaaaaaacttgaaactaccttataaccgcccagacgatgaccaacgtcgtcaacgtcggcgaagatg

SEQ ID NO: 26005 - DNA, 3003 bp, Unknown
  misc_feature (1)..( 3003): 2750-1469P.txt file - cDNA_ID_2709783; gDNA_ID_2214576; Annot_ID_135176
ctaatatttattagtcaataaaaaaattcaacagtcattatggagaaattttttaaaagtaacttataattgacaaatattgattttttattattttatttttaaaattccttagttttttaatttgagtcattttacaaccaccacttttaaaaataaataagaaacccctatgcttattaaaatttatgtagtctagtactcttatttgtttaaaaatatatatatacaattagcatcaaaaacaattggaaaattatagtaaaaattattggtttaaagtggttaataaaaattttgatatcttatggatatattatctaatcatttgattgacctatatatgattgcatttgatatcttactacattggctatatatcttttcaaaatttgctaaaatctattaggaaaattgtcattggaactgatatttacatggtgtatatatgaaatggttgatttgttaacaagccaaaattaagagttagatttaaaaagtaaacgaattgattggaccaaattaagggacttattctgtgattttttttcattttcttttgttctcacacttggaggttaaactggtaaatactaaaataactaattattttattattattttaaagtaatttaatttataaatggtaattaagtctaacaccttttgtccagttatacaattagtcaataatttactttctttgaaagtaattaattaaagtagttaatgattttgcaaaactgcctaaataacacctaaatttattcttaacccatctatgtatatgtttactatgtatgtatatatatttatatatatatatatatatatatatatggccctctacttcatacttagaagcaagaagctcatagaaatttacttcaaaaattgacctcaaacgacaagctaaaagaggtgaagttctttttcctatcttttattttaaatatggctctgtttatatatctatatttatatattacttactgttgatttgaaagaaattttctattcgaatatgtatgtgagaggaaaggatatggttcaagtgtcattgttatcgggaatggcaaattatattcctttcctcaaaaaatttagcataacaaaactaattatccatcatataaaaacaatcacatcgtatttgttttctattgtcttatgctaaacaagttttatatataactcatgctcacgttaacgaagacccatacaaaaatgggttgattttcttgatctccttcattggagaacatgactgattttcaatagtcactaaagtatatacatagatatatactatatagttgtttttgatattttaaatggataaaaaaaaagatgacgggatctatcatttgggaaattattcatagatttatttaaatagttcctaactaattgcttgaatatgggaagagacgacgaaatatagttaaaaaattggagtatcctttttggtttttactttaccatatacatgaaaaatatatacaatcattcttctttttgtcttcttttatctttggaatatttcttttcacattcaatcttccatgacacacagacagacatatatatatgtgtgtatgtatgatatgataggaactttttaaaaccaaaaaagagagacccatatgagatgatgatgacgattgagacaaataattattttgacaatttaagaaaaacataagatgctttgtggattaacttttgaaaattcaagaaatctgtccctatatatatgaaaacattagctttagaatacaattttatgagatttatttagtttatagtttatagttttaaatttatatttatgtgttattaaaattgtaaaattatatgaaaacatagtcgcttagttttacaaccgctaatttatttcaaactcaaaatattatatttttattccttcttcggttacgtatttttcttatgagatattatatggtcaaacatttaaaattagttaaatgttacatacacacaaattccaacattttcatttctttttaaggaaaaaaccatttcatttctttaagatatataaaaccaaaaaaattatgtttttatatagcttagatcgtgatgctaaacttttcttgtaagagcaatctcgtatagatattttatgttagtgtcaaatatcttcttctacaatttctaaagtcatattacactatggtaattgttttctaaacccttttagatccaaaaaaaaaaaaacttgaaatttattattcacatatgttagcgagagagaggagctgttgagggttgtctcacgcaccatccactgtcgttttgtggcaaatggattgggtccaccgacctctgtagctctcatagtttcttttttttctaaaattaattacatatttagaaaaaatgatatcaaaaataattaatagctctgtatatgtgttagtgtctacaggcgacaccaaaattatataaatattcttatttaaatgcgttacaaacaaaagaaaaattatataaaattttacaaataaatgtatagagtttttagtatcatatgtatcatacatatgaaattagagctataccaaactaaccaagctagatttaaattcagtttgattatcttaccctatttttttaaccgaatatgaacttttaacactctaggctataacattgggtggtgacttatatttcttctttctttttactagcctacactctttttcacctgtcactttcaacttctctcttctattacctcacaagaatttctatgtttttttaataattttatatctatttaaaaaaagtataaccaattaattaaaaatctggaatatcccaattttagggctttattgagataagatatcagtggaagtcaaaaaagaatttaatgttaaagagtttcttctctctaatttcatttcatttctctttttttttttctttttcttctttctctctctcaccatcacatagaacacagaagaatccatg

SEQ ID NO: 26006 - DNA, 3003 bp, Unknown; identical to SEQ ID NO: 26005
  misc_feature (1)..( 3003): 2750-1469P.txt file - cDNA_ID_2709783; gDNA_ID_2214576; Annot_ID_186342

SEQ ID NO: 26007 - DNA, 3000 bp, Unknown; identical to SEQ ID NO: 12854
  misc_feature (1)..( 3000): 2750-1469P.txt file - cDNA_ID_2709787; gDNA_ID_2214576; Annot_ID_135177

SEQ ID NO: 26008 - DNA, 3003 bp, Unknown
  misc_feature (1)..( 3003): 2750-1469P.txt file - cDNA_ID_2709791; gDNA_ID_2214576; Annot_ID_135178
acactttcctcttcacttctttggttgatttttgtttcagcttccatgggagattgtgtcctcttcggtgaagctgtagattttgttctctttgaaaccctttgttacatacatcgcatatgaatctgtttgtagccattagtgtctttggagataatgctaccacttccgcatcaggatctgtttcatataattaaagaatttaatcatttaaattaagtcaccaattagacccaaaatgtcaatctatgtagactatatcgaaaaaaatgatacacacacatgtaaacataaatcaaatgacatatacacgtataaacatataagatatactggcctgtcaatatatatgaaatcttgatactagctagatatacaaaacaaaatagaacaaatgattagggttctttttcttcttggtattatcttaaagcttatatatagtgattcttatagaaaggtgataaatatatagagatttatatgtaagagatacttgcttgggtttccgggttggtttcttcgtttcttgggtggtggagctgaggagttaggttgttgaatcattgacataaaagtatctttccggttaaagtcgttatctccggtgccggagctggtgatgaagaaaggctgagcagaggatgatgatgaaggaataacgcttgtgttatatgatgatgacgacatctttagatcttcttctttgcgtggaagagaataatctacaaataattcgtaagacaaaaaagttaagaagaaaacgaagggaggaattataagaacaggaaaaatccatagagattgacgacatgaagaaattttataaaaaccatttcactagaagacataaacaaagaaaaacaaattaagagtttatacttttgttttttgttcctaaacttttgaaagaattaagaggaaagatttctaagttgtatttttcttgtacctgagatcaagagaaagaaaccaagtagaagaaggaaaaaaaatagtcaaaattaaaagctataaatcggagctaaagaaagaaccaagaagaagatgatgcatgatgatgatgatgagatagaagatgatgatgaagaagaagacactattcctatatattatgtattataatacaaacacaaacctcaaagccctatctctctctatctctatatctctttctctctctactgttttgtgttcttcttcttttaaaaataagccatatatgaaatgatcttgaaaagtatgtctctaaggtcccctctctgtctctatcattttattttatttcgattaatataaaataaagctactttttttctttcttataatttaatttgacagaattaagaaggatggttacggtttgggtgtcactgttaaaacggtgaaatgtgtccacatgcgggggtgtgttgtgggtaccacatttttctcattcgtatctttctggtgagctttaagacaaaaccctcgttttctcttcatttaacttgattaggttttgttgtactaacttttttttaattgtttttatctaataaaatcgtttataatataacatatcgtatattaatacacatgatacaccaatcaatagagaattttttaaaatttgttagattcttgtatgaaaattaatatattgcttttcttctttggttcaattcttcaacctttcagaatgttcaatgcaaaacaatcgaaccgattggttttgaatcaaacctaattaatcctgaacgagtaaccaactctcaaccgatctgaatagattttaaaacgatatatcacaaaatctccaatatcactttaagagctttgagaaaatattattgatatattattattcgaccgtaaagtttgattttctccttttcacttgggctttttaatcttatacaatttagttttattttagtttacaaacgacaacatatttaagtaacaggtgacttctcaacttgatcctctcttcattaccatcgatgctttttaagttatactgagatcgtaccaactgcaatgggtcagtgccgggccatattcaatcagggcctccctgattgggttgtaatatgatttcaagttagtaatatgaaatagcacacagtcacgcacacaaaagagcctatataaggagagatataccacaaacagcccaagacccagttgttttagatgaaccaaaattgtatggaaatatttagtatttgaaactgccgtcaccaagatggcaaggtcagagaaactcaataacaactctgtttctgccattccgagagttaatattaattttcagagttaatggattagctagtaaacatatatatacaaatgataataacctgtagaatgaggattaagatcgagaacgacgaggttatctttaccgcaacattccaaacgtagccaaagctctattaccatacccctcaatgtacatatccagcttataagactcctatccagtatccaccatccaacgaaacacactctcagattcttccacattatgaatacatgtcaaccaaataatttctcacctcaaccatcatttcaaaaccaaatcttcaagcaaaccccatggatttaaaaacccttttcaagtgcgtcaaacaaaccacaagcttttagatttgtcgagaaagtgaagtcgttgggcccatttcttcggatcccttaagttcaccattaagtactcattagagcccatttcttggggcccattaagagattaagtccgcgcgcatagcttttggaggatgccgctcttttgtaagaagcaacacgttgttgagtctctaacctttctttgaaatcttgacctttcccttccttctccgctaaattcgttttaatttcatcttcttcttcttcttcaattcgatgcaataatagtcacttcaatctcaatctagggttttcaattttcttcatgtgaattttttttccccttcttctcaatttcaattcaatctgggattcgtaaattctcggaagatg

SEQ ID NO: 26009 - DNA, 3003 bp, Unknown; identical to SEQ ID NO: 26008
  misc_feature (1)..( 3003): 2750-1469P.txt file - cDNA_ID_2709791; gDNA_ID_2214576; Annot_ID_186344

SEQ ID NO: 26010 - DNA, 3003 bp, Unknown
  misc_feature (1)..( 3003): 2750-1469P.txt file - cDNA_ID_2709806; gDNA_ID_2214577; Annot_ID_135196
tgttgggatatcaaatcctcacatcagtgattctctctcaagtggtagtgtgttcctatgtcatggaagcataagaagaaaccaaacagggttgctactgactcaagaactcagttcttgtagtcaggatcagagtagtggcgctaagtcccatgacgttggtccttttgaaatattgaagcctcaacagttaaaagaaaagttatcttggttgacattatcgatacatgaagaggattgtcgttatattctacaaaaggaggatgaagttgcgaatttgcgacaagtaagtgtttgtggtgatcttatttgttgtttcatttagttcaacctttggtatgagtattcttacatgtagctgttactctttatctttcagggacatcaagaatacttaaactttagctccttgaggggaagtagctccttggactttaataaagagtagaaatatgaaggctgtggaaatctgtaaagtgaaaagtctgaaatatgcaactcttcctagttctggagatagctgctgcaaaatgatacttaaagtcattgatccgaactccgaagtgtacagcaaactttcaagcttacattacctgatttagtgacctttccagattttcttgtgaaaagaagccggtatgaaggagcgatacagaggaaatggacttgcagggacaagtgtaaggtttggtggagaaacaaaggcgaagaagatggtcgttggtgggaaggaggaattctagctgtgaaacccaaatcaactcattttcttgatagtccatgggagaggtacaaagttaaatacaagactagcccgaccgagacacatcttcatagtccttgggagctttttgatgctgatactaagtgggagcagcctcatattgataatgagaaatgaaacagtatgctcttagccttaacaaacttacagacttcagaaaaaagaatccaggtatgtgtgtttaggcttatgtttaaatttgcttaggtggtttagaagtagaaaataacataacactatcacaagaacatgacaatatgatataaacttgacagattcgtttgaggattcttatggactccaaaaactgaaccagatcatgggaaactcaagctacaccaataggtaatattctacaagactagaagaggttttgatatggagccgaatttgacatggttttgttctatggattatctacaggttcccagttcctttgtctcttgaggtaataagatcaaggattgagaacaactattaccggagtatggaagcgttaaggcacgatgtatcagttatgctatccaatgcagagactttctttgatctaaacaaatgtgtaggtgtagcagtcaaaatttcagatctttctcaatggttcgaccgcacgttgtcttctttgtagcttatctgcctatgtatagagtacgtgaattagggtcgcttgcgttgttgtatctgaaaggcttcttcgatctaacgagtaagcacatttttcattgatctaatttttgtttgtctcttgtgatgtaatgtaccctaatgtcctaaagttggagctaatttttgtcattttatgtgcatcagtacaatgatgttattacagcattttagtgtatattcgggtatccaagttttaagctatacacgaaaatcaactcttacttgacccacaactacccaactttggcgtggtattagtcgtaataataattttatgggttttggaaagttaagcaccaactattatttttcttttttttttgtagagttttggtcgatgtgagacatcttatcaaagttagtttagggccattgttttcaggtccgatccgtaccgtccggtccgatcggttaacccatgacccggacatttttccggtttagattaagtgctaatatccgataatttagggctaagcgattgtcccacaacctcctgtaaacgctacgtatgccggttgctaacatttaacaacaaacacacaaatttctttatactgttacagattgctagatatcgcttgcaatcgttagattttaaaacttcatttccgccagtgtttgcgacagcaggcggttgcgggtggttcaaatgattttttttttcttttttatctacattagtattttgcatcttttgctatgtattttgagatagtgaagtaatataacttcatttttcaggacttgtagtttttatgaaagaaaaaacaaaaactagaggctgattttaatgatagatcctaaagaaatcaaaccaaatgaaatcaccagaaccttaagatactttaacctattgggtctataaaacggattttattgctttggatctataaagtcacgttgtagacccaaagcaataaaagatttgggatagttaaaccatatgatggttagtgtgtggttttaaaaccttaagatatttgtgtaggagactaggaattgtgtgttttgaaaagaagcagccactaaaatcatatgataagtcaataaaggaagcagctactgaaatttacttgaaaatgatttttcagtaccaaaatcaattaatctcttccatgtctcgtttaatgtatataaagaccgttgagaaaagtcgtatttggatcaccacaagttagtagaaagacttgttagtcagtcaacccatgtgatatatatgagaatgaaaccatgttatcacattacaatttccactttcttgctttttcattgttgatactcaaaaaggtaaaaaaacttaaaagaaagatgaaagactcttggaacacaatcagtcattcttattactcttttctttcccttctttctcacttctaattatggagacgtgttagcagctcctaatagaaacttgtgtcatccagaacaaagagacgcaattctcgagttcaagaacgagtttgagattcaaaagccttgtgtgttgatgggcctcttaagacggagtcgtgggcgaataacagcgattgttgttcttgggatggtatcaaatg

SEQ ID NO: 26011 - DNA, 3000 bp, Unknown; identical to SEQ ID NO: 12884
  misc_feature (1)..( 3000): 2750-1469P.txt file - cDNA_ID_2709833; gDNA_ID_2214578; Annot_ID_135211

SEQ ID NO: 26012 - DNA, 3000 bp, Unknown
  misc_feature (1)..( 3000): 2750-1469P.txt file - cDNA_ID_2709837; gDNA_ID_2214578; Annot_ID_135210
aaacacgagtttccgatcaatcaatccaagctagatccttattttgcatcattaagtttatggaacaagagcagtgattgttgttattggaagggtgtcaagtgcgatgctaagtctggcaaggtgatttcactttaccttaattacgtctttctcaacaactccttgaaaccaaatagtggtctttttaaactccaacatcttcaaaaattaaccatttcaacttgctatctctatggggagattccttctttattcggaaacctttcccatctcacaaaacttaaccttctcaataatagattagtaggtcaagttccatattcatttggaaacttaacccatcttaggcacctagaccttagtgaaaacaacttaagtgggagaaccagttcaagggacatatagagtttgggaatacaacttcatcgcctaggcttattggtatacaccttggcgataacaaatttgatggctcagtccctgaatctatatctaaattttcgaagcgcaaaatgttcagtcttacaaacaacaatttcatcgggacaatcccaaaatctatatcacagttacataacctctatatccttgatctttcctacaataagatggaaggaacagtaccaggttgcttatcaagattgacatggttatcgctttctcacaactcttttagtagtattggaaagtcattagaagttctagatagagctccaatgcgtgtattgagtcttgagtcaaattcattccaaggaccgtttccccattggatttataagaaaagtcaatagaaattttgcttccccacagaggccgaatatctccaaacactctttcttcttggacatgttacacatgatgttgaaatggacataaagcccgctggcctgaaaggatacggtcttattttgtggacccgaacccgtttaaagacactatataataggttgacccgtttagatttgactactaataatggatctgaaaaatactaaaaaggtagcccgtttagacctaattactaaattgtctgaataagatgctaaaagtctttgctttcactattctagtgatttctttcggaaattccagaaatttgattcgaaatgatttgtggatttatttgaatgaaatccacaattttctgagtatttcgaaggagtcaagacaaaaatttcccctcttaatcatgtgaggaaatgaagcatatcttgttctttgtttcttgatttactttctggtagtaatggataactagagagattcagtggaatggccaaaatctcataagtagaatttcattggttttgcactgaatattagatggctttatggctctgaaaaagcagctcttgccggccagtttagcatgtttttcaacagacaaatatttaataattataccttgataatgtataaacaatctttttttttatgttgtgtttattgtttgccttgggatccaagtgaacaaagaaagcaagtcaaggtttatactccatttcactacaaattttagttatctgcaataatcaaacccactgtttctgttatcaacatagcaatctttcatgtcctcatttcccatgtttttttgtttattaatatatatatatatatatatatatatatatatatatatatatatgtatccatactcaaattattccatctatatcgtagtgacactgcaattataatgataaggtgttcattttagagtagtgcaagactattgtaggagaatttaatttgtatgggaatgtgactatgtttgttactcacgagcagattttaaggaagttgtgagataagagattaaaaattaggtagaacttctaggcattgtctgatagtaccattggcagtgccgtctcgatataacctatggcaaaaccaaacaaaaattaaacctcttagtaaaaaaaaaagttaagaaaatttggacttttcttctttaagtgtttttctgaaattaatattggacccttggcatttgcctaccttgcctataggtaataggtggagccgatgctgaccattgggacaccttttacactgcgaattttcccttttgtctccaattgataaattttgttgggaattaacctatgaaattagctaacgaacgtttttttcaggaatgagacaagtcgaaacagtatgtggcagataaggtggaaggaatgagtcaatggtctatggggcacaaatcacaaagacttagagaggataagaagactgataagtttgtaaagatttcccatcagtgttctccaatctccaataactcgtttttgtaacaaacgtctttgagggttatttttctttttttttgatcatttgtctctttcatgaaacccttaattcacgcctcactgactcttccatatgaagaattttgcaagtcaaaaagtccaatggaaatgttgcgtctcctaaaccattgagactgaaaatgcccaattcgttttctatgtcacatttcccaaacactctttcttctggcacaagttactcatgctcctctctattgtaacgattttgattgtgaaattccaagaaaacttataccttaaaaatttataatgaaggcattaaaatttttgaattgtaaaaaaaagataatgaaatcgacaatgtcaagtcaatagagtgtgtgatgggtcaatgtcagagttgacgacagtactagtgttcaccgaaagtcaagagctccacaactgatttttgttattggttctttataaagagagatcagaagccataattataacctatcacaaccacacaaactaaaacttaaaaacaaaagaagtaatgatgataccaagccaatcttattcctttaatggtattgttgttattaccttgtatttcatctccttgttttcgttttttccacacactcttgcttctcctacggcccaccgttgccgccatgatcagagggatgctcttttggagttcaaacacgagtttccgggagcagatatg

SEQ ID NO: 26013 - DNA, 3000 bp, Unknown
  misc_feature (1)..( 3000): 2750-1469P.txt file - cDNA_ID_2709837; gDNA_ID_2214578; Annot_ID_186390
tccaagctagatccttattttgcatcattaagtttatggaacaagagcagtgattgttgttattggaagggtgtcaagtgcgatgctaagtctggcaaggtgatttcactttaccttaattacgtctttctcaacaactccttgaaaccaaatagtggtctttttaaactccaacatcttcaaaaattaaccatttcaacttgctatctctatggggagattccttctttattcggaaacctttcccatctcacaaaacttaaccttctcaataatagattagtaggtcaagttccatattcatttggaaacttaacccatcttaggcacctagaccttagtgaaaacaacttaagtgggagaaccagttcaagggacatatagagtttgggaatacaacttcatcgcctaggcttattggtatacaccttggcgataacaaatttgatggctcagtccctgaatctatatctaaattttcgaagcgcaaaatgttcagtcttacaaacaacaatttcatcgggacaatcccaaaatctatatcacagttacataacctctatatccttgatctttcctacaataagatggaaggaacagtaccaggttgcttatcaagattgacatggttatcgctttctcacaactcttttagtagtattggaaagtcattagaagttctagatagagctccaatgcgtgtattgagtcttgagtcaaattcattccaaggaccgtttccccattggatttataagaaaagtcaatagaaattttgcttccccacagaggccgaatatctccaaacactctttcttcttggacatgttacacatgatgttgaaatggacataaagcccgctggcctgaaaggatacggtcttattttgtggacccgaacccgtttaaagacactatataataggttgacccgtttagatttgactactaataatggatctgaaaaatactaaaaaggtagcccgtttagacctaattactaaattgtctgaataagatgctaaaagtctttgctttcactattctagtgatttctttcggaaattccagaaatttgattcgaaatgatttgtggatttatttgaatgaaatccacaattttctgagtatttcgaaggagtcaagacaaaaatttcccctcttaatcatgtgaggaaatgaagcatatcttgttctttgtttcttgatttactttctggtagtaatggataactagagagattcagtggaatggccaaaatctcataagtagaatttcattggttttgcactgaatattagatggctttatggctctgaaaaagcagctcttgccggccagtttagcatgtttttcaacagacaaatatttaataattataccttgataatgtataaacaatctttttttttatgttgtgtttattgtttgccttgggatccaagtgaacaaagaaagcaagtcaaggtttatactccatttcactacaaattttagttatctgcaataatcaaacccactgtttctgttatcaacatagcaatctttcatgtcctcatttcccatgtttttttgtttattaatatatatatatatatatatatatatatatatatatatatatatgtatccatactcaaattattccatctatatcgtagtgacactgcaattataatgataaggtgttcattttagagtagtgcaagactattgtaggagaatttaatttgtatgggaatgtgactatgtttgttactcacgagcagattttaaggaagttgtgagataagagattaaaaattaggtagaacttctaggcattgtctgatagtaccattggcagtgccgtctcgatataacctatggcaaaaccaaacaaaaattaaacctcttagtaaaaaaaaaagttaagaaaatttggacttttcttctttaagtgtttttctgaaattaatattggacccttggcatttgcctaccttgcctataggtaataggtggagccgatgctgaccattgggacaccttttacactgcgaattttcccttttgtctccaattgataaattttgttgggaattaacctatgaaattagctaacgaacgtttttttcaggaatgagacaagtcgaaacagtatgtggcagataaggtggaaggaatgagtcaatggtctatggggcacaaatcacaaagacttagagaggataagaagactgataagtttgtaaagatttcccatcagtgttctccaatctccaataactcgtttttgtaacaaacgtctttgagggttatttttctttttttttgatcatttgtctctttcatgaaacccttaattcacgcctcactgactcttccatatgaagaattttgcaagtcaaaaagtccaatggaaatgttgcgtctcctaaaccattgagactgaaaatgcccaattcgttttctatgtcacatttcccaaacactctttcttctggcacaagttactcatgctcctctctattgtaacgattttgattgtgaaattccaagaaaacttataccttaaaaatttataatgaaggcattaaaatttttgaattgtaaaaaaaagataatgaaatcgacaatgtcaagtcaatagagtgtgtgatgggtcaatgtcagagttgacgacagtactagtgttcaccgaaagtcaagagctccacaactgatttttgttattggttctttataaagagagatcagaagccataattataacctatcacaaccacacaaactaaaacttaaaaacaaaagaagtaatgatgataccaagccaatcttattcctttaatggtattgttgttattaccttgtatttcatctccttgttttcgttttttccacacactcttgcttctcctacggcccaccgttgccgccatgatcagagggatgctcttttggagttcaaacacgagtttccgggagcagatatgaacttccggagacttgaaaatatg

SEQ ID NO: 26014 - DNA, 2610 bp, Unknown; identical to SEQ ID NO: 12891
  misc_feature (1)..( 2610): 2750-1469P.txt file - cDNA_ID_2709841; gDNA_ID_2214578; Annot_ID_135221

SEQ ID NO: 26015 - DNA, 3000 bp, Unknown; identical to SEQ ID NO: 12888
  misc_feature (1)..( 3000): 2750-1469P.txt file - cDNA_ID_2709845; gDNA_ID_2214578; Annot_ID_135217

SEQ ID NO: 26016 - DNA, 3000 bp, Unknown; identical to SEQ ID NO: 12876
  misc_feature (1)..( 3000): 2750-1469P.txt file - cDNA_ID_2709845; gDNA_ID_2214578; Annot_ID_186398

SEQ ID NO: 26017 - DNA, 3003 bp, Unknown
  misc_feature (1)..( 3003): 2750-1469P.txt file - cDNA_ID_2709849; gDNA_ID_2214578; Annot_ID_135215
attttcatcacccagttacaaacttgaaaaagaatcacacatcagaatattttaatttttcttttgttttgccataagaatatatatcatgacgataaagaatgtactttttgttctagtaaccatttgtgtagcagtttctgtaaatgctcaactacagcaatatccgattattttctcaaacccgcttccatttctgcgctcgactggtatactaaacctaccagacgtaaaaaaatgtttctcgtccgtgaggaatgttccaggatgcttattagagatctctcaagcttttggagagaaattcggtcacatgatgcccgcttgttgtaaggctttcatggatagcataaaatgcatgccaaatattctatacagtgtacttttccctcctaatttgaaagaacaatgtaatcaggcagggatccactaatttgaaagaacaatgttctgagggatccacgcctagtaaagaggtggtagttgccaccacttaaaaaacagtttttaatataactttactaaatataaataattgccaccgtaacaatttaactctttccatgatcccatttttttaaaaataaaaatatttaagatggccaaaagctcactttactagtattttataaataaaagcgtaatttgtaaactaaatctaacttaactaattaaaactaggcttgggcgtttaatctgaaaccgataatccaaaccggaaaatcggattaaaatccgaatcgcattcaatatccataggtaccagattatacttgatccgatgcaatattcgatatgtatccgaatttgtgtcttttgttgtaccagggacatgtccaagtttgaaaatgtagctaataagaagcttgaggctggcttgttttcactatcttccaaaatttttttactactttcgattgaattctgctacttttttaatttttaggatgttatggtttaccttcgctttaaaactttgatatattggcatcgttttatgtctcactttggtttcccaactctatggtttgctaaggtttcatgttagttcaactagtcatttcagttttgttttgcggttttcggattgtttggattatgtttagattttttgtttaaatcagatattgaatatcacatgcataccgattcaaaatccgaaatatccaaaccgaagtcgaaccacattctataattatttttatagatattaattagaatctatttccaaaaactcgaaatccgaaaacaccaaaccgaattcgattcgataatcaaacgcccagacctaagtaaaaccctacaacttttgaatccaattttttttgtcgttctttctttttcctcctagtttttctccagacgagaactccctggtaagtttttgttctttgttcaattataactgtttatttcaaattttaatcattgttttttcattaatcattctaactgtagaaatctaaggacaagtttgtttcttcttattgtagaggtttagttctcgtgtgatttgatgatactttacacatgtgctaataatgattttgtgtttagttttccaaaataacgttgttgcttcatttcgtttgaatttgtgttggatccgacccaagctcgactcttttactatttaagagatgttatgccacattttaacctaagatttaagataggtttatttcgctgaattgtctaagagtttagaaaggcaatatagacctaagtttttactatttaagcaacgtttgctacattgtcggtgaagatatccccccctctagcaagtagcaacattagtgaaattgttttatgaatccatgtatctttacgcagtcactacgtatgttgtctcatatcgatcgaagtgcatgctttcaatatattcattagtaagtagtcccgatgggaacagtgaatttggtagattagggagattgtgatctatgatgcttagggtagaaatatatgtttctaatttgaatgcacttaaaactagatttgaatttgctaaagatattaaaaattgttatttttgtgtgtcgaaggtgtttgatgcacagtttaggccaatcctaatagtgttcatgatacttggtcaatgagaattgatgattaaggtgagattagtggactaaaatggacctgttgttttcattgccaattgatttcctaatttgcaaatggaagttcagataaattgggtgtttaatagagcaattaaaaccatggaagtaatctaccttatttaattgtttcacccatgatccatagcttatcttatttgctaatctggtttcattattttgtttaatcttattgtttagtagtttcccacttttcctttcgaattgaatgtctctttatttacttgtttacgccatctatccacctagtttaattagtataacatacacttaagtgtgttatagtctaattctttgtggattcgatcacaatattgtgctacaagtgacttaactgtactcttcccgttttacaattcatatttaaaatttgacggacctatagtccactcaatttagctggtattgtaaatgtctacaaaatgaaagtcatgaatacattttcacttcaaagtacgttttttatttgtttgagatgtcaagcacatgtttatttcgttgttttccaaataatatctaggagaggaaggttatcaactatgatctctatctttctagtttgtggtcacgcatgagtgacttcaccggtcatttcataccttcgactttaacatatgacactgtacacgtaccatgttaaaaatgtgtggatagtaaccttttctagaaacccccttatttgatttttgtatatcgaatgacaaatccatgtgatgtgacctaaccataataatacaatgcaaaactaaaacgtgattcggccaaaactatgacaacctaaaaagctagagagtaatatatatagacatacacctgaagagttacgtatagcataataatacatttattcaatatg

SEQ ID NO: 26018 - DNA, 3003 bp, Unknown; identical to SEQ ID NO: 26017
  misc_feature (1)..( 3003): 2750-1469P.txt file - cDNA_ID_2709849; gDNA_ID_2214578; Annot_ID_186396

SEQ ID NO: 26019 - DNA, 3003 bp, Unknown
  misc_feature (1)..( 3003): 2750-1469P.txt file - cDNA_ID_2709853; gDNA_ID_2214578; Annot_ID_135212
tgatattccagattattagatctaaaatactcggagtcaaacgaatcatatcagtaacaaaatacaaaactagtcactacttgcgaatcaatcaaacaaaaataaaacatctaatcatggatgtgtattcacaaataacttaccattacaagtgtgtagtttacaaatgctctgttttgacttaaaatcaaaagtttcgacgatttaattttttttgatgtggtcataaaaagaaacttgaagaaatagagaatgattcttcagatttcttgttaagtgatcgtgaaatactttgattagggtttttgaactgcacaaaaaattctaacagagacaaaaggattgaaatcctctatgaaaaaacattatgttttaaaagagttgatttttcttttacgggcaacccacaatctgcgacgagtttatccacatgaatttgtgatctacgatggatctatccatgaagcccactaatttatatacaaaaaaaccaacgtccaatccgcctcgacagaactaacccaacagattttaatgcctaaaacatatttaagtttatttaaaattgttaagcatttttaaatctatttctaattaaaagtcacaaaaaacaaagctaaaattctaaccgttcactaataagacattaatctatgaaataaccactagattacgaaacattttcgaaatttgttaccttttacaactatctataaatttgtgtgcctaaagcatggacttcagccgctttagccaagggcagagctgaaattttcgttcatcaatttacattctagaaagaagtccaggacacaataatggttgagtcatgactcatgaggtggccagtagaactgttcccttctttgatgtgtttgtgtcacgttgataacgggtggacattttattggttttgtgagataaattgttgaaaatcgtagcgaagcaagttgatagggttcaatcatatctcgtattatctactatatataaaacattgtagaaaagtaaaatattttcatttaaaatattataaaacagagaagaaaacttatactatttgaccaaggaaaaaaactacctactcacgacacgaccatcacgtttataatgttaatacacagttacaccatacattttttcattgtagttctatacaataatatatcatcgtttgatctaacaagtattcgatagatagtgggaacttttttttcccttttggccttatatttaagaacatggagcctgtgtttctaaaattctatctaaaaaagtatattttgtattgatcatatctgaaattgcatatattgtaaaatattgtgtacaaaaggatccggtccaagattaaacacacaatacttactgagactaaaaggggctaaaccacaagaacaaatccttgaaattgcaatggttaaacttacaaaaaatatgtctcttattaccagatcttaatattgtttaccgaatttctgaactaaactacattttttgcccaaacaaacaaagaactaaactatatttattcaagtcaagtcaaataattgcatgcaggagacaacgcaaaaagatgaaaaaactaaaaattcagagatgaacatcgagaacacaaataacattatccaaatctcattaggatcctattaaccaaccacaaaaacgtccacttcataatggtctaatagtacaatttgtttttatgtagaagtaaaagtgaagttcgaatattcttacattgatttcaatcatattttgctactatagattaacatgtatacatcagcatacacatggtccaacgattgagtctatactgcacaaaactctggagatgaatctaaactttggttcgaaattccggcaatgtatggaaaagaatattcaaaaaaataagaagaagcatattgaccgtttcttgttcaatatactagaaggtaaacgtcaaaaatgtcagcatgttttctttcaaaaacaaaaaaaaaaatgtcagcatgtggtcagaactcagaagttcttaccaagaaaacttaactaacagttaccatttagaccctaaattacttatgttgtatttttgtccgaaaactttgattaaaaaaataaaggtgtaagacgatgaaaaagaacaaaaaattatattgtcactgtatctttcaaaatcattctaaaatgatagacatgtatcttagcgcctccaaacttttccactctatgaaaagttgttcttcgttttttttttttttttttttttttttgtcaattgttcttcgtttttgaacttctattttgcttcgttttgatatttttatgttttcgtttatatttttgaatttttctttctttcgtttgagttgaagaaaaaacagttgttattatgtaagaatttaaataacaatttcaaaaaggaatattttttttggtcttactaaacgtctgaccggcatgtttgaaatatttcagtttcttgttgcttcttgatttaaccatccgaatctatctaaaccaactaaccaagtgattgaacaagaactaaaccgatttttctttgatttgatctgaatccttaagtagtaaagtccaaaacagcaaatactaaaactgaacacaaactggagccgaactgaatcccgaaggaacaggtgttacctattccgacaacgataaatctcctatttttgggatgttttatctattgaaaagttgttgaatgaggatggtctaatgatttttccggtctctccttacaaattacacttttatggttcaatccactcttaaaaaataattgaagtcaagattttcagcctgtggtcggaaagtccttacacgaaactgaagtatgatataaatttatctttagcatatggtcgaaaagtctttacaataaacttagttaaatagtagtaaacatatacactagctacacgtatttcatctttattatggtcacacatactacacaaccaacaaaaactacaagacgataacaacaaaatg

SEQ ID NO: 26020 - DNA, 3000 bp, Unknown; identical to SEQ ID NO: 12897
  misc_feature (1)..( 3000): 2750-1469P.txt file - cDNA_ID_2709857; gDNA_ID_2214579; Annot_ID_135235

SEQ ID NO: 26021 - DNA, 3000 bp, Unknown; identical to SEQ ID NO: 12897
  misc_feature (1)..( 3000): 2750-1469P.txt file - cDNA_ID_2709857; gDNA_ID_2214579; Annot_ID_186431

SEQ ID NO: 26022 - DNA, 3000 bp, Unknown; identical to SEQ ID NO: 12896
  misc_feature (1)..( 3000): 2750-1469P.txt file - cDNA_ID_2709885; gDNA_ID_2214579; Annot_ID_135233

SEQ ID NO: 26023 - DNA, 3000 bp, Unknown; identical to SEQ ID NO: 12896
  misc_feature (1)..( 3000): 2750-1469P.txt file - cDNA_ID_2709885; gDNA_ID_2214579; Annot_ID_186429

SEQ ID NO: 26024 - DNA, 1440 bp, Unknown; identical to SEQ ID NO: 12912
  misc_feature (1)..( 1440): 2750-1469P.txt file - cDNA_ID_2709897; gDNA_ID_2214580; Annot_ID_135259

SEQ ID NO: 26025 - DNA, 3000 bp, Unknown; identical to SEQ ID NO: 12911
  misc_feature (1)..( 3000): 2750-1469P.txt file - cDNA_ID_2709909; gDNA_ID_2214580; Annot_ID_135252

SEQ ID NO: 26026 - DNA, 3003 bp, Unknown
  misc_feature (1)..( 3003): 2750-1469P.txt file - cDNA_ID_2709917; gDNA_ID_2214580; Annot_ID_135250
ttataatggatttaacaaaaaaaagaatagtttataatggagtcttgagagagttatttgaattattttgggaatttacaaaattgttggataaaaaaagtagttacaagaaaaaggaaaatatttacaagtgtgtttctaattttttcctactagaaagacaactagataagatcatttcaatagtcttctattcactaattatggacaagtaaaaattaaaagatttgttacaccatctctatcttacatttctctatttatagattcacatacccaatgtaaaaacaaatctcttgcctatataactctagacataattcattatattacaacaaacaaagattcaataatcaaaagaaaaatttagaatgacaagtaaatatttctccgtactagtgttcatcatcttggcttccaatgaagttgttgccaagagacactcttcaacacctaaattaagaaaaactgatttcccagaagatttcattttcggagctgcaacctctgcgtaccaagttgaaggagctgctcaggaagatggtagaggacctagtatatgggatacgttttctgaaaaatacccagaaaagataaaagatggtagcaacggatctattgcagatgactcttaccatctttacaaggaggatgtgggtttattgcatcaaattgggttcaatgcctatagattctccatctcgtggtcgcgtattttgcctcgtgggaatcttaaaggaggaatcaaccaagctggtattgactattacaacaacttgatcaatgagcttttgtctaaaggaattaagcctttcgcaaccattttccattgggacacaccacaagaccttgaagatgcttacggaggattccgtggggcagaaattgttaatgattttcgcgactatgccgatatttgtttcaagagctttggagatcgagtgaaacattggattacattgaacgagccattaacagtggtgcaacaaggatatgttgcaggtgttatggctccaggaaggtgttcaaaatttacaaaccctaactgcaccgccgggaatggagccaccgagccttatatcgttggtcacaaccttatcctagctcacggagaagcaatcaaagtctatagaaaaaagtataaggcttctcaaaaaggtcaagtcggtatagctttgaatgcaggttggaacttaccttatacagaatcagctgaggataggttagccgcggcacgagccatggctttcacattcgactatttcatggagccgctcgtgaccggtaaatacccggttgacatggttaacaacgtaaaaggcggtcgcttgcctacatttacttcaaaacaatctaacatgcttaagggatcatatgatttcattggcatcaattattactcgtcttcttatgcaaaagatgttccttgctcaagcgaaaacgttacaatgttctctgatccttgtgctagcgtcacaggcgaaagagatggagttcccattggtccaaaagctgcatcagattgacttttgatatatccaaagggaattcgtgatcttatcctctatgcaaaatacaagttcaaagaccctgtcatgtacataacagaaaatgggagagatgaagctagcactggtaaaatcttacttaaagatggcgatagaatcgattactacgctcgacatctcaagatggttcaagacgctatcttgattggagcaaacgttaagggcttttttgcatggtcgttgctagataactttgaatgggcatcggggtacacggtcaggtttggacttgtttacgtggatttcaacgatagacgtaagagatatcttaagaaatcggctcactggttcagacatttattgaatggaaaaaaggagaattgatgagatatgcaacattccaatatattaactaactagattaatacatgcacaatggtttgtttggaaaacaactattgttaatatacaaataaggtttgattttactgtattatatcaaacttaaatctcaaaaatagtggtttcaatgtaaaacttgtgcacactaaattaaatggaatagtatgcatttaaataaaaaaatcaagaattttcattcttatttcggccttctaaaattaattaattagttaaattagtttgtgattttattttgttgtggttgtcactagtggtaaattattaataatttaaaaatctaatattttcaataaaaattaatgatctatttttaatattaaataaaaatagttaaaattatagaaatttagttcatattgatatctctctaattcatttggaaaaatatttttagcacagacaacagtttatgcctgcatcattacaacaattttttttactattttctcataattttttaatactatttgagttataattgaaaagctaattacggttaaggagcagctatagataacgaattaatagattagagaggttaattatagagtcgtcacatctctctcacatgcctctctaagttccctttagggttttcttcttcactatagagactcatgctcttctcttcccaatcgccgcctctgatctctcttcctcgcttctcagattaggtattagacattcactctttcttacattgttataacattgatgaagtagaagcttagattcatatcattgccattggtcacgattaatcatctctttcactaaatcatcaattgtttcaatgagaaccaataacagctgaatcaatgtcgatacatttgttgttacgaaatcttttgaatcttcactgaatccgctttgtcatttttcttttgcagcctttgttttgttagattgatttgttatgtccaacaatctattgcctcagccttgtatgcaaatgggtcaattcattaatgtccctactcccactcctgagctgatttctaatccggaaatgagattgtcacaaccaatctgtagtcatatctctggtgggagacaagattttcatgtaatg

SEQ ID NO: 26027 - DNA, 3000 bp, Unknown; identical to SEQ ID NO: 12909
  misc_feature (1)..( 3000): 2750-1469P.txt file - cDNA_ID_2709921; gDNA_ID_2214580; Annot_ID_135248

SEQ ID NO: 26028 - DNA, 3000 bp, Unknown; identical to SEQ ID NO: 12909
  misc_feature (1)..( 3000): 2750-1469P.txt file - cDNA_ID_2709921; gDNA_ID_2214580; Annot_ID_186458

SEQ ID NO: 26029 - DNA, 3003 bp, Unknown
  misc_feature (1)..( 3003): 2750-1469P.txt file - cDNA_ID_2709947; gDNA_ID_2214581; Annot_ID_135272
atctctgggagtaccggatttagcaagaacctcaagatcaacgagactcatagacataagacccaaagtaagaccagacattagtccagcgaacaagactagtaacactatcacagcgatgtgtatgaagaagctggtcccgcagcattcatattccaccgccatagttataagaaacctagaaatcgaaactctaatcttacgtcagagcttcgacatctacgagaatcaaaaccacgtacggacaaaatccaccgtttcgaaacttagaaagacagtgaaaatcaaatcagattgcacaaaattttttttgaggaagattgtgttttgtgtgagtgtgacacgagagatacgaaaatcaaaatggagagtgatttttagtgtgagtggagagacgaaaaggtgatgaagaagaagacattaaaacaaattttgcttgatgaagctggaggagatggtttacgtggcgaaagactgtaatgtccacgggatgttattgcaaacgtgttttcggtgaagggtgttttcgtcatttagttgatttatcagtttgattattattagcaatgattattcgactttttggtagttagagttttgatatttgggttcgagtattaatggtataatgtggaaaggttatgatgtgattttatgggaataattgttaccaaaaaggtacgagacctatatgatgtttagaaattataaaactgagaattttaagggcttgattggtttatccgctaacaactgtctagtagttgttagcggtcggttgtggttgttagcggtcagttgtggttgttaacggttggtactaatcatagaaactgttccatatcgtttcgaaccgttcgaaatcgctggatttcaaaagctctttcccgcaagcgtttgcggttgtgggcggttacggttaatttaaaaaaggaaagaaactaaaaaagaaaaataatcaaattaaattatatatattatcaagtcttatatatattcacattaattctaaaaaaaataattatctaactttaaattttcaatattaataattatttttgttttcaacgtaaaatttatttgaataattatttatagttttaaatcattaattatgtttaaaaatttatactttttcataattctagtttttggtgtttaaattttttttttaaatcatatattaattttttttggtaaattttggtttaaccgctatcgtacccgctgatcaaccagtcgtaaatcttctgcaaacgcacatgttttcaaccgctaaaccaatcggtcaaaacgctaaataacgcttgaaaccgcaattgcccatttccgcaaactcccacaaccgctgcgtttaaacgagtcaagcccttaatgtttctgtggcaatttctttgttggttggtacacgcatgtcaattaattggactaatccaatacggccggacttgcaggttcaacatgattcactccgtaccggttttttttcttaaacacaaatgaaaagcgaaaccatttgcatctgtgataatgagattgtaactttgtaagacacattcaagaacctattttctgcaactaaggaataaaaagcaaatcacttggacactaaacacactcttcaatcgtaggcagaacagactttcataggcctcttagcagagcacaaaataagctaaccatcagagtgttataagtgaaatgatgcctattgtattaatgtcaaaacacactgaatcatacaacaaaaccaaataacccacaatcactagagattcaccacattaagccttctcacaagtcaattcatcaaagtagtagtaatagtaagagcatagaggcccgattcagttaattattggacatatttctcaatagtttgaaaaaaaatatatataaacagaatttaaattttttgggttttttctaatttgtttcaatacaaattagcctaaatactgaagaaaaatgtcaaaattatattggaccctattcaaagttccaattgcacagcccaataatcgggcctgagcgcacaaacaaaatcataaaaaagaaggactgtactaagaacatcatcagcccactcaatctttccccaaatctcttgagtacttcgtctttcaagcgcaatcacaacacactaaatcattttgtttctacatgaaggaacgcacttatcccacaaaagagtcatctttccactataatctaccaatctaacacaaccatcatcgtcaaacactggcagaccttcctaacccttcaaagattcccagtatcttgttttagagttgaagcattggatttttggtaaatcaatacaacgatataacacattttgtataccatagcaagaaagtaagttccatcatgtttccaaataatgcagcattcctatagctttccatctatcttcttttgccttgtaagccacgcgattttgcacaaccacatacttttgtcctttaatcactatcctcttcgagatcagagttttgtatttctcttcaaaagggtacaacatatgctcccaagtttggagttttggatccgaaacgttagcctaattggtggaattgaagagtctgaaacatcttgctacaaatatttctccatgactaatattggcagatgggtaatattgctttacccacacattaggagcttcacgccacgtgttagatcggtagtctgattcaccgtccggatcggatttaaaaacattagttttaaatttgtcggatattaatactaaactcaaactaaaaatggatcacgggttaaccggtcagaccgaacgatctggatcgagcatgaaaacactggtctattggaaagctagtgttttttttattcaaaacatttttaaaaattgaggacttctttttgacattttccggaaatatataataaaattaaatcagttaatcaaataactcaagtagccaaaatccaaaatctccgccatggctgagagcttctgagagagacacagccatg

SEQ ID NO: 26030 - DNA, 3003 bp, Unknown; identical to SEQ ID NO: 26029
  misc_feature (1)..( 3003): 2750-1469P.txt file - cDNA_ID_2709947; gDNA_ID_2214581; Annot_ID_186503

SEQ ID NO: 26031 - DNA, 3003 bp, Unknown
  misc_feature (1)..( 3003): 2750-1469P.txt file - cDNA_ID_2709959; gDNA_ID_2214581; Annot_ID_135275
cagaataagataatagggagtagactttagcgttgagccttaaatatttgaatatgacatagaattctaaacatattagtgacttgcaaacaactttttgaaaacccaaatagtatttcatttgaaaatttctacacctagcactcaaaactttaattaaatattaaataggttcttaaaagtgggggcttactttctttactcattttacactctccattatgtgttactcattttacactctccattatgtgttatacaggcgattttaggaaggaaaaagagagagtttaaaatgtaatgaaaatagtgtttcatgcgtgtatgtattttctaccgtcttgtttatgtttgatttgtgaacatatatatgccgtcacgtttgtaagaaaacttgtaacatgaaaaaatatcagacatatttatctacaagatagcaacatgaagagtggaacaaaaaaaatgatagcaacagccttctttaataatctacggtaaatccatgaaggaagaaaacaaagatatcttgacttgttaactaaaaaagtctttgggaccaaccaataatttcatgtttatctttcttgctacttggaggtgttatggaataatcaaagctgcttccttattgatataggttaaattaggcaaatatgacatatttattagttttaaaaaattacttagatgtaattatactaaaataattagatgctattttttggaaatttttacaaaatcaagattacacagtcaattattaaaaaatatatagtcatgaagaatgttatatagtcttttaatgattttgcatgtatctctcccacttgctttacatatgacgtcatgtttaaaacgtaggccgaaccagtaacatcggatactatcagacacacattcatatctatggccagagatgacctgaccattatccatgatgcaatataataaaacaaagctatcttgacttgtttactaaaacaattcttaagacttatatataattccatggttatctttactggcttcatgcaaggattatggaataatcaaaacagctgcttattgaatgaggttggttaaattaaattacgaaaatatgacacatcattataaaagtctaagagctcatttgtttcaaatttggaaaaccatatacatcatctatattcaacatcctatatattgtttaaaactttaaactcgttcttttttttcaattttttattttttataattcggatgatttggttcaacagattttatgatctctgaaccagagcacgaagatttctttttctagctggttcttgggtcaatggaccatgagaactgactaatcccaggacgaggggaagccatgtgaaaacctctaacactcacacatttgtggagtagtttttagggtagatcaaactttggatagctcattacaactttttttagtctgatcactaccactagaccaagcttgtgtgggcaaaaagacttcgttctcaagggcggacctagtaaagaagaagggggtcacttgacccaagttgaatagtcaaattttattttttgcatagaattttgtttagaattagcagaacaattggtaaattccaaggtgttgacacccccaaaacatgagttcaaatctctataatgacacttttactcttttctcctcaatttagttttaaataaatgttttttttgtcttatatatttctttactttttccaaaataacagcaattaatatactatttttatttccttatgaaattgattttatttttgtgagtttgtataaatattataagaaagttagttataaaatactgtttataaattttttttgaccccggtaaaatttatttatgggtccgctactgctcgttcttgcctataaatgtaaattttgtttctatttgagtatgcagaaaaatacaagtactatatatataaaacactcgttttttaagtcatgtaaattatcattaatgaatgaaggaatttgtaagttaccaaaaaattgcttaaccagcgaaggggataaaccttgccaaaaaagaataaagaacaaggatatattttgcatgtcagagattaggtattaccgtattagcaagccaaagctgcattagggaaatcccaataaggtttttacgttcatgatttcttgcacgactatgatctcgtcaatatggaattatacaacgtctgctatttgaatatggctgccttaggctctctcaaatcttatctatactgcatattcgattggacgaaatggaactatgattatttgccaattttgtccatacatcaatattttcaaagtattccctggaattgtttcttattggtgttaagattttgtcattgttgaagtacttttgatgttatttttatacgtaattaatttaaatgaagtgaaaaacaagaaatgaaacttttttgtttttattcaattgtttcttttgttagtttttctatttctaaaatcttatttttcatactttggaatattttttagtttttttgttcatcaaatatcctataatttatttaaactttttaacctaatgtaataatacaaaataaattagacggtatgctgttgtaaatgttacagaattcagatcaaatttaatcaactatttttaaaaaattaacaagtaagtcatgaagaacatatagtctttttatgtttaatgcatgtatctactatctctcccacctgctttatatatgacgccacgtctatgacgtaggtcaaaacagtaacattagatactatactatcagacacacattcatatggccagagatgaccaaccactggagatgctctaagaaatttatcctcgtaggcttttctcttttaaaagtcaacatattggagccagatgtttattttataaatactaagaaccacaccaaagaaaaaacatttcaaagcaaaacaaaagagagagagtgtatccatttttggaggggaaaacaaagtatg

SEQ ID NO: 26032 - DNA, 3003 bp, Unknown
  misc_feature (1)..( 3003): 2750-1469P.txt file - cDNA_ID_2709979; gDNA_ID_2214582; Annot_ID_135281
agactagaaagagaaagaaagagagagagagagagagagagaaccagagattatcgaacacgaagcagaagacgattcgtggaagagacttggagagaatatttctcaatgtctcctctcccaatcttccatcgtcttcctcacgccacgttctcttcctttctcctctcactggttcgttccctccattgacgaatgttgcattttgcttgttacctacgactgcttttgattctctttctccatttgggtttcttccgattactttaatacttcttcaatttggacttgtcgtcaacattttcttgctaaagtatggattttttgttgttgggttactgttcagtttgactttgatttcagagaacccattctttgttgttcttgcgtgctacattgcttttagatctgattcactaaatccgttaaaataccaaatctttatcgtgtttgtctttttgtcctctaagagcattaaaacttggtgtttttcttgtcctctagttctgggttctctaatcgttttctcttttacttgtcattgtagtctcaagctggaagttctaaaacatcagtggcattcctcaatgccttcaaatcagaagatatcattgctcgaattggactatggtggcagcttataagggctgttgtagttgtacctgtcttcaagttcctggtgcttctatgtttggtcatgtctgtcatgttcttcgttgaggttatgtacatgggaatcgttgttttgtatgtcaagctgttcaagagaaagccagagaaattttacaaatgggaagccatggaggatgatgttgagtgtggcagtgcaagctaccctatggttcttgtgcagatacctatgtacaatgaaaaagaggtagttactgaaccagcaactatttttccagtgattggtttgtagttgaacttatttggtgggatgttaatgtttgtggtaggtttgtgagcaatctattgcagctgcttgcaaaatctcatggccatcgaatcgtataataattcaagtgcttgatgattccacggatccagccagtaaggtccttgtttaacctctatagacacttgtccctttctcgtctaaatccctctgttttagactcatgattgtgttgtgttaaagtgagttccttaacatttgattatgtggcaatgatggaaggaaacaggagttggtgaaaaaggagtgtgacagatggtctaaagaaggtgtcaacataacgtttgagataagggacaacaggaacggatacaaagctggtgcgttgagagaaggaatgaggcatagctatgtgaagcagtgtgattatgttgctatctttgatgctgatttccagcctgatcctgacttcctccaccgcactgttccattcttaattcacaatcccaagttagcacttgtacaaggccggtgggagtttggtaacattccttagttacctttcttttctttttccatcataagtttatagattgtacatgctttgagatttttctttgcaaacaatctcagtgaacgcgggtcaatgcatgatgacgagattacaggagatgtctctaagttaccactttacaatagagcagcaagttggatcttcaacatttgccttctttgggttcaacggtatagcattctcaattttcttttcttttctctccataaagctttttcttattctctgaaactattgcaggaactgctggcgtctggagaatctcagcattgaatgagtccgggggatggaatgaccagacaacagtagaagacatggatttagctgtacgagctacactgagaggctggaagtttctatatatcgatgatctcaaggtatgtatagaagattcctctcttttcttggaatcttggattttgcatttgaatcattaatgcgttatctgtaggtaaaaagtgagttaccttgttccttcaaagctctgcgtagccagcagcatcgatggacttgcggccctgccaatcttttaaggaaaatggctggacaaataataagaagcgagaatgtatctctatggaagaagtggtatatgttgtacagcttcttcttcatgcgcaagatcgtggctcacatcctcacattctgcttctactgtgttatcttgccagcaactgtattgttcccagaagtcacagttccgaaatgggctgcattttatctcccttctttgatcactctcttaatcgcaattggtagactaagatcaatccaccttttggctttctgggttctatttgagaatgcaatgtccctgctaagagcaaaggctctggtcatgggcttgttcgaaacaggaagagtacaagaatgggttgtgacggagaagttaggtgatactctcaagacgaagctgattccacaagttcctaacgtcagattcagagagaggtaagttagacatttcgtattaggcctcctttacttaaccgagtttgagcttaaaccattgtgttgcaatcagggtgcatttgctggagctattggttggagcgtacctgttattctgcggaatctacgacatcgtctatgggaagaacacactctatgtgtaccttctgtttcagtcagtggccttcttcgttgttggttttggatttgtaggaaaatatgttcctgcttcctcttacttagcataggatagatcatagagtctcaatatgtttcagaaggttttttgtttgatgtcatattgagaacaatgcctatatactactctccatttgtattaacacttgagtatctgtaaccaacgaagctcagatgtgatcgatattatttttttaacagtataaaaccacttaacacttatttagtttgttgacctcgtggcttcatattgactacagaatgaaataggtaaactataaagtctacactatttatggctgaaatttatttgaatacatatccaccacttgtcttgttcttgaaacacacggtcgtggccatgtctgttctgcttccgatg

SEQ ID NO: 26033 - DNA, 3000 bp, Unknown
  misc_feature (1)..( 3000): 2750-1469P.txt file - cDNA_ID_2709986; gDNA_ID_2214582; Annot_ID_135283
acttcagccattcccctacaaaccgaaatgcatatgcagatgccagcagaggaaacaacctgttctgctgagttttataattaatcacctgccaattataacaacatcaataactggtctctatgtttatggtcatgactgatgaccatattctatctagagattggattcttacttaactaagttacagaaaacatttttgccccatagttatgaatagtgagatttgttgaatacctgtgtctcaatgccaccatcatgtgagccaaactgccttcgaacagcactgtacctagtagcaatgcaaactgcccgagccagcgcggtggaagcatttgacacaatagactgtctcacatacaccatagtaccatacaccaattgccttggaacatctgatgctacatattttccttctcttgtaacttttgacagtctataagaagaaaaatgcacaaccataaatctgtttctcttagggatattaaatgataaaatgcttttattcatagaaagggccaaagagagaggacctcatgagcatttgatctctaggaatgcgaaaatgatcaaacataagaaaaccattgtccattgagttatatgccccgtttccaaacttcattccgatatcaccaacggttatacccggaagaggagaatgatcatccaaactacgcagctgcacgatgaatcctgaaaaacagaaaaatcttgttactcaatactactgatgattattaaaaaaatgaataagaaatcgttctagtgccttaccatgtacaccatggtctttgccattggttattagacgagcataaataacagcatgagtagaaacttttcctaacccaccaggccaccactaatgtttcaaacaaaacaaaatcaagacacaatttaaacactcagagatcaaaatagataactgtctatacttcttccccttactttggatgatgtctgagttggactgtgaatgataaactgatctgtctttggatcaaaagtagcggttgtctcaaggccttgaacattagagccatgaccaagctcagtttgagcataacatccaattatctgcatcttagtagctaaagacaaccacttttgttgttgttgctctgtgccttgtcctttaattgcaggcacaaacattccctatccaccacaaaaccaattcaacaccaaaattctaattaaaccacccaagggaaattgtaaattttgtgttatacccaatgcagatccaagaagcctggttgatccatgaaagatctcaatttgagtccttcctcatctgagagacgaagctcgttaatcaacttccaagcgtgaacacttttcctcaacgtgttcttgaacaactctttcctactcatcacagctcttttgcttttctcaaagaccttaacatggcaaaagtttcgaaattcacatcggaaatgtcgccggaaaaacagagaaaggaggaaggagaaatcttaccggatcattagcgacgaggcgagacatacgatttgaaacatcgaaagcgtggcgggaaccggcccagacgatcttcatatcgtcgacgttgaactctgctttgttcctctcatcggcaaggtgatcaactctctccattgttctctctattgtctcagattctcgagtgtgtgtgaaaaattggataaatcaaagaaagagaagccactaaaaaagctcttacctttgggtgattcaataagaaagaattcgttacagaaaaaacagaggattttgttctatttttaggattacaagtttgaacagaaagagagactaatgtaataaaggtaacaaaaaaattggtaatagaaagttccaagtatttatcatttatatcggattctaatgaaagacgtgataagatttggtttaaaactaatcaagctctctctaatcatctacacatcatagttgccattagcccattagcccattactacactctcgtgggctgtagataatttgctcagctacttttgatttttttttgttgactttagtaaatcactccaatataataaagcctatttgcagtaatttctattttgtagcctagttgtaaattctttttactcgaaagtattacccaggactagttttgtttgttttgaatttaatattttagaggacttagatactttttcttaagctcaaagagaactttatttttggctcaagaagtcttgaattttaacaattaaaaacataattttcttttcatttcaaatatgggtaaattaattgttcttttaaaaaacttaaattaatttgatacttaaaaattaaagaaaggatcttatccaaaacaaaaaaaagagttaaagaaaggataatcctaatattatccgggccttgtgcgacgcatgactctttctccataaatcggcaaaacacgtgtcaacagagcattgactttcacataaaagctacaataagaggtgaaacgcttgtcagtttagcaaaaaccctctcattgaaaacactgagatccttctttttttggttctcctctcttaaagagaaaacctaaaggttgagtagagattaggcaaaaacaaaattctcgatccccaaatttcgaaaacttgttcttagggcgattcttctctttggtcatttggcgaatttgatttatatccatcggtgatcggatttttttcagtcttctccgtctcgtcgttaccggcgtttgatcggatcatcgttttgtttcaggcgaaatatggtggtgatctccctgaagattttgaattcaaaatttcttcggttgcttcctcttgactttatcgcgatttcgattacgtgtagactttcttcttggctttgtcttcgaatcaattaggattgtgaataatcgtgtctgtgtatataagactggtgattgattattagggcatcggttggcaggagaatagattgtttttttttttggtgtgtgttggatctttagatctttgactgaggaatatg

SEQ ID NO: 26034 - DNA, 3003 bp, Unknown
  misc_feature (1)..( 3003): 2750-1469P.txt file - cDNA_ID_2709990; gDNA_ID_2214582; Annot_ID_135284
ctcgccagcagactcacctgcattcattcttcgccatcatcatcagtagacagaaatgtcgacgcttatgcctcccatggaaagatttttcccagaaagcttttggtcctcacgcaagcccagccacagacacgatatcctcgccatcgcagcctgccccaccactttcaccctgtacaccatgctcagatctgcagctgccgcccatagctcattcccattaactttcactgacctccgtgaccgtgagtcatcatcattatagccctctagatccgagtgggtgactacaaccattgacccatcatcaaacaccactacattcccagaacaaacctgcttcacatttctcgggatcaaagctgaagttgcatcagttaagcaactctgagtattcagcaccttgacatggtagtactcaacaacggcctgcaaatacatcaacaatcagaagaagaagaataaatgactaaactctggttcatcggtgatgaagaatgggacccctgtcagataccttccattgggctgctgctaaaagaaccctgggcctgattgatctcacgtaggaatatgctgcttcaggtgtcatgtttttgtgttgaacctgtgttgaaaaggtatgatcagagaaaaggagaaaaagtgtctctgctcaaaatgtttttctgggatttattgcaatacaaaccaagtagcatatgacaatagttgtgctgcgaccccgacccgctttgcagtgaacataagtcgtctttccaagcgaagcatttccttcaaggagacaaaatagaatttgagatcaaatgaacgcgggttcggacaacagtaagctttttaataatggtcagtggcaaaaaacgtaaaagaataaaatgagaaggtacacttactatggataaattctacagcttggcatattgcttccatggaaggagcaaaacaataatctcttgtagcaatcaccaggtggtcaatgcagtaagacttccataagagtaagaaaattaaatgggccgggtcagtacatagaagaaaccaaaagacagaacggccacattaaataactcactttgtagagagacgatggaaccaaagtttcatatggctcattcagagtgatcactccacaaacaccgagctctttcagctgtggaacatcagatggaaatggaacagctcccagtaatataaactgcagaaaccaaagagagagagaagcataagcaaaagacccagaaccaaatccagaaaacatacttagaggagtatctacaagagatacaacaacaaatgaagacgattttacacaaaccatcaaaagcagcacaatctacatgatcaatgtatcaatttccactaaaacagctcaaaggacaatcaagattttacctcagccacgcgatcccaccagcgaaactcagattcgagcttattcctaacaacgttgtaaaccagagtaggataaaacaaagcacgagcaccaacaccaacgagtgccctctttgtagtcaacacaatcacgtttcctctgctcaccaataccgccttatctccatcatcaacgttatcctcaaccgatctctccctcttctcctcatccgtttccgtcagttctttgatatacatattcctcagtcaaagatctaaagatccaacacacaccaaaaaaaaaaacaatctattctcctgccaaccgatgccctaataatcaatcaccagtcttatatacacagacacgattattcacaatcctaattgattcgaagacaaagccaagaagaaagtctacacgtaatcgaaatcgcgataaagtcaagaggaagcaaccgaagaaattttgaattcaaaatcttcagggagatcaccaccatatttcgcctgaaacaaaacgatgatccgatcaaacgccggtaacgacgagacggagaagactgaaaaaaatccgatcaccgatggatataaatcaaattcgccaaatgaccaaagagaagaatcgccctaagaacaagttttcgaaatttggggatcgagaattttgtttttgcctaatctctactcaacctttaggttttctctttaagagaggagaaccaaaaaaagaaggatctcagtgttttcaatgagagggtttttgctaaactgacaagcgtttcacctcttattgtagcttttatgtgaaagtcaatgctctgttgacacgtgttttgccgatttatggagaaagagtcatgcgtcgcacaaggcccggataatattaggattatcctttctttaactcttttttttgttttggataagatcctttctttaatttttaagtatcaaattaatttaagttttttaaaagaacaattaatttacccatatttgaaatgaaaagaaaattatgtttttaattgttaaaattcaagacttcttgagccaaaaataaagttctctttgagcttaagaaaaagtatctaagtcctctaaaatattaaattcaaaacaaacaaaactagtcctgggtaatactttcgagtaaaaagaatttacaactaggctacaaaatagaaattactgcaaataggctttattatattggagtgatttactaaagtcaacaaaaaaaaatcaaaagtagctgagcaaattatctacagcccacgagagtgtagtaatgggctaatgggctaatggcaactatgatgtgtagatgattagagagagcttgattagttttaaaccaaatcttatcacgtctttcattagaatccgatataaatgataaatacttggaactttctattaccaatttttttgttacctttattacattagtctctctttctgttcaaacttgtaatcctaaaaatagaacaaaatcctctgttttttctgtaacgaattctttcttattgaatcacccaaaggtaagagcttttttagtggcttctctttctttgatttatccaatttttcacacacactcgagaatctgagacaatagagagaacaatg

SEQ ID NO: 26035 - DNA, 3003 bp, Unknown; identical to SEQ ID NO: 26034
  misc_feature (1)..( 3003): 2750-1469P.txt file - cDNA_ID_2709990; gDNA_ID_2214582; Annot_ID_186527

SEQ ID NO: 26036 - DNA, 901 bp, Unknown; identical to SEQ ID NO: 12946
  misc_feature (1)..( 901): 2750-1469P.txt file - cDNA_ID_2709998; gDNA_ID_2214583; Annot_ID_135292

SEQ ID NO: 26037 - DNA, 901 bp, Unknown; identical to SEQ ID NO: 12946
  misc_feature (1)..( 901): 2750-1469P.txt file - cDNA_ID_2709998; gDNA_ID_2214583; Annot_ID_186548

SEQ ID NO: 26038 - DNA, 3000 bp, Unknown
  misc_feature (1)..( 3000): 2750-1469P.txt file - cDNA_ID_2710001; gDNA_ID_2214583; Annot_ID_135299
taatttaatgatttgatgtgcgtcgtttgtcttatatttagcctgatattgtgaaaaagaataaattattcctcaaacttatctatatatatagcaaaccaatataatattatatcgttaaaaattgttatatagacgattaataagcttaatgaatatgattaattgaaactttgacaattttgaattatatatttttagttattattagaacacagaagaaccatgatgcgtaatataggtcattattatgcgttaagtttcatgtgtcgtgatgaaagaaaatcctttttgggtgactaaagaggaaagattctaaatcggtggctaaaatgtaattatgatggttgaaccattaaaacaattcatatcgacacatttgcaggaaggtttcatattcgataattctaacttcttctttcttatgcacccgattagtctaacttacaataatagttttatctagaaattcattgaacctttatggtgcatttagtttatatgtctatgttattatacctactcaaccatgaagattgtttgttttcgtatttttctacgatctgatttgacaattagacttacaaaattatcaactaaatagaagctttgttcaaaaaatcggatagagtccgcagcgattttgtccaaatcagaaagattaatcgtttatccgatttttgtccgtatagatccgctagacccgcttaatatatatatatatatatatatatatatatatatataagttttatattaaaatatccaacttatattcgtaatttatatgaaaaattataaatttgaacctaaaaccttattttcatatgtctaatattattttaaaaataatattatataaatttcttaattataatggattaatatgttttaaaaatattaaacaaccctaaaactaatccacgattaatccccctataatctcctattttcctgctagacgctatgtccactctcaccacccgagtagcacctagcgattttttgaacaaggaatagaagtaatgagaacattaaattgtttatcaatttgaagtaaccacattaggttttagtttaagtgaactaaaggcatcggtaggtcctatttttgtgtcgtattgtatgttccatgcatgatgcatggggctatatatatcgtagtcaaacaagaacctaatataatcaaattcgacccatgaggttggtatataatagggagcaaaaatatgaatcttcttggattaaaaaccggtccaaaccacgccttatacattaggagttttatattgaataaaacgatcggattacttgtaatatatgcaacgactgcatcactctcaggtaagaaaaaaacgtagatacatcgaacatacatcaaacgcagacgcgttcactaaccgcgattcaaacacgcacttgatcgatctaggacataggttaggaggcgtcgactcacgtgaccatgtctcttccaaagtcaacataaatgtgccgcgtaaggatagagactacttttgttgttgttttactacgtttctaattttatactaaattttacgtgtttaattattaacctaatggctaaatgtctctagttattaaccaattaaaccctacaaatcgagagaccacgaaacgacagagaaaccccttaaacactttgacagagacaacgtccaattattaattacgttgaattattggcctttatgccttaaattgattctcttactacttcttaattttgttgacctaccaatatatatttacaaagttgtatcatcgggcgtttaatgttgaaacccatgctactattattaatctgcactaccacgtaaattttgcagtaagagctaatgaaacaaaaaaaaatactattgactaataagtaataaatgaccatagctcaatttgtttactaaatacctcaacttgtagcattattctatagagtatcatatagtgttaaaagtgtactgatgcacgcaaatatgtcgttaagttaaatgatacacagaaaaattgctccacacttgcaatacgaagtgttttttaattataatccaaaattttgttggtttgtcctcattatttaatatctaacacttgttatttgggtctacacccgaaatttacaaactaatcgaattatttcccatatgaattataaaatatatatgatggaaataagcaattaagcatgatcaaatcatcatcatatttggatttattaagggatagacataaactttaaactaaatttccgagtatataaaacactaaagtataaaatcagatccgtgtgctgaaattattatttgtgaaacaaaattgatattttaatgaataatgatgtaataaaggttttttttttttgttaaagatgtaataaaggttatgagatgagatcattgataatttgataaacatatgtctacaatatttaacataaattaactaaaaatggatatgatagagaagggataaatttataatttatatttacgaaatgagataaatttagacttgtagctatgcttattggtacttaaaattaacatacatttttcttttaaaaaaccccaacattagctttagcttctcgaccaatgatgaaaattccaagaaaagaaagaaacattcataattgtttttttttcaaacaaaaaaaaagagcggccgttttattataaaaagaagataagctattggaggttgatacaacgctttttgtctcatctccttcttcttctccttctcaaatcttttttttcaggcgtaacgaatcgaatcataaacacttacgcagaaacaaaaactaaactttggatcttttaaccgaccatagagattcgtgggttcttcttagtttcgacagattcttgatccgttttagttgttacgctcatctttgcttttatacatcagacccttctcttctcttccttctttatctaagaaacattagggttctttgaaatcttgctaaaaaaaatg

SEQ ID NO: 26039 - DNA, 3000 bp, Unknown
  misc_feature (1)..( 3000): 2750-1469P.txt file - cDNA_ID_2710001; gDNA_ID_2214583; Annot_ID_186557
atgtgcgtcgtttgtcttatatttagcctgatattgtgaaaaagaataaattattcctcaaacttatctatatatatagcaaaccaatataatattatatcgttaaaaattgttatatagacgattaataagcttaatgaatatgattaattgaaactttgacaattttgaattatatatttttagttattattagaacacagaagaaccatgatgcgtaatataggtcattattatgcgttaagtttcatgtgtcgtgatgaaagaaaatcctttttgggtgactaaagaggaaagattctaaatcggtggctaaaatgtaattatgatggttgaaccattaaaacaattcatatcgacacatttgcaggaaggtttcatattcgataattctaacttcttctttcttatgcacccgattagtctaacttacaataatagttttatctagaaattcattgaacctttatggtgcatttagtttatatgtctatgttattatacctactcaaccatgaagattgtttgttttcgtatttttctacgatctgatttgacaattagacttacaaaattatcaactaaatagaagctttgttcaaaaaatcggatagagtccgcagcgattttgtccaaatcagaaagattaatcgtttatccgatttttgtccgtatagatccgctagacccgcttaatatatatatatatatatatatatatatatatatataagttttatattaaaatatccaacttatattcgtaatttatatgaaaaattataaatttgaacctaaaaccttattttcatatgtctaatattattttaaaaataatattatataaatttcttaattataatggattaatatgttttaaaaatattaaacaaccctaaaactaatccacgattaatccccctataatctcctattttcctgctagacgctatgtccactctcaccacccgagtagcacctagcgattttttgaacaaggaatagaagtaatgagaacattaaattgtttatcaatttgaagtaaccacattaggttttagtttaagtgaactaaaggcatcggtaggtcctatttttgtgtcgtattgtatgttccatgcatgatgcatggggctatatatatcgtagtcaaacaagaacctaatataatcaaattcgacccatgaggttggtatataatagggagcaaaaatatgaatcttcttggattaaaaaccggtccaaaccacgccttatacattaggagttttatattgaataaaacgatcggattacttgtaatatatgcaacgactgcatcactctcaggtaagaaaaaaacgtagatacatcgaacatacatcaaacgcagacgcgttcactaaccgcgattcaaacacgcacttgatcgatctaggacataggttaggaggcgtcgactcacgtgaccatgtctcttccaaagtcaacataaatgtgccgcgtaaggatagagactacttttgttgttgttttactacgtttctaattttatactaaattttacgtgtttaattattaacctaatggctaaatgtctctagttattaaccaattaaaccctacaaatcgagagaccacgaaacgacagagaaaccccttaaacactttgacagagacaacgtccaattattaattacgttgaattattggcctttatgccttaaattgattctcttactacttcttaattttgttgacctaccaatatatatttacaaagttgtatcatcgggcgtttaatgttgaaacccatgctactattattaatctgcactaccacgtaaattttgcagtaagagctaatgaaacaaaaaaaaatactattgactaataagtaataaatgaccatagctcaatttgtttactaaatacctcaacttgtagcattattctatagagtatcatatagtgttaaaagtgtactgatgcacgcaaatatgtcgttaagttaaatgatacacagaaaaattgctccacacttgcaatacgaagtgttttttaattataatccaaaattttgttggtttgtcctcattatttaatatctaacacttgttatttgggtctacacccgaaatttacaaactaatcgaattatttcccatatgaattataaaatatatatgatggaaataagcaattaagcatgatcaaatcatcatcatatttggatttattaagggatagacataaactttaaactaaatttccgagtatataaaacactaaagtataaaatcagatccgtgtgctgaaattattatttgtgaaacaaaattgatattttaatgaataatgatgtaataaaggttttttttttttgttaaagatgtaataaaggttatgagatgagatcattgataatttgataaacatatgtctacaatatttaacataaattaactaaaaatggatatgatagagaagggataaatttataatttatatttacgaaatgagataaatttagacttgtagctatgcttattggtacttaaaattaacatacatttttcttttaaaaaaccccaacattagctttagcttctcgaccaatgatgaaaattccaagaaaagaaagaaacattcataattgtttttttttcaaacaaaaaaaaagagcggccgttttattataaaaagaagataagctattggaggttgatacaacgctttttgtctcatctccttcttcttctccttctcaaatcttttttttcaggcgtaacgaatcgaatcataaacacttacgcagaaacaaaaactaaactttggatcttttaaccgaccatagagattcgtgggttcttcttagtttcgacagattcttgatccgttttagttgttacgctcatctttgcttttatacatcagacccttctcttctcttccttctttatctaagaaacattagggttctttgaaatcttgctaaaaaaaatgggtgttgagaaaatg

SEQ ID NO: 26040 - DNA, 3003 bp, Unknown
  misc_feature (1)..( 3003): 2750-1469P.txt file - cDNA_ID_2710015; gDNA_ID_2214583; Annot_ID_135307
gctgtcttccttgcataattgctcttctttatgccgttgctggaacggtatgaagccatctcatcgatctttgttgtctactactttaaagaacttagagacgccttttcttgcgggttttatacaggaaggtgtatcggaggcggagctcggtgttcttcccttgtacaaatttaaggctttccatagcaatgagaagaacattactggacctggtaaaatggttcctataccgatcaatggcttatgcttagcaactgaaagaacactgcttgctgaggatgcggtaaacacgaatctagtttgacaacgatttgttacttatgaactctgcttttgcttagtttcaaaggcttcttctacttgatttttcttaacaggattgttgcatatgtctgagttcatatgaggatggcgcagagcttcatgctcttccttgtaaccaccattttcattcgacttgtattgtgaaatggcttaagatgagagcaacatgccctctttgcaaatacaacattcttaaaggaaccactgatcaatcttgaagacaaaactcaaccaaccagagggaataagattctgcacatatagaaacagattccatttcctcaattaaaaagcttctgtatatatttatttacataactatcaaagtcatgtgtcttttgttaaaagcatccattttaaatgtaaaagatcacactttacaaatgcccttttctatatttgcccatatttgagaatacagctgatgctcatagtcatagctcaaatcataagaaagttcacgaacagttcacttcattgccacactgtttgctgcaatccgcatcacttactgctgttacaagcccccttctctgcatatcaagaagcaaatccgaagcagcggccatgtttccctccttttcataagctctaatcaagagatcaaaaacagccgaatcaggacttattccgctattcaacatttcatcgaaaacttgtcttgcctcaaccatcaaacccttgctagctagcccgtaaatcaatgtagtataggctaacaaatcaagcaaaagaccttcctgaaccattctggtttttaacttaaacgcatccaccaaattcccttgcttacacaaaccagctatccaagaagtgtacatgaacttatctggaacaagtccagcctctgagattttactaaacaatctctcaacttctataaagtctccttctttgcacaaagcatcaataagcacagtgtacataacatcattagctttctctatacagaaataaactatagcttcatgtagttgtccattcttcgcaatcccatcgatcatagtcgaaagagctacaacatcgggctcaaagcctctctcaattaatttgtggtacatgttaaccgcagccttcatgcgtccggatttaaaatatgcattcatcattgtagtaaaaatcaccatatcaggaactaaatcacttttctccatatcttctacaatctcagttgcctcctttagtttaccattaccacaaaggcctgatatgattacgccgtaagctgttatatcaagtctcatcccttgattgagcattttggccagaaacttcatggcattatccgaatctcctctctgaaaaaaaccatcgataatcgtagtgtatacaagagagtttggctcaactctatcctcgaccatccttgaatacatttcctcagctctctgcatttcccccttcttgcagaaaccatctatcaaagcagtataagtaacaacattcaaagacatccgaacgcgtctcatttctttgtataacgaaaccgcaacctccaagtcaccagctttacagtacccatcaatcaaacaagtgaaagtaaccacatttggagataaagcatctctcttcatagagtgaaaactcttcaacgccaactgcaactccccggatttgcagaacgtgtcgatccaagtactataagtaacaacattcggcgaacaacacttcaacataacacccatatacacaaaaacctcatctaacatcttcatcttgctaaacccattaaacagagaattaaaactaactatgtcaggcttgcagataaacccatgagaggctcttaaactctctaaaaccaaactagcacttctgatatctccatttctacaatgcccatcaatgagagagttataagatataacatctggttcacacccgaatctaggcatcgagtgaacgatatcttcagcgaatttaacttgccctagtttacaaacaaacgatacgaccgaattgaatgaagaacgatgaggagtgtaacctctggagactaagtaagctaagaatttgagagatagaatgccgcaattggaattgattagctgatgaatatgcttgttgcaggtgaatgggtctgggagattcgaggattttctcaggcgagaaagaaattgaagagcttctctgaccattcatggacatgggtttcttcagaagattcgaaaggttacaactttgaaaagatttttaaacatcaaagctaaatctaacggagaaggcttaaaccctagaaggttaaagaagaccgtcgttcggttctaaacgacagcgtttaattgtaagcttattattaaataaacatgaaaatgtaaaaaaaatctgaaaacggtaattatctctctctactcgctgtgacttagcataaacctcttttaaatccttctctaccaaaaaaaacttgctatttctcttttgtttttgtagaatctccggtgaagccgaattcaaaccctaacacttttggttcatcagttcttcttgacgattcagtgttgttgcgcgtcttatttctacattttgctttctcgatttgagaatgtgctgattttaggtatgtgttgattttttttttttgtttctggtggatggatttgagacttcaatagatatggaacttttgatgcctgtgtagattagagaagtaagggttttatagatcgggaataaatg

SEQ ID NO: 26041 - DNA, 3003 bp, Unknown
  misc_feature (1)..( 3003): 2750-1469P.txt file - cDNA_ID_2710015; gDNA_ID_2214583; Annot_ID_186567
agagacgccttttcttgcgggttttatacaggaaggtgtatcggaggcggagctcggtgttcttcccttgtacaaatttaaggctttccatagcaatgagaagaacattactggacctggtaaaatggttcctataccgatcaatggcttatgcttagcaactgaaagaacactgcttgctgaggatgcggtaaacacgaatctagtttgacaacgatttgttacttatgaactctgcttttgcttagtttcaaaggcttcttctacttgatttttcttaacaggattgttgcatatgtctgagttcatatgaggatggcgcagagcttcatgctcttccttgtaaccaccattttcattcgacttgtattgtgaaatggcttaagatgagagcaacatgccctctttgcaaatacaacattcttaaaggaaccactgatcaatcttgaagacaaaactcaaccaaccagagggaataagattctgcacatatagaaacagattccatttcctcaattaaaaagcttctgtatatatttatttacataactatcaaagtcatgtgtcttttgttaaaagcatccattttaaatgtaaaagatcacactttacaaatgcccttttctatatttgcccatatttgagaatacagctgatgctcatagtcatagctcaaatcataagaaagttcacgaacagttcacttcattgccacactgtttgctgcaatccgcatcacttactgctgttacaagcccccttctctgcatatcaagaagcaaatccgaagcagcggccatgtttccctccttttcataagctctaatcaagagatcaaaaacagccgaatcaggacttattccgctattcaacatttcatcgaaaacttgtcttgcctcaaccatcaaacccttgctagctagcccgtaaatcaatgtagtataggctaacaaatcaagcaaaagaccttcctgaaccattctggtttttaacttaaacgcatccaccaaattcccttgcttacacaaaccagctatccaagaagtgtacatgaacttatctggaacaagtccagcctctgagattttactaaacaatctctcaacttctataaagtctccttctttgcacaaagcatcaataagcacagtgtacataacatcattagctttctctatacagaaataaactatagcttcatgtagttgtccattcttcgcaatcccatcgatcatagtcgaaagagctacaacatcgggctcaaagcctctctcaattaatttgtggtacatgttaaccgcagccttcatgcgtccggatttaaaatatgcattcatcattgtagtaaaaatcaccatatcaggaactaaatcacttttctccatatcttctacaatctcagttgcctcctttagtttaccattaccacaaaggcctgatatgattacgccgtaagctgttatatcaagtctcatcccttgattgagcattttggccagaaacttcatggcattatccgaatctcctctctgaaaaaaaccatcgataatcgtagtgtatacaagagagtttggctcaactctatcctcgaccatccttgaatacatttcctcagctctctgcatttcccccttcttgcagaaaccatctatcaaagcagtataagtaacaacattcaaagacatccgaacgcgtctcatttctttgtataacgaaaccgcaacctccaagtcaccagctttacagtacccatcaatcaaacaagtgaaagtaaccacatttggagataaagcatctctcttcatagagtgaaaactcttcaacgccaactgcaactccccggatttgcagaacgtgtcgatccaagtactataagtaacaacattcggcgaacaacacttcaacataacacccatatacacaaaaacctcatctaacatcttcatcttgctaaacccattaaacagagaattaaaactaactatgtcaggcttgcagataaacccatgagaggctcttaaactctctaaaaccaaactagcacttctgatatctccatttctacaatgcccatcaatgagagagttataagatataacatctggttcacacccgaatctaggcatcgagtgaacgatatcttcagcgaatttaacttgccctagtttacaaacaaacgatacgaccgaattgaatgaagaacgatgaggagtgtaacctctggagactaagtaagctaagaatttgagagatagaatgccgcaattggaattgattagctgatgaatatgcttgttgcaggtgaatgggtctgggagattcgaggattttctcaggcgagaaagaaattgaagagcttctctgaccattcatggacatgggtttcttcagaagattcgaaaggttacaactttgaaaagatttttaaacatcaaagctaaatctaacggagaaggcttaaaccctagaaggttaaagaagaccgtcgttcggttctaaacgacagcgtttaattgtaagcttattattaaataaacatgaaaatgtaaaaaaaatctgaaaacggtaattatctctctctactcgctgtgacttagcataaacctcttttaaatccttctctaccaaaaaaaacttgctatttctcttttgtttttgtagaatctccggtgaagccgaattcaaaccctaacacttttggttcatcagttcttcttgacgattcagtgttgttgcgcgtcttatttctacattttgctttctcgatttgagaatgtgctgattttaggtatgtgttgattttttttttttgtttctggtggatggatttgagacttcaatagatatggaacttttgatgcctgtgtagattagagaagtaagggttttatagatcgggaataaatggaggaaggtggatatgcgtttgaggttaacaatggaagaccaacggcgagtgagtttggtacgacggcgaggatttcgtcaccgtcattgactatg

SEQ ID NO: 26042 - DNA, 3000 bp, Unknown; identical to SEQ ID NO: 12949
  misc_feature (1)..( 3000): 2750-1469P.txt file - cDNA_ID_2710027; gDNA_ID_2214583; Annot_ID_135301

SEQ ID NO: 26043 - DNA, 3000 bp, Unknown; identical to SEQ ID NO: 12970
  misc_feature (1)..( 3000): 2750-1469P.txt file - cDNA_ID_2710038; gDNA_ID_2214584; Annot_ID_135322

SEQ ID NO: 26044 - DNA, 3003 bp, Unknown
  misc_feature (1)..( 3003): 2750-1469P.txt file - cDNA_ID_2710041; gDNA_ID_2214584; Annot_ID_135323
atatatgctatatataaatggccacaaacgttaaagacctacataatgaaattgattgacgtattagtaaaaatctattactgtatcacgattaccaatataggctctaagcttgaactagtaaacatattacgtaataatttaggtgtcatatattactttatattttgatataaatatcattttggtatttaacacaagaattaattgtttttttttgtttttatgatcataagatcgatgaaaaatggtaagtataagatcgatcaatgttgtaataagtataaaattgaaatacaataaaaaagcttttttttttaagcaaaaaaaaaacaattaaaaactagtattacccaaaataacatgtatttcaaaaatttaactttacttatccacaataatatgcctttaagaattgtaattgtaagatcgattaaaagtctcatattctcaatttacatcaattcttcttatttttcgtttgtttgtcgtttgtcaatttttttcttaaacatgaactcacccaaattagcgaagcttaaatatttagttctttttatacaacaattaaagattccaaatttacttggttaaagacattaatcaccacaaacaaatacaatcttctcgagtaatcaataatcatgtacggtcaaaccttaatcacgtggcacttaagtcatatgctttccaaaaatatacatttacaaagattattctatactctctctcctttatctttgcctctttcgagctccaacctgtgtctgaattcgatatcaccattaggtgctttaaccacatggttagcaacatgttaatctatattatacatttccataaataggttgaggacacgtgtctccatacatgtgtttacaaatatcatgttgtaggtaatgattctaacaaggaccagctaaaaagaaggtggatttctagatagctcttaagttatggtcctagatctgtttagccagttaattaatcttgtttttttcaattgttaaatgttaatacttaatactattattaatatattctttctattttcgttcatgcagcttttaaggcgatcttgtataacttcgtggtggtccaaggtatacatggcacaacatagaagcattgtgtcaatataatattttcttaatcaaatcgaaataattgtttagctcaaaactttgattggttcacatattatattgtatataataacctttttccttcaagaaacaaccagtaagatctatatcagctgtaaaataaatacgcaagaacctattaactcgactcgccatttattactaaatgcggtagtgtcattaggaccaatctctcgaatttgacttctgaccatataaaatagggagtgtattttcattaacatttgagactttttcttgtaacaattgatttataatttttcatgtgcctacttgtatctttagagtctgtatggttagaggactgaaaacttttgtaatgttttaggcttatttgaataggctataatacattagacttctagttcaaatagttaatcatttttttaaaagatagttaatcacgttatggaataactcaataagtagaatatcatataattatataattgggtgaaaactttaatttaccataacatggaattaacaaaaaatgattgcgacgagggaaaagaaaaagagagaatcagagaacgaaagattggaacatgggaaatggcatttcttgttgtctttgttttcataatgactaaaagtctaaaactataagccgtcataaaaaatttatgtaaattatttacaatagcaaaaaattacgtgtttggtaaaacatactgcacaattattcccatccgactactacatttataattatgtttacgggctttataggctcaaataatttactaaacttaggatgcatataaatgaatacattaatgggccacatttcttatagcccgataaatagttgagttactatctttcatagtcttgagtcttcacattaaaacgggtttaaattagcttcaattcaaagtcaaattataccaaaccagtaattaggatttactaacaaagaattgaacagaaactgttgacaaaaaatatctcttggactttgagttattccattgatgcatttttggcggtggatctttaaatgatattgatgcaggaacttaatcgttgtaattttaggtaatttacatttataaactatttaatattttggcaatttttattggttttccttctttttttatggggttttctccataattgaacttaactcggtctcaaaccgaacacgtataaatttctaaaaaaaattataaaatcgaatcatactaattttttatttcccacgcacgtcatatatatgacatatttattttgatacacgatagtgcatataatgatatcagaatatcaaaatttcagtgttaattatatctttagtaaaaatgcaacaaatgaaattagtatcttatttgtaaataatttttagaatgacaaaaaaaattgcttttgttttctaaggtgaggaattaaaattttaaatttgtcatttttaagtttattcaaaaaaacatgctagtttaattggagaatcgagtccgatttttgaagaaacatgtctaaatccacatattgaagaaacatgactcatatattctctttctgttctttttctacaaattttggcgttacaaaagtaggcatggtagtttttgttaggtctcgctaacaaataattaatagcatgtcacttgtcaatgcctcatccgaaatccaatccaagattattttgttccacagaaaagaacaaagtttataaaaataataatatagcgactataacgtttactattcatccctttatgggtcagtgtatatgtaatctcttcttttatcccaaatcacacattggcattgccattgacaatcaataaaacatcttgtgagacaagaacgggtaagtgataagatcatg

SEQ ID NO: 26045 - DNA, 3003 bp, Unknown; identical to SEQ ID NO: 26044
  misc_feature (1)..( 3003): 2750-1469P.txt file - cDNA_ID_2710041; gDNA_ID_2214584; Annot_ID_186600

SEQ ID NO: 26046 - DNA, 3000 bp, Unknown; identical to SEQ ID NO: 12966
  misc_feature (1)..( 3000): 2750-1469P.txt file - cDNA_ID_2710065; gDNA_ID_2214584; Annot_ID_135314

SEQ ID NO: 26047 - DNA, 3000 bp, Unknown; identical to SEQ ID NO: 12996
  misc_feature (1)..( 3000): 2750-1469P.txt file - cDNA_ID_2710168; gDNA_ID_2214588; Annot_ID_135369

SEQ ID NO: 26048 - DNA, 3000 bp, Unknown; identical to SEQ ID NO: 12996
  misc_feature (1)..( 3000): 2750-1469P.txt file - cDNA_ID_2710168; gDNA_ID_2214588; Annot_ID_186685

SEQ ID NO: 26049 - DNA, 3000 bp, Unknown; identical to SEQ ID NO: 13000
  misc_feature (1)..( 3000): 2750-1469P.txt file - cDNA_ID_2710188; gDNA_ID_2214588; Annot_ID_135381

SEQ ID NO: 26050 - DNA, 3000 bp, Unknown; identical to SEQ ID NO: 13000
  misc_feature (1)..( 3000): 2750-1469P.txt file - cDNA_ID_2710188; gDNA_ID_2214588; Annot_ID_186698

SEQ ID NO: 26051 - DNA, 3000 bp, Unknown; identical to SEQ ID NO: 12999
  misc_feature (1)..( 3000): 2750-1469P.txt file - cDNA_ID_2710192; gDNA_ID_2214588; Annot_ID_135380

SEQ ID NO: 26052 - DNA, 3003 bp, Unknown
  misc_feature (1)..( 3003): 2750-1469P.txt file - cDNA_ID_2710214; gDNA_ID_2214588; Annot_ID_135370
gtcgtagatgagaagcttttcatcgacagaccaataataagctcgaagactagcaatgttaggatgttttagtttccctatggcttcaacttctgtctgaaactccttgaatctctgagaccctccttcacccaatctccgtacggccagtgtgagcccgttctctagaaccactttgtagacaattccgattccgctcttccccagaacgaaagctgacgcctttagcagctcctccaggttaaacgcaacctgagcgtcgaggggaacaatgtcgcaatgctccacgttttcagatggcgtttcggattcgtctttacggaaacacagacactcagaagcccttttcttggattctttctcgactccgaattggttctcgcggttacaagcgcagaactttgagtagcagtaagtgaaaagcaaacccacaaggcagataccaaacacgtcgcagagaacaatggcaatgacggcgcttttgctcaaaccacttgatttctgtttggtttcagagttagtactatcagaatcctcaggtgggttgttgcttgggataaaagggtaagaggcattgaggccaagttgatatccttggcaaaggtccttcaatggaggcccgcatagaccagtgttgccgataaacgctgttggtcctctgttcataagagcaccggtttgaggaatgggaccggagagattattgaaagtgagatcaatgtaaaccttttcaggaagatctccaagggcaggtgggattgagccggtgaagtgattatgagagaaatcagcagttccttgaaggttggagaggtttccaatgtcgctggggatggagccgttgaattggttgaaggcgaggtcgagtttctccagagagacgaacgctgagccaaacccatcaggcaaaggaccagacaagttgtttctgctgacatcgagtgttttaagtctgttgcattgcagaatcgaaagtggtaacgacccgttgaagagattctgtgacaaatctaaggtctgaagaagcttcagcttaccgatctcttccgacaatgacccatcaaaggaattgccgtaaaggactagactttggagtccctgaagatggaaaagctgaataggcaacgacccataaaacctattgctccggagattcaagtgacggagactggagagaaaccctagagacgaagggagagaaccgtaaagattcttccttggaatgcttagagacaccaccctgagttctttgcaagttacaccgttccacgaacaggcgttctcgtctgatgagttccaattgttaagagaacctgtaggatcatcgtgaacgctttgtttaaacgttaagagcgcaaagccttcgtcgtttaagccacttatgacagtcacattgcagagaagagcaacgaagatgatcagcgaggccaacattatcagatgcaaattagaacaaaaagacgagtgttggctttgtacaaagcaaagagagatagtagcaagaagagtgtgatattgatggagtgaagagtaaagtgaaaaagatactctcgttgaagaaaaaggagaaagaaagaatacaaaaagtagagagaaagagagagagagctctgtttttgcattgggagaagagaattaacaaaaaaaaaagaaatgaccaaagaaagaggtgaaagttggagaaaagagaaggccatggcgaagtaatccatacgctaatttgaccactaatctaatgggtttgaatggtaacaaacttaagctttatacagttttgaatcgatcataaaaactttattaaaagtgttacaaaaagttttacttttagcttttttgtacagcttttttatacagcttcttctaacagttttgcactattccgataaagctaatagcttcagctaacaggtaaaaaacttgtccagcttttggttaccaatcagacccaatatctttgtaatctctcctatatacaaaatgttacaaatgcagatatctttattcaaatagttacatcttgtaataccttttgtcatgattgttgttttattccgaaaagtaatatattggggtcctttgattgatctgtcaagtgtcaatgtaggtaacatttacagtgtttgtccttttctattaatctatcttgtcaatatattactactacagtagtatcattcattttttatttcttagatgatgttgctctagcacgaaactccataaaataccaagtgatgcatattaatagagtgtagcaagtgtagtaacaagtagtaacaagtgtagtttcaaatgagcattgaacaaactagttacgattgggagagagcaaacataacagtggagtttactagagaagaaaggtgccacaagataccaccacgctcttcctgctttctttattcctcgagtctgcttttacagtactagtactacctcttttatatcttactttaccatataaatcacagctcatctttcttattttacttagaatagtagcttgacatgttttttcgcaagaagaagattcatataataaacgattataaatgtggtttagatttagctaaagccttaaaagggtaaaaggagaggacatgtgtacaaacattagtccggcccttattgtcgttatggtgatacgataaaattgtcgataagtagacttggtgaagtgtgatgtctcctagtttcttaggatagagagccccaaaaaaacctaaacctaaacccagagagagtgtgccagagtgggcctattttctcctcacggactaacggcgacgactccgaggctacatactagtaaatcaaacaacttgggttttagtgcaatataaaattattttgggcataaattgtaattatggaaacgtttgggcatgaattgttattacggaaactgttggggataaattgaaattacggaaactttggggggcttaatttggctttttgctggcacggcaatgggaggagacgaaaccgagagaaacaatg

SEQ ID NO: 26053 - DNA, 3003 bp, Unknown
  misc_feature (1)..( 3003): 2750-1469P.txt file - cDNA_ID_2710218; gDNA_ID_2214588; Annot_ID_135367
tctaaacaaataataaaaaaattatatgatttaaatcttacatgaatctcttaaatttgatgaaacctaagccaattgtttcttaactaaaagataattagtcttggtttcaccaaatttaagagacccataattaaaaatattatttatctatatttacattttaattttgtttaagaagggtttttaggtaattcttattgcatatgaaagtagaataggaagatagagaataaaaaaaaactcttatctaaaatttatataagagtctaatgagacacatgtctcttttatattggtttatttttttttctaaaaattaaaatttaattatttagtaaattatattaaaataataatatataggtatttagaagaaaaaattaagagtcctccattgaggatgcatccctaatggtagtttctaaacaaaactcttaatatataataaaaaatgtatattatttaaatattagatgggtttcttaaatttgaaaaaacttaattcaattgttttttagttaaaaaacaattgggctaagtttctttaaatttaaaaaatccttcattaaaaattattatttatctatacttatactttaatttattttaaaaaacctatgttaagaaactcccattagaaatattagaaatggtcttaactcttaagcttagaaaactccattgaaaatgttctaaggacttaatttaaaagccatgaaaggtataattccttttgtaactaataaatatagttaaataataccagtagtagtagtacgtgaagagccgtcggatgcaatctgaatcgcaaaataaggaggaatctacggacaggatcacagtggaaagatgatacagagtagagagatttcttcttcttctttggcagattccagcgaggaaccaattagtaggcctgctgtcaaataatgtgacccacaacttctttgattccttaattacaacttttgattagtaacgcttataatgtctcaccttttactaatcaaagtaattacgaatcagctttccataatcatatcatcgtccaattttattcattactttgctttaggaaactctattcatcttattcctttctaaattgttgattaaagtgatttgaaaaggtaataatctcgtgcatttgttgctaatgtgccaaaatatatttgttttggggttattcaccattttcatgtgaccttgttgtatgttataacttataaccgttgggttttttttataactctttttggtaatattatatatttatatatattaatatacagtagtagtagaaaactaaattatcatcagtttgttgcttttctttaacaaaataaccaattaactaattaaattatattaacattgtttgactgtttgtagtgggtatactagtttactaaataaaatatttttgtcaccagccgtactacaatagcctaatgatacgttaaatttaatcatatttgcgatcattatattgtgagtttttacattctaactaataacaaaaaaatactacctttgtattaaaaggtaggatgttttagctaaaatgcatacacttgaaaaaaataaattgtttttgaaaagaagtattaaataatttaattcaaaaaaattcagccaatgatataaaggctgcataatacaaatggtcataaaatatcaaaatatttaaaatttgcataaaaattggtaaaaagtatatattattttaaaatttttctaaaacatcttataatttgatataagggaagtagtgtttatggaaaatcccgacatatatgtaaccacatttatggaatctccgtctctcaatttccagttagctcacatacacaaattgtatttactcgttgacaaacggtttatatagttgataatgcattagatgtatccataagaaagtcgacaaaataacattgaggcgatcattatagtgtgagtttttatttcctaactaataacaaaaattttaagatagtgataaatcttactctctttgtattaaaatatttttttaaaaaataattatttaatatttaattcaagaaaatttgtcaatgatataaaagattgcataataaaaatgatcataaaatatcaaatgtatttaaaaatttgtaaaacatgatatatattttaaaaaaaaatcctaaaacatcgtatattttgatataaaggaagtaatgtctatgaaaaatcccgacacgtatgtaacaacatttttgagaactcggtctctcgattcgcagttaactcgcatacacaatttatacttactgcttgacggatggtttatatagttgatcatacatacatccatttgaaagagcatgttggtcttaattgcatcaaacattcttatcaacacaaaatgatatacatggcatcagataaaccatcacgaacaaatacaattttgaaaggtaatacacacaaattcactaacactattaaggtaatacacacaaacattcttatcaatttcatgattttctattaaaatgtcattataaaaaaaaaaaaactgaaagaaattggactgaaagagaaataaatttaaccataattgtttggtaaaaatagtaaaatatgccaaaaatgagatttaagaggaaaataaaaagaagaaaaaaaaaacagctgtagtctacatttacatacaagtcgtggactaacagctatactactactaagtactaactctttctctctctaaatatcaaattcaatttaatttttcttctgcaaatggaaccaccgccttcttctctgtcctccaccgcggtggcttccacctccatctccgccgccactgctcctgttcctcctcctctacctcctcacgtgacttcttcttaccccgaatctctcgactcctcccctcgttctcgcaccaccgatggctgggatgaccttcctgctccttctggcggcggcggtggcggtggtggtagcgccgtctcttctaaacttcgttttatg

SEQ ID NO: 26054 - DNA, 3000 bp, Unknown; identical to SEQ ID NO: 12995
  misc_feature (1)..( 3000): 2750-1469P.txt file - cDNA_ID_2710222; gDNA_ID_2214588; Annot_ID_135365

SEQ ID NO: 26055 - DNA, 3003 bp, Unknown
  misc_feature (1)..( 3003): 2750-1469P.txt file - cDNA_ID_2710240; gDNA_ID_2214589; Annot_ID_135392
tctagtactcttttgtcagtgtggattctgtgacggtacacttgtaaattctagtattaaccaaacaagggtaatatcggtatttaagcagccaattaaagctcttgggccgtttaaaattcttaaaagcccattaatttcgaaacgccacctgtcgagacataattgggtcagaggattttaacggtggaagatgaagaagcttatctttttgcaaaatcgtttcttccttcattcatcatagcttcaaaatcttaaaaacaacaacaaaaatgaaaagtctccactttttagctcccaattcaacgattatcaatctgaagcaacaatcttatacaaaaaccaagttccagttgcatcgtagcaacagaagaactctatcgataaactgcgtaaacagtggcggtgatgaagagaagattactcagccgttggatggagtggagataagattcaaaagaggatccagaaggaaaatgagggaagagggttcaggagaaggaggaggacaaagcgggaagaaaaaagagactgttcaaaagccatgggaagagatgacattgaatgagaaggcattggagctttatgttggagagaaaggtttgttgttttggctaaacaaattggcttacgcgtcgatatacattgtcattggaggttggatttttttccggtttgttggaccggcgtttaatctttatcaactcgatacaccgcctcttgatcctaagaacatcttaaagggttaagaaatgctttgtagctgtgtctgcattctctgttccaaaacattttgaggcttatatattcaagttagtttcgagtaatgtgtagccatgtctcactagattaagatacacaagagaacaacactcttcatgaattttcaagattgttctgttggagttatgtcctgatcaaggatatctcgtgtagtcttgcacctgacatggaaaagaaaatatttttttcttcggctttttgtttaccttaactcaatgcaaagaatcagaattattaactgaaaaaactagattaaaactcacctattgcactctgctcgtgatgcataattgtgattcttgcaatttgtacacatccagtcgccatcacgccattgtttcactctaagaaatcagacaacacaaagaattgggaaggttgcaaaagatcacgccattgttctagcgtttagaaaacaagaaaacaatggagaccagagatcaatacagtaccccattccaagtaaagcaggtgttgagtgttgttgtagaaacgggagaggaagttgccaatttgagacccttcctaggctcataccaggaaaagatgcatatatcgctgactgtgtttgcatgcttgtctgcacaacgagccagaagaaacagaggttggttaagcagcaagtaaaattgatgaatgtactaatcaatttatgcgctctaactaatccttacatatccttgattcagtcttttgctatcccattcatgagccaaagcttctgatgctaatctctttgtaccaagggctgcaacccaaaataaactttcccatattaaaactcgtgaaaggattatcagacaccttcgggttatataagattgcacgcgcatcggtcttagacaaaaaccttacctagtggagctatttcattgcactttttgcactgcagagacatacaaaacagaaatgagtaaaacaacaagccggaatctgcaagtcggttttgcattgtgaacccatttcctcacctgtatacgagaggaataattgtgaaaaccacatctgcaaatccagtcaccactcctccattctttatgaaccgaagcttgatttgtagcgttagagaatgcgagtaaagaaccaggttgatcatgtgactcaggtccacgggtgaagtaatggagatgagtttgaagagaagctccagggatagcaagtgctgacaatgctgctacttccttagattgcccacatttcttgcacttttctcgtgatgcataattgttgttagtacaacctattgccacaccacaccacaccacacacccaaacgcaaaacgtagaacgaagaagatacacacgcacgcacaccacaacacacccaccagcaaattccatataccacataacacagaatacacaaaacagctcaacctagttataagtaaatcccctaattcacaattccaatctaatgaaacatcaaatgtaaaagggcatttgaaagttgaaggatttgaactcagaacttacgaattagatcaatcctagttttcattcacaattcaatctaatgaatccgcaaatggaaaagggcatttgaaagttttaaggatttgaactcagaacttacgattctgatcaatcctagttttgcttctagttcattagcacaatctgggaagctataaaagaattgaattgagataggagaagaaagaacgaaccagtgcagatccaatcgccgatacgaggaagccacttagagtttggagaagtattattatccatgataagacgaggctgcttgcatctgttacagaatgatctaaacgcataattcctgtttctgcatcctaaacattcccagtctccttctcttccgtctcccatttcttcttcccggaaaaactccagtctccggcgacgacgactcactctttttcgttcagagaggagaaagaaagagaaagttgaagaaagctaaagctgggccacatttgttgtgaagtgactaggcccattaggcccattaatttcttcagagaaaatctctttcgtccttctcttcgcaggtggcaatcgttacttactgacatacatcttcatcagtgatttttgggtttgaaatttctctagatcgattttggatttagatctctttgtttctactgcttttcatcgttggatctgcgttttgcaaagggagatacagaaaggaatagctttgaattgacaaggtttctctctaatccaaccgaatctcaagcttccatg

SEQ ID NO: 26056 - DNA, 3003 bp, Unknown; identical to SEQ ID NO: 26055
  misc_feature (1)..( 3003): 2750-1469P.txt file - cDNA_ID_2710240; gDNA_ID_2214589; Annot_ID_186724

SEQ ID NO: 26057 - DNA, 3003 bp, Unknown
  misc_feature (1)..( 3003): 2750-1469P.txt file - cDNA_ID_2710251; gDNA_ID_2214589; Annot_ID_135396
gaggaagaatttgggtttgaccatgatatgggtctaaccattccttgtgatgaagtcttcttcaggtctcttatctccatgtttagataaagcccgatatcggagacagattattattcttgaagaaaagatttctttattggaaagaaaatttgaagccgagatcagtaaatccaaaaacaagaaacaaactcattttttagggttgtctgattaagatgcaagaacatggctaaaaagcttcgtaggcattaacccgtttgtggtttttttctttgctaaatttattagtcattttctcttttaaatattttgttgtagttggggtggggtgggagactttttccctcaagtcaacgtaaaatgttgatcgatgatcttgagaggattagctagttaacttctaaaactttattggttaagatcaatcaagaatcctcaatagttttggtggtttgtgctaacgatgtttatgtgttatcatcgttcgagttaaaatccgcgtaatatataatgttgttttataaaaaaaattagtacatgaatggtccaacaattcataactcacgttcttaacctaatttgtgactaagactaactaatcatgtgtaaacagctttctatttcttcgaaaaatttagaattacaaagacatagtttcgtatgacaaagtatcacggtgtccatcatttgacaaaagtaatgatagaaatattacttagcatctttataaaagtaatactttctcttttactaagatacaggttacgagattaatcataaaacactcgagtcataaaacaatttgttttgttttctttcaacacaaaagttttgctatacgtgtattcaatatttatttgtcggtgtgtcaatcaccgtaatttgactcatttccttttacatgtagacgtagcaagtagtatttcaaaagattttatgtgtatatatcaattatattgagtcagatttttgtgatggatcattatggtcctaccaaccagagtccctacatatacttgtatctgtgcgaatttatagttgttacctaagctacaaaaaaaattgaagagatcttccgtaatatagatgaactaatttgatgtcccattatgtttctcgtaaaagaagaaatacatgtgtatttgacaagatggtacatagaccgctaaaccatcatgtcctaacaaagtagattggtatcatttgcaaaatatgtcacttaacattaatgttcttcattccttaataccagtctacttgatgagtctctcctctttttgatgagctagtctcgcactttttttcatctctaacttttgtattttatgaaatgttcatagactttattcaaggcacattactatcatatatctggatttaaattgccataccgtattcacgagacaatttatatgtaataacaatttaaaaaatgcattgtctgctcagaagctagcttgcccatattgtgtgttcttctaacaattttttattgtttcttctgagggtttttgcattaaatatgttattgttgacatcatagatgctagtggatatatcatcgacgacgaactcgagttgcttaataattatttccagtttcatacatcatcatcatattatagaacatatacctttatcatatgtatctcaaaaatctataatcagcttgatattaacttattctaaagttcaaatcagttttaacttttaagaaaatattatgagttttctaatttgattcggttttcgccgggttaacctgaaatcggaatctggattggacaaagtacaaaccgtgggttagtattagtaacatccaatttgggcttgcccgtatttgtctgctcagaagctagcttgcccatattatgtgttctccaaagaattgtttattgttattttggagagggtttttgcattaaatatgttcttgtgttgacattattgattattagatgctagtgatataccatcaccaaaattagaattgcattatcatcattttatatatcaatctatatatttatcatatgactcagactatcatgagacgcattttttttaagtattatgaataatataccacttgttcacgttttaacgtttgaaaaacatgattttgctactttttacgattcaaagtatttattaagaatttacgttcttgaaaagtgattatactgtatatataactataagtaaataaaacttttttcgacgaaatttctgatgataaataaaaggtcggatatatttgactttttttttttttttaattattttttgacgataaatttttcgttgaaaaatcatcgaaattttcgacggattccaatgatcaaaaattcgtcaataatttccaacgatattctgactaaactaaatctgatgaaatatttttgacggctttccaaccaaaatatttcgttgtgacttgtcaaaaatccgttagaatactaagcaacttttcgacagattttcagcaaaaatattcggtaatataacgtgttaaaaatatgataaaaaaaaaaacttgatgaatctactaaaactaaattttcaatcatatatatctattattcatatatttcattcattttattatttttctcttaacaattatttagttattctggtatcgtgtaattatattcatatgatttattctgatattgattcggttagcatccggataaatctgggttgggctttttaacttggtttttctaagaaaaattctaatatgatttggttagcatccggattagtctagtttggtaggcctgcctttgtgattcttaactcggtcttttgtatgggtttgaacaattactacaccatttagattcttctgacccatatcaaataaagatccacttaggcccattagggttagaacaaacatgaggttgcagaataaaaagggttcattttcctcactctcaagttggatctcaaaaccctaatatctgaacttcgccgtcgagagcatccatg

SEQ ID NO: 26058 - DNA, 3003 bp, Unknown; identical to SEQ ID NO: 26057
  misc_feature (1)..( 3003): 2750-1469P.txt file - cDNA_ID_2710251; gDNA_ID_2214589; Annot_ID_186729

SEQ ID NO: 26059 - DNA, 3003 bp, Unknown
  misc_feature (1)..( 3003): 2750-1469P.txt file - cDNA_ID_2710260; gDNA_ID_2214589; Annot_ID_135403
ccatatatttacatagaattttcaaaaattttattatcttattaatttatcgatttgtatcaatttttacactagtcccaactcggaaccagaaaaatttattaatttatagaagttattaatttatcgaatattaatttatagaggttatactgtatttctcttttatttgggttgtatttcttctttttttactgagtttgagatttaattttaataaaaattatcagtttgataaaaaaaaactaaaaatataattttctttataaactaataaaattaagtttctcattctagctaaaaggcttagcttaatattattatgaatattattcatctttcctctttcaaaaaacatatttttcatcttgattatcatcggttgcaaccaaaacgaaaggctaagtttcatattcattttactcccaaaccaaaacaaatagaggtaaataaatttttcgtatttcgtactggagctttaatgttaattttaccatttgttttcacccaaaaaaaaccacctgaatttcttgaacaaattcacaaggaaattaaatttgttttctgggttttaatttgtaacaaaatatcacctggttttattaaactagttccattagttaaaattaaaaattgccggtattgttttgttaaatattttattttgataaaatcctctgatctctatcattcgaagtcaaagctgttttgttcacgtaaaactgcatgtgtgatcctatatattgtatattgataaatacgtttaacaatgacaatctagtgagatagctcatgtcacatcgacctatgatcaatggattacttcagtttgataatatgtttgtatgtgatcacgaattatatattatataccaatcgatttttcattgttttatgtactataatttgatttcagctcactacatataatatttaaacgtgacatgttcatcttttttcgtcgtcgatcgacatatcaactataagattagtcggttgtacgtataaatcttgaccttttaccatggatttgtcctataaaagcttactagagactagagaccagaacgcattaatattattaggtctatcttctatcacttcatagtgtttctttaacactcatgttttgcaagtgtcgttttgtactattggaaaagattattgttataaaaaaaaaaatgaaacaaaactctaaaaaatcagttaatcttagttataaaacattatcctgctagaaatcattgcaactttaataaagtattgagtcttgaatcgttatgtccacttcgtttattttatataaaagtttgtcaactaattaatagctgattttttttttcttttaagagaaagaagatctcgaaatgagaattaaagataagatatatggttaggtagcgagtagaagaccaaagcaagaaactacgaccacgacatcttgcacataagaaaaaaaaaaagtagttcaatttcattttcgctttggtccactttattatttaacaaaaaataatatctaataaattacattaatataacagtccgtgttagactaagacacgaagcctcccccactaaatcgacgcaaataaaaataaacaaatggtggggttaagagtttaattcgagctgtggaatttttttataaatatacaaaaataataatatttaaaataatatatattacgataacaaatttttatgtcaatcaattatattttaagaatcttctaaaatcaaatattattgaactaataatttgaataataattttaattccactattattgaaaatattcatatcattagtttttaagggtgtatagtgaaaaaattcctcaatttcaaatatgttaatacaaatttccctttttaaaaattatcatgaaattggacaaactatatttatattgaaaaagatatataaacttatacaacacaaattgtaaacaaaaataacatgatgttcttcaataaaattataaatcatcaaacctaaactctaaaattgtcaaagtaaaaaacctaaattgacgaattctaatttattatagcgaaattctctgatgtttgtatgatgtcgaagttgattatgagagattttgtaaaattttgtgttttaattttaaccatagtttatctaatttttacgacaatgtagaaagacaggattaagatatttgaaaaattgaagtttttttttataaaatatataattgaataatttcttatagaattttagaaaaaaattttagataaaattaaaaaacacaaatgtaattcttttatgtagaatttggggaaccagactacaacaaatcataaatttctctaaatttacctaaaatcatattaaaaattaataaatcattatgaatcttaaattacttaaaatataaatttgaaaatactcctctaactcagagatcaattttttctaatgcctcgtgatttttttgcatcttgtagcttagtcacctatatatatttttagtggtaacaagattctctgttaaaaaaataataaaaattaaaaataataatagtttattttatgggaaaagacgcgagtggctcccaccagcctcaactttgcccacgtggaaccagccatatgcgcggcgtttagacaacaaaaaaaaagcgtgttgtttctttctctctctagaaagtcaaaaaaaggagacagacaaccaaacactgccttgtcacatctctctctctcttgcttttggcgagtaacgagtaagtccattttccatgtgcccactgtgtcttctctccttacacgccaccatctcctccacctcctcctccctcccttctccaattcccaattctcctccaaaccctagggttagggtttccacgattgcttcaccttcccttctttttttaaaacctcagatcttccgcttcctcgttcttgtctttttgttgagctgagaagcaaaaaaaaagtgttctttggcttcacgaggagccaacaacgaatcgatg

SEQ ID NO: 26060 - DNA, 3003 bp, Unknown
  misc_feature (1)..( 3003): 2750-1469P.txt file - cDNA_ID_2710264; gDNA_ID_2214589; Annot_ID_135404
gcttgtgttaagcgtactgaagcattcttcagatcgagatctaaatggaattgtggtaagttgttcaatttttatctgttttctcttctttgagatggttcatagtgatgaggatggttttttggtttcaggttggcacatatgtactacttgtcaaaaggattcgttctacatgtgttatacttgtccgtattcagtttgtaagaggtgtgttagaagctcagagtatgtagttgtaagggagaacaaaggattctgtggaatttgtatgaagactataatgcttattgagaatgcagctgaagctaacaaagaaaaggtatgagaatcctgtctacattttgttactttctcttactcgcagtactacaaggttatttgtggaacttgaggtctgttcttgtaatgtcgctttgtttttttaatgtggattctttcttctagctaaatgtattacatgtacattttctaggttcaggttgattttgatgatcaaggcagctgggagtatctttttaagatttactgggtttctcttaaagaaaagctaggtttatcgttagatgatcttaccaaagcaaaaaatccatggaaatcttcttcttctactgccgctaagcgaagaactactagtcgggttcatgaaaaggatgatggaaattctcctggggttatgaaaatacgtcgtgctaaagtaaggaaaatggatgctgtttctgtgagtaatttgggtccttctttggattcaaactgttctttgggtgacagacttccacaattgactagtgctgctacttgggcaaccaatgagcttttggactttgtggggtatatgaaaaacggtgatatttctgtcttatcaaagtatgatgtccaaactctcgtgctagagtatgtgagacggaataatctacaaaactctcctcagaattctgaaataatgtgtgactccaagcttatgagattgtttggaaaggagcgagtggacaacttggaaatgttaaagcttcttgattctcacttcatcgatcaagttaggtctccagtcacagataattcagccggaggagtcactgaaactatgtcttaccaggttaatgcgggcagaagctgtgataggttaaatacatctgaacagcatcaagaaggggaatcacagcaattgaacgggcacagtattcaagttagaccttccagttctgatagcagaaaccatgcagttgtaaaacctgacacaagtgccactctgtccaataagccaattgatggtttggatacaaatatggtatggttatatggagatccagatgggaagattcatggaccattttcgttatataacctgcgacaatggaattcaagcgggcatttcccaccagagctgagaatatggaggttgggtgaacagcaacacagctccatacttttgactgacgcattaaatgggcagttccataaaacagggttattacagaatcattctatccccaagcaggaagtgacagctactatagctaacgatcaaaacaggtctgtggctgttcctaaaatagagagtagaatacttgacttcagccccaactcagtgtgcactgaccagagtgttatttctagcagtaacagtgtcatcacaaggagctcggatgtgagtaacaaaagcggaaacaattgtagccacgccgtgccattggatttttctctttctaatgaaagggatactgtgggttttatctctctctgggacaaaagaaaagttgaaagttctttgcttgtacaaagcccaataagctgttcactctcgctggctacattacctagaaactcaaactgctctctgccaccacatgaaagatggagtgctggtcagacagatggaaacagtgcagcaacgactgcttgcaatcaaaacggtagtcttagcggctcagctgagaaacaagtcacggctacagtccagtcatgtggacagaactggaatgctgcaactccaagcagtgcttcaaatgtgtgggattcgaactcgggtttgacgtctttcccagacaatcaagaaatagactttttagatctctttagtccaactttcaaattcaactttgcatctactaccactgattggcaacccattgtggctggacctgacgaatgcgacgaatcagtctcagatcttttggcagaagtggaagccatggagtcccaaaaacgtcttccttctccaacttcgacattccgtggtcctgaagaattattaatccggcactcaataaacgatagcttcagtcccgcagaaggacatagcccagcactagatgtaagcaaaggtgactccatgagctccacaaacgatcttcaaatgcattcacgatctaacagcaccgtgcatttttagtcgtgggctcgggttcacatagagagaaatcataacctggggcacaggttaccatagatcatccaatgtcctagattcgtctgatcgatggtggactatgccctctttcttctctttttttttgcaggattattacagaacataaataaatggcagaatcatcagcaaaaatgaaaaaaaacgagtggtgcatatgtagaagatgtttcttcgcggtatttttgactgcacccattgttttcttcagtatttaggttttgtaacgttgtcctgtgttaagatttgcacagacatacccaacttctgtatcttttttttttacattgtttgtacttaggaacaagtataaaaatgggaagaaattgttgtccatggatgtaatcaaaacatttgtagggatcatatcatcttattattctatatatatgataatgatagtgtaacgtttcattctttttgttttgaatgtttcaaatctatttatatcatgacaagtgtaggctccagtttattctacttgtttttggaaaatgagacgaactctattgatcgtttctggatttggaaactttttgttgtttcttcgatttcgtttttgttgatctgagttgatg

SEQ ID NO: 26061 - DNA, 3003 bp, Unknown
  misc_feature (1)..( 3003): 2750-1469P.txt file - cDNA_ID_2710271; gDNA_ID_2214590; Annot_ID_135412
aaccactctaagttggaaggtaaataggagcgtatccttatcgactcttgatgggctatgcagccttttgcttctccactaatgaggacttaatacgatatagaggtgatacatcatatattcctacacacatgtttgggaaaaaccgagtctaagtatgaaaatttcaaagatgttatatccaacataatcatatgttttgctcatatgtttttaatactaagaactattttctatagtcttgattacttaatattagaatttagaagactagaagttttcatgccctatgagaataagcaaaatgctaaattttccggctacaatctacggtattaagtttgaacgaactattttcaatcttttgcaaagatttttcaagatagttgaagttaaccaaaatctttgatcgaagagagtcgtcgttccatatggtaagtttatacattgtgactgattttacaaatgtttaggaaaagtaattgggtagtatagtaacatcattacatcaacatgttggataatcgaagaaagagaaggtgggggatgatgggatcaatcaagaaaagcccatatggtgtgttccacagactggacgaatcaaacccatttattccaaatgtaaccgtccattaattgccaacccaagctttgtctcttaatttattctttactctataaaaatgaaccaaataagaattataaggaaaaatatcaaaagcattttcagaggaaagttttatactcttactgcattgttgcaattacatatgggtatgtacatatagccggtcctgagttttagaaggtcgaaaactagagaaaaaaattagagaggcgacaaaacattttttcgatgactagagaaatgacatgaataataaaatttcgatgaagtgaacaatatcgtatacgtttactaaaatgaattttctttgcaattcatcttcaatatataaatatgtgagtttccagtagaaacgaattaaaatgcaaaactgatggattttttatacattaacaagtgtggaaggtgtatccaacttattttagttttgaaatctgtcattttgctagttcgagactacattgaccgattcatcttatactattgtaatagcttaaatctcaatataatatgcaaatagtcttcgtattttgaggggtgtttggcatttttttaaaaaattttttatgacatgtgaataatctaacgaaatatacagtggtgcaattaaagcaatctaatccgatgagtaaatacgtcgagatttgtgaccaaattattactatcgtaaacgtagtttcggatagatttaatgaatagaagacaaatatggtttgctataggcgacgaagcaaatactataacacttgaacaaattagttaaaacatcatcaaatgcatgtatgtatcaagggcctagggattgattcaattcaccaacacaacacttacaaagagtcatctaaaacatgagggaaactggaacctaactttagcgtggactaaaatgctctataaacaagatgtatatctagaaagaaacaaacaaagtaaaactaatcagtagttcgtaaaaattggaaccaaattaaatatttaagagaaacttgaaagtcaagcagtgtggtccgtgcaagaactggtacaaacacatggctggattccaaaaaacgagtcaactccttggatcttacaaatccaccatcttattaatttttgaactctatgttactactattagtatacatgtccatgtactgacacacatacacaaatattgaaggagatatgtttttcttttatagtgattggctttttttgtaacactatattgttaaagtgtgatttcgaatcattgagttaccagtgactaaatatcaaaccgaagattttttgaatcggttgatgtttttgatcttgtaagtgaattttcctaatcgttaatctttacctttgttatatctctacattaataagtattcttgagatgatactggattccgttctagtggagacatatgatcattcacattcactaatatttcccttgttcatttctaatttgagtatgttcttgatctcggttcatcgattctccaccttcttcaattgcgcgcgatcggtttggctaattggctgtattctattaaccttcaatctcggcttcatcttaatgccagtttctcaacatgaggtgtgtatttcattacattaatcaacaaacaaattttaaattaatcagatttatatttaaatggacaaactctttctttctttattctattttttttcatccaaaaaaaacaacaacttgtttttatcatcataatttggctttgtactttatataaattacatatgtgtaaacaactatattagtaccacagtagctacgttttaaaagtgtataaatcatgtgatccgtacaaaaaaagttccactttgtccacacacacaccattgcactagaaaccttttttagcatctctttctaacatttttctttcttttgttctttttctctcaacacatagtctctttctggtcctacttcttattcttacagcttcttttgttggtgttcttgtgtcggtgccttaatattcaactttcctttttttgttttcacatcgaacatttcccctaaaagtaatctctctatctgttggagggttttacggcttttttgcttgtagtctaagcaactaaaacttttttccataaaccagattcatctcatctaattcctctttaaatcatactttaagcttctcttctgtaatcttattgctaatcatttcttgatattattatgcggatttgatctttcgtacagttgtctacaaacacacgtgtctgatccaaatatgggtttcgctttcttcccttttcttctggaaaatttaatgttcccaagttggcttaaatggttccttcattgataaagtcagaggacttctcgtgaagtcagaggatttgataaagaagaagacatg

SEQ ID NO: 26062 - DNA, 3003 bp, Unknown; identical to SEQ ID NO: 26061
  misc_feature (1)..( 3003): 2750-1469P.txt file - cDNA_ID_2710271; gDNA_ID_2214590; Annot_ID_186763

SEQ ID NO: 26063 - DNA, 3003 bp, Unknown
  misc_feature (1)..( 3003): 2750-1469P.txt file - cDNA_ID_2710285; gDNA_ID_2214590; Annot_ID_135410
ccttcgaaatcttcaaccttcagagaacaaagatgcaatggaaactcttgtcattacgagattatctacgcggacaaaacctattccaagggaatcttggcaaccgagacggtcacgataccttccacttcaggagagccctttgtgatggctgaaacaaaaattggttgtggcctcgacaacacaaacctccagtactcagggtttgcatcgagttcttccggcattgttggtctaaatatgggacctttgtcgcttatatctcagatggacttaccctacccaggtcttatctcttactgcttttctggtcaaggaactagtaagatcaattttggaacaaatgccattgtggcaggagatggaacggtagcagccgatatgtttatcaagaaagataatcctttctattatctaaacctagacgcggtcagcgttgaggacaacctgattgcgacattggggacaccgtttcatgccgaagacgggaacatttttatagactcaggaaccactctcacgtactttccaatgagctactgcaacctagtgagggaggcagtggaacaggttgtgacagcagttaaagtacctgacatgggcagtgacaacttgctttgctactactcggacaccatagatatctttcccgtgatcacaatgcatttttctggcggtgcggatcttgtcttggataagtataatatgtatctcgaaacgattaccggaggaatcttttgtttggctattgggtgtaatgatccgtcaatgcctgctgtctttgggaacagagcgcagaacaattttttggtgggttatgatccttcttcaaatgtgatttctttcagtcccactaattgttctgctttgtggagttgaagaaacaaaccaagagattctcttttctacattttcatggttttaacttcagttttgtttcgatttatttgtactgtcactaaaagcatatgacatagacatgtttaaatgaaaaaatatgcgaatgagttacacaattaatcgaaattcaaatcacaatctgctataatctcaagttttttctggagtttgcaacttgttctatcaaagtcttttataagttcattttttctcaatgcttcttatagataaacatgaccaaagaaagaaatcactaatattgcaaagcacataattttacctagaaatactaagttatgttttggtttagcctctcacagcttgaacggtagcaatcatgtgagccatcacgagagcgtaacgaacagctgtgtgttgtggagtgtagatgtctccaagtccaaactccccaaagttgagatctatgttcacaaacttacccggcaacgaccttttagccagagcttcattccatatctccaagaactcctccatcaccttttgtgccttttccattgatgatataggaagatactccacctgcaagtaacaacacacaaactcaaaattgagattacaagaaacaagacaatcaccaaaagggaacagctccatataccctttaggtgattagattagcattgagactatagggatttaagaaaacaaggattttttcatcatcattgtgattacacgaaacaagactaaagaaacttgtagatgcatagtcaacaatcaacaatgttcaattttcatcatctgtcttaacatcataaacagcatcaaggatcatcactaaaagatattacaagaaactcttttaacaagaaaaatctgtagaaaaacaagattttcatctttaaaattaatcaccactgttcagtgttcatcatatctgtcttaaacaagaaaaagctggaaactttgtttacctccatgacaatgcctctaacattctcagaatgagtaggaacaactttaccaactctcaacctaaaatcaccaagctgatactgaaacccatcaaagtaaagagccactttagatttataagactgaagcttctccataatcaactgaatcgaagaatcagcttccaagacaatcctctgcgtcctgataatgaaatagtacttattcggctgatccgcaagtgaaatccctagaaaatcacgaggaaactccaattgattcgcttggtcttttaacatgggtttgtaatagttgagtgttgctttccatcttccttctttcacaccattgatgctctctacacattgtgttgcttcgtttaggatttggctgcttactgttgatccttggtttggttgccaatgtaaaaccctagaaaaaaacaaaacccaaatacaagaatcggaagagtaatcagaacagaaacgaaaaaaatcgagattttggaaaacgaaattggatcaaagcttaccacttgacgggcattgttgttgagggagaatgacaaaacaaacactgttcgaaactgacacaacaaaaaataaaaaaaacatatgtatatgttatatcaacaaacccaatcgaaattgaggtatgggccgaaggcccaaaacagcttaataaatgtggcccaacacagcttaattaaatactccatgtctcttgattctattaactgttcttaacctggacttcacgtagacgaggaagaagaaccttgaatccgacatttgtttcttcattttaaggtagggttaagtctattttcggttctgggttttcttctctttcaattctcaaacaataactcgcaattttattttcacggatcttttttatttcaaaatcgaattgaaaaaaatggttcttcacaatctagcatatatgaaatttgggaataaagttacgatttttatatataatatggttttaatttcgttgattctatgttttgctactatgattgttaaagtgtcactctcattttcaacttctcggtgattagtgtgtttgtgttcttcaaagattgtaaatttgaatagcttggttttgttttctctaatagactgagatatgttatgatgtgtagctaaacctcttcactggtgaaagcaatttgatgttatg

SEQ ID NO: 26064 - DNA, 3003 bp, Unknown
  misc_feature (1)..( 3003): 2750-1469P.txt file - cDNA_ID_2710289; gDNA_ID_2214590; Annot_ID_135411
tgaacctatgaattcaactgctcctcctcgaccctcagtcacagcagcggaagctacacctccaaatctttcagctcctctcccgcactgcaacactcctcaaccaagtccaatatctcagcaagcagcagtagaatcaaacacacagatgcaatcaaccgcccttcctcgaccctctgttacagcagaagctcgtcctttacatcaaccacacagcaacacgtctcagccaagaccaataccacaacaagcattagcacaatccaacacaaatatcacttcaaccgcccttcctcgaccctcaatcacagcagaagctcgtctgttacatcaaccacacagcaacacgcctcagccaagaccaatacctcagaaagctttagtacaagccaacacagatatcaattcaaccgcccttcctcgacccttagtcacagcagaagcccctcctttacatcaatcaagctgcaaggctcctcagccaaaaccaatatctcagcaaccagcagtacaatccaagacggatatcatcaattcaaccgcccttcctcgaccctcagtcacaacagaagcccgtcctttacatcaaccacgcagcaaaacgcctcagccaaaaccagtatctcaaccaccagcaaaacaatcaaacacagaaatcaattcaactccccatcctcgaccctcagtcacatcaaaagctatatctctgcaatcaccgccctgcaacacacctcagccaagaccaccgcctttaatctccaaccatactccaacttcttatcaaccagcttctgctccaccagtgcatggtatagcgcgaaggaccatggcacctcatttaagatcatctcgagctcccaactctgctgctgcaccatcaacatatccaaggttggctcaagaacaacaaaagcaacaacaaaagaagtcaaacagtagcttggtctatctctcagatgacgactagtgacaaatctttgggagtatataacatcagtatatagtttttgaagtttctcttaagggaatatataagttcgagaggccctttaaaacatttgagaatgccttgtacgaaggatcatttcgaatactaattttttggagaatatcaagtaagttaactaaaatatttttcacaaatttgcagtttaatcaaaatttatttacataattctgttatttttactctataggaattttcaaaatactttttttctccttacttcgagttttgaaaatatttttcatgcagcgaatctctgatatcaatttagcgccacgtggcacgtgacataccccgatctctaataaatgaactctttttaaaatcgcccccctcgatacatcagttcactagtttagtgactccactcgaccacaaacgctaacgcaaacgcagtcgcgtggactcctctgtttatttcgcgttttagatttcttaattctcattctgatttgactgtggaaagggattcgtttctccttcaaggaaaaagttttatctttgctggaaactcaactacaaacgcggttttgctccatttcgcgtttgcgttttagctccaatgctggtactctctgttctactataagctgtagcaagctccaaatcctcaaaaatcgacattgttgcttcttcatattaaggtgggtttctcattaaatatgcgttttcaattcatttccctacatgtatgaagaaatcatgaaatggggttccccaaaaacttcaccttttacttggagagagcatcattgaatttgtgggacatgattctttccatcaaaaagttagattttttcggtcaatggtggaggaaacaggtcctacaatcgaaaaccggttttttaaaccggtttccgacaaccgacaccgggaattgtgagtcccacaatcaaaaaccgggttttaaaccggttcctgacaaccgacaccggaaattctgggtcctaacaaatttcaacagtttgcttcgaccaacgttttgcttttccttaaaagcaaagtcctttttggctctatctaatttggtttgtctataattttggatcaagaatctacaatgtcaagttcataaagaaagagtcatgtgagctaagttacagtatcatcatatagttcttgttaagattcacaaaatctaatatttatcaattttggtaaagtttaagatgttttgattataatataaagattttgccattagtaaacagtttaaagttaagagcttttcaatgattctgcctctttgattactataatggttgaaaggtcactctcagatttgcaatgcccgtttctttctattggtggttggtctgttttcattccatttattattgtatttgccattctttgactaatcctatactcaatcatttctttaatcacattattttagtaatcaatatccttcaagatgctccattacttctttttaatatcctcttgtctgcaacttccttttcttgactctgtagttcttacttcaacttcaccactttgcagggtaatgtaatctatattagctctcttgtttggttcttttagtgttttggttgttgtgttatgatgtttgttgtctgtatgtgaaaacatagccaactaactttagagggaactaaagattttgcagaatcagatgagtgacaatggatctttaaatgattgatgtggaccgtatatctatcgctatgagtttcttgttttctcttctaactctgggcccttttaagaattggagactcttgaccaaatcatagaatgtttttggttcatagtgggtgtaacagagttagaatcttttcgatgtctgttcaccaactcattcattcacattacactgtagttttacctgtgaattctataaaaattctactctacttgtaatctggtctaatctaaacataacttgtttcaggttttagattcttgcactcttggaggttgagcttagttcgacatgaaggtctttatctaatctccactcgctggcaatg

SEQ ID NO: 26065 - DNA, 3003 bp, Unknown
  misc_feature (1)..( 3003): 2750-1469P.txt file - cDNA_ID_2710293; gDNA_ID_2214590; Annot_ID_135414
aattgggcaagctttcaagtgtacaaagtcagagtgcgattacttcttgcacaagtcatgtttcgaccttcccggtgagatccatcacaagtctcacacaaatcaccctttgaccttgctccattctccaccgaatggcctatccacttacacgtgcgatgcgtgcggtgagtatggatctgctttcacttaccattgctcagagtgcaaataccatgttcacgtgggatgtgcgtttgtccccgagaacgtgaagcgtgaagatcacgaacacccactcactctactttacaacacaccatgcaaaggtcgtaaggacggtgtggtgttcatatgtgatgtttgcgaagtagatgtgtcggagaatctttgggtgtattactgcaaagaatgtgactatgggacacatgttcattcatgcacgacaaatgaagacaatgggccaaaaaaaggaggagaagaagaaggagaatcaagctcattatcgacttcaaggataaagtcattaatggaggctgaaaaagagatgagagagatggcgataatacatcaactacagttagatgctcttgacgcagcaggtagttatgtcggttcatgggaaccaaggagaaaagattattggtaaatgatgaatcttgggaggaccatcaaactttgtttgaattatattcttttgttttcattctgatatcgttctttctttgtatggtttgcaaattattatttttcatgtggcttgttgtaatgttatgaaataaaaatagttatatattttgctgtttgatttatattcaccgattctgattgatgcttatatattactttgtttccatcgcttctaaatgtcaaatgataatattctaagatcatagcaattgagatcacatgcttaaacaacaaacaacgacatttttttcacgaatccagtcttactattagaggaataacgaatcaagaaaaggttgttaagagagaaaaagaaaacaaattcattctcattcatcttaattgggaccggaaagattacattggaacctcttatatagtaagagatactctaaaactgagataagtaaacaccacaaaacaaaattaagagattagggtgtgtttgggatttgcactgagcttggaacataagagcacacaagtgggtaacaaaacttgtctctagattcgccaagatccactttactcaagattccattatttccaatgatgtaagcaatattgcgagcgggaaggtgacatttgtctattatctctttatcaagaacaaccgcgaccttcttctcctcgtcaacgaagaaactcctaccgacattaggaaaccaaaaaccagcgactggtttcatatcaacagcaaataacaagttgctccacgacactgcattaggctcaatcttattagtaatccatatctcgacgacggatgcccggtgaaacagcaccgcaagctgctcttctctaacactagcaagcgtcacagtatctccaaatacggctcggaaaggcagaggcagacgcggttcaaatcttgaaatcaaaggatagtagaaaatcagggtgatctagtgatggtagaccatgaaatgggatctcttctagggcataccagtaagtgtttccctttagagacacgccactgtgtttgtacaaaatataccagtctggagtgaaatcatcaatgacctcccatgaattggagtataaactgtaaatctgaagctcacgaattcggtccctactggtctccaagtactcattcacgaatctcaagattttgtgattctttttctcgtatccgagagcgtacttcacgcacttgtggtagatagaatttctaggtaattcgatataccttgtttgtcccaaataagggttccaaacaacaaccctagaagagtctttgtctctgtccttgttgatgcataagaataaacccttggcagtgaaagattttagatattttgattccatctgcattgagattacctataggatctatagacggagagagtagatctacgctcatcaaggaaactctatagtccatcatcatcaccacctcaattccattcctctgtttcttctttaaaaagctctcacttttcgttatagtgttccactttttgcaggtcaatcgcagtttccccagagatttcaccggaaccctagagagcacctcctcctccatatcaattggaagatcgaacatcttcgaatcgaatctcccaaaatctctctctcttttccgtgtctatcaatccatctcttcacgccctcttttagtgatataacttatctttttcaatttgggctttatggtaatgggtcaaggcccattaaggggtctcgtttagaactcttgattaatgtctgaaataagttttatacatttcttcatttggagagtcatttcgcagagacgacgcatagcttcttcacttgtcagctctcaacgtttctcacctgaaatttcacttctgcttcgtcttctcgagccggatctctaatttgtaaagctccctctctctttcttcttgttcttcttcgtctccttctacactgatggatcgttatttagctatttagggttttgtgagttgcattaactagagtaactcgcgaattcttctcctttgccttgcgatttggggaattttttagctccatcagccaattttacaattttgtatgtatccgtggatttatcacatgaattgtggacctctgagttttttttttttgttaggttcttctcgctttagttttgcttttaggtacataaattttcctcctttatgatttacttgctcttgggctattttcttttatttgtttggtatggagtatggactctagagtttagtttagtttttttttttgggcacattggttggaattagtcttgttttattctgaattgtgtaatcaatatctgcatgcttgtggtgatgcagggaattcttatgtgatggtgtaatttaagttaagatg

SEQ ID NO: 26066 - DNA, 3003 bp, Unknown
  misc_feature (1)..( 3003): 2750-1469P.txt file - cDNA_ID_2710297; gDNA_ID_2214590; Annot_ID_135415
atagtagacagtatacacttcataagacattctggctttaactgcacccttatggttgccatctgactaggcattgctatcagaagaggagaatctactgatcatcaatcgacttcaccaagttcttcgaccatttgttctgcgtcggctgaaacataaggttcataacagaatgtctcctttgtgttactttaatatgttagagatatggaaggatattttccaatgcaattatctcagttactttaagttttatttaacatactattttattttggtaggttgaaaatgagcttcccgaaaagatagagagattgatacgctgtgaggcttctgcttatcagaagctgttgatgaagagggttgaggataatttgggttcgattggaaatgcgaaggtgttgttttatgctctaggtgttggtagttttgcgataatgttgagttatttttttagttattttcttttgtttacagtctcgtgcagtgcacaactcagtaatggagcttcggaatatttgcaatcatccatatcttagccaactgcattcagaggaggtaatggttttcatttatctggaagtgttattgtaaatgcaatgaagcactggttagcgcactatggacaaccctaatgaagggcatttcacttttattaggtcaataacataattcctaagcatttcctgcctccaattgtaagactgtgtggaaagcttgagatgttggatcggatgttgcctaaactcaaagcaacagaccatcgggtaatgatttctctcttttccctcatggtaataggatagttgtgatgattcaatgctcttaaagacgaaagcttattattgaagttgggctaagtgttttcaagtagtgtgctagagtaccttgcattgcgttcgcctctggaggattaaagtgtctattacgaaaagtttttgaaattatgttttgattggatgaagcattactgttttttttccctttatttggttgcttacttgcttctatatcacttcacgcaaaacatcaagtcctcaactataagattttctgttatttgtgaaacgcacatatatattagaatttgtaacttttttgcatttttaccttaaatttaatactgaagcttataaatggttgttacttttatttatggtatgcatgaattcccacaggttcttttcttttccacaatgacaaggcttcttgatgtaatggaggattacctcaccttaaaggggtacaaataccttaggctggacgggcagacatctgggggtgatcgtggtgctcttattgatggtttcaacaagtcgggttccccatttttcatatttctgttgaggtgatgtatcatatatcatggctggctttctgtagttctaatctctatcgggatgattcatgttcatttttaatagatttagttatgttcctaaatactacaagttgtaaactcttttgggcgttcagtacgactgatatgtatttgtatgtgattgctgaatcattcatggaatttcagcattcgggctggtggagtaggagttaatcttcaagctgctgatactgtgatactattcgacactgactggaatcctcaggttagacctagcatttccatatgttaagttatagttgaatactgtggacatcaggccggacttgaagcagcatttattatacatttcaggttgatctgcaagctcaagctagggctcacaggattggccagaaaaaagatgtgcttgttcttcgttttgaaacggttagttttttatttattgtgctcaaggaaattaaacatctgaataaatgggttgatttgtgattggttgtaacttttaccctggtgtttttagtttatgttgtttcatcattgggctacataatgtagtgttgctgtcctaaatctatggctgttcaacatgacttatgaggcaaatagaacagtgcagtactcttgggagatactaattgtttcttggctttttccctttcaattgacgcgttattatataattaagctgtctgaactgtttgtttgtctttcgtccttaattatatcctaaggtgaattctgttgaggagcaagtcagagcttcagctgagcacaaacttggagttgctaaccagagtataaccgctggcttttttgacaataacacgaggtgaatcgagagacatcccttttatgcttcaagaagtttcaactaccaattctctaaaaaaattcttactttgtaacagtgctgaagatcgtaaggaatatttggaatcccttttgcgtgaatcaaagaaagaggaggatgctccagtattggacgatgatgccttaaatgatcttatagctcgaaggttaatactcttttgcatcgttttttatacagaataatttacttgcacaaattttaattttacaacagcctatgcatacgtggttttaaaataatcctgatagtttggttcctttgcactatgataaatctagaaattctaccaagattactgccaacaatttgtacaaagtattttactttctaactgtaaatatttgtcttctatattattttctattttcatagcatctactgttttttcatgtgttctgtgttaattgatagcttggcttcctttttaattcttagatgacaatctttttacatttccatgcatctcgattttcttttaactttcttgcagatctgacatttttgttatctttctagggagtcagagattgatatctttgagtccatcgacaaacaaaggaaagaaaatgagatggtatgcttgttcttattaactttattttcgggttatatcgttttatgatgtttatttgaaaaagatatggccgtgcaggaaacatggaataccttggtacatgggccagggtcagatagttttgcccacataccatctataccctctcggcttgttactgaagatgatttaaaactactatatgaaacaatgaaactaaatgatgtccccatg

SEQ ID NO: 26067 - DNA, 3003 bp, Unknown
  misc_feature (1)..( 3003): 2750-1469P.txt file - cDNA_ID_2710341; gDNA_ID_2214594; Annot_ID_135452
tgtaaactgatatataattaaatataatatgaaaattcgtcgttaactaattattatgaagttttttctctcttctctctttcataccttttagagagaaaaacactttgattctatcgattggatttttcccgtgaatagccgtctctagtgaatcgagtttttgtccatcatcttgtggctccgttagccaagatagctagcttctgtctggcaaatctagcttctataagcagttttggtcggcttttatatttgtttttagtttttttttatagattttaattgatgattcgttttatagattttaattgatgattcgttttaggtgttagtcacttaaaatcaatctatcgacttgtatctctggaagctcgatcttgcaaatcgcctaaagtaaagagaagaagagttgtttccagcaaatttggattgccatagccgtctctagttgtttttggtgcttcgatcaaacaaaattttgtgaattaatcagaatttttcctttttatcttatagggttgaatgatctgttattgatttacttctctatgtctatgcagaatctggtgaaaaacaaagtaaatcgatgtttaagaaatttacagcatcgattgagttcaccagaatcggaatcgttgacgacaaagattaaccggaatgtttaacgcatctctcatacgtgtctgtttttattacatttttggattgtaggcctgaacctgtacactttgtttatgaatctttaataatagataaaataaaacacttattattccgagcacgggcttgcatatggttcggttaagttcctgtttttcatatctttctttttatacgatttgtcagcatcattcagccatcgttattgacttgttgcctttgaattttgtatcgaaactaactaaataattcattgaacgagtgagactctaacacttgcatggtctatgtttcaggagagcttagatgtgcctataatcatcactaaccacgagacagctcactattagcattaaatgttaatacacatttcgtttctaaattctaacctttacgtgttgggtgggataaacaaacccgagactccacatttttctactagcattgacaatctgtccttatcacaagcttaaaggagaaaaatttgaacacatttttttagaaaaagaaaaaaacaattattgttgtcattaataaagtcggttaaattatttaacacaaataataaataataaaaataaaggataaaaaaaactatttcgacatataacatgtttcatacgaaaatatataaatgatatgttgtccaaacatatagtactttataggactatcacttttgtaaggattttggagataacgactactaagaacatttttaatggaagattgtattgaaaattttgtgaggttatattggatgaaaaattgacagaacccgttttgtgaagaaatttttgagaaaatggaaaaggtggacatgtgttcacatgcatttgattggatgtttagttttaataaaagaaaaaaaaaaaagcgtatattgttatctttacaaaagaaactcggattttctttctctctatttctcgcacgaagataaaaaccggtgaacttttgatttcctatgagttaacaccgttttatgtgtatatttgtggtatttgaggcttccaaacgctcaatttattaatttgacagacggtgttgattatcgctggaggaagataaacccattcagagaataacgaatctgatttggagagttttcgttgaaggaatgtctaaattaggtatgaatcaagccattctagcatgtatatgataactaaatattgtattttctagttaatatatgtaattttaattttatttaatattcttaagataaatttatcatgttcaacatgtgctactgtatttatctaatcattttaaatttgactaatatttaaaaatgcaatagttttgcttaaacttaaatcaaagtattattcctattttcgaaagtttgtgttgttatttatagtataattacatttatttaatttttataaaaaatatattttgcataatacacggtatagtgatccggtatatgacctgacgggttttaatataatacaagacgggttttattgcggaacgggttacataacatagcgggttaaaatcgatattaataaaaaattaaaatatttttgacaaaaaataataataattaaaatacatcattagccaacgctttgaaaaagttaaaatcttcattttattaatttgtcaaaaccaccaatattattttatgttgaattaaactaatttcattaattaaaatatatgaaacagttttttcgaattttaatgcggattaaaacctaattttttttttgttatttatagtattatatttatttaattttcataagaaatatattttgcatccactgaaaatatttcagtattttaggtcctgtaaatttgcaccactttttaaagccgtccgtaagtgtagccctttgatgatctatttattgatcagtatcactttacataggtttaaaatatgtcgactaaaaaaagggtcgtatccataacaagtaccaagagtggacgacttttcttttctgtccaaaaaaacaacaacaatgataatccaataatgaagtttttgcatatcaatattgtttaataaatttatcgaaatatccaaaagactagtgggtttgccatttatggagtttcaaattatttacaatgcgtccaacatccaaccagaataaggggaccgacgcaattaaactcatatatacttagacttttctactttgttttaattgtgataagttccttttctctttattggattacggataagttatttgacttttctcattccctcctcctcgttttctttaaatagaggccatgcatggtaacattttatgcatcacttgtttctccataataagagagttttaagcatttgaaacaaaaaaaatg

SEQ ID NO: 26068 - DNA, 3003 bp, Unknown; identical to SEQ ID NO: 26067
  misc_feature (1)..( 3003): 2750-1469P.txt file - cDNA_ID_2710341; gDNA_ID_2214594; Annot_ID_186841

SEQ ID NO: 26069 - DNA, 3003 bp, Unknown
  misc_feature (1)..( 3003): 2750-1469P.txt file - cDNA_ID_2710352; gDNA_ID_2214594; Annot_ID_135456
ccacttttgtagaaaggggtaagcctcacgttacttttccaaagaacccaaatcctgcctctcctattaaattcataatttgttaaaaccgaccatcctggaaacaacttttcactcagctcctgcatcttattctcctggacccgtgtttcaagtaaacaaccaaattgaaaattttgttcttgaacccatttctttatgattggatgctttgcagattcgtttaaaccactgacattcaagaagaaacccgtcatttagcgatgctttggagggagccctaaactctgaccactaggagtgtgcctagttgaaggagtagaaggattggagagcactttatgtgcagactttgatccacggggtaaagatgcccgaggtggcagctctaaaacccgtgaccttaccactgagtttttttttccttattttccacctcttgtgtttgagtatccgcctgtttagacttctcctcaggctcgtgaggttccatctctttagatatttcctcccctatatcctctgcgccacgaagtacaaagtatgagtttgataaaatagaaacttctccaaacttcaatcctacatgacttttcccggggctaagcgtagtcttaggagtgatccatccttcatcctctcctctctctacctctacttcccccggagcgttagattgaatcttaggcacctcatccaaagttacatgaacaacttccttagcttttcccgtaattggagaggatggctgaactggttctgaagcaactgcgggaatggttacaaaatcactattccccgtgctggttttctcaatagataaacatgtttctttaagatgaccccatttaccacatccattaaatctcggaggcagccaaggatatgaatatgtaataacagcatcgagctctccttcttcctcacccgtgaatacgtactctctaggtagatcttttgttaggtctgcttctattaagatttgtgcttcatcaaaactcacacaagcttccgtttttggatgtaaccgtattggcttacccactgcactagccaagaactccaaacctttatcagtgaacattgacgggggaacatctgtgagagtaaccaaaagctgaatggatttcatagctggttgagaatcttcttgaaaaggcgtccacttcgagagcaccatcggaatgtccataatgttccacattcttctattcagcactctcctcctcattgcctcattccttatgcgaaatttgactgttgttgcgtttacttcatacacatcaattaagtttaaattatctccaaattttattcacaatcatgtgaatctttcccacatgcggggccttcgtactaaggaatcgaccaaccaaaaaatcctcccagagaggttttgcacctgcaaaaaacctctttcggaacaaccactctttctttaccatcaactgcatctaccacaaacttttgttttgtgaagatatgtttttttgcagcgttgagccatgatttcttaactggtggagacaccacctcaacaactgttggagtagcatctagacctaacgagatctgctggtctgaaactgtctcacttgtatccgacaccaaaaccccttgctcacccttcttcgtatcatcagatttctcctcctgactctctagaatcggtaaactgttagccaaatcaatggccgacaccgaaacctcaccggaagtgactggagaggctgtcggctgcagcattcttgcttggtacgcaaaaaaaactaatcgcctttttttgtctcctgccacgtcagccctttttcttctttttaacctttgtctttctctttcttctttgtttgatttctctctcgtttttaccactcttagataaattataggtatgctgccaatctctctcttgataaatctaggctgccaagtgttcttcatattgatgggttttctctccctcattttgtagataatctctttatttctttggtcggaattcaatctttcttaaatttttcgttgtcatgtctttttctataattctttgtcactttcttccgtaacatgttatttctttgaattacacgtaatagcagaatatctctctctttaaaatgttacttttttgtattacatgttatttattaagatcacatgtaatttgtttttaaaacatgattttaatgttaaaacactttatttttctacgcttttctttaagtataatatgatttttttttattaaatgacatgttcttttagagcgataagaaaaaaattacaagtttttctttatctttaatttttcgtagtgcaaatgttaaatcagattctttagtacaaaaaattcgtaccgaaccgcatcatattacctatgtaaacaatatttctcaaagataactcttttgaacttaattattattggttgacaaaaaaacatgtttttttcacaaataacaatacgctactgcatttttgtctatgtttaagaagaaattttcacaaaagtggacgaaaaaagatttgctctaaccgtttgtcaaagtgagaactggttttcacgttttgtcttttcattcaatttcggaccaaattaccctgggaaaacttaataatggcacaaaccaaaccgtgcagcagttcgtatcggttgagttgacggcgtaaaccaaaccctacagcagttggtttcggtttagttgatgcggttcagttttgaaaaagacaaaaaaaaaaaactgaaacgaagaaacccgagaaaacgataaagagaagagagtaacggagagatttgagagagaatcagaaagcgaaacgaaattaagtatccattgcttcaaaattcaacataacttcgaattgttgggtagttgaattgagccacagaactcccacatccggggaagtgaaagttaatgtttttcccagcgaagccaagagaaagttactgtttattccggcaaaatttgaacctccggcgagatagcatctttagctatg

SEQ ID NO: 26070 - DNA, 3000 bp, Unknown; identical to SEQ ID NO: 13050
  misc_feature (1)..( 3000): 2750-1469P.txt file - cDNA_ID_2710363; gDNA_ID_2214594; Annot_ID_135463

SEQ ID NO: 26071 - DNA, 3003 bp, Unknown
  misc_feature (1)..( 3003): 2750-1469P.txt file - cDNA_ID_2710374; gDNA_ID_2214595; Annot_ID_135465
aatactaaaaaagaaagtttggattcatttcctacacaaatttatggttttataaatgtacaaagaatattgaactaatatttcatgttccgattatatataagttcccattttcaatcgatgagattaataaagaaactttctggagtatatatttaacattttcgattttatattatgaagctaaagtatgtacagtatgttggtgaaaaaacatggatcgttaaataaaaaaacatattaaggaggagaacgaccgagcatcttctaaagaagattaaagcataagaacattggaataaggaaggtgaagtattgtcgtggacattcctgagtgggaagactcaccattacatacataattaattagtaacaaagacattggcgcctgtcttgttcccgttgcttttccccatctttatctccaattctctctctctctgtctctcttgttctactactttggggaagatgatagcttcttcttcttctccctccatcacttgttcttgattctacttgtggtcctccgcttctcttttcaggtgattggtcattgatctctggtttttttattttgcaaacttatgggttttgcttttcgtttttttctctgtcttactaatccgaatctgattcaaagtttacaactttaactaggggtttttctcactgaactcttatgagtgagacatagattcgtcttctaggtctgtttccggagggaattaattaataatagtatcaattttcgattatttttctttggttgattctctatcgaagattgtcgatgcttccaaagttgaagcctttgttacttctgaactcaggattgtcttgtgcctcgctgtagattatcgaagatagttgtggttctgggtaattagcttttggtgataaaggtttgtgctttacacatcttctgctactttttgggtatggcctaactaaaaaaagtaacttttagtatctctttccgatgatatcgattttataggagtgaatctctcatcttgcttcggagtgaaacaaatcatgtttttgttttgtcggaatgcttatctgattgcagtgcatatagttgtcaaagtttgttcttgatggtgatgtagaagctcttttatttgacatatttggttctttgtttagtttatttttagtaggatctagaagatcatggctcaaaggaaaggacctgatccgcctccgcctcaaaggcggattctgcggactcaaactgctggtaatctcggagaggctatgttggacagtgaagtggtgccatcgtctcttgtggagattgctccgatccttcgtgtagctaatgaagttgaagctagtaacccccgtgttgcttacttatgtgagttgaaataattaaaaaaatcgcctggtgatgtgatttggtcatcttatatgatcttgaaaaatatcgtcgtggatgtttctatcaggtcggttttatgcgtttgagaaggcacacaggcttgatcccacatcaagtggacgtggtgttcgccagtttaagactgcgcttcttcaacggttagaacgggtgaatatcgtctcttcatttactctgcttgagttttcatcttcaccccgttgtcttgctaggggattatgtgtcattttgccttatatcccaaacttctgcaggagaatgaaacaactcttgcaggaaggcagaagagtgatgcacgcgaaatgcaaagtttctatcaacactactacaagaaatacatccaagctttgcaaaacgccgctgacaaagctgaccggtttgttgacatccctgtcttatctctattgcaatctatctttctgtgattctcattcataatacaaatttgttttacttgtagtgctcaacttacaaaggcatatcaaactgctgctgttctctttgaagtcttgaaagctgttaatcagacagaagatgtggaagttgctgatgaggtgacctgattctagattatattttgtagtatttaagtctcttacttctgatcttatcccatgctttcgtggaaattttgatattctttattgatattatttgtagtatgaaagctgttaataaaaaattttgatattctttattgactcactgggttttgttcatcctttttcttgctggtagattttggaggctcacacaaaggtggaagaaaaaagccaaatctacgtgccttacaacattcttccccttgatcctgatagtcaaaatcaggctataatgagatttcctgaggttaaccaaacattccactaactgtttcaattctatgtttacttgtcttttgagacggaaaataaataacacttttctgcagatacaagctacagtaagcgcacttcgtaacactaggggtttaccatggccagctggtcacaagaagaaactcgatgaagacatgctagactggcttcaaactatgtttggttttcaggtgatgctagcgaatatcctgtttggttagttgattgaggatttatccctgtgctgattgtgctccaaacctttaaaatggcagaaagataatgtttcaaatcaaagagagcacttgattttgttacttgctaatgtccacattcgacagtttccaagacctgaacaacaaccaagggtatgtattcttttcaacttggatatgagggtttcttgctcgtctagtcctctgtatctgcactaacggcctaaattacaatttctgcctttagctggatgatcgtgcattgactatagtgatgaagaaacttttcaaaaactacaaaaagtggtgcaagtatttgggtcggaagagcagcctttggtgaggcatctccttgtaacacctgcttttgagaatttattttgttatttcttaggaatatagaaacagatgtagtacataaattggatactataagtctttgtgcttagttatctctcttttccctgcttgtaggttgccgacgattcaacaagaggttcagcagcggaaactgctatacatg

SEQ ID NO: 26072 - DNA, 3000 bp, Unknown; identical to SEQ ID NO: 13069
  misc_feature (1)..( 3000): 2750-1469P.txt file - cDNA_ID_2710382; gDNA_ID_2214595; Annot_ID_135468

SEQ ID NO: 26073 - DNA, 3000 bp, Unknown; identical to SEQ ID NO: 13069
  misc_feature (1)..( 3000): 2750-1469P.txt file - cDNA_ID_2710382; gDNA_ID_2214595; Annot_ID_186880

SEQ ID NO: 26074 - DNA, 3000 bp, Unknown; identical to SEQ ID NO: 13070
  misc_feature (1)..( 3000): 2750-1469P.txt file - cDNA_ID_2710386; gDNA_ID_2214595; Annot_ID_135469

SEQ ID NO: 26075 - DNA, 3000 bp, Unknown
  misc_feature (1)..( 3000): 2750-1469P.txt file - cDNA_ID_2710398; gDNA_ID_2214595; Annot_ID_135477
caggtcgagttttcactggtccgaccaagcaggtcattcggtcaatatttgttttgttaatcaagtcctaaagatattttagccaccagtgactataactaagtctggctatttttgtacatgtagaatcaagtaataactaataaggagttaaggactaacgatcagttatgacttgctgttgctggtaatttggcgggtgagaatagacaatggatagaagcaagttaaaaatggaaatgaagcatccaatataataagtattttggaagcatgtttttgtgaattatctcattatgatttggttatagagactaatgtgaagtcgtgttggtgaaaggtttgaaacttgttgtgtttcatatattcaatagtttagcgactatttttgcttgtagcctatatattttcagggttatccctcgttactggtaaagatcgtatcggataacactcgaaatgcacagctgagctatcatcgtgccaaggctagggtggaccggtggtaccacttcgcgtagttatccggcaccagaaaaaaaaaaaaagattcgaactcatctttcatatggataaatttatgtgggccacaacagaaaatatagctatcatcatactttgttgttacataagctactcatgattcgtccgccaatattccatcaccaaataagaaccacaaaagcggcgactgatggatcataagattttagattatggtaagttgtagaatgtttgtaatgccttcacaccattatgcctcttgccatgttgggggtatggacaacaacttagccccacaaattgatgccctattttgtttagactggaattttgaaacacatttttctctattttgctatttttggggtcatcagtctacacatggatgttgcaaatgaccaccaattcggttcacttcaggttgggtttaattacgacccgactatgatctagccaaccataatttagcctcgatatctgaggtttaggtctgattcgaccaagctttatagcaatacaagtcaaccggaagttagaaatgatacgtttgatgagttcaatccgggttgaaccgggtgagtttatatgaccaaaacaactcttcacaataaatgaataaaatatctcgagttgtgaatgtatggttgttcttagttgggtctctatcgtcctctctctctattataactatcccaatctcttcggtgttgtaatagagacatgggaactactagacaaggaaaagctcataaattcgatacatccaacattcaaagcacatgacacgaactttgaggcgtaagctgtcacaagttaacatcaaacctagacatatagattttatttcaacaaactgattatttatacaatacttttatttcattctataagtagtgataccacatatttcaggttcaaggctcatgatcgacttgctacctctaatccgtttcctgcaaaatttgacgacagaatctgtaagttgaaacagacaggatcgctgaaagataatcctagaacacatgttccggatcgatagaccaaagtactaaagcatcaatgcatataaatatataatacacaagaactgtaatttgcaaatgcttgtgctgaataagaaaagtagacatatatctgaccaagttataatagttattaagccggcttaagagcaaaacagagattaattaccatcaggatcaaagaagaaaacttgcttgacttttccatcaggaagagacttctgaaaagtttctatccctttctcctacatcataacaaggacgagaaaggatcgattaaataactctgaaagataccaatcatatccataactgtaccatcaaaagctcatgtaaacaagccaaagaaacaataccttgagagaatgaaggaaagagtcgaaatttgggacagagaaacagatatgatgacccattgggagatggctaggatccttaaccgctgaggtagcactgtaaggaccttctggaagatttgttgaagggtttctctggataatatgcattgcaaaagcacctggtaagtttagccacaccacctgtaggtctccaaaatcaggactttcgatctcctcgaacccaaacacctgacaattatacatatataatccattggtttcagaacaaaccacgaagatgaagataacactaacttaatcaaaaggattaaaggcatccaaaagtggacactctcaatagaaactagaaacgagataagtgacaagagaaagagacaaagccacaatagcaacacaaatctctaaataaaaagccaaattacaaaccatagattctaatccagatgggtaatcgactcagtgcgtttgtttttttgggtcgaaattggtagtaacaacacaaacccagaacagagaatacgaagagagataagaaaaagaaaagtgtaagaaattgaaaacgtcgattaggtgtcgttacctctttgtaaaactgggcgaggcgtgtgatgtctgatgattctctggctatatggccaagactcgccatgtttggttccaagcggacaaagctaatcaagaagaacaactcagaaacaaaaatggtcgacaaaaaagagattagtaaaagtacgtggcatcggctccttataacacatctttaatcaaaccataaggttgaaccgatcggtttgactatcagtgaaactaaaaccaactttaaaaaaaagaattattatacgtaattgcagttactccaagaaaaattaatctgttgcttaatctgaatatccgaccaatcagaaatgttcggaccccgaccaaacaatgtatccggtttaaaacatccggtccggtattaaacccttattgctccgtaatctctcacctccaccaattcctcattcttccaatcgcacttcctttaccagatcagacgtcaatttcaactcttcagtgaagagatttctttcaccgaattttctactccgatcgatcaattgaagattgaaatg

SEQ ID NO: 26076 - DNA, 3000 bp, Unknown; identical to SEQ ID NO: 13067
  misc_feature (1)..( 3000): 2750-1469P.txt file - cDNA_ID_2710400; gDNA_ID_2214595; Annot_ID_135482

SEQ ID NO: 26077 - DNA, 3003 bp, Unknown
  misc_feature (1)..( 3003): 2750-1469P.txt file - cDNA_ID_2710402; gDNA_ID_2214595; Annot_ID_135484
acattataccctctaaaaactggaatagcgccagctgtcaagaagaatattgacggtaactaaacaaaaacaatcttaattagtgcttaattacttatatttttcttaagacatttgggtgaatgatattattatctgggcagattttctagtggagaaatttggattctcagaaagtaaagcttcaagcttaagagttgaactcttcaagacttatggaagtactctcgctggtcttagggtaatttcacttctccattttctaaagaattactagttcattatatatcattgctttctaatttatttatttctttcttataaattgtaggcgttaggtcatgatgttcatcctgatgaatatcacaggtaataatcaatcatcttcaacaactatataaatattttgatctcaggaaagcgatttttgttcttaagcttttttttcttgcaaaatctgttttgtagtttcgtgcacggaaggttaccgtatgggtcgatcgaaccaaacaacaagctacgtaaccttctcaacaaaatcaaacagagaaaaattgtaagtttaatcttttatttattgtggcatgaatttttcttgggtccatacagccaacactaataaatgatcatttgttttttcttgggtccagatatttacgaattcggacaagaatcatgcggtgaaggtcctcaagaaacttggtttagaagattgtttcgaagagatgatttgttttgagacaatgaacccaaatttattcgggtcaacaacccgacccgatgaatacccggttgttctcaagccttcgttgaccgcaatggatatttgcattcgtgtagccaacgttgatcctcgccgaacagtaatattcttatttatttaattatttcttatgataaaactattgtatcatcattacaataagcaaactgtttttgtaaataggtatttttggatgataatatccacaatattaccgcgggtaaatctgtcgggcttcgcacaatcctggtaaatttttgttacatttcacatttattaattccctattttgcgacatttgtatgtgttagtttcaagttttaaaaatttggttacaaaaaggtgggaagagcagaaaagacgaaagatgcggattatgcggtggagacggttactgagatagctacggcggtgccagagatttgggctacggcgacggcgacaggcggatttgacgttggtggtgagaggatcagacggagcaagagtgagctggagggtatggcttcaatagcagccgtcggtgcgtgacgtgatcgagtgggcggatcgtggccgttggataattttaacgtctagtggttgggattgtacaggtggcgttaaaatgttgataatgcatatgtgaatataaataatagtggtggtggacaatattcatcccatgtggacaccaaatgtgaatacgcaatcagataatattatgtatgatgattatgatttcaatatgtgtacatttttattcaactgatttttttaaagtttgattgggattttataattagtctgttcgtttcgtcgccgcgggtacctgcggctgcggtagacgcaactagttgtgtttgtttggttgccgcaactacttgcggcaaaacgcagcgtcaaacgcagttttctgcggttaaaaattttagacgccatttaaatttagcgtcaaagatgaaagagttgcgttatatatcctaaatgacaaaaatatccttattatttttgaaaattcacaaacaaaccaagcgattctcttcttcaacaaacaaaccctaaatcccaattctcttcttcgtttcttctgtcaagatcaccaaacatgcggcagcgtcggtggcaacgatggcggcatcgaaacgaacacaaaacctgcggttgcgacagcggctgcggcaacgttggcggcgacgaaacgaacaacaacctgcggcagtgttaccgttgccgctgccgcaaccgcagccgctgccgcctgcggccactaaacgaacagactaaatatagttttttattagagatatgctgtttataattttatctccaaccaccatgatacatattacagttaaatctctataaattaataaattctttcactcccgaattgggaccattataaaaaataatataaatcgataaattaataagataataactttttgaaaagtcctatgtaaatatatggtctcatcaatatcataaattaataattttataaatatatcaattatatatacattatatgtaagaaattgttttgaaatataattctaatatttttttgcttaaaacttgtatttattcttatttaaaatttagttatagtattttactttatcaaaaacttttgatgttgttttctaaacatgatattattatttacttgtaattgatttttgaaagatattttctataatgaaaaaaatcttatagaaatttttgaaaagttactaaattaagaaaatctctgtataaattaataaatattaatttatcgataaattaaaacatctataaattaataaaattttgcagtctcaacattattaatttataaaggttttactgtatttgataaacgaatcccttgcgatttatatcttgctgtatttctaaatcctaccgaagttttttttctactgtaggaagtaattcacagttttatatctatggtatttataaattctgaatgtctggcattacaacatttaaaacgttcctaacttactccattttcattgtaggagaaataatataacatttatatctatgttagtaatataacattttcaaattgctattgttatattttcaaatttggacctcatgttccttagtaggccaaactttaccccattttcatagtaggagaaataataaaacgtacctttcagaaataatcttacgtcaaaatatatccttaaataacagaaaagtctttttagtcttcgtgtatacgaggaaccataatg

SEQ ID NO: 26078 - DNA, 3003 bp, Unknown
  misc_feature (1)..( 3003): 2750-1469P.txt file - cDNA_ID_2710406; gDNA_ID_2214595; Annot_ID_135485
cttacttgtttctccttaggaaatgtcgattgagctaagtttggaggatgtaaagagagttgcttcacattatgggtttgagatggaggtaaatctacacaatataatgacaatgacatttgcctgtcagaaataaaacatctcatgatgcatgttcttcctcacttatatgagtggttgtcctaacaatatttgcagaaagaaaaaacaatagaaacaacgtactctacaaacccccggtctatgatgaaggtcagatttttttccatgtctttggatttgtggttgacttttggatccagagatgggtttaatttgtgcatgatgttgtgtgtgtctgttgcagaaccgatactatcctgtcttctggacaatgaggaagaagtgtgctataacaacaacttaaccaaatattcctcaaaactatatatgttttattctgttgcatttgtttttaaggaattaacgggtccaatctaaaacacatactatttcttttgttgttgcaaaataatgaaactgtgtttttcggttgatgtttgaaaaccaagtaaccaacactcaaagctaaacaaaacctttggcctgtgggcacaaagctaaaattttattattttctcggcactactacgcaaataggctaactaaggcccattaaataatatgaggcccaacttgaaaaagactcgtttcttgttactaataacctttccgatgaaatcaactccaaaaccgaagagccaccaccatggtttcgccgtcagagatgacggagacggcaccggcaattatgacaacggaaagcgaaaggatagagagttcgagggaactcgtggataatgaagaggaggagaaaatacgccgtcagaagaagctcgaagaagctctcgaagccaaatctcttcgccgcattatcagtgcttacctcaagtatctcacttttctcagtccttttaaacactcatccttctctggattttacatcatttcataggcactgtgttttctgattctaaagataattctactgattgggaatttcaaatcacaattctagtttctagattttactttttatctttttctttagcattttggtattggttctgcatcgttgacctttggaaatgtttacagttacccagaggcttcggaagaggatttgaaaagatgggaaagatcatatcggaagctgtctcctgcacacaaggttattttttgcctcatttctagcattgagaatagtagtagcatgttctgtaacagttaagagattaccaaacgatttcaagtcaagttgattttttgtcgaatcttctttgtttgcttatataatagaactaatggtttcagtgatgaatttttgtcctttgtgtaggcattggtaccccattaccctatgaagtttcagagattaagaaggtgaaatctttagtcagttaaatatttcacttatcatcttgtagtcttattaaatgtcgcgattcacttggatgatattcagaattttttatttccatcatagttgcttcgaggtttgcatttgattgcctaaattttgtgttcgggtgtcatttttatgatatccatgcttcttataattcttctttctcatgcttgcatactaaactcgatagtatgcaagattgaacttgactcatttctatcctgtctgtacttgtcccagacaccctgcacatagtgtttgttgaagtgttagtaagttgttggattttgtttgttgcaggtgtatatcggcgaattcatatttcatatttaatatgcttcaggtcagttgcagacatttctttttctaattcccttggtgtttcatttgcttcaacttatttgattatgtgattcgtaacttgacttgaaatgctagaaaatctacagttcatgtcaattgtcatgtaaaaatgtaattcataattacttggcaggcttttgagcctcctatagacttgagtcaggaacttgatggttgtgaagactcaaatcttgactgcgctccacatgagagatacactctagatgaaaggcacgactcttcttgtcagccggccttgaccaatagttgtacatataaggaagaaagcaaacacattcgtgacccaataacaggagtgtctatcgaggtcagatcaagacattggaactttatccttgtcatttaaaatctttaatttatttgtataaatacaggagcttcagaggaaagaagctcatgatcattctcccaaggatgactctgcagacacaagaatcaacgataagacatgtgattgtcatgaaggccagttaaatcatgaccatggcagtgtaatgccaactcatatactcttatacctcagttccgcccagaaaacgtttttgactatgttagctttgcgcagattctttagttattgtatcagttaagatctttggtgggatcatatgagtatttcctggcattctagatcaaatgaattttaactgttagtctatattaagaaagcattcaactgtcaagcataggcttgttgtatatatttttgcattatacttcatttatgactataaaattgtcataattcatgtgatttttctaattctaatgttcctcttttctttcttaggtatcattttcatcccatgattggttggattcatcgttacagacacatgttcctctggttgatgtagataaggtatggtttttcaaatttactatggctggtgatattcattttcctcagtcctagcctcctaggtaatcataattgtataagagctcttgtagcgtgagacaaagatcattatgtgtcatgttagaacttattctcaatctctattagttccattaggcagtttggtaagttatgagggttggtttgctcatgtagctttgcatggggaggtaaatcctgttgagcttaagtgcaccttcttacacgtatgcatatgcacatgatagaggtgacacacacaccagtacaattgcatatatttgttgcgatg

SEQ ID NO: 26079 - DNA, 3000 bp, Unknown; identical to SEQ ID NO: 12655
  misc_feature (1)..( 3000): 2750-1469P.txt file - cDNA_ID_2710418; gDNA_ID_2214565; Annot_ID_134929

SEQ ID NO: 26080 - DNA, 3003 bp, Unknown
  misc_feature (1)..( 3003): 2750-1469P.txt file - cDNA_ID_2710422; gDNA_ID_2214596; Annot_ID_135496
ttcatcggttacgaactaaaagaggctttaacgccatcacacacaattcacaagccaatagcagtttcactaatttcattcggtgtggctcgatagaagaaggtagtagaagagaagagcctaaatgaattttagtttaaattgggcttttaaatattttcggcccaaacttatttagtgtcccaaataagtttggtatttttattatcgaaagtgttcatactattttaaaattctaatatgtatagcttggagtattattgattctggagtttgagtgactttagcatcttattactaaataatactagtataacaacaaaagcgttagatggcatttacacttgtaagataatttaaatcatattcaaaccccttaagactcttttagaaatacaaaaatgagaagagttttaatgactttaaaatttccacttaatgatactagtatagcaacaaaagcgttaggtgacgtatacatttcgacgacgattcaaatcaatcatattcaaaccccttaacccaaattatacttttctttcttttcttatattttatttatttttaaacaaaattttaaaccccgaaaattaagtttgggcattttcttttataacaataatctcaatttaatagggaaaaataattgaaaatatgtagctagctagatttccccacacccataggtaattgttacaaaaggtgcatgcaaggtaaggacctctagcattcgaataatttgcaagctttcaatattcctcttttcttaaaaattagcttggattattattcatatacttatcacattgaaatgtgcaagcttgatttttgttattaatagaaaattaattaactcaaagtacataataaatatgttgattgagtactcaaatcactgatggtctgtccttttcattctcctttggcgttgggaaacatctaaagcttaaacgtaaggccttcaatgatttgtcccaattcaaaattatcaaagttagttcttacgtatagtcaatcatcaaatcatttgtaattgtataattataattgatatctatcaaaaataaatcattaagacttaagagttatgtgtttatttagacacatgataagactaaatccgaaatagattacttatttgttcttcaatatagatcaattagcttgaattatttgtagtattatacaggtacattattgactgaattagttgtgcatgcatttattagacaagaccttgacctattggcttagcaattataaatctagataatatatagatataatgtattaatgtctaattaagtcaattcgtataagctaagaggtatgagtttagtggcatccttatcaaacaattatcgaaaacaactatcttaatattaataatgtttatttattcatactaggccctaactcatacaagtcagacactcgactcatactgcataacagcataagtattaatttggagattctagcaataacagtgttttaacttttaaaggaacagaatacacaaatgtttttctttgaccccgaggctgccaagtgggtgaggagtagtgacgtcgcgtcgttgaattttctttgagcagtacaaactacaaacaaacaagatggatcccattttgtttgtccgttttaagtttggcggtatcattatccatgcacaaatcaaaatcacgcaactttttttataattaattttccataataattaacgatgaaacatattttccaagaaataatgtaacgttaaattaagcaggtacatattttgtaaaaaaaagttttggttattttcttttgttgccattcatcttttgttttttgctaacttgttctccgatcctcgatacattttaagtagataagtcgcatttacatacattttgtttgtctcctcgatacattttgctagcttgttcacctcgatacattttaagtatataagtcgcattttaagtataaaagtatcattgcgttgtgagtttttttttccattttaaaggctgggagctggagacgtacgtgtgattttatttttatggtaaataaatttaatacgaaaacaaatttactagtacttattaaattgttaatacgtaacttcgtactttatactatggttaaattgtttgggaaaagttttttttgtttgttaagttccaagaatttgtttagaaaaagttatgaacttatacgcggtttgctttaaaatgtttcactttttgttggtcaataaataaatgaacttcactttgcatgaatacagattgactatatcatacatacattaaatatactaatatacgtatattcgcaaaaataaagtacatacaatatatatacgtagctctatgattaaaaagcagcaaatgattgtaaatgttacgcacagtctggcaatttaaagccttctttgcattgcttcacccttaaggtttacgtttagtgaactaacttacatacattgtgtggaacatgtaatccatataaattgaccacaaaatagagttgtgaaatgtttagtttcattgcatcaaagagaatatattttttcaaataaaagatagtacttgtcacttcctatatctcttacctgttaactagaaataaataaacaaatccaaaaaaaatgtgtcctacttacttactaatgcttcaagcttggtaacacatcaaattaatattctgatatatcatatatcacctatcttacaaagtcattaattttcaggatggaagagattagattaggcactgcttattatacgataaagattgatatggatgcatcatatttccgaaataaagtacaagtatttacggtatgtgattttgctcgaaacttaagagtcgtttcttagtaagaaattaattaacatcgacacaaatcaaaaatagtaacgaacataaaaatgtaactatatatacatgtatccttaagctgctgctactacaacaactcgctaatcattaagtttcataactataatg

SEQ ID NO: 26081 - DNA, 3003 bp, Unknown; identical to SEQ ID NO: 26080
  misc_feature (1)..( 3003): 2750-1469P.txt file - cDNA_ID_2710422; gDNA_ID_2214596; Annot_ID_186926

SEQ ID NO: 26082 - DNA, 3003 bp, Unknown
  misc_feature (1)..( 3003): 2750-1469P.txt file - cDNA_ID_2710429; gDNA_ID_2214596; Annot_ID_135492
acctaaatgatctcataattagtcagtacccactccacttaacatttttctcacgagaaagtaaaatagatggaatgattagtaaaatagtccaagaaaaaaagtttggtcgactcgacaaagttatttgatctcgtgactaatatacattttctgaaaacttttaataattaacttagcaaatacaatgttgtttttcgagtttatttgccatgacaatttctcaccgccttaacaaattcatttttaaaaagttctagaatcattttggctattggttatttatatatcaaacaaaatataaaggacagaaatccttagaagatgtataaaacgacggcaaggagaaataaactatcaaagaaggtacaggcgataacttagccaggatttagctcctgtgccaaatgggaaagtgacccatttgatctatataacattcaaagtcctgattttgactgttgaatattatcataaaaactcattataaaaaaaccaaagtaataaaagttgccacaacaatatcagtacgcatccaatcttctcgggaagagaaacaaaatcaaattaagaaaggttttcaaagaaggaagagagtcaaaggaacataatatccaaattttcaacttcataaactttttctaaatttattcaacatgaaaaaggagggaaacattgaatggtatcaatcagtatcaggtttctaaaaagggaatgttcatacttacaacaaagaaaatttaaacaacaatcaaaattagaaagacagcaagaaaagtagaaaactttggcattttgatttacatttatgaatttccacatttatcatgaggtcggtggaagcggcggagcaacagttattttaaccgccgcaacaagtcttcaattctccttcctctccgccgccaatctgccgacaagtttcttttcgtcttaagaaaatatattgggtctcgtttcgtacaacaaagtgtagtgtttgggctttactcagaagcccataagtattttattattatttttagacagtaaggcccaatagtattttattgttactgtctgcgctgaaacaatttatgtttttcagcaaagtaatatcttactaatcagtaattacatacaccgtaacaccatcacgaattttcagtacacgacagagtataggtatgattgactgacaacaatataaaaaggctaaattagttagactgtcttattaattaaaaagtaatattgtactattactatactacttcacttaaatatttattcgacacacaaaaataaaccattcgtgtgaatgtttcccaaacacatttggggccgaagcattcgagcgggcgtaccactccaattacctggtacacataattgaagactatagtatgaaaattaatgttttatgtttttgtcacctaaatttttaataaaatgcagttgcagtttggttgtcattgttctgttgatccgttcattccgcgtcctgtatttggctatcacaatttcaatctatgaaaatttgaaatccgtatggtcaaaattatattttaaaaccacattgctagagaataattaaaaaaataataatcttcatgtggaatttatagaaattaatgatatacatttcaggaaaacttagcatgaagtatattattttaatgtgatgattttagaaatacaaaccgagacgcggtatgggatatggtccattacaagtaggcacaatggtccactaataattgttattacgacaacagaattaattgcctatttaaaacgaaatgaatcatcgaagaacatactagatctttttccaatttacaaccaaaaaaaacattattaggtgagtagtaaaaagattaaggttatcagaaactaactgtagtagtatgttgtgtgaaattcttttgtatttcttattaagccaagggtgccctttcaatgcaacgtgataaacgccaaaaacgatgatatgaacaattataaactcgttgagagcattgaactcggataataaatcatcttttatatacatcgtagataacaaacaaacacgtaattaaatttgacgtatagcaaaagacttgaagaataaaacgtcaagttaaagataattttggtatatatgagaaaggtatcgacaaaaaccataacgctatagatgattgtgatttgacaaaaacaccctcaaatcattgttttcagagtttttttagataaggtacagataagaaaccacctctaaaaatcaagcaatagatctcatcgcttaaaagaagagagagatcttcacttgtatgtgtcccactgattccaacacaatgtcccagaacttgccacgtgtcgttcatttcaaaagattgcagtactgttgtccctagagaatcattatctccctcgctgtaatatctttatgctcctgtcactttctgtctgtacccaaaagaagtaatgaacctctctcatcttcttcttctctgtttctttcatgttttgtgagttgtttctcaacaattttctggtctcttagagtgagaggagagagatagagagttgtgttgggcgtggaacttggactagttccacatatcaggttatatagatcttctctttcaacttctgattcgtccagaagctttcctaatctggtcagtagtactctttttatacgggtttttggttttataagatgtggctatatttggaaataactattttgcaagctttcctagattgccagaatataaaaaaagatgtttaacaagagaacggactcatggacttgctttaaattttaattattttaaaatcattctataatgattagagtaaataaactattaggactctgaattataaaattcgattttatatatgctcctccttgtatctcttaatcataagttatcattagctctgttcactagtgctataaaatatattctgaggttaataaaacttttttttctttttattttgaaatgtctccagagatctgacatg

SEQ ID NO: 26083 - DNA, 3000 bp, Unknown; identical to SEQ ID NO: 13088
  misc_feature (1)..( 3000): 2750-1469P.txt file - cDNA_ID_2710433; gDNA_ID_2214596; Annot_ID_135495

SEQ ID NO: 26084 - DNA, 3003 bp, Unknown
  misc_feature (1)..( 3003): 2750-1469P.txt file - cDNA_ID_2710440; gDNA_ID_2214597; Annot_ID_135498
gtcaaaagtatttatgggtccggcgcataggcagacacaaagaagattaaaggaggtcagctggtctttttagaattctacatttgcattgtaaccctttaaaattcatgatattatttatatatatttttttatttttactcttttaaaattacaaattcatatgtaaaccttctaagttttattgtatttttcttctactttgtggtttgacactatttctaacatgttttttactttttttgtttgattcacccataaacattgaaccatattttatctattttttaaatgaagttttttgagttttaaattttttggttacttattatttcgaagttatattttgatactttataaattatttatgggtccgccgcataggcagacccaaaaaagattaaagcaggtcaactggtctctctagaattttatattcgcattgtaacccattaaaatttatgatattatttatatttctattgtttttacctttaaaatcactaattcttatgtaaacatttaaagatttatcgtgtttttcttctactttgtgttttgatactatttctttgttttcaacttttttgtttgattcacccataaatattgaaccaaattttggtgtttttaaaagaaatgaagatttttttagttttttaattacttattattcaagttataatttgatcctataaaaagtattttggatccttgacttgaaatgtaaaattaacgggtacaatgtgatagttaatatcctaaacattatatgacacatgcctttgatacgggtaaatagatataaatataggtgttgttatatccatataatatatattttttaatttcgtaaatgtctctaacttatcactctaaattatgattgattcaagaagatactcattttaaatttttttggtcgaatttcaaaaattttggtatgcttgatctttaaaatttaaatttaattttaaaaaaacaaattttggtcgcgcaaggcgcgggtggctcacttagtctcatattattccttcacgaatctggacttattacattttcgtttataaaaggaacgttaatacccggttcattccagtttacagactcaatcatagttattctaaaccatactctaataaaaaccaaattagtcaaactgacccaaatcagaaacaaaacgaaccataaataaatcgaaatgcacatcactagcaacttttctataaaagtgaaagtgggtggacagacacttgggtagaaaacccaagagatgagtggcttccacgtcatcctttacagtgatcctcgcacgcatgtataacacttatatcagtcaaagtcattattttaatcaatggaccatttccaacttaactttaactttaatgatgccagctttgtgtcacaccacttactaataaacgtagaaatatatccaaaaatgaactaaaacactactctggaaatattaaatatagaaaaccaaagaattggaacagttcatcgggaagggttttgggaccctagagaatccatggctatcactctcactaatttcactgtaagtacactatttctttactttctctatggtttgttgatgatgaaaaatttatcaatctttgtctcagtttctctatatggatgcaaacctgaaacgtttaggcgacatatatccttccttgaacttcatgggtttataggagtttgcgtatgtatatagatacatgaatgctcaattttggattgttgttccttaagaatgattacagttttagggtttggagcaaatgtagttactcttcttctgattctgattctcaccataacgagaagaaatggtagatgtaacagaagggtaagagtaagcctaattttctactttggttttggtaaaaaaaaagaactgattcgtcctcatttgattttctttattagaaaagctacattgagaagtgtttgttgtatgtaacacctgcacttggagcttgtttgtcatgtgtggacttggtgttacttgtgagaacaaaccgtaggagagaagtcattctctgttttgtccccttgtctggtttcgtaatgtgggtaagcttcttgttaccaaacacgaacagaactctgtctttgtctttctcttttgtttctgctttgaaggttttttttaccttgtagattgccgtcatcctctcattgaagtttgcttgttgtgcgtgccacgttttcactagccagattctatgtttctggtggatctttagattcctaacagatgcccttcatcttaacatgattttcacattacaggtaattaagttgtctttatgaatctgtcacattctccatataagtagagttggttaaccgaatttggagcgtgtacaggagatttgcctcatcatgttggacattgcttttggtatctctattaatgtcctcaggataaagcaggcacatcccaaaatcatgtatatgctttaatatggttctcttatttaatatttttttccttttcatttcttgtttaattccttattctccttgtagtcctttggaagatccacttattgaagacgacgatgatcaaaagcgcattgtacgacgtctcttccttgtaactaactagtttaaagagtagttaaagaccaatagatttgttcattctttgaaggagaaaaatggaagctggtgggacttattcacttttgggtacattggttcaataatgaaacatggctcggtgaagcagctagaattggaaaatctacttacactaccacctgaaatggatccttttacatgttgtgagaatttattgagatgttggcaacttcaagagtgtaataattactcaactccatcactaatttggtcaatatatggtgtatatggatggccatattttcgtcttggactgttaaaggtacgttgcttatttgactttcttatataatctttgttaatattgctactacaaaacatgaattttgcaggtgttcaatg

SEQ ID NO: 26085 - DNA, 3003 bp, Unknown
  misc_feature (1)..( 3003): 2750-1469P.txt file - cDNA_ID_2710444; gDNA_ID_2214598; Annot_ID_135505
aacagcacaatacaacgatgcctttaaccttgtccaatacaaaaacggaaataagtcaatgagttctcagattgatatcacgttttcacaatgtcctcaacttgagcctttgcctcgtttagtctttgccttactccgtaatccccttctccggtttcatgaagaaggtgttcatcctgattacagaatctacttgcaatgccttttcaggtaaccatcccaatgaactactaataaccaacctagagtcagcgtgaacaatattgtatatttagtgtattttttcgatcgtggatttatttggaaaaaataccttggtatctcatgtaaacagaccacaagcaaggctttagtctctaaatttcgtgtttgtgttcttctgttttgttttccttaaaactgcagtgtgttggacccgagctctcttcattgcggcatttacccagcactaatgtcatattcaacaccggatacactggcatatccgcgtcattcgttgagccgtgcagcattgataacaagtggtagtccgatatttttcctagatgcatataccactttgatagtcttctactcatcaacagcagacccgtcaatacctttccctccacctcaagactgtaagttttctcaccaaatgaaatccagttcaaccacctttagatctttgagactatgttgattcgaaaacttatatcttacaggtttattgaggcagaccataaataaagtgaagcaagaaaggagcatcacaccaaaactagtgtttatccgaggaggacgagacgatgctactgtctttgagaactatcttatagaagaacaagatgtggacggtaatggttttgctagcgccatgggtttcgtgtctttcctcgatgatatttcgcagcgtgtcactgaatacatgaagtgaaagccaaatgaccctctagtttattatacatccaaactcaaaattttcaactgtgtcagagttttactcttcttgttgtaacatttgctttagactagcatcccaacttttttgctctcttaatcaaaatgaataattaagctaaaattttgttgcaaaacttcattttctaaactttgacttacatatttggtaacactagagccaaagagcaaaaagatatgttagtctattacatgctcatggccacaaccactgcttcaagcttacaagctaatctccaacataaacctgaaaacatgttcttagcaaaaatataaccttgagttcattcatcttcttcatcactctctacctcttcaccacttccacttacgctcccgtcctcgttctcattatcttcaccaaccccgctcccattttcttccatgctatggtcctcattcccgctctcttcgctctcattcccattctcttccatgctgttttcctcatcctccttctcgttctcctcatcattcccattctcttccgtattttcatcgtcgttctcctcatcattcccattctcttctgtattttcatcgtcattctcatcttcctcatcgtttccattctcatcctcctcatcgtttccattctcttcttccgtgttgtcattctcagtctcctcgtcattcctcttagtttcctcatctattttgcttttccttgcacccttttgcgtagatggttcttcctgtttcctcttcttcgtctctttgggcttcgaagcagttccacttgaagatttcaaagcagctccaccagcaggatacgaagcagctgcagcacccgcctttttccccgcattcttcttcttaaaatctgaaaaccagtcatgtggattacactaggattgacatcataagctcaaagtgcacacacctaggccagtgtccataacaagacaaatcacaacctaagccatttctactaacactccatgaaagtaacaacagatagtgacaataggatcttcatccgaacaaaacacttaccttcaagagaagatttaagcggctccaaaaattctgaaaaatccatttcttctaatgccttaaacacatcatcagccttcatagtttgtcttcttgcatctttacaaaaatcatttgccctatatcattcacccccaaattaaactaaatccatcaattcgatcgatcacaattcacaaacactaacattcatcaattgaatcacattaacataaacccaaacttggaacattccaaatcattcactatcatagtgcagaaattcgaaaaaaagttagggtttgtgaagtgtacatacgtggcggagaggtagtggatgaagatcctcgcactctctgagaatgcgagcaaagcttccttgtgaatactgacgtcataatccggcgaacactccgacagcttcttcttcaccacccggcgcacaatagctagcggcagctcgtccaccaccactttctccgactccattcttctctcctctctctcagtcgccgtctttcccgcctttatgttaataatacaacaaaacacatcggcccagtaagctgatcagcctattaaaatatttaaaagcccatattcaagtttataagcactaaagagttatgaccacgccgctcaatattacccgttggattgattgacaaaatcctagccgtcaaatcgtactagcaaatcggcccattattcaaattgataagcactaaagagttatgagcacgttgtcaatctcaccgttggataacctttattaaatcttcaccgtccaatcgtaatactaataaattcgatcaaaacacgaataagaatcggagtcgtcttcaacctctggaatttgagacatcttcgaataaccagattctccgaattcgagccatttctaagaatttcatactctgattaatgtcttactcaaacgcctacgcaccgtcggcaccggagctaccagaatcgttcgttcagcagcagcacgatggtgaaagtagatacacttacgcgtatccatcatatcaaccaactcagcaattcagctcttactccgggatg

SEQ ID NO: 26086 - DNA, 3000 bp, Unknown; identical to SEQ ID NO: 13103
  misc_feature (1)..( 3000): 2750-1469P.txt file - cDNA_ID_2710462; gDNA_ID_2214598; Annot_ID_135507

SEQ ID NO: 26087 - DNA, 3003 bp, Unknown
  misc_feature (1)..( 3003): 2750-1469P.txt file - cDNA_ID_2710477; gDNA_ID_2213645; Annot_ID_132375
tcccaagttcttagacaatctaacaacactttctagtttgttgcaaattagatccaaaacattctccaaagacaacacctttactatctctacttaaccttctgatacaaaaacacaacaacgttctctgcattccgctagcaatcatcaagattcccaagttcttagacaatctaacaacactttctagtttgttgcaaattagatccaaaacattctccaaagacaacacctttactatctctacttaaccttctgatacaaaaacacaacaacgttctctgcattccgctagcaatcatcaagattcccaagttcttagacaatctaacaacactttctagtttgttgcaaattagatcggaaacatttcccaaagacaacacctttactatctctacttaaccttctgatacaaaaacacaacaacgttctctgcattccgctagcaatcatcaagatttttccaagttcttagacaatctaacaacactttctagtttctagcaaattagatccgaaacattccctaaagacaacacctttactatctctacttaaccaatatcgaaccaatatcgaaacacacatgaaaactgaaacaaagttgcagagtaatttagctcaaattcctctattttcttggaaacgataccgggaaaaaaaaagctataaacttgaccacataacacacaaaacccaaatcaatttgacatttttagcctaaaaatcaatcaaaagaaagggatcgaaatgaaataaaacgatcattaaatggcgataatcgaaaccctagaagttgaccacagtatggaaaagctcaccggagatttcagcagctgagaataccgattcgagatccgtcagagatagaacaagtttccggaagaatgtagcagaaatcgaaacaattagggtttggcgagaagaagaatgtaaaattgggagcgatgatttttttttgtttgattgaaaaaaaaattgagaggaaatgttttttttttttttaaaccgtcgttggggttggaagagacggcgaagatgctgacgtggactcagcgactatgtttcgtcagtgcgttgacacgtgttctcatcattgcggatattgtttttgtatgtgttttagattttatggattttcattttaatcgttgggttcaaaactttaaaagcccaaattcataaaatccatagttatatcattttaaactacataaatacaaaacaaatatttacatcttcgtgatatcattttgatcctctacacatctaagatattattatcatcttggttttctacaatttttaccttccttactttgagtctttgattgtatatcatcttcaaaaatatacgccaaattcgttttttggatctttttacaaagatttttttcgtcgactatcacaaactttgactctatgaaacaaattgaagaaaaatgaattccctaaaaatcttggaagaaacaaggaggctaatggtgctttaacaagtaggctagtggtgcactggtgcttttacctttgttgacatcccaccaaatttaagctcgatcaatgtgactctaattggccactaggtaacatgttaaaaataaaaagaaagttccctaaaaacttcaaactttttacttcaacaaagagaaaccaaaaaaaatctagtgttcatgagtttatcattcattttaattttaaacaccggttcttcgattcatctccaaaaaatcccttcaaaatctagaaaccctaagggggtcgtgtgcctccatttcttttctctttcattttgtgaaatccaaaacattatcgtctatcatatgtataaacaaaaatttgttgcattttttactaacaagataggttactttgcatacaatttaaagtgacgacattttgccaatcgataagtctctttctcaagagagaattaaaaatgcaaggcctgcagcctctggcagcaaaaataatacaagggtagtggaccgacaaaataataaatggggcactctataatcagaagacggccacgactcgagctggtaataagatactaattgacattgtaatgcatggcaaatgataattgcctatttaggacaagagcattaaaataattttcaattatttagagtaattacttctaaaatttaaaattttagcctcgactccaggtgtatgaaaacatggtaagtatggtcaaataataaaaaacaatactgaaaaaagaagttgttggcaatgatttaataataaaataatgtttttttaaaaaatcccaaaaaatcatatctacccgatcacatactaagtcaaatgtagttttaaatagattaggtagtctatttttagggtgtattttactgaatacttcttccgtttcacaaaaatgtcattttaatttattttattatacatattctccttcattataagagtttttaaagaaaatcacggatttaggatgctgatgtataagcattatactaataatacactaatttatatagaatattggaatcaatacactaatagtactattgaagtctatatataatgttttgtaaaaaattcttacacaaatcagtctagtaataacattttctttattatcttttggattggaacgaaaacaagtacaaaatacgatacataatctacaaataactcgcaaataaacaagtcaagaaacggtacaaagaatctgcaaacacatttttttttgagagtgtaaacaaataaaatacaaatacaaagttttattgtcccatacaaagtaaatttcctttgccccacctttacttaaggctcattaactcatatgactcattggcccatctctgccaattgtcacacgacttgatggttttctttgttttcgacgaagtgctaaaacatgtggctcaactttgggttccaaaacaaaagattttgaaaataatatatcataacacaaagaaaagaaagaaagatataaagtcagcttaaagctctcgcatg

SEQ ID NO: 26088 - DNA, 3003 bp, Unknown; identical to SEQ ID NO: 26087
  misc_feature (1)..( 3003): 2750-1469P.txt file - cDNA_ID_2710477; gDNA_ID_2213645; Annot_ID_181419

SEQ ID NO: 26089 - DNA, 3003 bp, Unknown; identical to SEQ ID NO: 15517
  misc_feature (1)..( 3003): 2750-1469P.txt file - cDNA_ID_2710489; gDNA_ID_2214599; Annot_ID_135523

SEQ ID NO: 26090 - DNA, 3003 bp, Unknown
  misc_feature (1)..( 3003): 2750-1469P.txt file - cDNA_ID_2710492; gDNA_ID_2214599; Annot_ID_135527
acaatattggcatgccgtattctatctatattattcactagctccaaaaatttgccttcttcttcatgattgggagacttcttatccaacttcctcacagcgaagagctatccaagaaagtaaactaacttatcagttgcggaaattgaatacacataaagaaagaatgaatgtaatgcatatatacctttccacctggaagctctgccctgtagacactcccaagcatgcctgttccaataaggttttcgtgggaaaagctatttgtgtgttgttgtagagatgcgaccgtgaaatgcttcacagctgtcaagggaccatgggatttactggttgtcctttttagagatgcttcagcaggttcagtcgcctttgcgatgacccttttgataggtggaattgatgagggatgcatcaaatccatagcattgccattcatgtctatctcatgactctcctgctttgattcacttcctacgcttctttctgccccaccatgcagcttcgaagcacctcctactctctcttttggtctagcctccttgtcttttgtttgaatttcattgaagaagagaaaacaaacatgtgactttcttgaaatctaaaagtgaagaaatcaagatatgagatttcacctttattgaatgtattggatggaggaagcatagaagcatttgagcgagaaccctcccttgccctcccgtattcactagttaggtgcggtttggatagttgttcactgtcttctctttttctgagacattttctcccacaaagtagacataccaaggccaaaaccacaaatgaaaaagccccaagaatggatatccaaataattcttttactggtaaatgagtcttctttcccttgaggagttggtcgggatgggtgatgatcagaagggggtgatctcacgtgtgcctgaccatgaccagctgatgcattgggagatggtggtccaaaaaatggccgcttaggtgatgttggacttggaggtgtttcaggtgaaggcgatggagcaatagtgacgttaaacagattaccgccttttctgcatcatagtttgtcacatcagcggactgatactttgacaagaaaaagtagcagaatttgtagatgtaaagttggaacgagcaatgaaaactgttgcagcttacatgaaatttggtatactcaacaacttttctggtataggtccattgaagaggttgttctcaacgttcctgtagagttaataagaatgagagtaagcaagtggcaagatatataacagttgacaggaaaagaagatgggatggcaaagaatttgtacaagtccttgaggggaagatcttgaagaacatcaagctctcctgaaagatgattgttctgcaaaagcctgaaaggatgagaaatcagaacaacgaactgaatgagacctactcaacacagactgatatgtatatggaatgcaaaggagaaactcacaaggatgtaagagtcgaaagattctgcatggaaggaggtaatggtccactcagattgttgctagacaaatctctacgcatatgtcgaatgttcggttacacatatatacagaaaacaatcttaacacagctgatttagaaagcagacctacatattgatcataaggccaaggtcttgaaagacatcgggtatcttgccagacaaaaggttattgttcaaggacctgtaagaccaaagaagtcttaaacgcttatcaccggtagagaatgaatgtgatgacagagagagcagagacttacatgacagacaaagattttaaggaggaaagagattctgggatggttcctgtaaagttgttacctgaaagaaacctgtgaaaatgtaaagattgtaatacaagatgttgaataagaaaaaagaggggatttgcgagttggaaaatgggaaacatacaagttctgcaatgaaacaggcaacgtggatgggatacttcctccaatgtgattgttgctaaaatccctgagacaaaacatcaaaaggtaaaaataaggagagaagcagattaaagaagcaaaagtcataaacgcaagagaggataaagtacattgctttaagagaggtaaacatgtttaagccaacaccaagctctcctccaagattggcactgatgagaattctgaaaaagggtgagagtgttgttagaagaatgataaagaaaagtaagaagaagaagatgggaggtgtcgttttttacattgtttctacttgggaagcattacatagaacaccttgccagctctcaccacatgggtcacctccagatgcaacccaaccggggagaagaggagactccagtgcaaggaagagactgttaatagccgcaactaaagcaaacaatcagggtacgattagctatactaacattaccattacacaaaagggaaaaacagagagaattaggggcttaccatcgtcaggattggtaagagcaagtgacaaggagggaagggagataagggcaaaggagagaaaacccaggaagcagatgttgttgtctctcccagatctcatcgatctcattccgaatccagtagacactaagagagatatgtgagtgaacagagtcgttgaaaattcaaaagcaaaacttagcagccaagaatatgattcgacagacgaaggaaaaaggtgagtaagagaactttatgttatcttaagagaaaagggaatgtttttttgcaagtgagtgagagagagcgtcactgtgtgaatgcgattcttcttagttcttacaagcaaatctaaacttgtgttttcaaaatttgacgggcagacgaaacagagaagacgacaaagaagcttttaatgggcctacatttatttatgataaggaatataatgggctttagtttataaacaataggcccaaatgagaccttcttgtagaagaagagggttcatcgtcaccttaaactcattaccgtcaccggtgagattcctccaaaatcgggactttttctcaggacgtttgagatg

SEQ ID NO: 26091 - DNA, 3003 bp, Unknown; identical to SEQ ID NO: 26090
  misc_feature (1)..( 3003): 2750-1469P.txt file - cDNA_ID_2710492; gDNA_ID_2214599; Annot_ID_186988

SEQ ID NO: 26092 - DNA, 3003 bp, Unknown
  misc_feature (1)..( 3003): 2750-1469P.txt file - cDNA_ID_2710500; gDNA_ID_2214599; Annot_ID_135509
gtattggaattaataaaatacatattttatgagaagacaaaattttcttttatgaaaaccaaaagattaatttaagcaaaggttatacaaataaattattattatattttagtttttttaaaaaaaataggaaaattctgttgatgattccttgaaataaccaaagttggctgagttgatgatcatcctagtcaaacattgtgtaggttattcaacaagtgatgtctatgtgcctaccaaagattaatatgagtctctaattgatggcctttttgggcctattgggtcacaaattaaattaaactccatcaatttcttttgtgcatgagatctaaacgcaattttagttagctaacgttatgtacatcatgtcttaactaggggttaatccgtgtcgtacacgggtgtagaaggttaaataaggtgattaaaggatacataaacgtatccgaaaacttacaaaatcaatctgtggtgcgtttgagtgttacagtttaaactgagcaattgtgatcaaagcatgcatagagaaatacataatattttactagcttttaaattataaaattttgtcttataaatcaatcttatgaaattgatatactcgattgtcgaagaatgatctctaatgagcgaaactgttgttgaagaatgctaaatgaacattttgttacctttctggtgttagataatactttagagtcgccaaattcgtccaaaatataaattctctctacttatagaaagagaagtggtgaacgtgaatggtcataagtcataactaaagtcgtgatttgatgaactcctccactttgatcaccttatatgtatgagtaagctgcaaagtggcgcgaaattagtgccatacttttgtaattttaactttaaaataaatcattacatgctcattttcatataattaaaacactgtattagaatgctgataacaaattttacactttgaatattattctccatgaaagccaattatataaaaccgtccacaatgatttctttaatatgggaataatagtcaccgacagtgtttttcttttggtacttcccttagagcatctccaatttgatacaaatatataaaggaaaaaaaaaacccaaatattggcattgattttgtgatattatgaaatattaatttaccaacataagatagatttaacagaaattaacttaagcaaatatataaaatgttagattttatttttgttgttgaaaatgttagattttatagtaagaaagtactattttatgtgggattcacatggttgaacatttgtcaaatctaaagaggaaaataagttaaattactcacatgacttgtgagaatctgagtcctaatgacactcaacatgtggtctatatttttgtagagattgtttaggaaaaactcctagacaaagatttatttttatctttgtctcagttttaaatttgaatgaaccgtgttcaacaacacatacttaatatacaattatacatgcactgacattaatagctatttttaattattgatcttcatatgaaggtattccatgacgcattaagcggtggagcccctcagagggcagggttacacatgttgttggcagcaagtttttttttttctctccaaatcacaataaaattagattagtcagaagattacttatttttcttagcatatcagctatctatacgtagatgtgtaattgctaggatcattgtctaatcgaacatgaacgtctctttactcttcaaaaaatgttttcctagttttacgtccctattggattaaactaaaaaataaaaaaataattgaaaacgtaaacgaaattttttttaaaacaaataacaaaagagaaaaagaaaacatgatggtatactagtttggtggggctaaggacacgttcctttgatcaaataactaataagtacaacttacaataatggaagctcatgttataatcaacttactcgagattgaacaactctctctcttatatgtttgcactctaccgttgtattgtaacatgaccttcaataaattagtcaaggtttcaaatccaacaaacatgtagaacatgacattttattgtgaaaccgaacccaacttttttttttcacttaccctagttcgtcaaaatttattatattttggaattaaattaaaattaattctttgtacatacataaccatacattagttattttgttttggaataaataactacgaaaaaatgtttttgacaacaagtattatttacttttcactgtcttcactcttctcttctgtagtattagtattatggattggattaaataccaaatgagaaatttaagtcccttgtgtggcagatctggtgggttaatgataccaacgttctaccgtaaaagcccatccgaaattaacgcatacttaaccacaacacaacacacacacacacacatcaaagtgcgtgtatcctgattcttacttgctacctttcttcttccttcttcatcattcatcattcatcattcatcattcatcattctcatatctctcttcttttactggggatcacaatatctatctagttgtaaattgtgaatgatagatcctgagccttcttgccgccacctcttgaacttaatgtacttgaaaccagtctccacatagcgatagagagagagatctgttatgtgtgtattcatcaagttctctttttttgggctcaaagtgtaaaaggagacattttcaattctgagttcttttgttttcttataataaaatctgggttttctgagattttcttcacatcgtccgaaacgtggacacattttgatcttttgggtgtcactgtgtcaataaaggttgaaactttgattacatttctctcaaaaggattaatttttatttctctatctgggtgagatttggattaattggtgaggaatcggaagaaactggcgagattacaagcgattgtgaaatatcagaatctaataagaggaagaagaggcatg

SEQ ID NO: 26093 - DNA, 3000 bp, Unknown; identical to SEQ ID NO: 13104
  misc_feature (1)..( 3000): 2750-1469P.txt file - cDNA_ID_2710515; gDNA_ID_2214599; Annot_ID_135513

SEQ ID NO: 26094 - DNA, 3000 bp, Unknown; identical to SEQ ID NO: 13104
  misc_feature (1)..( 3000): 2750-1469P.txt file - cDNA_ID_2710515; gDNA_ID_2214599; Annot_ID_186968

SEQ ID NO: 26095 - DNA, 3000 bp, Unknown; identical to SEQ ID NO: 13105
  misc_feature (1)..( 3000): 2750-1469P.txt file - cDNA_ID_2710527; gDNA_ID_2214599; Annot_ID_135519

SEQ ID NO: 26096 - DNA, 3000 bp, Unknown; identical to SEQ ID NO: 13113
  misc_feature (1)..( 3000): 2750-1469P.txt file - cDNA_ID_2710527; gDNA_ID_2214599; Annot_ID_186976

SEQ ID NO: 26097 - DNA, 3000 bp, Unknown; identical to SEQ ID NO: 13107
  misc_feature (1)..( 3000): 2750-1469P.txt file - cDNA_ID_2710531; gDNA_ID_2214599; Annot_ID_135521

SEQ ID NO: 26098 - DNA, 3000 bp, Unknown; identical to SEQ ID NO: 13107
  misc_feature (1)..( 3000): 2750-1469P.txt file - cDNA_ID_2710531; gDNA_ID_2214599; Annot_ID_186978

SEQ ID NO: 26099 - DNA, 3003 bp, Unknown
  misc_feature (1)..( 3003): 2750-1469P.txt file - cDNA_ID_2710535; gDNA_ID_2214599; Annot_ID_135522
tctgcgtgtaatatacgtttcaatggattcgagtctgaatacaccagtacaccaccaccaccactggacaacaatacataaaaagacacaaaccaaaataattgttagacccacgttacttaaaaaaaacatagatctgagtcgaaaaaggtatgaagcttatagagatggtatgcattatatcatgcatcacagctagggaagaggccaaaagaggacaagcgaaaaattcggacacgtgcataggagtggtcaaaaacatcacaagactaaaaatactaagaaaacagtcaaagcatctataaagagaattggaaacaaaagagttatatagattctacagctaaaagaagaataagaagaagaagaagaagaagaagaagtgtagaatggtgaaggagatctaaaggagaataaggagagacctgaaagtgctgagaagaagaatcttggaagtagaagggtaagccttgaataagctagaagctctctggtaaaagctatggaaactcatgttgatgatttctcaaacctcagatccaaaagaaaacaaagctgagagctttggaagagaggctgcgaatgtgaaagaatatgcaatatggaaactatcaaagctactttagggtacgtgagagagaggtcggcgacacacaaaacaaaatttaaagaaaaaagaaaaaaagaaaagacagtgaggtatttaggaaattggagtaacgcccaagtaaatttaggtatattcttttttttttttttttaaagtaaataaacagcagatttgtttagggtttgactttctctcaaaactcgagactttaagcgacattatgttccgcgttccctggagattttttattattatatatatttggaattcgaacaactgttggattcgattttgattttcatttctgattttatttggaatactgtatatgataaagctaataagaagaatggaataaatacctcattcacttctatacatgcatgttacaattcataaaattcataactaaactttttatgttatatatgcatgaagactatgagattgtgcctttacaaactcttatcgattacaaaaacgatattgaggtaagtgcttttgaagatattaatagtttttaacaagaaaactattagtttgatgtctttaattaaggttcaatttatgaaaatgcttgcgagtttaaagagaaagtatgagaacaatcttgtgaaagccaagaatggtgatgaacatatcagacttcatgatctcagggcttttcaattgtctaagtttgtttggggagatattgaagaatcacctgtgaaatcgaagaaagttatgtctatgaaccttgagcttggtaaaaacaaagatacttttcccaattcttctcttgttagatcactagagcgttttggtgttgatgaacttactcctcaacaaggattgagtagccttgacttagaggataagaagatattcgaggagcagttggaaagctttgcaggttatagaattcgagttctattcgcgaaaaagtggttttcttcatgaagtgttagcaaagatgattgaagcacttcgatcaaaaacttaagagttttaagtctcgaaaaagcttcttacttatgaaaataaaatttgatgattgtgattacgaagcaaatgtcaaaaatagtacaaaatagctccaagattaagcatgaataaaagagctattatgttaaacactaaaaaaggaaaaaatattacatttaatatgttccagggtaggtctgggcgtaatatccgaatccgtagaaccgaactgaacccgacctgaaatatccaaacttgttatacttcggtttcggctaattacccgatcatattctgttttcaaataaatgtgggtatcgggtattatccgaaccgaacccgatacatgtgagtactttttattatttgaacatatatatacatatgaggacatatatgcactaataacttgaatttgtgacttgtttaatgatttgagttatggaacgagctcaaaacaaggtttacttcttgttttatattattttcttaaggaaaaatttgttataattttagatctttggggttttatggatattttaatatatgtttgggtataattggacaatgtttgggtaagtaatactcaaacccaaaataattttggttatgtatgggtttttaaccaatacccgaattacttgtattagaagtgaacccaaaccgaacccaattcaaaattgtacgtataacccaacatatccaaaatttctaaatatggaaagaaaaaaaatccaaaatttctaaacccgaaaaactccaatccgaaaaatttgatccgaacctgacctgaataccgacatgcccagagctactccaaagtggggaaaattggctcggattagtgtggatgaagtttttggctttgttatgtagttttttggcttgaagaccaaaatttatatagttccaaagtccaaactagcttagagaaattgaaagccaaaagagggtagatatgtcttttaacactctcttacaaaaaaaaatagttacttgattctcaaagaagggtgaattcgaggttttttgcagcgaagagaaagaagatggtcggttgagctatttttgcttctcccgacaaaattctcagatccgaatacttccaccatcatcattcatttataagatctgggttttacacagctctgcgagtacagtaactatgagaaggagaggaggggatagtttccggagagctggacggaggaagatctcgaatgtggtatggtgggttctctctggtattgccctcctgctcttctttctcattctctccaaagctggtcatattgaacctagaccctctattcctaaggtatattcaatctcaaagatctcttcttttgttcgatttcaattgctaaattcgaaccctttcttttgtgcagcgacgttaccgtaatgacaaatttgtagagggtatg

SEQ ID NO: 26100 - DNA, 3000 bp, Unknown; identical to SEQ ID NO: 13120
  misc_feature (1)..( 3000): 2750-1469P.txt file - cDNA_ID_2710539; gDNA_ID_2214599; Annot_ID_135526

SEQ ID NO: 26101 - DNA, 3000 bp, Unknown
  misc_feature (1)..( 3000): 2750-1469P.txt file - cDNA_ID_2710543; gDNA_ID_2214599; Annot_ID_135531
gccggtctccttcacaatgaaatcgctgctcagatctatcgccaggctggtttggttaagcgtttagagaagtcacataatcttcttcaggtattgcttttcccgctgataaaatatgactacgcagacgattatatgacatcgtcactcatttgtaactctacgcaaaagctgtacatgtgtaacgctattcttttcagtattgacactaacgtgtatcacctttgtttgtgaatttgcaggaccaggaagatgataactttgccattgtgtttgcagccatgggtgtaaacatggagactgcacagttttttaaacgtgattttgaagagaatggttcgatggagagagtgacacttttccttaacttggcaagtatctcaattaagatgtagatgccttgaaaagatatagcagctctaatgtttccttgacttcaggcaaacgaccccactattgaacgtatcatcactcctcgtattgctctcacaacggctgagtatttggcatatgaatgtggcaagcatgtccttgttattcttacagacatgagctcttatgctgatgctcttcgtgaggtgaaaaaaccgatataggcatttcttctgtttttttcaaggcttaatttagtggttaacgttgataattgcactaggtttctgctgcccgtgaagaagtacccggtaggcgtggatacccaggttacatgtacactgacttggccaccatatacgagagagctggacgaattgaggggagaaaaggttccatcactcagatcccgattttaactatgccaaacgatggtaacttcttcctagtcgtttctctggttgtaggtgtatatatatatatatatatatatgttttgtagtaatcttttgatgtctgagatttctaatatccatccttcttcgttgatcagatatcacacatcccacaccagatcttacaggatacatcacagaaggacaaatctacatcgacaggcaacttcacaatagataggtacaaatgttgcgcggaagataaaattattttcctcgagagagttgtgggctaaatacaccttgtgtttgtattccatagataaacccaccgatcaatgtccttccttctctatctcggctcatgaaggtaaagtaaagtcttgtagattttggactggaggaaggtatctctatttggtagagatcactcaggtgtgctgtgcagagtgccattggtgaggggatgactcgcagagaccactctgatgtttctaatcagctgtatgtgaactatgcaattggaaaggacgtacaagcaatgaaagccgtggttggagaagaagcactctcgtccgaggatctggtctctctatctctgtctttctaaatgccatgttaaataatgaataaactctaagcgtttctttgtcactcacactgacaataaaaacttggggatgcatgcatgcaacagctgtatctggagttcttggacaaattcgagaggaagtttgtggtacaaggagcttatgatacacgtaacatcttccagtcgttagacctggcctggacactcctcaggatcttctcccgtgagttgcttcaccgcataccggcaaaaaccctcgaccagttctatagccgagactccaccaattgatcgatcatcccatgcttcttctccaaattgcatctctttttgttttgctcctttgcgctttggtttgcacctctctgtcctttcccaataaaaggtgactgacccaatcgccggctattcttttgaacattcttgtatcctttatttatcaaataaactaaaattaaaagaaccttggagacttgagctgttgctgatcctcgaatactgcttcaattgcgatgatatatctatctaataataataataataattccagagataagtaattccaagaacatacataacatcgacatgcttattattaaactgatgatagtcaattgtaaagaggacaagataataagaaatgtaaattggtcgtcactgatgactatttgttcttctgaaaaaattgccttcaaaattttctgaatatttttaatttataatatgattttgaatcattatctaaatattttagtcgatttgaaatgttaaacacacattttcgttaattagataatattaggtaatatgtatgttttctaaaatttaaattacaatataaagtaaaagatttttttttttttgttactttatgtattatataattattcaaaacagttttaaaatcaaacaaatatgataagagaatcataattttaaatcttctaataataaatattattaatttattattaaatatagaatattccgtgtatgagtcggaaacaatttgaactgaccttttaaattttctatgaacaataaatacaaacggatggagcatccatagaatccgacagcattttaccccacccgccaaaaaattcttgttataaattcttaattgctctgttttaccatactcacgttttcattggctatctttgaccgccttctctacaagtgctataaaaaatttaacagcctcgtttaaacgtgattaccaatgagacggccataatcttaaaaatcactcaaaatctgccaaccattcatgaccttgatatcaaaatacattcaaatgtatagaaatacaaaattcaatagcacctagtaaatttaaaagtaaagctaaacattcatgaccactataattttggatcaaacaatgcaaacgcagcacatgaccgagtccgcgtcagaaaaaggggccaactgctccgtagccgccaagaatctcgcaggtgtggaactttcctcctttattcgatgaatctctttcttcattcttcttcttcgaattgtacgtttattgaaagacaagtatattttcttatttactatataaagtaatttcactttctcagatcccgattcctcttgatcatcgtcttcttctaccaaaattgttgcgcgacaatg

SEQ ID NO: 26102 - DNA, 380 bp, Unknown; identical to SEQ ID NO: 13116
  misc_feature (1)..( 380): 2750-1469P.txt file - cDNA_ID_2710547; gDNA_ID_2214599; Annot_ID_135533

SEQ ID NO: 26103 - DNA, 3003 bp, Unknown
  misc_feature (1)..( 3003): 2750-1469P.txt file - cDNA_ID_2710549; gDNA_ID_2214603; Annot_ID_135591
atcttttgtaattgcagcatgaacgtggaagagactacagtagagaaagatatgaagctgaaggcaatgtaacttcccggaacagaccttcaagcccatttcatccatcccaaagccgctctccaccgccacacgcaagggttagtggattcaatcattcattctctgatataacgcctttgttaatcattcattctctgatatattggctctacttagttgcagactcagagatacaacaacggaaaagatcatttcgaggggatgtacgaggcagatgccgatatcacaccgcgtaacagccctcccatgagtcctgttcatcaacacacaagctactctccaccaccgccgttctactcatccagtgacgacgaagacgacaacaattccacctatctctttccagaaattgccactggacgtcgttccaggggagtttcaggaagcagcacggttcgtttttttctctcgcgggtctctatttaccaaagtgtgaagaaaatgcttaaattcaaattgctttggtttgtgcagccggttcactacaagtatcagatcacatcggtagagacttacgagcaggagaggcaattcgagccgccggagctgccggacgagtcacagagcttcacgatgcaggagatcgccagaatgcgcggacttcaaagctacggaaaggaagagatacaattagcgatatccgagacttacgtctccgtcgccaattacaaggtacggatgagcatcgccgccacgctcgaagcgatcattgacaaacacggtgacatcgccgcctcgtcgaagttacaatctacctcaacgaggtcgttttatctcgaatccctagccgcagcagtaatggaactgaaatcaacggcgttgagagatctgacgaagacgcgagtggcggaaatcgcggcggtcgtgaaggacatggattcggtgaaaatcgatgtatcgtggctcaaaacagcggtgacggagctagcggaggcggtggagtactacgggaagtacgacacggcgaagattgtgagggaggagtgcgatagggaaatgacggcggggaaaaaagagatggaggagatgagggaggagctgcggcggagagagaaggaaacgaaggaatgtagagagagagtgacggagttggcgggacggctggggcagctggagatgaaggatgtgagagtgaagaagaatctggagctctatgagagcaaggtccttaaattcgacggtcattcggttctcgttgactgaacccgaccttttggaaatttaattaaaccggtttagtggagtaaaccgctttggaaaatgcttatccaagcataatcactcggagaagtctttgtttgttggaaaagagggagggagaaggttcatgctcattttttaaaagtcctcctatctattctaaacgttgtccatgtcaacgtgtgatagttgaattggtaagcataaaatcatccccaacaattatagtccgctgttatcatcgcgtttttgcgttagtttacggaaaaggtatagacgtttgatactgaggttttgtggacgggcctctagttgggtttgttcgtggcaactaggatgagatttcagctccttagagttgtggaaattacgtaaatttctaaatttggcatctcggaatcggtgtttcttcttttatttccgttatatacatatgtttttctcctttgctgttttgtcattgtctgtttttctgtacattttgttatttttttgctactagtactctttgtaacttcaatcgaaatttcgaaaattgtataaatatttcatattttaccaaataaaaaaataaaataaaaattagtatataattcaatatttgtgattctgactctggaaaaccattttgtggtcctctcttgaccgctttcattgaaaaacagttggtaaggtcacttttactactgctttgatttcgattactacctggtttttgtatttgggctgacagaagaaactgggccttcgaaagggcatatgttgtctattcctttctaccgcctatataattagggaaacgcgtcaaacgttcaacaaaagctaaattacgtgagtgatagtagttttttttttgttaaaaagatattcaattttttgttgttaaaaattcccccaagaatttaagaaatgataaaatataaaaataaatgtttttcaattaaactttgtcaactgagattcaaatagagcatttaaatataaccaaaaaaaaaaagaagaagaaaggaggaagcaaatgataatggagtaatgagaacacaatgaagttagagatctcctaaaatctttgattcttttcttctgcttagttagactgaaacctcttcgatccattctaactttgacaaatacataaaatactaaaagaaaagaaaaagaaatagccaattgacgaagtctcggctgaaactataaaatgactcatttttttattgcggtcaaagtcaacccatgttagaacccaataagatattattatatatacacctataagcttcattggctatctctcttatgtacagacaagatgagataaatcattcatctcatttcttcaactggctttgcttctttctttcttcttcctcaattataattttttcacaggtatcatcaatctctattctctcttgacctttttttttatctagcaaaagcttttaattagctgattatgagagtttttgcaatttatcaacatcacaatccgttattgattagtaagaaaaccagtggaagattgtcaagtctctctctttggagaagaaacataattaagcaaagagaaaacatgaatcttttattgtagtttccatatatagaaaccgttgactctcttcttgtgtgatgatatctacttgttttgctgggtcaatggatctgacgcttttttttttctttttggaatggtcaggtttgagatcttatcatagagttttgttttaagtttgtgagatg

SEQ ID NO: 26104 - DNA, 3003 bp, Unknown; identical to SEQ ID NO: 26103
  misc_feature (1)..( 3003): 2750-1469P.txt file - cDNA_ID_2710549; gDNA_ID_2214603; Annot_ID_187118

SEQ ID NO: 26105 - DNA, 3003 bp, Unknown
  misc_feature (1)..( 3003): 2750-1469P.txt file - cDNA_ID_2710569; gDNA_ID_2214603; Annot_ID_135599
gataatgctccgggtgaaactatgtataaccataaatccttataacatccccatataagtgcaggccctaagcttcttgctggattcatagatgctcccgaaattggccttgaaaataaaacattgttagcttatgttttaaccaaagtggtcgagaaaaacttgatttaacaaataactagtggaaaaacatattttgtctgcttatagttatgaatatggtcgaaatcatgaaataaccttataaagatagtatgaggtatttttttacaattgtagatatctttggttcacctgattaaaagggaacttcttagaagaggcaaaggcaatagaaacagcagggttgaaatgtgcaccggagacatgaccaattgagtagatcataaccgttacgactagtccccataccaaagctataccgggaagtgtcaccggtttaccgtacgtctcatttaccacgatggctgagcagccggcaaatatcatagagaatgtccccacgaactcgccaatcaactatagagtttagacaaaaaaaaaaaagtcaacttctatagggaaaacatgaaaacataaactttaataatttttatgaatggtaaaaataaaggatttaatttttgcaaacgtcaacgagtaaaaatattacgtgtttaaatttactgttatagaaacaaacttgtaccaaacggattcgaaatagatgtttgttcggtttgattactatacttcataaactggaaaatcaatcaccaataattagagccaaagtcaagattgagatcgcatatagcaacatcacacggaatataaaatcttgattcgacaaacaaatatttcaagaaaaaattaagaaaccatgtggcaacataaaagatgtgtctcaccttttgaacgaatgatacggacacaagaggaccagataaaaccgacgactgggaatcatcaattgatcgatcgttttcgatgtccgagacaacggtttgagtctgagtagtaatatcagagatctcagccattgatggaactatgatgactctttctccaaacatgtttatggtttgctcatctaaaacctcaaatggtcaactctactttgtattccttataagcaaataataaagttgactttttatattctataccacatgttgatcataaaagaactaacatttgatatttttaaacccccaaagaggagaaagatctagctagaattaaagaatagttaggttcatagttgacttctttatctttgtgtcacaaaaacaagacatggtttacattacttgaaaacgtgtagagcatttaacgataattatacttatatgtaatcagctttgattagagatgatacttcagaacacttgatttatgtataagatgttaagctaattaagatgaacaaaagataagcaaaatgtatatagttgtgttgttatgtgaatgagattaattaattaattaaagattgtggtagagaagctcataatgtttctttttagaggtactgtgtttgtattctctctctgttctgctcccaccatgtcttaacatgcacttccccaaactgttcccggctgttgattaaaccacaaaatcatagattcctgttagtcacggtatgattatcaactttcaaaatgtatatgattagccaatgcttagtttaagatgttttgttatacctgaatctgactcgacgtacatctgataattgtctgatagtaatgtaaacaccgggctagtcctcttcaatccactcagcttgcatttcactagcattgctcatggaaggtggatcatctctggaagaagttgtggttcttgctgcatccatcggtggtcctccatgataacttcctggtccatagttgctagagccgccataaaagtgatgcgggacagatcctggaggtctgaagttgtgtcttggagtccagtctttgctttctcttgctgaatccatctttgagtatgttgaatctctctgtgactgaaaaataaacttgtgttaccttctttggatcaaaggacaagattcacaaggttcttgtctgaagaaagaccaaaggatctaggatatatgtcttttacctgatcgtcggatcttgcaggcgtttggagagcttggcggttaaatctctgtacattgtaaagctcaacgatcttgtcatagttctcaccccaccgccgttgagcttgccacttattgtacatctctcggctttcaaaacaagacacaagtaatggttagtttttatctcatgttccagctttgaatgtcatgaagatatagagattgttttgagtagttaaaatacctgaagcggatgcgtttgagatcatttcctccagtgggaagagaagcgaatgtgatatgactattttccagaattatgcaagtcaacttcaccatctctaaaatcacctgcaatacaatccttacgtgtatcgatgacgtggcactcgataactctattagaaaacataagaatttgtgcaaaaaaaccttcaatgtaattttgtttttgcaagataaacctccatgtcaaataaatatagcataggtcaaaccacaatctgaaaaatctcctacaacataactcttccgtgtatcgatgacgtgacagtcggtaactcatttagagattttataagtctatcgaatatattattttattgcatataatttaattgagttattgatttaagttttaaataaactataagagaagcgttaggtcatcgggggtttctcctgatgtcatgattcaataaataaggtatagatctcaatctaggtgataacatggttaggtttgtttacttcaaaattctcggacatacgaaactctatctgaaagaaatggtgcttgacgaacataaagcattcactttggaactacgtaagactttggacggtggtcaagaacggcagcttgtagggggaagctggaagttgaactcttgtataagtcattcacgaaggaagaaatg

SEQ ID NO: 26106 - DNA, 3003 bp, Unknown
  misc_feature (1)..( 3003): 2750-1469P.txt file - cDNA_ID_2710584; gDNA_ID_2214600; Annot_ID_135541
aggctgagagtcttctatcctctcaggagacgagttgaggttgattctgccactttgactcgaagaaccttcttgatcaaagctaaagaccacacctttttcctttgacagatcatggtgaacaattggaagagattccaatcgcagaactgttttttgagtaaaagggtccttttctgcttcactaactgattgaataactctatccactcttacagatcgttcttcagcatttgcgacccgaaggtattgacgcataccttctaacacttccggagcaattctcggccttcccgtgtttggatccactcccacctggctttctttcaacacaccaaataaagggtctgattccttcagaatcggaggagtagtagcttttggaatgataatgcctttccttctggctgtagctaggtcctgtctagcttttactaggatagggcaaacatctttttcgtgcgtaagccgttgacactcataacacctcttctgaatcctctcataatgaaagttaacagtcgctgaccctccatttctgaaattcacaacttttgatctccttaagggtcttgagacatcaaacagcaccttcactctaacgaactcccgaatttgtttcaattctgggttaaagacgacttctttaacttcaccaatgagatcacccagcttagtgatcgccttggccgtgttgtaattgactgggatattccaaatttgaacccacagtagcatgtaacgaagatagtcatccggaggattttcataccacctatctaccacgattgaccaatcattgaaggtatgaactcctttcgctagcacttcctctaaatcatgttcagagtcgaaaatgaactggaatctctcattattgagagctattcctttgacctttccttctttctgccacttccttggcatatttcttaagagattcttcatcggttgacaagccgggttcaggacccttccaatgagactgaatttgtttctctcactagacagatactcaggaagatctggcatttcaaacggttcttccttttcttccaacgacatctccatcaatgccctatccatggcggatgacatcttcaagctaagaggaaaacagacaccgtagaactaagactatcgagctgaactaactccaccaacttcttcagaaaaaacagagatatggaacccagatctgagaaaacgaaagcagtagagcatggctgagaggatatgataatgaacacgaagggttagaatagttaatttcggctgaaaagaaagatggtttccggtcaaaagctttattttaaacctagtgaaagacactaaaagagaaagagggttctaagcccaaaagatagatttctaaaaaataatcacttgttaggattggatacttcgacgtcaactgctaacgacatgatatacagttattgaaaattggtaattatgaagttaaagaagtctaaacatctcaattgaaaaatctcaaattattcttacggtgacagttgtctttagtatgaagttattaccatagctagagcctaaaggacagcaccaagaccaccactaagacaagtgacgtcctgcaaaatctaacacttaaataaaattgtcagagaagattatttagcaccaaacttttattctattaatttccaaaagaaaaaaaaaaagtcatatctttccaaattttcattacataactaacattttgtcacatgaaatctgtacgtctctgaatcttctcttcttctccctcatccattgcttatgtgcttcttcttctgattaccaaattttcattcctcttcttctttctgataaaaaagtttgcattttttttctttgttgtgataatcgaaaaagagactaaaacctaagaatcgtgcagaggagaggataccacaccacacccagaaattgaaactaccaaaaagtttatgaatttgatttcaatttcaactttttatgagacccatttgattctttagggattttgaaggtaccatttgtctcaatcttataaaaaatttcacctttttttttttttttttgttaccactatgtgtctttaatctgtgttcattgttcagatcgttgtgaaatttggttcgtgattcgttgcattgcaatagctagacggatcgggattgacccactttaggtttctcatctcaaagattgcgaaattttctaatttggcatcggattgtttggatttgattgcttatgtaagtaacttgatttggttggtaacttggtattgcaatcagaaaatgtgctattcagtgttcctttgtgattaggtaattaagtatattagaaccgcatggtctttgttctcaatgctagtttagttgttttggtttcatgaagtagaagaagttttgacaatatttactctctgttgtgttaaaaattagcatagctttatgtaacatgtaccttgttttctctgtactttcatcttttgaatggattctatgttaaagaatccattgatgaagtttacaagtggtagtttgttacttgcttatatgttagttattacactagtttgacaaggttttggtacttacttgctcaattgctacactcacactgtgaaattcatgatttatacttatttcagttatgcaagaaacttttgattacataggaatgatgtttttgatatatgatagataatttgacatttattagtgaaagtttctgatcttgcctttttgtggtatcaattggaaacataatgcagaagctatagttggagcatgagtgtagcctgaagctagattgctggctggtatgtggtgatcgtaatggtaaatagggtgcgcttatttcagttttttaattttccctcattcatggatttcttatgcatatttattttcttgtttgtttctgtttgtgtgactctaggtctcctcaaagttcttttaacttttgttctatttactggagagtccttgtgttctagtttaaggtatg

SEQ ID NO: 26107 - DNA, 3003 bp, Unknown
  misc_feature (1)..( 3003): 2750-1469P.txt file - cDNA_ID_2710584; gDNA_ID_2214600; Annot_ID_187024
gtcttctatcctctcaggagacgagttgaggttgattctgccactttgactcgaagaaccttcttgatcaaagctaaagaccacacctttttcctttgacagatcatggtgaacaattggaagagattccaatcgcagaactgttttttgagtaaaagggtccttttctgcttcactaactgattgaataactctatccactcttacagatcgttcttcagcatttgcgacccgaaggtattgacgcataccttctaacacttccggagcaattctcggccttcccgtgtttggatccactcccacctggctttctttcaacacaccaaataaagggtctgattccttcagaatcggaggagtagtagcttttggaatgataatgcctttccttctggctgtagctaggtcctgtctagcttttactaggatagggcaaacatctttttcgtgcgtaagccgttgacactcataacacctcttctgaatcctctcataatgaaagttaacagtcgctgaccctccatttctgaaattcacaacttttgatctccttaagggtcttgagacatcaaacagcaccttcactctaacgaactcccgaatttgtttcaattctgggttaaagacgacttctttaacttcaccaatgagatcacccagcttagtgatcgccttggccgtgttgtaattgactgggatattccaaatttgaacccacagtagcatgtaacgaagatagtcatccggaggattttcataccacctatctaccacgattgaccaatcattgaaggtatgaactcctttcgctagcacttcctctaaatcatgttcagagtcgaaaatgaactggaatctctcattattgagagctattcctttgacctttccttctttctgccacttccttggcatatttcttaagagattcttcatcggttgacaagccgggttcaggacccttccaatgagactgaatttgtttctctcactagacagatactcaggaagatctggcatttcaaacggttcttccttttcttccaacgacatctccatcaatgccctatccatggcggatgacatcttcaagctaagaggaaaacagacaccgtagaactaagactatcgagctgaactaactccaccaacttcttcagaaaaaacagagatatggaacccagatctgagaaaacgaaagcagtagagcatggctgagaggatatgataatgaacacgaagggttagaatagttaatttcggctgaaaagaaagatggtttccggtcaaaagctttattttaaacctagtgaaagacactaaaagagaaagagggttctaagcccaaaagatagatttctaaaaaataatcacttgttaggattggatacttcgacgtcaactgctaacgacatgatatacagttattgaaaattggtaattatgaagttaaagaagtctaaacatctcaattgaaaaatctcaaattattcttacggtgacagttgtctttagtatgaagttattaccatagctagagcctaaaggacagcaccaagaccaccactaagacaagtgacgtcctgcaaaatctaacacttaaataaaattgtcagagaagattatttagcaccaaacttttattctattaatttccaaaagaaaaaaaaaaagtcatatctttccaaattttcattacataactaacattttgtcacatgaaatctgtacgtctctgaatcttctcttcttctccctcatccattgcttatgtgcttcttcttctgattaccaaattttcattcctcttcttctttctgataaaaaagtttgcattttttttctttgttgtgataatcgaaaaagagactaaaacctaagaatcgtgcagaggagaggataccacaccacacccagaaattgaaactaccaaaaagtttatgaatttgatttcaatttcaactttttatgagacccatttgattctttagggattttgaaggtaccatttgtctcaatcttataaaaaatttcacctttttttttttttttttgttaccactatgtgtctttaatctgtgttcattgttcagatcgttgtgaaatttggttcgtgattcgttgcattgcaatagctagacggatcgggattgacccactttaggtttctcatctcaaagattgcgaaattttctaatttggcatcggattgtttggatttgattgcttatgtaagtaacttgatttggttggtaacttggtattgcaatcagaaaatgtgctattcagtgttcctttgtgattaggtaattaagtatattagaaccgcatggtctttgttctcaatgctagtttagttgttttggtttcatgaagtagaagaagttttgacaatatttactctctgttgtgttaaaaattagcatagctttatgtaacatgtaccttgttttctctgtactttcatcttttgaatggattctatgttaaagaatccattgatgaagtttacaagtggtagtttgttacttgcttatatgttagttattacactagtttgacaaggttttggtacttacttgctcaattgctacactcacactgtgaaattcatgatttatacttatttcagttatgcaagaaacttttgattacataggaatgatgtttttgatatatgatagataatttgacatttattagtgaaagtttctgatcttgcctttttgtggtatcaattggaaacataatgcagaagctatagttggagcatgagtgtagcctgaagctagattgctggctggtatgtggtgatcgtaatggtaaatagggtgcgcttatttcagttttttaattttccctcattcatggatttcttatgcatatttattttcttgtttgtttctgtttgtgtgactctaggtctcctcaaagttcttttaacttttgttctatttactggagagtccttgtgttctagtttaaggtatgaatccaatg

SEQ ID NO: 26108 - DNA, 3003 bp, Unknown
  misc_feature (1)..( 3003): 2750-1469P.txt file - cDNA_ID_2710600; gDNA_ID_2214600; Annot_ID_135537
cagagaagtctctgagagaattcatattttgttcttccccttcatggctcaaggccacatgattccaattttggacatggccaagcttttctcgaggagaggagccaagtcaacccttctcacaaccccaatcaacgctaagatcttcgagaaacctattgaagcattcaaaaatcaaaaccctgatctcgaaatcggaatcaagatcttcaatttcccttgtgtagagcttggattgcctgaaggatgcgagaacgctgactttatcaactcataccaaaaatctgactcaggtgacttgttcttgaagtttcttttctctaccaagtatatgaaacaacagttggagagtttcattgaaacaaccaaaccaagtgctcttgttgccgatatgttcttcccttgggcgacagaatctgctgagaagctcggtgtaccaagacttgtgttccacggtacatctttcttttctttgtgttgttcgtataacatgaggattcataagccacacaagaaagtcgctacgagttctactccttttgtaatccctggtctcccaggagacatagttattacagaagaccaagccaatgttgccaaagaagaaacgccaatgggaaagtttatgaaagaggttagggaatcagagaccaatagctttggtgtattggttaatagcttctacgagctggaatcagcttatgctgatttttatcgtagttttgtggcgaaaagagcttggcatatcggtccgctttcgctatctaacagagagttaggagagaaagccagaagagggaaaaaggctaacattgatgagcaagaatgcctaaaatggctggactctaagacacctggttcagtagtttacttgtcctttgggagcggaactaatttcaccaacgaccagctgttagagatcgcttttggtcttgaaggttctggacaaagtttcatctgggtggttaggaaaaatgaaaaccaaggtaaattgtttctccccagccattattaaccaacatagtaatgttaatatttgtgtatatattcgtattgccaaatatgctctgataccatggcaagtaatagattggctcatgtattttatttgtgatcatgtagaattttcttaacagttatgacttggtgttggtatggttgggacaggtgacaatgaagagtggttgcctgaagggtttaaagagaggacaacagggaaagggctaataatacctggatgggcgccgcaagtgctgatacttgaccataaagcaattggaggatttgtgactcattgcggatggaactcggctatagagggcattgccgcggggctgcctatggtaacatggccaatgggggcagaacagttctacaatgagaagctattgacaaaagtgttgagaataggagtgaacgttggagctaccgagttggtgaaaaaaggaaagttgattagtagagcacaagtggagaaggcagtaagggaagtgattggtggtgagaaggcagaggaaaggcggctatgggctaagaagctgggcgagatggctaaagccgctgtggaagaaggagggtcctcttataatgatgtgaacaagtttatggaagagctgaatggtagaaagtagaggaagagaatatgtttaatgttctgagatagattattgactttgtgttcctctttggagttgttctttatgtcatcttagcttttgctactgtttagtaagagaaagtccattgtgtgtttctatataataaagaatagacctgaagataggcattttcaagtttctgctttaagataccaaatcttcgttgtgcatactttttacttcttgtgatcttactatgtgatttatatggcatggattatataggtcggattttctttgaattttaagtatataaatttgaagtaacaaagtatgtgtagtaatgatgcgatgaaaaattggtaatgaatctagggcctaaactagtatagtttcaggtttattccaccaaactcttagcgtatgtcacttggatccaccaaacttgatccaagcgttttacaaaattgtataccgagctaaaaataaaacattctttgttgtttccacaaaccttattttctaacatagcctacatgtctttctccttaagcactcattcttttggcctctcgactctttgaaaatctctcacattaagacttaatgttacccaaacctaattaaactactcgagaaccccatgttcgtgtccatgagaattctcactcaagtcttccctttagccacttacaaaactacttgtagaactatggctatgaatgatgacataactcgcacccaaaaccgcatcgtaacagtgttgtaatagtatcaaaatctttacatatacatatatatctatgtatttttgttactatttaaaccgcaccgcacttctcccacaccacaaaacgcagtcactattcggacaatatgttttaaaaacgctattttgccattccccataggctcatggctttaaatgcaaagccttcgaaatttatggctcatagcttgcacaatactcatcgctaagtgagaagtcaaagtttgcttctacgagaaacagaacacatgtgctgactcgattcccggtttgtagccaaccaaagatgacgaaccagaatacggcaacacaaaagtaaaatatgacgtatgcaaacacgtaagtgatcttcgttaattaattttttatctgatcttcctccactgtcttcttttaagtgcacacgtgcgtgtatatatctcgatatggccgaaactggaagaaacaattcagacaaagtcccaagctaagaaaagagactctctttgttttgtctggcagaatattttccattcttgttctgttttcttttcatttttcttcttaatcctaaaaccaaacatgaacagagagcaaattcatattttgttcttccccttcatggctcatggccacatgattccactcttagacatg

SEQ ID NO: 26109 - DNA, 3003 bp, Unknown
  misc_feature (1)..( 3003): 2750-1469P.txt file - cDNA_ID_2710604; gDNA_ID_2214600; Annot_ID_135536
gggagagtctcacgttcaaatccaaaacctcaagttaaagaacatatatggaacatcgaagaacaaagtagcaatgaatctgcaatgtagcaaaatctttccatgcaaaaatgtggagctaattgacattaatataaaacagaatggagtcaaagatggttcttccacttcggtgtgcgagaatgttgatggttttgctcgcggtaaaatgtttcctcaacattgtctaaattaattcgacggtccatcaaaacaatgacgatattttgtatatgttatttttatttactaaataattgcttaagtgtatatatggcttatgttttttttttatagccaaaaattccaaaccatatcgtaaatatgtatatatatgctttttgataagtttacatcaatattctacaataaattgcattttctgaatttattagtgtataaacatggattaacaattggatataaagagctaagaaatccaatcccattggtgtacactccgctttgtgttgcattttttggaaaaccgttttttgtgaaaaaaaattatatttatacaaaaaagtagaaataagtataatgcattttttttctttttcttaaatagtctttgtttaaatataatttggcttcatctgttccatataacttgaaccgagttcttgaagtaaaagaactgatttgtgattcttctggtgatcagaacaacaactgaacaaactgtcttattgttttcaaagaaaaaaaatatactaaaaaaggcagtgagttcaatgtaatataatgtggtagcacacactaataaccagaaaaaagattcttgaatgtggtagtgatcgttcagagaagagagaaaagtatattagtttttttttacttgtcaccaattcacaatgattaaagctccagactaaccgattctgtgattttatcattcctttattcaatcatgacaatcattagatcattacacatcttatacactttcttatattcatcacattaaaacacctctactggattcaaaggtacttacatcttctttgtagattatggagagaaagacgattgtcctcgtcaatttctctgtatactgtagggataaacatgcaaacataaaaagtcatggctctaccaaaatcgtaagctttagcttattttctttcaaacataaacagttgctaaatcagctaaacttagatgtcacttgcacatgatgtcagtgaaaagatggaggtgaatccatgcatagatgcaccggcttcctctgatacaacgatagctttcaggaattgccatcacatcttcattcttttaatcaatgttctaacactctgctcgagtttctcggcaagccataataaaaatagctgcagtctcagacctctcatctagccatatatatatatatatatatataatttattaattataatactaatgagaccatatatatataaaaaattatgactttattattttgtcaatatttttttttaaaaatgttatagtgggtcgtcccaagtgggcttaagcctaattcatatacaaatccaccgttacaaaatagaacgaaattaggtcaaattttatgatgtactgattcattttttttttttggtcgtttataagtgttcatttttagttataggctccgattggtaaccacttttgaggtaaatgaatgagtaggaaagtcgtgttcctctttgttcttcagtttttttaccaattgcaaggtatttttgttccattttcagatatgtgggtcctacatttttcctcatcattcctaaaaaaaaaatgataaaacaaaattctttcaccccaaaattgtaaaagaaccaagaggaacaaaaaaataaaattcgtttttatttattaaataaatttaaaatagattttatgataatatttatatttctatatataatattttccatatctttagtatatattgatatataaatttttttttatcaagctttcaatttaatgaatgttataaatttattttaaattagtataaataaatgttttaaagtgaaacttattttaaatttgtaatataatttaattttttattataaaataaataaatgttttgaagagaaatttataatataatttattttaaatttatgcagaactttaattttaaatgaaattaataaacaaaattcaaataaatgattttttactaattattatgttaaatactattaattcacctttttgattactattacaataatcattttgttcaattcctatgttactcttggttcctacttattgttattttcctttttttcttattttcttttattctctttcattcatattcctattgttctttttgttatcaccaatcagagccagttcaaattaattttgtcaaaaccttagaattcacaaaaaaaaattaccaatcagagagaaccgttttgatactttgatttatcaaaatagtagtaagtgggattaattactctattttatttattgtagaaatgctaaagacatatctattaagaaagaaaaaaatcaaggcttagtcgtcatcactaaagtaagaagtcaaagtttggttctacgagacacatcacatatatattcgattcccaatttatagccaaccaaagaagactcggtcctaaacgaaccagaataaggcaacacaaaaagtactaaaacatgacgtgagcaaagacgttagattcgcctccattaattcatctgatcttcttccactgtcttcttcaacgtgcacacgtgtctgtgtatatatatcttgaatgtctgaatctggaagaacaattcaagaccgcgtacaaaactaaatccaatccagacaagaaaccgtcgttgttttgtctgatcacataacacatttcagtttatagatctgcagaatttgttttttgtatttttgttctgttttcttttgattttcttcttcatcctgtaaaacctagaattttgtttcttcaaccaaaaatg

SEQ ID NO: 26110 - DNA, 3003 bp, Unknown; identical to SEQ ID NO: 26109
  misc_feature (1)..( 3003): 2750-1469P.txt file - cDNA_ID_2710604; gDNA_ID_2214600; Annot_ID_187021

SEQ ID NO: 26111 - DNA, 3003 bp, Unknown
  misc_feature (1)..( 3003): 2750-1469P.txt file - cDNA_ID_2710639; gDNA_ID_2214671; Annot_ID_136613
gtctttatttgaagaccaagagtcgacgatcgtcttcaaaccgatcgcttatggaatcctctcgaaggagtttccggttatcatccatgatgttaatctactctcttattactttcatgtttccccttcctttatttttctattttaaactttcaacaagtgagttatgtggcaaagcttcaagttgttataatcgcaagttaacttaatatcagttgtttgacaaaaaaaaaactgtaaaacgataaaaacttggcatcggtaaaactttatctccttttaaaatgtcccagcgaagcaaactaaacaaaatttgctttaaaatctacttaaacattataacatagttctcaattcttaaatatgctaaagtctaaagactatgtatcgtaagctcacaacaatgtgtatgaaatacactagcaaatcacgatctagattaccaaactgtggaagaaaaaattccacactcacaaaaattaacaaaatttttaaaaacaaattccacactcattcatgaacatatatagttctaaactaatcgccagtgactagtaattgcgaccagcgagtgcgatcaacgaattgttctgttattcgtttgacagttgctactttgttagtttggtagtcactatgatttggtcgctccatccaacgactggtcgtttgatagttgttgatcgaagtcacagtcattagtctctaacgtgcctttaatataaggaatcttaaacttaataataaagaacacaaaactggactaatacaagatgccctaaggagcaacattaattgtttcgttaaatccataatttaatttatagtacagtttgttacttataaaaaacttacacgtattagttttgttatagtacaatttattaacttaatttgattcaaagtttccagtatttcccacaattcaatgtcatatggtcaaacatttcagcgacttgggtcaacctcttttccatgttccaagacatgtgtctcgactctcagcgatttcaagatcattgtctcaatcttgttgctattttattttacgtatataggggtataaattatatatgattaagcttttcttttaaatttatgtacatcttttatagagttgtattttaaaacgagcctttatcaagttttagatttgaattagtggttatttatccattggtcacacgagggtgatgattgtgattagaaatgtcatgatggaataatccaacctaatccaatcctagctagtagatcttgctgattggtctcatacagttttataaaatgcaagctcaacgtttgtagtcatgcaagccagttcaattagtgacaagtaacaagacagattttgcagattttacttagtacggtctagttggagcatatctgatcttgatttgttttcaaaacataattgtgagctggtcttgacaacctagttttttttttcttaatatatatagctaaagtatattttgaaccgaaatccaaactaatctcttagacctgtaaaacattgattcatattttgtcatttaaagccttacatgtcaagaaagaactgtaaacggtatttgtaaaaagagtaaaactcgatcattggccttgacccataaaattcaccttaaacaaaccgttggaccacacgttcttagtaaattgactagtacatggagttgaaaccttttaagacgtgataagatcaatgatgccattagcaaatgtgttttgtaacaaactagaaagtgatggtctcatcttcacccattttggtagcacttttaagtaagtaacttaggcgtgtgaatgtccataaagtgagagaaaagagccaagggtttttggcaagttttggcaaatatgatgtgatagtcccaacaactttgtttatacctacctactcgcaaagagaagcacgcataaataatataaccttatgtcaataacttgaacttaaatctttgaaatatttggtctattaaagtcaagaaaattttctatatatataaaaaggaacatcaactattaagctatttcaagggaaaaaaaaaatttatataaaaaaaaaacactttataaaaaatacacaaatttaccaacgtgatgttggtctagtggtaaatctccctggaagtgctgggttcgagacatgttgggaagaaactattctccaaaaaatatgaatttaacctggtatgcatcccacttctaagagatgtaagatttttgggtttgaatttccagatattcaaataaaaaataaaataaaaaacacaaaattaggactcatagttgtgcttgcggatgttaacacaatttgcttcgacaagatatatacacaaattaggtttggttaattcactatccttatgatattcatctagcatctgatcaataggctgtgatcatctcagattaaacatagtataaccgatcgacttctaaaacatcaagacaacttacataaatagtaaaggatttctaacttctaagagattattctatattggttctctctaaaatcttgattaagatgataatttatgggaaacttttcacaaaatgttaatggaaaataatggtagataaagaacgtgggaaataagagaagagagacaaaaaaagacagaaaggcaaagactcgacaaattgggtttgatgaagtgtgatgccaaacttgtgtttgtcccaagacaaacaaccccgagaacgagcctcaatggcgtgaaccccttttctataccttgacataataaattcatatatttttaataaatagtatcttcaaccttttttgaaactctcacttttgtgtttcgtgcacttatctcacatagtcacattaagatattatatacaaatataataggtatatagatagatagatacatatatatgtgttagctccttttagttgatataaaagaagagaagaagaagaaaaagaaagatagcacaaaaaagcttctcatatagctaaaaatcactttgaagaatatg

SEQ ID NO: 26112 - DNA, 3003 bp, Unknown; identical to SEQ ID NO: 26111
  misc_feature (1)..( 3003): 2750-1469P.txt file - cDNA_ID_2710639; gDNA_ID_2214671; Annot_ID_189116

SEQ ID NO: 26113 - DNA, 1307 bp, Unknown; identical to SEQ ID NO: 13918
  misc_feature (1)..( 1307): 2750-1469P.txt file - cDNA_ID_2710647; gDNA_ID_2214671; Annot_ID_136611

SEQ ID NO: 26114 - DNA, 1221 bp, Unknown; identical to SEQ ID NO: 13925
  misc_feature (1)..( 1221): 2750-1469P.txt file - cDNA_ID_2710651; gDNA_ID_2214672; Annot_ID_136619

SEQ ID NO: 26115 - DNA, 1221 bp, Unknown; identical to SEQ ID NO: 13925
  misc_feature (1)..( 1221): 2750-1469P.txt file - cDNA_ID_2710651; gDNA_ID_2214672; Annot_ID_189126

SEQ ID NO: 26116 - DNA, 3000 bp, Unknown; identical to SEQ ID NO: 13936
  misc_feature (1)..( 3000): 2750-1469P.txt file - cDNA_ID_2710655; gDNA_ID_2214673; Annot_ID_136629

SEQ ID NO: 26117 - DNA, 1251 bp, Unknown; identical to SEQ ID NO: 13941
  misc_feature (1)..( 1251): 2750-1469P.txt file - cDNA_ID_2710687; gDNA_ID_2214675; Annot_ID_136634

SEQ ID NO: 26118 - DNA, 3000 bp, Unknown
  misc_feature (1)..( 3000): 2750-1469P.txt file - cDNA_ID_2710691; gDNA_ID_2214676; Annot_ID_136656
tcgacgaattcattgtccagttgtatatgtgagtgaataaggcatatgtttatctattagttttatccttttcctctttgaatcctattatagaaatccaaagttggtctgtgtctacacgatttcaatgatgacatataggggcatgcttgcttctccacatttagttattccatgcatatattatacacgatgtgatgtatttttgaagatattccatgcatcgttcaagttataaataatatatatatatgactgatcgagaaaacaaaaaatcgtttgtaatatgttagcttaacatagccatgacttaatctactgtttagtaaatatgttaagctttaaaattttcatagtagaatacttgtggttgtacttgcctagtagcaaacacgatgttttaaacgccaaaattctatgtaccgtacaaggcatagttcacagtatatttctctacatatattttaagatcttttgttgtgtcgattttggttatagaacatgtcaaaactcatatttgtggctaagcctataggttcaattacttatatgttggagtgcgaatatgttaactacacagaatttgttaaaggagatagcttttatgtacatcttagggacctagtttagaattcattcactacaaaaggccgcaaattgctataggacattcactattcttctctagaattacaatgaatgttattgaaatagtaacaacctcccacaaccaaactaccaatcttgcatcatttttggtggagcgacgccacaccttgtgtacatctctcgagaatacatttaagcttgtaagtcttcatgaaacagttttttgaaatttataaaaattgctcaaccctaaaccttacaattgacaattttcttattccacaccaattggaatttcctattctactaaaaataaatattgacaaatttcttttttgtttatggacaagaaaactttgtcttcacattctcatcttgaatatactattcaagatgtatatccaactcaacagacgcatcttctcttgtctaaatcggccctaaacttctgaagaaaccaaatttagattagaaatttgtctacgaatgaattatcaaattatagaaaagaacatacgaatgatttcaatcatctactacaattttagtattaattaatcataaaataatcactaaaattacttactttagatatatgtcgctgagtgccttaaaattgagaagaaaccaacaaagaaaataatttataaaatttagttaacgaatgaaaaaagtaggtcaatgtactcaatgatgcctcttctttccgtcggttattatttttgtcttaggactgagacatattttttatgagcttttctgtttaattgttttgggctgaaatattattttcgttttaattgagttgggttggacattaggatagggcaattcattttctattctaatggcccaaaatatataatcagtaaatgaattcaatgtgtaattttgtttttcctgaaaaagaatgtcggacacgtgcccaaccccctctagacgtgggtccgcccctacttgcaacttaacaacttttaatgctcataatgtaatcagtaaacattggtaaatttaaacaggaaaaatatactaaaaagaatccatatattttttattggacgtttagtacgccaaatattttagttggaaaaaatatcccatttaaaatatatataattaaaaaaattcatctttgaattatggatagatttgagcctacgacttaatagccattaacaggcattacaaaatcactgaacgatgttaaatgtttacttcatgtgttgatatatatatatatatatatatatatataatctttattcaaaatttacaaatgtattagcgttgtctggtggtaataaatggattatttaaaccttttaatcaccatctatttgttacaaagtttattttaatctttttaatcactactacttctaacttttggttctatttttgctctttcaaacaaaaaaattagttttaaccgtaaaaagttaaaaacatatatctttttccgaccaaacaattttttatttttttttgaatatttgaaggttctgggacaaagcccgtaatcctaccagacctgaaatcataacatataatattagtttcgttccaaacgtcactcgaaccaacgatatctaaactttgcatcgaatattaattgagctaataacacttggtcaaacaactttataaaaaccattaaaccagcaatgtaaccgaaatgacggtaaaatagtcaaacaactcgtgcaactttgcgacatttggataccaaaccccaagatttagtccttttgaattcaagccattttttcaataacaattcttcaaaataccacacttttaaattttgttgtcaggaatactactattaatttaatgttccaaaaatactatcaaaatattttgtttttcaaaaatatcacaacatcaaaaattgatgttcaaagattcaaaatattgtttttaggtttgggttacctattttagatttagagtattttttttaagggttaaaattttgtgtttatagtttaagggccttagttttgaatactgaaagtttaatttagttttgtggtatctttggaaaactaaaatgtaattgatatttttataattattaaactctctaaatattaaactaatagtggtaattttaaaaaccaaaatttaaatccacgatctctctgtatttttaaaaattattgtcatttttaatttatatcttcttaattgattaattccaatcaaggtaccaagtctattgcctttgtttgttcctcttcatgacgccaaactctctgtatataaattgatttatatctacttaattgattaattccaatcaaggtaccaagtcgattcttcttctcttatcatcacaaagtcatctcctttcttatttcttgatctagctagcgacaattgaaaatg

SEQ ID NO: 26119 - DNA, 3000 bp, Unknown; identical to SEQ ID NO: 26118
  misc_feature (1)..( 3000): 2750-1469P.txt file - cDNA_ID_2710691; gDNA_ID_2214676; Annot_ID_189199

SEQ ID NO: 26120 - DNA, 3003 bp, Unknown
  misc_feature (1)..( 3003): 2750-1469P.txt file - cDNA_ID_2710703; gDNA_ID_2214677; Annot_ID_136665
gcacttgcaagtaaatgtgttttacacttcactaaagcttcccttaccactagaccacaaatgattgggcgtgagtcatgtttctgaaacctatatcatgtcttgattgtacaaataacgcatgattaagctgtagattctgaaaatagaatatattgaagctttccacagttagggccggctcattgggggtgaaaggggagcaatatttctggatctaaattattttgggtaaatttaaaggtccaatttttttagtatgaaaaagtgtcattttgaaagatttataagaattttttagcatgaaaataggtccaaatatttttttagtatgaagaaaggccaatttaaaagagttttaagatttattagcataaaaagggcacaattttttcttttagtatgaaaaagaccaatgtttaagatttgtacatggactctgaattcattgagctgccatagtgagtaaaatttggaaacaaaactaaaaaaacataacaaaatatctcgttgaattcaatacaaaaagcatatacaaacacaacaatgtaacaatttcaaaatatttgctcttaagaaataaaaatcttcaaccttgaagagcatatgttagaaccaagctccttctaccaaaactatataaaacaatcgaaatagagaagcatatgtaccaacaatgtggctagcgggtaactactcgtcaatacattaccaatataaaaacaaagtctgtcagaaacacactatattctggttagtatctaacaaactttgatgatgttagaaaatcaaatgatagactccatattacaaagggactacactgttattatggctattcttctttcagaggcccatactatgcaatgaaccatgtgacatattctcttcattcccatacatggctacttaaatgttttaccaatcagaaatttgtcgttctaatcacgtaataacctttattagtattcacccgtttttttaaaactccaacattcgcattctcatccgctgcgtttaagtctgtcgagcctataaccccctaaaaatgccataatcttcttaccaatcacaattgatatcatcattttgaacatttcaaaattctcccgttgggcttagaccttaattaatgggtctaaagtagaccacatatctaactatgagttgttgttgggctttggaaaactacacacgtgtgagacaatatctaccgcacgtgtcagtgcaaggcgccaaagccaccattatccttccgttatcgtctatcttctccaccttcccggaatccaattcaccaattcctaagcattcttcagaaatccgagctgctttttgccacatctattcgcttcgaatctcttttcaccagctcaaaaactgtcgctttcaattccgctcgtttcgtcccaccgctccgtgtattgctgaacttcttcatagcaactcaataccatggatgttactgaagttccatggcgtcgtcttcctcaattttccgtttcttcacgcgcctcgtggctcgtttcttctgggtttccgctttcttcgtaagttctttcattgaggcattttatcatacactttgtctgtgggattctaattcctgttcttatcttctttcgatttttgaatctattgtggaagtgggtttcttaggttctgaacgggattgaaacatttgtttgtactcagtttcttgagttcatatctcacagtgctctcccctgaaactcattttatagaccagggaaaaatatatgcatgaatccaaaggaaatgatactttggactaacttggaatctctgttgttcaacagatatatgttctctcatgttgagcgtggaaagacgtttaggcttaccttgtgctttggggtctctcgtttacgtccaaggtctgctattgtaagtgcacaacaaggtaattgggagtacaaaacttaaaagttttcagagaatatcatggtttaactttcctgtggtgttctcagtttgtcttttcatggaatttcagttgagtcatgcctcaacttgtgaagtttctttgtttgcattttcagccactgagatttttgttatctgtattctcagaacagccacctagtcgtctcaaaggattatgcgaggtcgtttggattgtggaagctgatctggcagccaatgaacatctctacgttactggagatccttctacattaggtagctgggagccagactgcgcaatctcaatgtatcctacggaaaatgataatgaatgggaagctaaagtcaaggtaatctattcttttgtttcacttaagccgtagcgaacataagtagagatgtatcttaatttacataaaacgtttgaacgtttagtcgtagtaacaaaaggaaccaacctcaattcttgaaagtgagttcagatgtcgtgtttgcttttaacttaatatgcttggcagattgcttctggtgtaaatttcaggtataattatctgttaaaagctggatatggatcttcatcggatgtcatctggagaccagggccacaattttcgttatcagttccttcctctgtcaatcaagacagaaaaataattataagggattcatggatgagtatgagtatttcctcaaaatcacaagaatcctacggatgggggtcttggattgatgatgcttacctttttccaaactgtgttaccccagctcaaagcgaaggtaaaatctcggtggttcctccttgttcagtctcttttcatcctttgcaaaatgttttaaaacttaaatgcttccagtggtttggcagatgaatgcacttccgccgatagtgctatagaagtcccgagaacacatctgaatgataagcaagtaggagctgaatctttcttatgtgatgagcttgcagccttttcgtcagagaactcaaacttaagtgcgttattttctgacaactatcagcctatcgaggaaccgtggttgattcaagaatctattaccttacaacatgaaaggaatatg

SEQ ID NO: 26121 - DNA, 3003 bp, Unknown
  misc_feature (1)..( 3003): 2750-1469P.txt file - cDNA_ID_2710725; gDNA_ID_2214682; Annot_ID_136695
caatttgtagtttaacaccttatcggttgctatgctataaaaattttcttcaaatttggaagcgatgtcgttaatcttatattcttcatgtgcatgaaacttttccttgaacttttcaactctacacatacatgagaacaaaatatcagtgactatgaagaatttggttataactgatattcaagaggaagtgataccattttaattgcactaaaaatacaaaacagagaaaataatccgtagttaatattcgaacttacgataatcgtttagcgaacaaacactgaaacaattatacatatgtgccaagcaattgtacatagaagcgagagtaaaacaagattctcctagtgaggaagagcctaaatgcaggtaatgaggttaaaagaatatgcaaaacttaaagtacaaaaggttgaagttaggttttgtcaactatgataaacatttatgcacaactcttatgctttaactgttgcaatctttatcatgcgcaaactacaaatatcacatcgaaagcatgaccaagaaaaccttactctctttcatgaatgttaataatcaaataagaacaatgagtccaacaaaagaaacatgaaactcttgaaagaatggcttacatttttgaaagaaccttttgccgtaattcaggctcatgttgtgatctccaatcaatacgattattcgcagcatcacggtttccgccttgttcattaggcttccagttagtatttccctccattaagttatgcgtcctaacggggagatgtatgtataggctttgaccaagaaccgcctcgctaaaccttaacaaacaaacaaaagaatgattagagaaattactcaacatggtaacacaaaacagataaatatatagtacaagaaaacgacaaaagagtattcaaaaatcaatatgcatatcacgctaacaacctatcgcataatatcacacaacacgtattataatatttgttggtgcaggaattagcacctccgacaatactaatttaaaccgaggaataatgtgaataaaatcgagaattcgattgaaccggggtatcccggttagcctgttaatgggcctaagtcatgagatcgcccgaagacttaagtcgacaatcaagatcgccataaccaacttcttaggtcgtgtaaagggaaaacttccatttaagagaagaggatctcatgaagaatagaagtaatgaagatttaaacctaagataattagaagtttatcatattttggtatattcgacctattgtataaatagaggggtcaaaccccccattgagatcatctttaacctaatacaagagactactattacagagcaaaccctagctttttgtttaagcaacctagttcttttcctttgattatttgtgagctaagagaggagtgaatttgtctaaatcccttagtacaaattcattgtttgattactgaatcaacaatatttaatatataatcctaacattttaacaatcagcacccaatgtctaatcttatacaaatgaaattcagaaatacaaaagtaaaggtgatactatgtttccacagatcctaccctcaccttggcaactcggttggattttaagaaataggactagcaacaatggatccggctcaacaacgatctcaaactacaacaatttagattaatcaatcaagattatattcccttaataatttgttatttaatctaataactaaaccaagtctaataatttaatattagttgcttaacacgtaattgactacgccacatccatttacgtgaccaaatactccccggtttaataattaaaccaacgccacaattcaaatcacgtacatgtcaatgctacttctggtttgacaattaacccaacgctttctaataagccaataactgactatatcgtcttcttcactaacacaacccaactgacgccataaccgatcaactcaaaaggttccttaataatcaagtttcaattcatggccgtaactatacgtaatcccttggtttaggttggttcaataattaaacaacacaacaccttaacatgaatacgagaataaggtttcaccgttatctcactctgcaacgaagaagtagaggattcggtatcacagacccaaacaaagcaccaatgatagatctagattccggtgaagaaggaggacgaagaaggctaatagtggctcagatggtgatgattagggttggatgttacgtgacgataacttcacgtcaccacttaacacgatcgggaccacaaccacaaactacaacgatggtgaactcgatagtggaggatgatggtgacttgagagttgagatcaaatttctatgattttgataaggttaacattgcgtgctcgtaacataagcggcgagaggaagaagacattatatacatacgtacacacttctcacgtttaggtcttgtttttaatgaagatgggcttaatgagaaattgggtcttagctttacctcctttcgccgtctccagtcacgccgagacagctccctttcatgcttcttccgccagaatccatcgccggatacatctcgaagattgaatcagagtattaaggtaattcacgactatgaatcttctggattagcgtcagtgtattgtttatatcgatgtttgcgactatttttggtttaagttactggattggtggtttttgaagaagcatcaatgtttataggtttcagttgtttcaagaaccattggattcattactagtagtctatggtttcatgatcaagtaattgttgaaacatcgtaaatatcaagtttgtagtaattgttcgaactatctatgtgaattgtagttttttctgtgtagtttaccttgagattatccactgctctataccttgaaattgaaataggcttcacactgaagttataaggacttggggtacaagagtcgttggtttgactctccttgtgattggtgctatgagaatcaaagaagcttctgagatcccataaccatg

SEQ ID NO: 26122 - DNA, 3003 bp, Unknown; identical to SEQ ID NO: 26121
  misc_feature (1)..( 3003): 2750-1469P.txt file - cDNA_ID_2710725; gDNA_ID_2214682; Annot_ID_189288

SEQ ID NO: 26123 - DNA, 3000 bp, Unknown; identical to SEQ ID NO: 13984
  misc_feature (1)..( 3000): 2750-1469P.txt file - cDNA_ID_2710776; gDNA_ID_2214687; Annot_ID_136715

SEQ ID NO: 26124 - DNA, 3000 bp, Unknown; identical to SEQ ID NO: 13992
  misc_feature (1)..( 3000): 2750-1469P.txt file - cDNA_ID_2710780; gDNA_ID_2214688; Annot_ID_136721

SEQ ID NO: 26125 - DNA, 3000 bp, Unknown; identical to SEQ ID NO: 13992
  misc_feature (1)..( 3000): 2750-1469P.txt file - cDNA_ID_2710780; gDNA_ID_2214688; Annot_ID_189365

SEQ ID NO: 26126 - DNA, 3000 bp, Unknown
  misc_feature (1)..( 3000): 2750-1469P.txt file - cDNA_ID_2710790; gDNA_ID_2214692; Annot_ID_136738
accatctttgcagagagcatagtcgcgactttttaggtttccaattgcaagttcgccacaagcgtgtactctaacctaccgaaccagacttgacgcccggtacggttttggataccaatcccggttttccttgttttaatatcgctaaaccgaaattccatgatatatgcaatcaatctgaaccattaacgaactaaatttattggtttaattttggtttgagaaaaaaacactcgtgaaacacaaatgttaagattctggatcttacaagacagaacaggaagtaagatgtctttagagaggacttttggagttttggttaaggattcataaagaaaaactcaaatgagttcgtgtgtaaaatacattgcttgttctatgtaatcccaagtttccttttgatagtataccacaagagcatcacatcacattacaaagccaaatagagaagagagcttttgtatatccttcactagtctcctttcaagacaatcataattgtttcttcctcttttccaagtatgaatgatttctttggaagttcaatatagcccagagcagatgcctcaaaccaatctcaggccacagagcagccggagagcagagctgggtattacctgtttgccataagagaaaattgctcagcctcgtctctcctgaactcctgatgagtatatcaggattcggcgccacgctcatctgcatattctcctcaatatccaccaactgtatcttcttctcttggttctccatatctgttccttctatatcactatcgctatcctcgtgtttataattagatgcttcaatattgtctgacttgttaatacaagatttcttgacagcttgtacgatctcatctgtcgagttataggcaatgcaaatgagaagcactacccgactattcttagctgtggctttcatgactttttctgcagcagctctcacttggtcatttagaagcgctaagttaccgataaaatagacccgaatcccatactgatgcacaatactctctttttcaagcaaagactttatcttttccagcatcaaatccattacagactcaacctcctcaggttttcttctaaaattatctatgctaaatgcgtatatcgttacatacttgatacccagctcgtagcagtattgcagcatcgacataagcgcagaaaaccccgctttgtgaccagacccatctaaaagaccacacttctttgcatatctccgatttccatccatgataaaggcaatatgacaaggtataggacccatagatatgacccgaaacaaagatcttctcgaaaacccatatatctgctctagcagttgactcattcgaccgcctatatgtcttatttgaccaggaagttcagccatttgagattccaccttccaaatttccaatatcctcagctctcagctctctacgggaaagcaaaacattcataagtcttgtcagtaaaaggcgaaaacaagatatactaacggcacaaacggcaacctactccaacgtttcacagtgaaatataagttctacacaccttaacagtacttactacttaacaagtagcatcctaaactatccacatgtaacaaagaagcaacaatgatatcaaacaaagctctttgaacaactcatttaacaacaaataatacaagcttcccctttattcattctagtcttacttgctgcaaattctaggtgaaaaaatcagttctacaaatgtagatacgtatcatatcaaacgatccatttctgccaaatcagcatcaatgttcaacatatcagtccaaagttctaaaataaattctctattaggtgaagaaatcgaattcctttaccaagaaactgatgtcacgaaagaaaagacttttggctgttcacaaaaccccaaacttatggagttagttaaaatatccctcaaatagaaaactaaaaaacacacttgaaacataacctagtcagggttttagtttcgatacggaatacggaaatagaattcgcacaaggcaaacaaagaatctgcaaatttgcatgctttttgaatttctaaacaaacattgatggatcaaacgaatcaatcaacagatttcgagaataagaaacaaaaactccaatcttaacaaaaccccagaaacgcaagagcacttgaaaatctaaagcaattatatctagtaaaattgagaaactgttgtatatagctcgatcctacctgagagatagcgagatcaagcgccgagcttgtaaaggaaaacgaattggggaagcaaaaagggagatttcggaatccaagctttctattctttggatcgaaaacagatgatatctcttctcaacaaaaagttgacggcgcgactgagattctccgttcaagagcgctgactgtgaaagagaaaggcagcgagcgatgagagaaaagaggggaggggaatattttacaggggaaaaaaaatgtaaataaccggtaccggttaaatctaattgatctggtcaaacccggttcgagttttcctatctttctctcttctggtcaaacaatatttggggtttattagaaagcaaatgcgtcaattggtgaagaactttatgaatgtaattaagggcgagatctgcaagctcaggtacacgtgtcaaatggacggtcaggatttgaagagcacaatccattattccgtccgttgctcttctttcccatacgtgtcaaattatttcgctccttcacgaaaaaatcccgccacagtgcaaaatttcaagtcgcctttattttaaaaatagatattattttattattataatatcgcatctaaagcccccccaaaaaaaaaatcctattactcactcatacgctctctcgtcaaacaaaaaaaaaaaacctaaaggtaaaaactcgctcctaccgttttccccaaactcagtccgagtcaaacaattctctaacgatcttcttcttcttcttcgtttctttgtcattcttcaattgcagaaacttcgacatg

SEQ ID NO: 26127 - DNA, 3003 bp, Unknown
  misc_feature (1)..( 3003): 2750-1469P.txt file - cDNA_ID_2710792; gDNA_ID_2214692; Annot_ID_136735
tcatcgcccattaaaaaaaatagatattaagaatttgagttttataaaaaaataaaaattcaatgcattggatattactaaaaggaaactatagttggagtcttcttattacgattttaattatatatagttggccatttttcttcgaatctaaattacggacccatgaggaaaatgaccgttgtctccgaacgggcttcgtgggcttattgtttgtaaactcacggcccattgacgtcttcttatttgattcaagaccagaaaccacgttttgtactgtagtcttgaattgctctgttctgctgatagaatagcaaagttctgttctgctgataaattagcaaagtaaatcttgaatgctagtttgtctttttctctcatgttatgtgtaagaagatgatgatgactctgttaggtaagaaagtccaactttgtaatctaatcagatttagtctctaattgtttacttgtgtctacatataaaagttgcaagttgcagatgttaagaactaagaagtggtatctgcagattttgggtattaaggaaagtttccccctttgaataaataaggacatatactaatgtaaaggttcctcctttttcacaaatcaaaatgtgtttctttgtgttctagtgaaatccaatccattgtgtctctgatgctgagaatcttgaagctttcgacatcttctcgatctgtgccattgacaagattatggcttcttcaactgccttgtttctgctcatcttcttcatcatcgtcttctttgctttctgtgcccagcgatgatcatatcgtccgtctcattctagaccagaaatcagcttctggagctttggaaacttttcgatgggcttcgacttttcctgggtttatccattctcgttccacttaccgtgctctgtttcataaactttgtgttttccgacgttttgatactgtctaccaactgctcgacgaaatgcctgactcaattggtttgcctccggatgatgctatttttgtaactatcattagagggtttgggcgtgctcggttgatcaaacgtgtgattagtgttgttgatctagtttcgaaatttgggatcaaaccatctctgaaagttttcaattcgattctggatgttttggttaaagaagacattgacatagctagagagttttttacaaggaagatgatggctagtgggattcatggtgatgtgtatacatatgggattttgatgaaagggctttctttaacgaataggattggtgatggttttaagcttcttcagatcatgaagacaagtggtgtggctccaaacgctgtggtttataacactttgcttcatgctctttgtaagaatgggaaagtcgggagagctaggagtttaatgagtgaaatgaaggaaccaaatgatgtaactttcaacattttgatttctgcgtactgcaatgagcagaagttgattcagtcaatggtgttgttggagaaatgttttagtttgggttttgttccggatgttgtgacggtaactaaggtgatggaggttctctgcaatgaaggccgtgtgtctgaggcactcgaggttttggagagagtggaaagcaaaggaggtaaagtcgatgttgtagcttgtaacactttggttaaagggtattgtgcgctagggaaaatgagagttgctcaacggttctttatagagatggagagaaaaggttacttgcctaatgtggaaacatacaacttgttgatagctgggtattgtgatgttggaatgttggattcagctcttgacactttcaatgatatgaaaacagatgcgattagatggaactttgctacatttaacacgttgatcagagggctttcaataggggggaggacagacgatggtttaaagatattagaaatgatgcaggacagcgataccgttcatggggccagaatcgacccttacaattgtgttatttatggcttttacaaggaaaaccgttgggaggacgccctggaattcctcttaaagatggagaaactttttccgagggcagttgacaggagcttcaagttgataagtttatgcgagaaaggcggtatggatgatttaaagacggcctatgatcagatgattggagaaggaggagttcctagcattatagtatcccattgcttgattcatagatacagccaacatggcaaaatagaagaatcacttgagcttattaacgacatggtgaccagaggctatttgcctcgatcatcaacattcaatgctgtgattatcgggttctgtaagcaagacaaagtcatgaatggtattaagttcgtggaagacatggctgaaagaggttgcgttcctgatacagagagctacaatccattgctcgaagagttgtgcgtgaagggtgatattcagaaggcttggttgcttttctcacgaatggtggagaagagtattgtccctgatccttctatgtggagttcactgatgttttgtctcagccagaaaaccgcaatccacgtaaactcctcattgcaggacataatccaaagttaaaagctagaggcagtgacataaatgatcattgagctcgaacttgaggcctttaataatgcatctgcaacaaatacgaagatggctccaaactagcaagcagagagatcaagatggtacgtttgcttcttttgaaaatctgttaaaagctttgggagaaaaggagaatgcctaaaatcagaagaggcagattttaaacaagaccatgagagaagggcaaaatggagaattggacatcgtcaaaatgggaaaatgtttgaagcacacccatcaataaaaaaaggacaagaggagcaaaaagaggagagagtcttacgtttcgtgctattcctctctctctcttttatctctctttctcgagaaaactaaagaaaagggggctcttttattcaaagatccaaactttgacaattcaaaatccaacatagaacacggatcaagctttcaaattcagacagagatatg

SEQ ID NO: 26128 - DNA, 3003 bp, Unknown
  misc_feature (1)..( 3003): 2750-1469P.txt file - cDNA_ID_2710796; gDNA_ID_2214692; Annot_ID_136734
cctttaaatttaaacctaagccagccaacttgactactaaaattttcaattctatagctccttattcgttcatggttaacgaaacgatgacggttaaaaccggtttagttactttttctctaaccggctcaatctgattaaaccgaagtaaacacagcaatacagctagtaaactcggtattactcttgatggaaaaaggtcaaaaacactctttttattttaaccaaaactaaccaatttttgcaagataatattgcatacctaagatcatttaccttgatctcatagaaatttttttaatgatgcatctccaattataccgatacaatttctagtaaataaatcagtgttcaataaagtgggataggcgtcgtctaggacgcctaggcactaaacgcttttataccgttttgactttttcaaaatcggttctattaatcagtgagatagatttggcagactatgtaaacattaagcggattagactctcattaggtgggttaggctaggcggatctaatcgtctcttaatattttttaaaaatttcaaaaatatattttaaataattttaaggacacctatactttttattattttattttattttactaaaatgttaaattttaaatttatttttaaaaatttgataatttccgttttttataatagtttttgcaacagttcagataatagtatataaatatatatcgttttattctaaaaccgattaaaccggctaaaattgtctaggcctcgactaagcgttctatgcgctaagcggagggtcaccgccagctaagcgcctaacattttcttaaacactgaaataaacacaaaattatatgataagaagtacgattaaaccaaaaataatcgtcacaatttttgccactatgtctaatgtatatgtgattgttttacctttaacaaaagaaaatgtgatttatttacctttaacaatatgaaaatttgttttttttaacacaattagtaattttagtgatattttcactcgaatttgttgatagcaaaaggtgtttagaagaccaaaaagcttaacgcatattggctcggctcggccgaataagttagctggacagtacggtggggcacacgaagatccttaaaccgcagcctcagacaaaccttactcgaagcaaaacagtgtttggttcgttcgtgggggtttaaaaaaaaaaaaaaaacttttgtatttttttccattaaaatatttttttgttaagaagattcaaaaggagaacgcgttagacacactaagggtgggggcaagggaggagaaactcgccggacagagacggagatccctaaaccgcagcctcagactaaagcttcgcatcttatctccgatccatcgttgacttcactcttaggtaaattcgaaaaccctttctcttatcttttatctcccaattcttaaattcgatgattgactcgtcctcctctgttttttcacagctgatcatcatcatcatctctatctctgttcggattctccataattgatccggaccatgccgccgagatgtcctttcctccgccatcttttcttcttactactattactctcaccatggatcatgtctccttgcggcggcgctgccgacgatgtgacgtatccgatcgttccatctagtcccggccgcagatcaattttgcagattcgtcggtgagtttcttccatcctctgcatgtttaaaaatacttagttagtatttgattctggtgacactgttttaggtatcattagcattgtaaacgtgatggactagtgattaggttttggtggtggcaagaattggtttgattacattttgatagatgtttttgattcttctctatgtggttactggttgtgatgttatctgtcttctactcagtgaaccaccaacagagccaaatacgaaacttgttgttgatcgtgatgggaaggtgtttttaaagcagcaaccgaaagaaacaccatactggtccttttcaacaggatcaccaatgcactcgttatatcaggctcctgctaataacaacacagaaaatgctactgagataactcgtcctcacataattgttgaatatctgaacaactcaaaggcggctactactgtcgatggctatcataattgggtatgaagcatctctctctttacttcattattactggactttgtttatcttaactttgtttcggcacatattcactgcagacagttcaggagttttttaggcagaagccacttgtaacagatgatggtgtgactcttggatcagaaacaactagtgcctatttggttgatggtagatcagggaggctgattcatgtttacaaatcaactggagatactaagattactaatgctctcgtgaagcccgctagcactgaagattttgtgaatgaacctcttcttatcaggcgaacagattccaaacttgagcattttagtaaaaccactgggaagcttgtctggaatttgacggtttctcacttcagagctgctttactatgtgatcctgttttcaattctggctatgacctcggtcctaaacttcaaactggaatttatatgccattgttatgtggatcacaaattgacgttcgtggcccagaaattgttatcagggtgctccatgatcagccaatgaatgtgaaaatgctaccctccccttccctaaatcacttcgagagcgaaaacagcatcatgccttttggaaaagccagagagtcaagaaagttacaagagcaacataagcagaaatatacatatttgtttggacaatggtcaccagtaaagttattggcccctttagtgcttctaggtgttgttgtctctgttttcattaaaaagttttcgtcgaggggcagtgatgttagtttgaaagctggaccttccaaaaagaagaagaaccgtaaatccgcgaaggatacaaataggcagtcagttcctcgtggccaggatcagttcgagctcattgaaggaggtcaaatg

SEQ ID NO: 26129 - DNA, 3000 bp, Unknown; identical to SEQ ID NO: 14008
  misc_feature (1)..( 3000): 2750-1469P.txt file - cDNA_ID_2710800; gDNA_ID_2214692; Annot_ID_136733

SEQ ID NO: 26130 - DNA, 3000 bp, Unknown; identical to SEQ ID NO: 14006
  misc_feature (1)..( 3000): 2750-1469P.txt file - cDNA_ID_2710808; gDNA_ID_2214692; Annot_ID_136730

SEQ ID NO: 26131 - DNA, 3000 bp, Unknown; identical to SEQ ID NO: 14034
  misc_feature (1)..( 3000): 2750-1469P.txt file - cDNA_ID_2710832; gDNA_ID_2214693; Annot_ID_136757

SEQ ID NO: 26132 - DNA, 3003 bp, Unknown
  misc_feature (1)..( 3003): 2750-1469P.txt file - cDNA_ID_2710846; gDNA_ID_2214693; Annot_ID_136751
cttgcactggtgtgctttgtgccaggaacacagggagatgaagaatcatctttctgatacagaagcctcatcatcaactactatggatcctcccccagttcaagagatgaacactgaggagagaagagacgcttcatcttcttcgtcctcatccccatcatctgccaaaagccaacacaatgatctcgagatggtccctctataggaaacgttccttattaatctctgctgcttatgctttaagctgttttttctgtgcagagaagttttcgtaccagatgactctattgtccttaggttttaaatatgcaaaagtttgttctaagaacaagttcaatagtactcttaagttttacagaacttaaattcatgacttcattgaatctcttggaagaaggaagaaaactattttgtgattaaacactgcatgattggtaaatttgtttcgtatttcgttattttgttcttttttattataaaacttcaaagtaattacacaagcacccgtggcctaatggataaggcgtttgacttctaatcaagcgattgtgggttcgagtcccaccgggtgtgctattctaattttactgaagctgacgaaaacaaattagaattttacccgactttttgttccctcacattttatctgctaaatttttttctgtcagtagtcatcacatcatgatccaatacaaggttatgagttataaaatgttaatgttactaattttcgcacaaatgactaaactcaaaacactgatgatgttaggaaaccaaagatgaatttacaaagtgttgactgcactaatccaaaacttcttgttttgataccttggacaagttgaccttcttacttgcacctcaggcctcagcttgactattgtcccacgtttggcctctgttctcaggtggtatcccctatcagtactccagggacgccagggccaaaagcttggcatattcagggagtttgcggaccagctttatttccccagaggaaaaaaaatcacacactcccaaatcttcatcctccatcgtggtcaaggcgtttaggctcggaggcggttctccatgaagcgtcgcccaatgtgatagccactcatgggctctcaccatttttttaagaataaatttttcaaattgatgagatgagagattctgttaaattttttttattttgcagtgtccaatagtagtctctctttattgggttttcatgaaaaaaataaattattagttcacacgtttccaacaacattttgctgcttctttagttctcccttgagccctctcttcaagtttgcggatcctagcttgcaatccacagaggtagtcctgttcgaagccattaaaacaacgccaaaagtcagagtagagtgtaaagaactcagattccaatttgatgaatctccaagagcacaagagaagttacaatgcaattatagatatgataggttctgtaagttacaatgcaatttttcttgacagacgctcaatgtaccaaataatgaacactaaagatatagaaaaataaggaagcaaacaagcacacaatgaaataagagagcaaacaagtaagtaattaaaacaagcaacgaatcaaagaagaaaataaggatctttttagacactagaaaaaatcattcaactatgaactcttttcaagatttctgtaactaccaaccttacacgattgtcatggctaattgccatctgtcaaaccttggtccatgtagcttgttgaagctcaaatcactggaaagtggaaactagacacgagttacttacatcatcaaagacccattttacaagctaaagcagatatcaagacaacaatttccatcggttgaacaacaaactctaagcaaaagccactatatccagaagttagaaaattttaaagtgtgtttttgacttacaattttaaagccactataatcaggtaaccattataaagtgtaacccgtcttccttctgccgtaatctcactgcacaacaatgcttaaattagtaacacactctagttcatacatcaaacaagaaaaagatgaatcttttaagtgtgccggatatcaatttcctataaaacacacacctaggagaaaatacgtgcatcaagctagaaaaacttgaagaaacactagttaaatctgcgatagacaatgaatactaacttgaataaacactaattaaatcttcttccaagagatgtacgtgacatgaacatatatgacaaatccagtgagattcaacacaaattaacacaaatccatcatcaattaacacatctactcaaacccatcatcaattaacacaaacctagaacctcaaagggctaggctagaagaacttacaatcgacgtgaccaccgccttcgagaaggatgaatccggcccaaccattgctcttgcgcaaccactgctcatacaacatatcgactgcttaaattcaacccgcaatcgtcggagcaaacgaccggctccgtcgccatcaccagcgttttcattgtcgtttggtttcgagagagtttcgcgaaaaatagaaattgacaaagtattttccttcaggcgttttttttttttcagttttgtcaaacaaaacatccaaaacgtgacacgtacacgtctctcttctctttcaaagtttctctcaagagagacagctctctctgtaaaaacgatttctgatttaatttttcacaattttattctgagaacccactgagagaactctaatatcaagccattggagatgctctaaggtgaagaatcagagattagaagagagaaaaagaaagaagaagaagacaaagataacccatcgggtccaaatgtactccgggtcaaataacccatcgggtccaaatgttaaaccggaagtttatcaaaccgaatctgaaccaaaattgataatacaaacacacacactctcctcaagtctctctcacaaagaaaagactcaaacccattttcctaaaaccctcgtcgtccatacaaagccatg

SEQ ID NO: 26133 - DNA, 3003 bp, Unknown; identical to SEQ ID NO: 26132
  misc_feature (1)..( 3003): 2750-1469P.txt file - cDNA_ID_2710846; gDNA_ID_2214693; Annot_ID_189440

SEQ ID NO: 26134 - DNA, 3000 bp, Unknown; identical to SEQ ID NO: 14023
  misc_feature (1)..( 3000): 2750-1469P.txt file - cDNA_ID_2710854; gDNA_ID_2214693; Annot_ID_136747

SEQ ID NO: 26135 - DNA, 3000 bp, Unknown; identical to SEQ ID NO: 14022
  misc_feature (1)..( 3000): 2750-1469P.txt file - cDNA_ID_2710858; gDNA_ID_2214693; Annot_ID_136746

SEQ ID NO: 26136 - DNA, 3000 bp, Unknown; identical to SEQ ID NO: 14079
  misc_feature (1)..( 3000): 2750-1469P.txt file - cDNA_ID_2710886; gDNA_ID_2214696; Annot_ID_136816

SEQ ID NO: 26137 - DNA, 3000 bp, Unknown; identical to SEQ ID NO: 14079
  misc_feature (1)..( 3000): 2750-1469P.txt file - cDNA_ID_2710886; gDNA_ID_2214696; Annot_ID_189539

SEQ ID NO: 26138 - DNA, 3003 bp, Unknown; identical to SEQ ID NO: 24011
  misc_feature (1)..( 3003): 2750-1469P.txt file - cDNA_ID_2710894; gDNA_ID_2214699; Annot_ID_136824

SEQ ID NO: 26139 - DNA, 304 bp, Unknown
  misc_feature (1)..( 304): 2750-1469P.txt file - cDNA_ID_2710898; gDNA_ID_2214700; Annot_ID_136858
aataaaccacttgttttcgctcgctcgctttctatttctcctccgatctgctgaggcgtgcgttcattacgtgcttcctcaatggcggcacgatccctatggagaacccgtacgaagctcctcgttgttggtaccgccttatgcggtggttccggcgccgccttcattgcttcctccgatgacccatcaacaaccctcaagctttgcacctccatccccgttcgtctctaccgcaataccgttaccgccgcctctattgctttcggtacggaaactaaaccattaaaggataatactttacatg

SEQ ID NO: 26140 - DNA, 3000 bp, Unknown; identical to SEQ ID NO: 14104
  misc_feature (1)..( 3000): 2750-1469P.txt file - cDNA_ID_2710906; gDNA_ID_2214700; Annot_ID_136846

SEQ ID NO: 26141 - DNA, 3000 bp, Unknown; identical to SEQ ID NO: 14103
  misc_feature (1)..( 3000): 2750-1469P.txt file - cDNA_ID_2710910; gDNA_ID_2214700; Annot_ID_136845

SEQ ID NO: 26142 - DNA, 3003 bp, Unknown
  misc_feature (1)..( 3003): 2750-1469P.txt file - cDNA_ID_2710916; gDNA_ID_2214700; Annot_ID_136838
tagcagctcaagataaatttgaggacaacatcattagttccattccatggttgactaaatttatttgcaaacatggatacgcatatcgtacatacgaaatgcatatctctacctactattcgttcgtacaatcatttttctccccatttttatgaagttataaaattaattaaaaaatttataaaagaaggaaaagcacaaaacacctaactgaattaaaatagaaaaacaaacagaatcatgggctcagcttaaaaagcccagtatggactatgggataggaatataaagactgtggagatgggtggctcctaaatgtgaacaacccgtggatatgtagacagatactcgtcttgagagtgctcctcatttactgccagatgcaattaagagtgctcaagtggcctctacatcaatcatatgtcttgagcttgaacatatggttgcgagggagggtcaaacactatttcaacccaatgaaactggcagagaagcggtaaaagaatgttttgaatggactttcaaggactcaatcatacctcacttgcacaacccaaatttttcgaacccaatattttcagatcccataatgacctattacccattcatcctcatgcacatcttgattcaaaactttcttgtgtgcaatttttttattacgttttattacaatgtttgagatgaaaatgattggcatctacatatcatatcaatcaataattgtactcataaaacttttgttagtcaaatttttaccaaattatattcctaccaaaataaagatggtccaaaagatgttttctcctttctctttcttttcggtgttaaaagtaattcaaagtttgcttatagaatattctagactttgttgttgtgaagtgaccttgaaactaattgcgtccacagcagtaagactcctttatggtccattattaaggcacttcacagcatctagggtataaacgagatatacttattcctaagtaatttctcaactatcatatagaaaggaacgtttgttttatgcatgttaatattactaccaagtaccaacatctaaagcggtaactcaactgcacgagtgtatgatcaatacaatatcagtaatattagccaaatcacaatttttgccttaaatgatacaggcttttgtaaccatgtaaaacttttttttggaacttaactcaatctaaaattgtcatgaatatgttcttttttcttcaaaaacaatattcatctagaaccccacttggaacaaaaactactgttaaagaaaaggaaacttcactatagtcgacaactcgatatccacatctaaatacttatttataattattttattgattggtaatctatttgtattatattctctgcaaagaattttgttttgtgtcatggtcagtgagtggcatatgatttcagtaaacacaagtcacttattatgcaatcatgtacagattgattcaaaacatatccgttaattaatttgaacagttggagatgtataaagtctgagttggtacttccaaatggtttaagatttataggaagttgtgtcctttctggcttctgccattaacctcagccaatagactgtaacttgcatggctccgcctccaatcaacttgctctctagaatatgttgtactattaaattaaacaatatatcgataaattcgatgaaaatcccaactgtaattttttctcatagtatcaattttaaactttactgtattttctaaaggcaaaagaactttctattatagataaaaaaaaaatattaaaattgtgtaaaagagaatgtattgaagttttaaatgatcgagagtcaaagacattatcatttgactagagactaaagatgcacattctgtaagatgttaacttaggtataaactttttttttaagtgtgatgtagaagttttccacgcatatcgatcagcttaaccttttatttaaactataaaacaaatcactatcaatagttttacttaacgtgtttccttctccatatcaaacttatataaataatctaagaaaaaccataaaagccaagtacaaacgtatataaatcgggtatttctcaacctagatatattttggtaaagtattaagaaaacaaaactgtatccaaaattggtagcttgagaataacatataactaaattaatatcgtaaagattgagaagatcatcacttacaaacattcaacaaggtagcttcgacaacaacacaaatctaatgtgtttagatggttccatatttttaaataaaaaatcagtttgcaaaacaaacaattagtactaaaatagtttgtttttttctcacttaaaatccatatttccctagttcacgtacattttcatttattattcgtcagcaaaattattatatcttcttgaaatgatgaattcaaataaaataagcaaaacttggcaaagactcaaaatagcacaactagacaaaaataccagctaacagaaagtaataagaaaaaactcaaataaatggaaagacattaataaggcagatatatgtttttttatattataaattgtttttttttatagtataaaaataaaaatatcggcattcttataggatcgatctctcatgcaaaacaacaaattcagacaagaaacctcaacggctcagacccaccaataccaattttttaaagagatttctgtcacaagtaagaaagaagcactaattacaaaaaaaaagaaaaagaatcaatcttttgttcttcgattcgatttctaatcaattagattgtttttgttttgtttaacatcagttgcgaatcgagctggattcttgggctcgctttttctttcaatcaaaagtttcgatattagtgaaggataaaattcgctaaaaaaagagaattttttttgttaaaaaaattataaaagctggctttctcaaaatttctccatgtggtcgacgaagaagacgaagaagacgaagaagaaagagaaagtctcttagcaaacatg

SEQ ID NO: 26143 - DNA, 3003 bp, Unknown; identical to SEQ ID NO: 26142
  misc_feature (1)..( 3003): 2750-1469P.txt file - cDNA_ID_2710916; gDNA_ID_2214700; Annot_ID_189624

SEQ ID NO: 26144 - DNA, 3003 bp, Unknown
  misc_feature (1)..( 3003): 2750-1469P.txt file - cDNA_ID_2710924; gDNA_ID_2214701; Annot_ID_136874
gtacctcccccatcgaccattttacacacttgtctactttagaattgtttgttagattggtaagtaggtaagcttttgtaatctccttttcttgttgttttagctgggttcagcttggaatcttttttaattaatggaaatttaaaatacaaaaaaaaaaagttatacaaatggttctaatttctatttaaaattttatgggcctgctatgtataaaaaatagaaaaaacattttaatgggcctaatgtcaaaaaaacagaaacaattgttttctatgggcctgcttttgggtcttatggttcgaaacaatggtccatgtgaagcgtgcaccgtcaagtaacctacaaaaccacgacatcgtttagtgctattcctgtttccaaacacaccttaagttcgttatcaaccccatcctctttttttctataaataacgaagcaacgagttaacgagaaaaattctggatcggagagagctacgaagcctgggaattttcgttacctccttcgttcttctctgatctcgaattcaataccaaattcttcaatctcccgaatctgattttcttatcactatccctggataacaaaagcccccaaagtaaaaacccaattgcgattccctcgtaaaccaatctagggttttcgcgagttcgtctctgagcttgtttgtttgtgatcgtgtgagaatgtctcggtgttatccgtttccaccacctggttatgtttggaaagaaagtctgatcgaatcgatcaaggttgatttgttgagcaatttaaaagtccatgactttggttcttttttatgttcttggttcatgtgatttttttattgctcagcttcctgcttctttgattttgataatcttttgtcaaagttggaaactttgattatcatggagaagtaatttgccatatagatgggaattcaaatcttacttaaaaagttaactaatttatctcaaagcatgaaattgattcattggactgaatactgacaaatgtggttgaaattgaatagcctcctaaaacttatagaagtagagtaagtcattgacaatttctacattgtttgtgtgtttctactctccttctttgtcctttggaggtttactggataagaaagttatggacacttattgttgtttctttcattggtttggaaatccagggggcaaaggaggaagtgaagaaagatagaaaacacaagaggaatgaaaaagatagaaaggatagggataatgaggcggggaggagcaggaagcatcggcataagagacggcggaaagatgaaggcgccattgctagtggcaaattagtaagcagtgaggtcgagttgttagagaagagctgccagactgtggaacttgagcttcaaacatcgtctcagaattcttgtgatagcactcttcatagcaatgagagaccaaagcaaattcagagtcagccccttgatggtaggcataacataacgactctggtgagcttgtttgcttttacttgttgttgggtctgtttgcttatggtgtcattctttcttggtttaaagaaaccagcatacggactcggttacctgacaaagggcaggaagatcctgaggatggggtgatgatgaccagcaaggatcaaaaacagcgcttttcccgggaaatgttagatgcttctcaagctgctactgctcctaatgagtctgttggtcattcaagggtctgtcaagagaaaagaatagatccaacttttggttcgtcgagagagatcacaacaaaactcaacaaagagaagaagtcagttccttcgaaagataacagaaaagttagtaaagagaagaagatgccatcattatcttcatgtaaccctctggaacaagagaaaccgacctctagtcatcaagaaacccctggaccttccaagctattatgcaggaaatgccctccttccatggctgggcaactcttgaatcttatcgagaactgggctcctgatcgggttgagagcaagctcactgactctgaagatcaagaatggtggttgttcatcaagtttggagccaaaagtccacaagttagcaatcagaaaaccaaccagggaagtagttccatggtgtggccgactgctagatttcttcctgaagccgaagtacacgcattgccattcactgtcccgttctgatttcaacaaagttggtcgagagagagtgagagagagagagagagagtggttaacatgaccaacatatagttttcccaagtattttagagtagccttgaaacttaagaaactcagaattatgtgtgattctttgtagatgtactggtaatatagtaaatcaccaattacgtaaatggtaaatatatgtgctggttagatagtaaattacatgagagtttcgaacttctttggctacttccttatcaatcgtaaatcttatttacgatctttgttttttttttctcataagtgttgcctctcattataaagagtttgccaacggtacaaaagtggaacaatccactttcaaactacagacaacacattaaacagaaaacaacattggaagaccaaacaggtggtatccatgttgcagagaaaactatttataatttgatttggttcgattttaatcaaaatgcaaatcaaaaatataataaaataacaaagtagttacaatattttatattaattgatatgtttattcataatacataaaatataaaattgaaataaattttgtttatccggttcggttgagttccaatatagcagaaacgattgcggttaaaattctggattttattcggtttgatgaaatagaatatggaccgttagatctaaagttaagtagaaacaacgaacggtggatagcgaggaaaacgtacacgtgtgaagcatgacataatttttttcccatccaaagactttcacaaggtcttttttttgaaacctgaaaagtgagaaacccagagatcgagattgagatttagagaagacgaagatcagaagatg

SEQ ID NO: 26145 - DNA, 3000 bp, Unknown; identical to SEQ ID NO: 14122
  misc_feature (1)..( 3000): 2750-1469P.txt file - cDNA_ID_2710928; gDNA_ID_2214701; Annot_ID_136873

SEQ ID NO: 26146 - DNA, 3003 bp, Unknown
  misc_feature (1)..( 3003): 2750-1469P.txt file - cDNA_ID_2710944; gDNA_ID_2214701; Annot_ID_136868
cgtacaacaacatgacgccatacacagaagagaaaaccattcttatcataaatacgtatcctgagtttttaatcattttccttcgctattacctatttatgtaactctgatatgtgtatgggactggcctagtggcatggacccaaatgcctttaggattagatgaaaatatcttcgggccgatatttgttgaaatgtcgtatacatttatgtatatacatcaggattagagtatttattataaggaagccactatgttacatgtattatttaaataatacgtactctagatatttatttattttttgttaaaagagaaataagtgtttcaatactttactttggagatagacagacacatcctttttctgacatcgaattcattagtattagatacgtattaaatgtcatgtgcatagaagatgtgttacaaagctactcggtccattcatgcagtttagagattgtcattgttaagctcgttggcttttataatatattaattaagatcaattgataagtagtgaattaatacgtattacttatgtacttaaaattttaactcattcttttatattctttctgttcctttttatatgattgtttaggaaaacatacatattaatgtagacatatcaagttgattttatatatatattattttttgtgttttataattttctataactttaaatcaataatatttacttatttttattaaaatttacaattcatcaataataactaataaatattgtatagaaaatctaaaaaatcaatctctttgaaacaaattttatttctagaaaattaaacaaaaagagacagagaaaatataaccgaaggaactccaaaccgtattccaactaattctcaagatccatagaaattcaattcttattttcttatcattaaaaacgtctacagatagtcaacctgtagatataagataatttttctcattcgtaacataaattttggttaaattaacttgttcgacctattttaagccgaatccattgtaaaaacggttatggttatggtgcttaattatggttagttaagcaccattaaataattactttttgttttgaatgtccacaaataaaattttaaatgcatttttgttttgttttcctatgttctttgccttttagatatattatttttcactattaaccataagttggatttttaaaaccacgaaggggaaacaaattgagtgaaagttttgtacgtgattagtgtataaattgatatctgcagttctttcgaatacaataatggtttatcaacagtaaactatctcacgaggactggattgtagaaaagccaacaacagtaaaaaatgtttggcaaagtgttcacgttttttatttgctataactgaatgtggagacaaagctcacaagtcacaactcacaactgctcataattatttttgtttgaagtaaacaaagtctgtagttcccgctatatgatgagcaattatagttgcatacttggattaagtggataatttttctgaaagatcaacttaagggtgcttgttaaatcgatatatacatatagaagtgttttttttcttttttttgtcaatttatattaagagtgttgtggtggttaaataagcatatctaaataccatttttgaactagtggaatgagacaagtgaactcaaaccaaattttcactattttttttttagttgatgtgtgtcatccttatcatacaattatctaaaactgttaggtggattattatcacatcatatttattaacacactttatgagaaaatcgcataaccatactgcattcaaggttttcaaaataatatggcaaacttttactatgacgtagagtgcactaaattgattttaaaattaaaccacaatttataataaaaaaacctcgtttagttgagcttctgttagattgaatattcaaattatacattaacttgttacgattcgattcagttgtgaatatatatcgtctagacctaagttgcatggaaattctgtctgatgtccatttcctatttcaaaatcaacatctcttaaaaacagagaaaacttaacgttcctttaatttgcatttttacacgttttgtttcccggtatgttgtatctgtttttgtttctaggcaatataggtctagacgattttgagaccactttattgtttcaaaaactcattgtagacatccgctaaattcgtgtacaaaactcagcaaaagttaaatgctgtctggttgacgtcactgtcttgtgatatatgaagttagaatacttcaaatcgaagttcctaaatgatgtttaacatttttaaaaatctagtattttgcattgttacacgagaaacttatttaaaatcatactattcttaagccgaaattttatatgatcaattttttttttaatattgtaatattttctttataaaggtaattattctaatcgtttaagcacacgactagacgattagcactaatacaaaattaggatcttattcttaacccttttttacttttcaaagcaaagtatattgcaaattgcaatgaattaaacctaagaaataacgtcctctaattggtttacctaaagaaaaaatgttttaattaatttaaaacaaaatagcttttaccaaatgaaaataaaagaaagttctttgccccgtgagctcatctctcttctcttctatctctgactcgtggttttctgaaaacgaaaagtttgaaactttcgtgttattcttcgtcactgattgtgacacatataaaagaacccctaaaagattatccttcttcacctacaacaaattctggccatgaaagcaaactcaccccaagctttaaatgcaaagtagcgaaacatcccatcccatctcctccctctctctcttaaccactaagcaaaaatcccatctttctatataaacctctctcccaactctgctacttcccaccgtaaatcgtttctgggttcttaagaataacatg

SEQ ID NO: 26147 - DNA, 3000 bp, Unknown; identical to SEQ ID NO: 14118
  misc_feature (1)..( 3000): 2750-1469P.txt file - cDNA_ID_2710950; gDNA_ID_2214701; Annot_ID_136865

SEQ ID NO: 26148 - DNA, 2929 bp, Unknown
  misc_feature (1)..( 2929): 2750-1469P.txt file - cDNA_ID_2710966; gDNA_ID_2214701; Annot_ID_136860
cttccagtgaacaaaatcttttattagacaacttattgaggaaatgctgagattagcttatgatgataagcaagagcatacaagaattagcttatgatggtaagaaatttgcatacaaagatctcatgatgtgctgttagtgtgtcctttctctgtatctcctgctgaaagtgatggtcctgttttcaagacacgtaaataggtaattcagattcagatctttcagtaaaactgtaatttcagattcttcatagcagagttcattgtgagtgtgcaagttaccgttagattgtgcccctttgtaaccatcagctacatgtcgaaagaactctttagtagcatctgcatattcgttcaagaacagtcactactaaatcccgagcgagacatatacacagagccagaagtatataagaatctgcaaactcaccgtgtttcattgctagagacgggtcttgctcttccatgaccctgatcagttttgcaggatttccagccaccacacttcgaaaatacaaagagggtttgttaactaaacaaaacagtgccaggtcatgaagatttgtcagatgaattttctcttttatacctatgcgaaggaacgtcttttaacacaagtgaacctgcagctaccattgctccagcacctatgcttatgttaccaagtatagtcacacaagctccaagcaatgcaccttcacctatctttgggtggcgatcgccagtttcctttccggttcctcctaaagtcacaccctgtgacagtgaaaactcaagtagccttgaaaaactgaaaggaaaatcatgatctcggtattgaatttacaggcaatggtttggagaagagacgcttacatgtaagatcgagacaccgttgcctatcacagcggtctcaccaatgaccactccagttccatgatccaacaatattccctccccaattcttgccgctatgcagaaagagaattcaagtaatatgtataaccagcaatcaattcaccggtaaacctgatcaactattacaacagagaagggaaactgagaatgttcaaacagatgagagcagagatatgaagctcaaaactctacctggatgtatgtcaatgccaaaaacctgagagaaaccacagcatagatcagacattgagctcaaaaatgcagctccagcaagactcaaccaaaagacaatgatcaccaactacctcgcttattcggctttgcaatgcaagagctaatagtttcctcccttcattccacagtttatgcgcaaccctatatgcttgtaacgcatgataaccctgaaatgcaagtgggaaaactcttcataagtcactcattccatgtgagaaatgttctgtctctcaacttcgagtaaagaattaccttcagatgtaaaatagcagaactatacgacagacaagcaggatcacgatctttaaatgcctgcaaatcattgagatacataagaaaacaacaaagatcatgtctttttacagtattaggtggaatgttttacctggagatcatggcgaatcgaactctgaatacctttgtcatgcatcataacaccataaaatatatccaagagttgtgttgccaacaaggttgggttttggagacggttggctagaacaaaccctaaagcttgctctaaacaatcatgtgctaagataccagcatacaagaagctactcaaaataggctctttctctgcctgaaacgcacaacaagattcaccattataagattcaacatttcacaaactgtactcaaactttcttgtcctatgtttggttggattaaatatcaaggctttcaaagagagaaacaagactgactaattctaaaccctaatggatactactataacaactgtggattaacatggagacgcaaaaccatgacatttactttatctgaacaagaataagaatcgatgaagcagagaaagtgttagaatttgagggaaacctcaagtttagcttcttctcttatagcatcccaaataggatcagaacgaggatcaagcaaattcgagtcaaactctgacttatgagttcccttagcgtaaacctcgaaaccactctcgaaaggaagctcatcgccattcatatctctccaaggagacgataaagaagaatcacaaactctttttgattggacaaaagagagagagacggagaaagcaaaaaggaggctactttaatggatatgatgagaaactttgagaaacccctttttaatctattttgttttcttagtggattctctcgatggtcgctgttgttgtttggtttctcgttgatcttgtgtttgtgttgtgttccagtgtccaccgctttgaatggttctacttctactaatttcatatcatttcatttgtatatatttttgttggctttggccttatctggtcgcgaccgtaattgagtccaagttcgtaattgtgattagggtctctttaatcagataattgttttttaatcaaagagggatcgaataatattttttataagattactatagttcttaatcgtatacctcgagagggggaatatgaatattgtacaaggaagatagatccaccataaattatgccaacttgtcttatgtttatagcatatttctctatagtatttatattaatgtctcttgtgacttgtcgcgtactaaaactcctatatgaaattgcaagcattcaatttaaaagtatatatatatccgttaaattgaatttgaaacttgtaatgttttccattcagtaaatcacacaccgttcgttaatcacgaggcagcacgactgtcattatctgatgagttcccacaacagagaatcatcaaactcgtcttgataaacttcaacagatacaataaagtttcaattttttttgagaagtcgaacaacagccaaatcaaagtgttaaccatg

SEQ ID NO: 26149 - DNA, 2929 bp, Unknown; identical to SEQ ID NO: 26148
  misc_feature (1)..( 2929): 2750-1469P.txt file - cDNA_ID_2710966; gDNA_ID_2214701; Annot_ID_189660

SEQ ID NO: 26150 - DNA, 3000 bp, Unknown
  misc_feature (1)..( 3000): 2750-1469P.txt file - cDNA_ID_2710970; gDNA_ID_2214701; Annot_ID_136859
aagtaagattgtgctttgaaatcttcctacgaaatggactcgtttcagacacggcggaatattcttttggctacttctttctttttttaatgtcttaaaatctttctgaggcacaaaaataacaaaatcgttggccttccgcgtaacaaatctaattatagccaaatcatatccatggctgatctgtttcttcattttcacgcggtggttttatgattctctgatctttgtttccttacatacacacatgaaccagagactaagcttttttgtttcttacatggcgattacaagctacccatttcatcagctttcttcctcagaagatacttttgtactttccccgtcgaggttttaggtatgtccccgaaaactatagtctttggagccatgtaatgcggcaaatgatctcgacagaacccgataatctcctcgggtttgatggtatcaaatccttctttcagctttacaaaaccgcaaggagtctgtccccagtgatgatctggacgtgctacaacagcagcttcaagaaccgcttgatggctgcacaaaactctctcaacctccactgagcttatgttttctcctcctgagatgatcacatcttttaaccggtcttttatctctatgtacccgtctggatacttaacagcgagatcaccactgtggaaccaatctccctcgaaagcttttcgtgttgcctctatgtccttgaaatatccactcatcacagtgtttcctctgaacataacctcacccatggttaaaccatcatcagggacagtctccattgtcagcggatctttcacatcgagcccttctagacccaaatgctgcactccttgtctagccttcaacttagttctctcctccaacgaaagtgaatcccattcaggtttccacacgcaatgtgtccctggaccgtatgtctctgtcaaaccataaagatgagacacattgaaacctaattcttccatcttagccaggatctgcggtagaggcggtgacccacctgtcatgatctcaaccctgtgaggaagcggtttatgttcagtcacagtatagttcacaatcatattcaacacagttggggctcctcccatgtgagtcactttatgcatagcaatgttcttaaagatcatcttaggagagactttcctgagacagatattagtaccaccttgagctgctactccccaaacaagacaccatccgttacagtgaaacatcggcactgtccataaatacaccggataaacagacatctggtgaagaaagactgtagcaagagaattgagataagctcctctatggctatacactacacccttaggtctcgaagtcgtccctgaagtgtagtttatactaataggatcccattcgcatctcggtttgattatctcaaactcgctatctccggatttaagcagagtttcatattcgtaatcaaaagagtactttgaagcaaaggtagatgagctatcttcatcactatcatcatcatcattagactgagagatcaacacaagcttcagactttttctagttttatctgatttagcaagaagatcaagagctccatgagcaatctcaagtaactgatgatcaacaaagaggattttggcctcggagtgtgctaacaaaaccgacaatgtggaaggatcaagtcgagtattaagcggacaaagaatcaaaccagccataggaacagcgaaatgaagctcatgcatagctggaacattcggagctaaagctgcaacctataaaagtttcctcttttatcactaaacctaaatcgagaaccctaatcagagcagaaaattgaacaatttaaagagactaaccacatcgccacgagagattccgagattggtaagagcagaggcaagacggagacaacgttgataagtttggaaccaagtgtgtttaacggaaccaaacacaagagaggttctgtctctgtaaaccttagcggatcgctccaagaacgtgattggagataaaggagagaaatttgcaggggaacggagaagaccctctatagttctccatgattccggctcggaatcgtcgggaaatccgccggaatttgaggttgaggagaagggagaagaagttaaccacagtctctggaaacgtgggttgaagattctgaatgctcttttggttaacaagaatctcatggttaacactttgatttggctgttgttcgacttctcaaaaaaaattgaaactttattgtatctgttgaagtttatcaagacgagtttgatgattctctgttgtgggaactcatcagataatgacagtcgtgctgcctcgtgattaacgaacggtgtgtgatttactgaatggaaaacattacaagtttcaaattcaatttaacggatatatatatacttttaaattgaatgcttgcaatttcatataggagttttagtacgcgacaagtcacaagagacattaatataaatactatagagaaatatgctataaacataagacaagttggcataatttatggtggatctatcttccttgtacaatattcatattccccctctcgaggtatacgattaagaactatagtaatcttataaaaaatattattcgatccctctttgattaaaaaacaattatctgattaaagagaccctaatcacaattacgaacttggactcaattacggtcgcgaccagataaggccaaagccaacaaaaatatatacaaatgaaatgatatgaaattagtagaagtagaaccattcaaagcggtggacactggaacacaacacaaacacaagatcaacgagaaaccaaacaacaacagcgaccatcgagagaatccactaagaaaacaaaatagattaaaaaggggtttctcaaagtttctcatcatatccattaaagtagcctcctttttgctttctccgtctctctctcttttgtccaatcaaaaagagtttgtgattcttctttatcgtctccttggagagatatg

SEQ ID NO: 26151 - DNA, 3003 bp, Unknown
  misc_feature (1)..( 3003): 2750-1469P.txt file - cDNA_ID_2710974; gDNA_ID_2214702; Annot_ID_136893
aaaccaagatattgatcaactgattctgtgtcagttggcacctgatgaaactggacagcggcgccgactaccttttctgcagcttttttaactatcatgttatgcacgtctttagttagacgaccctcacgccacaacggtttcaacatttctttaatggtttccacaactgcagtccggaatagtctcattactttcattcctgcatctgacctcacttcaccatctatctcatctgatttctttgtctttttatatgaagacccatcacttctatgccaagaatcatgccctgcaggtttgattcttttcaaaacaactctattctctgcagccgtagccgaagaaatctctttgctaggcgttgctgtatcattttgatcaaccactgacgtagccaccccttccactactccatgtgcttccaaactccttgccacggtttcttggtgttgattttgactgcatgaactgcttttatcatcattcttgcaatcccgtgcttggggaccactagcagaatcaccatctttctgctggcaggaacttttccgtgcatgttctcctttacttgacaatgaatcattaagaggtctgtctcctagattctctatatccgtgaaaggatcgtagagggcatcagacgagggaagaatataaggtggaattgtaaaagatgctttaaaaggttcagaaggttcccagtcatctgaagaaactttctttttagtgctagtagtgttggcttctgcgcctttatcagaagaaacagctaccccttgcagcgttggaagtgatccggatccagataaactattcccattttcaaaatcccccaccgtagaagcacgatcattcataggaacagaactggataatgatcctgtccaggctggtccagcagatcccatgtctgtttttaaataggaactgatagaaggtctatgctcatgaacaaagctgcttctcaatgcgaaggaattggcgttattaataactagagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttgatggcagaccaaagttcggagatcgtcaatgctctgtcgtcggagatggaagctgtttccgtttcatcaactcaggcatcttcttcgtccgatggattccagtgagttttcttaccaatcatcaatttttttcattttcgcgcttcaattttgatttggattatattatttgattagagtggaagagatgaaaaagctatagcaatttagaagtatggaatttaaaattgaaaagatcttgttatctgcttattggtctggtagatattgaaattttactaattcttcaggatg

SEQ ID NO: 26152 - DNA, 3000 bp, Unknown; identical to SEQ ID NO: 14135
  misc_feature (1)..( 3000): 2750-1469P.txt file - cDNA_ID_2710982; gDNA_ID_2214702; Annot_ID_136888

SEQ ID NO: 26153 - DNA, 3000 bp, Unknown; identical to SEQ ID NO: 14135
  misc_feature (1)..( 3000): 2750-1469P.txt file - cDNA_ID_2710982; gDNA_ID_2214702; Annot_ID_189709

SEQ ID NO: 26154 - DNA, 3000 bp, Unknown; identical to SEQ ID NO: 14178
  misc_feature (1)..( 3000): 2750-1469P.txt file - cDNA_ID_2711040; gDNA_ID_2214704; Annot_ID_136932

SEQ ID NO: 26155 - DNA, 1705 bp, Unknown; identical to SEQ ID NO: 14192
  misc_feature (1)..( 1705): 2750-1469P.txt file - cDNA_ID_2711048; gDNA_ID_2214705; Annot_ID_136960

SEQ ID NO: 26156 - DNA, 3000 bp, Unknown; identical to SEQ ID NO: 8341
  misc_feature (1)..( 3000): 2750-1469P.txt file - cDNA_ID_2711052; gDNA_ID_2214705; Annot_ID_136959

SEQ ID NO: 26157 - DNA, 3003 bp, Unknown; identical to SEQ ID NO: 21947
  misc_feature (1)..( 3003): 2750-1469P.txt file - cDNA_ID_2711066; gDNA_ID_2214705; Annot_ID_136946

SEQ ID NO: 26158 - DNA, 3003 bp, Unknown
  misc_feature (1)..( 3003): 2750-1469P.txt file - cDNA_ID_2711093; gDNA_ID_2214712; Annot_ID_136986
tgcagtttgatttaccagtcggggaacacatcgggagaagcacgtggatgcttttgcgcggatccgaggattcctattcttgagaaaaggttgaagctttggcaacagcaaggcaggagaaacatgtgcagtcattgctactaatgctttttctgctgcttcacaaacaaatcgcttgtcttgggaagatttaaggaggagttgagtaagctgtaagaagggaattcggagttactgttataagaacacacaaatgtccgctatttgaggagaattccaagagtatctgcaaaagatgatttaccaagagatccaattgatcgattgtatggtcattatatgagctgaagatgtcagcagatgtcatacatgcggttttacttacagcacttcttgggttcttcagtgatttcacgataaacaggatcactttctccctgtaagagctgacagcgtgagactagaaaattctctcgacgtgtaactcgctctactaaaactgatcataatcacgagtagaaagaaaatgacttacagcatatgcagcatttcttccttgtggaatatggaaagacgacgaatggtattaagagcatcacagaccaaaacccaatccttggagtctagctcggttacaagtgactggaataataaagaaagcagttccagaatggtattaggtaaacaacttacttccaatgtccaaattctaaacagatgaatataattgcaaatttgcaaggcagcattacaaatgagaattcacagtaaagcataggatactagcaggaaaaaacaattgataccttgagaactgcatcaacttgggttacattgttcaagtctttggattctatatactcaatttctacgataactctctctgcctcaggtttctcaatctcatcgcctttaggatgattgtgatcaaaggggacagagttttgtggtggtttatcttcagctgttccattcattttgccaaccaaaagctttgttttatagtcgatattcctctcagagacaggaagattcttcaaatcttttaaagccttggcagccatgcgtacctgaaaagtaacaaagaagacgccattataagtacaaacaacataagtttagcatctgcgattacaaaaccaaagataagattatagatgaattttcgacctctagcttagtattaagtattcccaatgaaaccctttcaaagtagaaatggtaagataaacacattactatgagagttcaacagcaataacattaaagagcagagatctatctacattcccaaatcttatttcaaacaattacgaaatttactcaaaacaaaagcaaaaaacctcgatcccactcaaggactctaaaaagttcaaacaaatcctcgcagtccgaaatctaactccggcgccgtaaactactgcaaccgcgaaagatcgaaaacgcagaagaatagaaaaagtagcggcgagtcaagcggtatcgatgactactaacttgaagagtaaatagtgaagattatttgactcgcgtacctctataaattcgaaatgccagagaaaattcagggagagaaagagtcgatgaagacgacgaaattgatttccggccaacagttcgcaactcgtagtagagtcgtcgtagtcatactcgtttacaccgacgtcgttttatggatccaacggaggggacccatttgtacggcatatcttgggcgaaattaatgtttttcttttccttctctctgatacactttggttggttattgtaaattcctcaaataccctcggactagatatgcatttttatttttatttagatatggaattggtatatacatattttttaatacgtaaaaacttggattggtgtggaaatattttattttctactaaacgaaataaattgaacgtataaagtacatcacatgttacatgcactgatgcacatgaggagtgcaaatttgaaaatataagataagaaacatgttgcaaagctgccacccaccgtatccaattgctactatttgtatcaatcagttacaaactgaaaaccaaaaatgaaatgactagaacaaataatgttaaaatgcacattgaaatagttaacaaggaaagcatacattgatcgataaaacgaatccaccacgttccaaaatattttgtcgcagatgttgcagacttgtagctaagttgggccggtagatgtaggtgacaagtgtttacaaatctgttaactgtcgctgtgttcctcctacttttgattttgtgttacactattcaaaagttggtcgactcttttaatcggttgattagactagtacttagtaaaatttgttgttaaaacttaaaagggagaagaagaagaagaatactgctttaattcttaattaatttttttttaaaattagtagtatcattaacgtgtttattacaccttcctcgagttactttcctcgtgatgccaatggtttttttaattctttaccttttcttctgacacagagtcacatatttgactacggaggagatctattgcttcctagttcctacttatctttatcgcgttgtaccaacatcaatataaaagcaacatcttactttataaacttccgtaaatttgataacaagtacaatcaagtttaaatttttctaaagttaacataaatttagcatcatacaataattaacattttttttaggttaaacttttggtgcgttacgtgagtagcagcatcttcgaaaatatgtttagtagtagtagtgataggaattaggaaaaggcacacacaaaaaagaaaaaaaaagggtaaaaggattcattcacgtttttttgttttctctctccaaacagaacttcgggaaaagtggacaaaaaaaaagaaaaaaatttaataagaaaacctctttttctcgcaatttggttttgttttcaatcttcttcttcttcttcttcgtcttcaatgcaaacaatgctcgattccattaacctaatcgaataatg

SEQ ID NO: 26159 - DNA, 3003 bp, Unknown; identical to SEQ ID NO: 26158
  misc_feature (1)..( 3003): 2750-1469P.txt file - cDNA_ID_2711093; gDNA_ID_2214712; Annot_ID_189923

SEQ ID NO: 26160 - DNA, 3000 bp, Unknown
  misc_feature (1)..( 3000): 2750-1469P.txt file - cDNA_ID_2711097; gDNA_ID_2214712; Annot_ID_136985
cgagacattaaccctgaagcttcgagactagcatgtcctctaccgagacttgagaagcttgaatgcatcattgcataatcaaaagagtttccaatgcaagagctgctggcgagcatatgctttctggagaagaagaaacaagcaaccacatgatccatcagtgctttacaatttcggctatgtgttttctcagacatactcatgttatataaggccagacaagtccaatcaaataaagtctaaacaactgattgaaaatatatcgtatgtataagtaattcataagagaagatcaaaggccccttaaaaactccaacgaacggtagcacagaacgctcaacttatactgaaacttaaattcaacaacaccaaatcctagtccagcttaatcttcaatagtttatcgctttaaaatcgaacacattactcgcaatacatgtaaagacagcttaaccaagtcttgcaactatgttctcgatctcaacccaaattcaattcttataaaaccctaacgcatcgtcgaataccagaagcaggggaacgtacctcgaatcagacgtctcctcagctccgtatccctcagcatcactgggcggcgaggcgttcatgtccagaatgagcttggacttaacccccaacggccacagtttgctcctctcgccgccagtacgacagtcgctgcacatccaatcggcggaaggagccgcctcaactccatcgttgacacaagacatatgaaagcctcgctcacaggcatcgcagactacaacgagctctatagactcaggtcttccacacgcgccgcacgaagcatcccgatccggttcaggaacctcggcaggggctccaggggctgggtccgggttatcgtgaattgacctaacaacttcaacaggttcatattcgccgtcgtcatcctgaccagcggtgcaaccaccgccgagagtagcgccggtagggatttcgttgagatcgatgccgagaaaggagcgactctcttccttgacagcggcggtcttagtgtctccgagttgctcgttagtagaatcagtgggttccattattcgattaggttaatggaatcgagcattgtttgcattgaagacgaagaagaagaagaagaagattgaaaacaaaaccaaattgcgagaaaaagaggttttcttattaaatttttttctttttttttgtccacttttcccgaagttctgtttggagagagaaaacaaaaaaacgtgaatgaatccttttaccctttttttttcttttttgtgtgtgccttttcctaattcctatcactactactactaaacatattttcgaagatgctgctactcacgtaacgcaccaaaagtttaacctaaaaaaaatgttaattattgtatgatgctaaatttatgttaactttagaaaaatttaaacttgattgtacttgttatcaaatttacggaagtttataaagtaagatgttgcttttatattgatgttggtacaacgcgataaagataagtaggaactaggaagcaatagatctcctccgtagtcaaatatgtgactctgtgtcagaagaaaaggtaaagaattaaaaaaaccattggcatcacgaggaaagtaactcgaggaaggtgtaataaacacgttaatgatactactaattttaaaaaaaaattaattaagaattaaagcagtattcttcttcttcttctcccttttaagttttaacaacaaattttactaagtactagtctaatcaaccgattaaaagagtcgaccaacttttgaatagtgtaacacaaaatcaaaagtaggaggaacacagcgacagttaacagatttgtaaacacttgtcacctacatctaccggcccaacttagctacaagtctgcaacatctgcgacaaaatattttggaacgtggtggattcgttttatcgatcaatgtatgctttccttgttaactatttcaatgtgcattttaacattatttgttctagtcatttcatttttggttttcagtttgtaactgattgatacaaatagtagcaattggatacggtgggtggcagctttgcaacatgtttcttatcttatattttcaaatttgcactcctcatgtgcatcagtgcatgtaacatgtgatgtactttatacgttcaatttatttcgtttagtagaaaataaaatatttccacaccaatccaagtttttacgtattaaaaaatatgtatataccaattccatatctaaataaaaataaaaatgcatatctagtccgagggtatttgaggaatttacaataaccaaccaaagtgtatcagagagaaggaaaagaaaaacattaatttcgcccaagatatgccgtacaaatgggtcccctccgttggatccataaaacgacgtcggtgtaaacgagtatgactacgacgactctactacgagttgcgaactgttggccggaaatcaatttcgtcgtcttcatcgactctttctctccctgaattttctctggcatttcgaatttatagaggtacgcgagtcaaataatcttcactatttactcttcaagttagtagtcatcgataccgcttgactcgccgctactttttctattcttctgcgttttcgatctttcgcggttgcagtagtttacggcgccggagttagatttcggactgcgaggatttgtttgaactttttagagtccttgagtgggatcgaggttttttgcttttgttttgagtaaatttcgtaattgtttgaaataagatttgggaatgtagatagatctctgctctttaatgttattgctgttgaactctcatagtaatgtgtttatcttaccatttctactttgaaagggtttcattgggaatacttaatactaagctagaggtcgaaaattcatctataatcttatctttggttttgtaatcgcagatgctaaacttatgttgtttgtacttataatggcgtcttctttgttacttttcaggtacgcatg

SEQ ID NO: 26161 - DNA, 3003 bp, Unknown
  misc_feature (1)..( 3003): 2750-1469P.txt file - cDNA_ID_2711101; gDNA_ID_2214712; Annot_ID_136984
gacagaataatactcaatagtcaatactaatttataaaaaaatattggaagaagaaacaaaatgccatctcattttggtctcacacacgacaacataaaaagtcgagcgcgtggctttcacttgttatcaatgtcgctatcgaaatcaattgagcatttagtggaaaccggtaaggaaggcgcagcgaatctcatcgagtaatctcggtacgggaactcgtcgtcaaaatgtccggtttgatttccgtcatcgaaatttaacgagtagctcaactgatcgtaccggaatttaccctgatccgatgaccggttaggcattgcaccacctccgcatcctccgctgctgtttccgactctccctcctcctcctccacagcagttgctgcgtccgaaccggcggatatacgtcttccatctaggtccagcgacgagctccgaccactccctcatcctccgccaccctcggatccaccatcgctcgtcgggttcgagtttgtcgacggtcgtgatccgttgccaccacacagatccgccgcgagttgatggctgagatgaggcaaggcagggcatgaggaaacaacaacctcgcttcgcgaacaacgcctcgtgcatatcgtcggtggcatcaacttcagcgatcggcggcgattgatgactcattctcagagagaaacagaaacgaaggaaatatggaatttcgtcctgatctagctactctcttttgtctccttagatcgtcgttcctcttctcatctccaactctaaaccctaattttctccctctacccaagagatttctatcaccttctccaatcaacgcgtctcttgagctgtaactaaaacagaagagcacaaaacggcgtaaccgccaacccggcaatattggttctcattaaccctttttaaccgctttggttttatcacatctaaccgggaatttcagctgttgatgctattaatttattaaaccacatatgaatgaaggggttcatatacgtaattgacgttagcacatttggttccaagtattgatcgatacattaaaccgcaataaaattggtccgtttctctctggcccaaaattggttcgatttctccataagctgaaattgataactcccagtggatgtaatgtatctaatattcttggaacagattcattgcaagtgaatgttctaaccaaaatcacctaatctttttgcaaaatctaatatagtaagtaggataatatcttacttttgcaacaagccactcattcgtaaaaaccggacatactttaatgggataacctacaagtctacaactcatctggaaactatatcacaaccgatggtttagtatagttcttcaagtaacctttttatgaataccaatatcaatcagaagaaggataccggtcagcagtttgtttcagatcttcaagctgcgtgagaacatattcaagcttctggaagcagatctcattggctattctcgcgttgtaatcgcatttctcaaagggacggtactcgcaagcgcttttgatctcttcccttagtgtcacttgtatatcctgcaagtttcacaagaacttcatcttattatggattggcgataacattatagcacatttatgtacagtcaaagatcaacaagttcatgaaccagacaatgaagctgatatcttcaaactttatgattatctctagaaaaaaagcagaatcaaaagctttttacttgttcacagaatgtaatgatccctaatctagacatgtgtcaaatgagagcccaaatgttctttaaacagtgagattccatccaatatgaaaatatcagcatccatcactcataaaccttaagcctaagaataaaggatcaatgtcaaatcctaagaaacaggaaaggaatacaaacctagagattgtgatacatgaacccatatgttaactagtcacagaagaatcacaaaacgagaagcagcggccatcttgaagactaaaaccaaaatcaaaattctaaacaaagcccttaactttgatcaggaaatgtaatgaaccctaatatagacttgtgtcaaattagcccaaacgatcaacactcgagaaaagataccaattccccagagagattgagtcagcaagaacactaatctagctagacttgtgtcaagtgatccccaatgttctttgatcaggtagtttattaatacactaatgcaaaagaaatcagaaaatatttgaagaagagatagagtaagaaaccttcatagattgcataaactctcggcaatggctgttgacgaactctttcttgggaccagaagggctcgcgagttcttccatcactccaccagctagttccaaaaccttaacaactctctgcccggaaaaccaaaaataaaaacacaaaaacacattcacatcaaatcgtccaataaaatctctaaggaaagagtgagttttccaaaatttcacattctcaacattctggagtcgctgcaacgaagtgttctgcgtctgcggatccattggactctccacgatttcttttagaccagagagagagaactccaaactgagatatatcacaataccgtcaaatccactcatacacataccctaaatactcaaatcggagcagtgggagtacctcaatcgaacacggcgacgcgagacagtgaagatggcagagacgatgaaataacacggagaatttcgattggaaacggcgtgcttatgatcagcaacggagggaagattttggggaatcggcgacactcggcaatacagatcggtgaaggaaaaagcaaagaagatacaagttttttttgtcacgtaaaacggcacgaactctactttatcaattcaggaacagcgagtagttaaaatattgaattacgaaaacaccccttggttcagataaaatctttgtgatggccgcttttctcatttataacggataaaaaccgtaaacaatacacaagaacagaggctgacacctaaagcttactctctaactgcaatg

SEQ ID NO: 26162 - DNA, 3003 bp, Unknown; identical to SEQ ID NO: 26161
  misc_feature (1)..( 3003): 2750-1469P.txt file - cDNA_ID_2711101; gDNA_ID_2214712; Annot_ID_189921

SEQ ID NO: 26163 - DNA, 3003 bp, Unknown
  misc_feature (1)..( 3003): 2750-1469P.txt file - cDNA_ID_2711121; gDNA_ID_2214712; Annot_ID_136977
tactcttcactatgtcttgtctcaatcggtttaggcgtcttaaacccttctcttcaagcctttggtgcagaccaactcgaccacgacctcgataagaatttcgatctttcctcgggtgatcaaaaggacgcgaaagctacccgaaagactcagtttttccaattgtggtactttggcgtctgcaccggcagccttatgggtgtcacagtcatggcttatattcaagacacttttggttgggttctcggtttcgccattcctggtatcgtgatattcctgtcgattttggtgttcatgtcgggttgtggaatttatgtttatgctccgggcgcccgtctgaagaagaaaacaactactacaccttttgagaagattcttaaattcattaaagggagagtagtgaagcagagaagcatatatacacttgcagatgagaaagatttggatgctatggagcttgagtaagttcggaaaaaccacgatatctcatgaaactaattagtcttttaagttttttagcgactaatgattacctgtttatgtaggctagaggagaggcctctctgtaaatgtgagaccgaagacattgagactccttcaacaacctccaaaggattggaagatgacgagagctcgaaaacggttttctctggaattgataatgttaagttagtgattcgccttttccccatatggatgatgcttctcatgttcgcggttatcttccagctaccagcaacctttttcaccaaacaaggtgtgactatgaagagaaacattgggtccaacttcaaaatcccacctgcaaccctgcaaagcacgatcacattatcaatcatcctgcttatgccattatatgataagattttgatacctattaccaagagaatcaagaaaaacggtacaggtatctctgtgatggagagaatgggagtcggaatgtttctatccatcattgccattgttattgcggcaatagtcgaaaggaaaagactagccataagccaaaagatgaagactttacctgattatgatccagaaaccgtcccactgagcatcttctggctgctgcctcagtacatcctcttgggaatctcagatatattcacagtcgttgggatgcaagagtttttctacagtgaggttcctgtaagaatgagaacaatgggatttgctctctacacaagtgtttttggtgttggaagctttgtgagcgccgcactgatctcaattgtcgaggcttactcgagctcaacaggtgaccgacaaaactggtttgcagatgatatgtcggaagctcggcttgacaaatactactggcttcttgctcttacaagtacaataagctttgtagtctacatatttctatgcaagtttttcaagagtagcagtgatcaaggcgatgaaaaagaagaagcccctaaatgaaagaagaaaaactttgattcctttgacacagtcgacttagataaccgtttgccataagattccacgaatgatctaactgtagtagtagctttagaactaactagcaaaccaaaagagatagacaactgtaagatttttattcataagaaacagtatcttataatatcaaatgcaaaagattcaacattattattatctcgtgtgtttgattacatatcatcattaatcctcccattgaccaacaacatttctaaaatggacagattcaaaacagacaaaaaaaaaaaagtctgaaactttgatttatacctttaatcatgtgagctgtttccattgagaccaacttctttagctacgttgctctcttctcgaacctcgtcttcttcatcagagtcaagtgtgaaagtacttaaattctccaactcagctccgagaggtcgatatttagaatgatcttgacggagataaccattcttgttagcaatgacagagaacaaaccagtagccacaactaccattagagccaaatgacagttaaattgaagagtagctatagcttttgctcggtgataatcaccgtgtcctttgcacttgatcgtgaaattgcctctgctcttctcgtgaaacgtacagttattagtgatcaaaccggtaaaaaacgatacacccatttgcagaaaccatgttccttgcagaatcagaccgatcccacgacctaatttcgcaaaccgatgcgtgctagagtcggatttgagctcaaaaaccgtggagaagacgcagatggcaatgggcacgagcatgagatcgtaataacgattctcgattccagaaacatctttcttttgcaggtagaacattaagaactcctcaatgaagccaaagagaagcaataaagttgtaatcgaagacggaagtgcaacaaagacagcgtttttggagttgaccagatatgttagaatggcgtaatataggaatagtactgccactgccacgatctgtaactggatcattgacccgacccgatcgcgagatccgattgagctgaagaaggagaaaaacgagttcgcaataaacagagacgaaagcaaagctacggggatggaagatgatccaacagattttggcggcgaagctctgatctgagccataggggaagatgaatcagcagtaccagaagatgaattcggatccaggttcgatgagtccagtgactcccacgcgccgattactgcaaatccaccgccggcgacggcgtaacttaatatacccatgactccaatcttcacaatctctgcgaatcaggttatacttctttcgaggaaatttggatttttccgccattaaagcttaacagaatcgagcttctgatctgataaaccggaaagatccgacccgacccgaataacccaaaatgggataggctagtagcccaataactcaatatgggcctactggggtcttcaaatagttcatgtttaaatattctaaccatcacgtgacaatcatgtgacctctatggatatgctgctgctgcatatagctccgcttgcgtaatccagtttgcttggagaaatg

SEQ ID NO: 26164 - DNA, 3003 bp, Unknown; identical to SEQ ID NO: 26163
  misc_feature (1)..( 3003): 2750-1469P.txt file - cDNA_ID_2711121; gDNA_ID_2214712; Annot_ID_189914

SEQ ID NO: 26165 - DNA, 3000 bp, Unknown; identical to SEQ ID NO: 11674
  misc_feature (1)..( 3000): 2750-1469P.txt file - cDNA_ID_2711138; gDNA_ID_2214509; Annot_ID_133812

SEQ ID NO: 26166 - DNA, 3000 bp, Unknown; identical to SEQ ID NO: 11674
  misc_feature (1)..( 3000): 2750-1469P.txt file - cDNA_ID_2711138; gDNA_ID_2214509; Annot_ID_184205

SEQ ID NO: 26167 - DNA, 3000 bp, Unknown; identical to SEQ ID NO: 11665
  misc_feature (1)..( 3000): 2750-1469P.txt file - cDNA_ID_2711142; gDNA_ID_2214509; Annot_ID_133810

SEQ ID NO: 26168 - DNA, 3000 bp, Unknown; identical to SEQ ID NO: 11665
  misc_feature (1)..( 3000): 2750-1469P.txt file - cDNA_ID_2711142; gDNA_ID_2214509; Annot_ID_184203

SEQ ID NO: 26169 - DNA, 3000 bp, Unknown; identical to SEQ ID NO: 11686
  misc_feature (1)..( 3000): 2750-1469P.txt file - cDNA_ID_2711149; gDNA_ID_2214510; Annot_ID_133817

SEQ ID NO: 26170 - DNA, 3000 bp, Unknown; identical to SEQ ID NO: 11686
  misc_feature (1)..( 3000): 2750-1469P.txt file - cDNA_ID_2711149; gDNA_ID_2214510; Annot_ID_184220

SEQ ID NO: 26171 - DNA, 3003 bp, Unknown
  misc_feature (1)..( 3003): 2750-1469P.txt file - cDNA_ID_2711175; gDNA_ID_2214512; Annot_ID_133872
agattatagcaatacgtcagaaaggtcaagtacaaatacgagtcgagcataacagagataatggaatcaatttcacagttgcaaacctgggattcacactgtcaagcccaagaaccagtggaaccaaaaggataatcggtgtccactcagactgtccttttgagaattctagacaagatttggtagcatcttctatacagagaattggagccccacctctctctccatcttcgctgccagaaacgatatgaacagccataggaagcgtctggtttttagaatcagtttgttttctcttcttgcacgctaatgactcccacgctcgacaaatggcatacggtcctacccatgacccagcagcgagaccataggacgctccagctattataagattgtggatggagaaagctgaaggctcggaatcaccaaaaggttccaaggtctctaagtattcctgttcaggaagctgcatttttaaatcaaacaagcatgaggtttccactatctcaatgcaagaaaccgggtttctgttcctagtgttgctacattgagcttacctcagatttcttagtccaagccctccccagcctatggaaaagcaacgcctgataatatttggtttgtcagaatatgttataaacttcaaaatctcatgccaaaagaaatactcttcctcacacctgagcaaaaagcatctggctacttcgaatcatgcaaccccagttcacatcgctggtataagttgtgtctctaaagggttcaaaacctgtaaaatacaattcgtaaatggtaaattttatgtaaaaaactttattttggctttaatctgtagttgagtttacaaacctttacgatatgtcatcagtattttggatgaaaaatctagttgcaatgcagccaatacagtgccagtatcggtttcccctgagttctcatccgcagatattttatagcagacacccaagagccatacgtcactagttgtgctcggaagaccggtcctattaggccctaaaacacgctcctggaatctcctaattgctccactagccatagagactctttttacaaatgctgtccaaccattacgagtggtgcaaacttgcttatgcccagaagttgaagactccctatacggttgagaaactgaggaagaagacgtaaacacgtttgaccataaggtaaacttggacttattatcactaggtccagaatctgaaactaaaggggatttatcatgcgtatcactcttgcttgatgaagaacattgttgaggaacaaatctatcacataaagccttcattacctagacatgaagcaccaactgcaacgtgtccttctcatagaagcaacctaaatcctgagaaccttatctgaaataataagcacaaaagacactgaattaacatccaacatacttttaagtagtatcagaaagccaagattgactaaaaacttccacaattaacttcaaacactacacaagattgggtgtgtgtgacttcaaggttcagaaaagtttaatcaattaactctctgagaccataactatagttttgtgaccactgaagttcagcttaacaccccaaaaacaagtaagcatgtaacacaataacgattctacaattacaaacactaagcagattttgatgagaaaataaacccaatccatagcttcttgacctcttgaaacatcacaacatagaattttccgcatgatattaggaaggtttagggagtcaacagagaaatataaaccaaaattttagagatcaaagcatttggattccacatgcatattctcttaattgaagaatgtttctagcaaatgacaaaatcaagaaacagacttgagcttgacgaaatttcaactcacggatctacagtaatcgaaaatgatcaattaatcaacttaaattttgacaactcctcttcgtgtagcagaatttcatcatccaatttagcccaggaattctcacaactccgaatttttctagcagagagaaaacaataggaaaagaaacagaaggatcacctgagagatcgatcaaatggtttcagcagacgacggagatggaaaacgcaagggggagatcgatttcgtgtcgtatcttgctcgcttcaacgtcccgtcgaagatacctcagagcaaagacaaacgtgtgtttcctttggaggttttgggacaatctcaatggcgattcttctttttaccttcttcaaatctttcgctttcaactaatgacaatctatatcgtttaattattaattaaacttcacataatcagggttatgaattatgattacacttgtttaccatttttttacgtggaaaaaaataaatactctccgatttacctgtttacttcggataaaacgttcgaatattatattaacaatgacattgatagtattttactttacttttctccaggttcctaatttttttgttaacacatccatcaacatgttaacagtacacaaaattaaaatgttgctgctgcttgctattaatgtgattagtgattacggctaaaaggctatgacatataaacgacataaagcaacaatattagtttgggttaattaagctcagctaatttgggctagttaaaaaaattggatcggataaaaaagcccatattgacactgggccaacatatcatatcgagtcaagttacggttttaccctgaagccatttatttctgaagcgtaattatcaaagagaaaaaaagattaaaaaaaaagcaactgccgctctttcttctttcttactgtctcagatccgccattgttacttcttcagttcttcttcttcaacaacaacaagaagtaataattagggttgagaaacttcgaattccgaaacaacagagagacgtactagttttagccatcttcttttcttagtttcatcgaacttggtgttacctcaataggtcgacgctcaaatcttgcttattctctggtttttagagcttcttttagattctttcgacatg

SEQ ID NO: 26172 - DNA, 3000 bp, Unknown; identical to SEQ ID NO: 11710
  misc_feature (1)..( 3000): 2750-1469P.txt file - cDNA_ID_2711179; gDNA_ID_2214512; Annot_ID_133871

SEQ ID NO: 26173 - DNA, 3000 bp, Unknown; identical to SEQ ID NO: 11706
  misc_feature (1)..( 3000): 2750-1469P.txt file - cDNA_ID_2711183; gDNA_ID_2214512; Annot_ID_133866

SEQ ID NO: 26174 - DNA, 3000 bp, Unknown; identical to SEQ ID NO: 11706
  misc_feature (1)..( 3000): 2750-1469P.txt file - cDNA_ID_2711183; gDNA_ID_2214512; Annot_ID_184295

SEQ ID NO: 26175 - DNA, 3000 bp, Unknown
  misc_feature (1)..( 3000): 2750-1469P.txt file - cDNA_ID_2711187; gDNA_ID_2214512; Annot_ID_133861
aaaagcttagagtatcaaagaatagacaaaacttcaagcattcaacgccgagagtagattcatcaatcacagcaggacaatggttgtaaaagtcaaacaaagtgtaatcacagtttttagtagttgtaagaggctataatcaccaaaacaaagtttctcaccaaagaccatagagaactcgcatcacattagatatcatcaactaggatcctagtggaatatcccaaaccaaagaacatacaatgcatctctgtactaagagacaatgatcatatcacgtgaatcaagaggattcgtgggaaatacagatccgaatgttcgatctacacatgatagcactagatcaacctaaatgtcaaacagatcggagaaacaaaaagctcgatctaattacaccacctttttccatgtattccgatcaaatcatgaaggatcaacgcaagaacaacaatgaagagaaataaaacttagtggatttgatttttacctggattggatgaatgtgagtcacagagacaaagagaagagagtgctccaagagtcacaaaatgattatagattgtggaattggttgatccgttgaactttatattaactattatcaatgtgacgcgtaatcttcgctcgccgacaaaattttcgtcgtgtaagatccttattggcttttaaaattgacatccatttcgacacctcaatttcaagatattacaacaaagaagatcacatttttgattagtacagaaagacccccaaaattcggaggaattattattatcatacgattcaaaaaaaaaaaacaaggccagaagcttacaaaagcgtttaaatgattttgtaaccaagggtaaaacattttgacaatctttgaggtacaaacaatttcagagactggattgtaaccaaatgggacaacatcaagaggttctcatacgtgatcatgttcatccatcgaacgagccgagctatttcaggtggtgctcaaacaacgacgccatttcgagctgaaaaacaagaggaagaaatattcaaagactttaccaaaaagacataagaacccgaatggttataacatgaccagttgctcaatggaatgatcaggaatttctacatcttattctaacaataaaggattgaatcataatgatacttaccgccgtcaaagcagtttcagctcccttattgccggctttgccaccagatcgattcagagcctagagtttcagttaaccacaatattaacaaattcagtgttcatccattatgatgaataagctatatatcatcaactcttgcataacacaacttaaacctgatccatgtcctcgcaagtcagtacaccaaatatgcatggaacgcctgcaaattggattttttataagctttaattactagagtcaatagtgcgtaaacacaaaatttgaagaagtaattcatgatgagggaatttaaacatccaaaatccaaagaaaagcaaaaatgaactacccgctcttttaggttcggaagtatacaaaatcaatctttcagtgtttccaaaacaatgtcaaataaaaatgtctaaagatgtatatccagcaaataagtatcgaggtaaacctgaatttatgctagcagaaagtactccagacgcagcagagttggcaacagcatcataatgtgtggtatctcctcttatctaaaccacaacaaggacaacagtaatatcaaaatccaactctttaagtatatgttatcaacataaagcaactactttctgaagccatatgaggagaaaaacaaatggaatagcctgagattctttcaaaacaagaatcataccacagcgccgatacataaaacagcatgaaattttcccgatttcccaagattttgtgcaacaacaccaatttcaaagctgccaggaacccaaataacctgaataaaaacagtgtcattagctttgtgaaagctcataactttttattctgttctacaagcaaaagacttttacttcaatgtcttcttctctgactgaatacttcttgaaagtctcaatcgctccttccaaaagcaacttagtcacaacctcattgaaacgagctaccaccttgagaaagaaaaatgaatcagaaccaagtcaacactgcaattgagctcaaagttttcaaatttcactgtaaatcagaaccaagtcactaaatctaagcagcgcacaaagtaagaaagcgattctgagaactcacgatggcgaatctaagaccttcgcctctgataagagaccccgtaacatggcgaacagcagccgtctgtacgaatgaagagcgtaattccttctctacagctagtggtgacgcaaatcctaacaccaaatgttaacatctcaatcacgaaattgcgaaaaaacgatttgagttattataagagaagtgagagaaagcaagcttaccggatgtggatgaggagaatgagagattattggatttgttcacagaagagccaccgtgtatataacaggcggaggaagattgacgcgaattgagctgacggtgtgccgtcggtatcaggcggagacacggcggcgaagctaatgacttcatttttcgttcgtcggagttttagagacggttcttcgttcttcaggttaagagtgagactgtgaggtccattagcttatcaaatcggttcaaggcttccggtttattattttcattaaaattacggtttcattgaatctattagtttggttagagatttccggtttgatgaaaagggataagctaaaccctacatccccaatcactctcaccggccggaaattttcagacaaaagtgaaagatttaaacttttgactccgtcgtaacaaagaacaaaacttccgtatcctggagagtaaattcctttatggctacgaatgggtacgtttcgaaacctacgaatttcacgttttgattgacggagatgagctttaaactctttaagaggattctattgaatttaaacgatttgatcacaggttaatg

SEQ ID NO: 26176 - DNA, 3000 bp, Unknown; identical to SEQ ID NO: 11704
  misc_feature (1)..( 3000): 2750-1469P.txt file - cDNA_ID_2711203; gDNA_ID_2214512; Annot_ID_133854

SEQ ID NO: 26177 - DNA, 3000 bp, Unknown; identical to SEQ ID NO: 11703
  misc_feature (1)..( 3000): 2750-1469P.txt file - cDNA_ID_2711210; gDNA_ID_2214512; Annot_ID_133851

SEQ ID NO: 26178 - DNA, 3000 bp, Unknown; identical to SEQ ID NO: 11644
  misc_feature (1)..( 3000): 2750-1469P.txt file - cDNA_ID_2711224; gDNA_ID_2214506; Annot_ID_133771

SEQ ID NO: 26179 - DNA, 3003 bp, Unknown
  misc_feature (1)..( 3003): 2750-1469P.txt file - cDNA_ID_2711232; gDNA_ID_2214506; Annot_ID_133767
gtcaaccaacacacttgaaactccatacgagtaaaggcccattggggatgaggatatttgggccaatccttcttaccgtttttcgtttgttaacaattaccgaattaaaagcttgatcgccacgtctttttcttaatagaatatattgattttatttatcttttatttttagaccaagctcaggctatcatctctccgttaattagggttttcttctctatctcgatttcaataccattgttgatccgctgagctagggttgttcgatcccgataattgtgtcgcttagctctgatctctgttcatcgaatttggttaatttgttttgattggttaagatacattggaaagcgatgccaccgaaggttgtgaagaggggaggcgccgcgagaagaggtgggaggcttacgagatcggcgctcaaggcgcagaatcctcacgtggaatcttcccatgacgaatctgttaatatcggtgagctctcaggctccgatgcactggaagccaaggaggtgactccggaggttgataaaactgttgaggaagagaatccattagatgtgccgaagtcatcggattcaattgatgattctgaagctgcagcgaatccgcatgttgatgttccgtcgaaaagtaagattcttttagcctggttattaattttgtttcgtttttgggattctctacgttttcgttgttttgatggatctaagtttcgctttgacgaaagtttgtgacttagagttccaacatatctgaccatagagattaaatgaatgtctgaccattgaatgtatgaatctaatttggaggatggatgtttagctgtttttaattctgtggaagatagacgtatcttctgagattgttatctctgaacaaactttaggctacctggaatagtgtagatgttttactcgcttttactcgcagaggagactgaggtagaggaatctgtggatgattttggaaaagatgaaagattggatttagatgacaatgaacctgagtatgaggctgaggaatatggcggggaggagtttgaagagagggaattgggacaggaggaccatgagttggtaaatgaggagggggaagaactggaggaagagattgaggtcgaggaggaagctggtgagtttgcagacgagattggagatggtgcggaggaccttgatagtgaggatgatgatgatgatcatgctattgaagaggtcaagcatggagaaactgttgatgtggaagaagaagagcatcatgatgttctccatgagaggcgtaagcgtaaggagttcgaaatatttgttgggagtttggacaaaggtgcttcggaggaggacttaaagaaagtgtttggtcatgtgggcgaggtgactgaagttaggattttgaagaatcctcagacaaagaagagcaagggttctgctttcttgcgttttgcaactgtggaacaggcaaaacgagctgttaaagagcttaaaagcccaatggtaattgtctacactttagtatttgatggagagtttgtgtagctttacattttgtatcatgctcttggtcattgggactgcagataaatggtaaaaagtgtggtgtaactgcaagccaagataatgataccctcttcgttggtaacatatgcaagatatggaccccagaagctgtaagtatttgggtgtccgtagatatgtcaattaaacccaactccacagttcgtggtgatcctgacaatcaggtatttgttgttgttccagttgagggagaagcttaaacactatggagttgagaatatggatgatataacgttggtagaggacagcaacaatgtcaacatgaatcgagggtatgcctttttggaattctcatctcgctcagatgccatggatgctcacaagcgtctcgtcaagaaagatgtgatgtttggagttgagaagcctgcaaaggtctcttttactgattctttcttagacctggaagatgagataatggcgcaggtactcacattgcaggatcaattatttctagcaactttcatcctaccatgtcttctttagagcgttggaggagtttataggggcatgtgtgggtgccacctattctgtatggtgacttagaatacttgctaaacccatcatgaaaacagagtcagaatacatattccttttggccctctaacaacatgctagatactgaattattgattgttggtgaatctattatatctaacttatctatcttgctcatagtaattagttttatgatatttctggtgttacaggttaagacaatcttcattgacggtctgttaccttcatggaatgaagaacgtgttagagaccttctgaaaccatatggtaaacttgaaaaagttgagcttgctcgcaatatgccatcagcaaggaggaaagattttggctttgtaacttttgatactcatgaagctgctgtgagttgtgccaaattcatcaacaactcagagctaggcgaaggggaggacaaggtatgcataatttaaatgcattatccttatccacgaagtattttcttgctttctaattctctttttttttccaggcaaaagtgagagcacgcctgtctagaccacttcagaaagcaggtaaaggccgacaatctagtcgctcagaccagcggtctaggcatggggctggacggtctggaaggagttcatttgctcgtcttccacctcgtagccttgcttcctctcggagtgctagaggcgctggatctcgggccccatcttctagtgcaaagagagcttctggatcaagaggaagacgtcctcgcccacctctacctccgcctgcaagagctaggcccttgcctccacctgcaagagccaggcccatgccaccacctgcaagagccaggcccttgccaccacctgctaggtcatatgatagaagacctccaggtaccactggaattattacatgtttagttatcttttttagttgaatctcttttgtgttcatgtatctaatg

SEQ ID NO: 26180 - DNA, 3000 bp, Unknown; identical to SEQ ID NO: 11623
  misc_feature (1)..( 3000): 2750-1469P.txt file - cDNA_ID_2711238; gDNA_ID_2214506; Annot_ID_133761

SEQ ID NO: 26181 - DNA, 3003 bp, Unknown
  misc_feature (1)..( 3003): 2750-1469P.txt file - cDNA_ID_2711244; gDNA_ID_2214513; Annot_ID_133896
ccatggggtccgacccgatcttttgactcagttggagcaagaagccatcaacttctttgctttgcatcactctctcaaagacaaagcgggtccacctgacccgtttggttacggtactaaaaggattggacccaatggtgaccttggctggcttgagtacattctccttaatgctaatctttgccttgagtctcacaaaaccaccgccattttccggcacacccctgcaattttcaggtataacaaccatatcaacctaaaaactaaaacgtttctttcgtcttttacaagttcttttaaacaaaaacagagcaatgatcttgaccattctcttcaccttcttcatgataaatatactcgaaaactattgttttatacgtcaatcatttccggaaaaaaacccatgaaatcagagttgccatgtttaacggcgagaaacaggggttattctgttttattctccgatgaataaggcttaaatctatccaaattttttacaaagatttcttacttgaaaatttgtcctttaaccccaaaaaaaaaaaaaaaaaaacagagatcctctgttctgttctttaacatacatttttggattgcaacagagaggcagtggaagagtacattaaagagatgaagagaatgtcgagcaaatttctggaaatggtagaggaagagctaaagatagagccaaaggagaagctgagccgtttggtgaaagtgaaagaaagtgattcgtgcctgagaatgaaccattacccggagaaggaagagactccggtcaaggaagagattgggttcggtgagcacactgatccacagttgatatcactgctcagatcaaacgacacagagggtttgcaaatctgtgtcaaagatggaacatgggttgatgttacacctgatcactcctctttcttcgttcttgtcggagatactcttcaggtactctttctgttgctacttctttttattttaattatatatctatcactactaatttacattatgagtttattatattttgtgctatttgggtgatattttaaattttatagaaacttatatattcttagatttattgcagttttagactttatgtataggaactaatacaaaaggagtatttggtggcttttgaaaattaatgcaggtgatgacaaacggaagattcaagagtgtgaaacatagagtggtgacaaatacaaagaggtcaaggatatcgatgatctacttcgcaggtcctcctttgagcgagaagattgcaccattatcatgccttgtgccaaagcaagatgattgcctttataatgagtttacttggtctcaatacaagttatctgcttacaaaactaagcttggtgactataggcttggtctctttgagaaacgacctccattttctctatccaatgtttgagctattattattttttgcttcttgtaatcaggcccatataggacatcttttagggggggtttcaaaatatatgtttatgggtcgaatattaatttggaagccttcaaattctgttattaagccaagtccattaccgaggacgaacaagtcgtaatcaggaaactgagataagaagattggtaaaaatatctggatttttaagttgttgatttcagttttcacatccggaagagtaacagcaaaaaaagaagaagcaagtagcaagcacgtctaaagtgtgcccgggttctatggttatggcgtaactgaatcttatagctggtcgtattatttaaagcaagcatgtaatcgttgtgatttatgttaacgaaaattttgactgcttatgaatcttttttgttttgatttgtgtttaaatcacacttaactttatttttcacaaactagctagtagtagaatgaatatacctcgccttgttaagaaaaacaataaagcggcgatactagtaattttgtttttcggaaattcaatgtcacgtcagcaagagtgccatgatgttattgatttgtcaaaaatatttgtggaaaacaataaattgaataacctttaataaaaaaatatatatatatttgtgtggtaggctgtacagtaatgtagtgctatgaaaagaaaaaaacaattgtcggctaattgttgagttttattattgttggaaaaaagttgggttttaacatgtgacatcatgagatcacgaacacttttagtaattagtactttgaatttaaaaagaaatcagaaaacgttattcttaaaaaaaaaaaaaaacacggattatcgatgctttcccgtattcctaaaactaaaatatactaacccctatatctggtagaattgttgtttaacaaaactgcagcagaaaattagccttaaaaaatagtattataagaaagttaacctaacactccatcattttcttcaaacgctcgtccattctattatgggtattattttctcttttgcaattttttttttctaatattgaaatacctaatactattctttatccaaaaaaaaaaaactatattgattcttaatttcatagtacactgtcattttatacaatataaaaatatataaatgcccccatactattttgtagtattagttgagaaaataatatttactaaacttgtgattttttaaaaatgttattctcgtaggtaatataattttgtttgtttaactacatattatcatgtaaatttttttatataaaatatagaaaaattacaaaattaaatttaaaaaaaaacgagacatttttcatgtgaatccatacaaaaaacaagaatccatggatctgatttggaaatgtgtttcctagcaattagaaataataataataattacagatttgtttcttgattaacaaatagttgtccaactgtgtagcacgtgcctgttggttgatgtatgtaagcgagagagctgttgttgttcaactctcgccatccatcagacatctctctgcttctcttcttcttcttcttcttcagctttgagatctattctatcttcaaagatg

SEQ ID NO: 26182 - DNA, 3003 bp, Unknown
  misc_feature (1)..( 3003): 2750-1469P.txt file - cDNA_ID_2711248; gDNA_ID_2214513; Annot_ID_133895
aatggatactattaattttttttgttgtatttatacaaattaatatgttttgtattggtacaactaagtacaacccgcacaactaaggtctattcacttggctagttttcagaatattataaaatatgaaatttaaacaaaactaagaaaacttaaataatgcatacacaatggtaatgaaattacataattagtttttgacaaaaatcatattttctaaattaatgaaactcttatcacaaaatctaacattcatacactaacaaccttatactttcatggttactttgtatattttaacaaaacaaattaaaaaatttaaatacttgtaattagataaatataaatacaccgatacaaagtaatggtattttgataggggaataccatatgttccacccataaaaattagttttgagttgataacaactagatttattatattctcgatattgtacaactatgagcaaaaatgtgcaaccgagtacaactgtacaactatgggcaatatatttttcagatatttatagatattttttagatatttgtagatattttataataaaaattagctttatttttttgtgataaaaatatttagtttattttttgtcatcaaaatacttaattttatagttaaataaactattttttttcctttcaaacttttttttccttttcaaaacactgttgtttaataaaataaaatattaacattcataattttttgtgttttgttttggatcaaaatacgttaatgtgtagattcatatttattttggagtttttttttgacaaaaaatcttagattcatacataaacttagatacatagttgtacatgagcgtaccagttgtatctaaacgcttagatctattatcttaaaacaaaaagacagccgaacaattgtatctaaacccaaaaacccaacataattatatctaaaaatttagccacaattatacctaaaaccaaaaacacaacactatctaaagactcaaacaagaagccttcttcttctctttgtcattctccttctcaatttctttctccttcttcccttttcttctagtttttatcacaaactatctctaaggaacaaaattcaaattcattcgaatcccaattgtaatcctaaaaactaagtcataatggctattagaagatgcttttaagggacaatttcgattttaaatcgataattaattcaaatttgaattgtaatcataaaattccaaattataatcgaaattttatccaaaatccatcattttcaaacaaaatcaaagaaaaaaaagatcaaactatcaaatctaataaaaaataaaactctaattaaacacaacaccatcaatcatcatatatagaatagagatggatttttggattgatagaaacaaatgaaaaggtaaaaaagatagatctttggattgatagaaagaaagaaaaggtaaaaaggagacgaaaaattaaatatggaatagagagaagagagtaaagagaagaagaagaagaaacaaatcaaaaattttgtttttgttgaattgaaagaaaaataaattgaagatgaaaaaaatttgatctgagaaattagatttttttttttttgagaagaaaagatccaaaattgttatggatgtagatccaacatagaggttgggttgtaaataagtgaaaaactctagttttacttgtcttttactattattctgaattgaaataaataaataaacatatatttttttataaggaggctaacttgagaatgtttgaagctgagggggtggactagattaaaatccctaatctagcctaatgatttatgtttatgctttgaatggtgaccaactaaaaaaaagaaggaggaggtgtattcgtcttcatttctcaaaagttacacttaaaaaaaataacatttgctacttaatgatggatcccacagaattcatttccatcgttttggggattatagaacaaaagtattcctatcaaatatggggagaaacgataaagaacatacaattaacacattttaattaaataataaggatatggtttcaataatatttttcaagaaaactaaatgagtattatattgacaattaccttttggtaaataactgtaataagaaactaagaagaattatgtttgaaacaattttagattcaaataaatattataatattatttagattagtattgatgactagttaattttcttaaagatacacatgatatcaaattttcaaattttaattcagatataaatattgctattatgtatttaaattaaacttaatattgaaaagtgatgatctatataacttcattaaaataatttttaatatccaattagtatgatataattacttagatttttactccatttctctatattatatttcccctttccttaaatatttatttaattttttctcctctttttattgtttatgtagtggtgatcatcatctcttgaagttttagaatcattgatgcatcaccactcgaattcaaatccgcataagacaatattatcagattatgatatccaaattatttatgatttccaaataaaaacttaataatgtatggagtaacataaaataaaaaaaatgatagaatcataactaatcaaagaatatatttgttttccgcagcccctagatttgttaagtaaataaaaaggaaattagaaaatatatactaaactctgtttgtccaaaaaatagaaagcaaatatataatataccaaacaaataaaaagaaatcccattacatttccagtatataggcatttaccatatagaaaaaataattagaataaccaaaaacagaattaaaaaaaaatgtgataatatatcctcttccatacaatacaacacagaacaagcgactataaattagtgctaagaaaacacccttttcaccaaattcactctcttttcaacaatctttatttttcaaagttcttgtttaaaagaccaaaagagtagaccatg

SEQ ID NO: 26183 - DNA, 3003 bp, Unknown; identical to SEQ ID NO: 26182
  misc_feature (1)..( 3003): 2750-1469P.txt file - cDNA_ID_2711248; gDNA_ID_2214513; Annot_ID_184345

SEQ ID NO: 26184 - DNA, 3003 bp, Unknown
  misc_feature (1)..( 3003): 2750-1469P.txt file - cDNA_ID_2711267; gDNA_ID_2214513; Annot_ID_133881
gaggaaggatttgaaccagatgagaggacgttggtgagtatgttgggtgcttgctcacatttgggtgatttgagaactggtagattgctggaggagatggccatcaccaagaagatcgggttaagcacgtttctggggtctaagttgatcagtatgtatggaaaatgtggtgatttggattctgccagaagggttttcaatcaaatgattaagaaggatcgtgttgcttggactgctatgatcactgtgtaagtcattgttcgacactgtattcagataaaagtatgattcttaaacccgttaatgaagctaaatttggactgttttggttgttctttatcagatactcacaaaatgggaagtcaagtgaggcttttaaactgttttttgagatggaaaaaaccggagtttcaccagacgcgggcacattgtctacagttctgtctgcttgtggttcagttggagctcttgaattaggcaaacaaattgagacccatgcatcagaactttccttgcaacataatatctatgtggccacaggactagtcgacatgtatggaaagtgcggacgggtagaggaagctctgagagtatttgaagctatgccagtgaaaaacgaagccacttggaacgctatgataaccgcttatgcgcatcaaggacacgctaaagaagctcttttgctgtttgatcgaatgtcagttcctccaagtgatataacattcataggagtgctctctgcttgtgtgcacgcgggtttggtccatcagggctgtcgatatttccatgagatgagttctatgttcgggttggtcccaaaaatcgagcattacacaaacataatcgatctcctgtctcgtgcggggatgttagacgaggcttgggagttcatggagaggtttcctgggaagcctgatgagatcatgttagcagcgatccttggagcatgtcataagagaaaagatgttgcgatcagagagaaggcgatgaggatgttgatggagatgaaagaggcgaagaacgcaggaaactatgtaatctcttctaatgttttagctgatatgaagatgtgggatgagtctgcgaagatgagggcgttgatgagagacagaggcgtcgttaagacaccaggatgcagctggattgagatcgagggtgagctaatggaatttcttgccggaagcgattatttacagtgtggcagggaagattccggttcgttatttgatttgttggtggaggagatgaagagggaaaggtatgaatttggttacattcacctgtgactttctcggagagtgcaagtctagtaaaatttgttgtaaaataaatttgaagttttattttgaatgtatatgaaacttaacactaacaattaaaattactttgaatctataatagttacgtctctctctagttattatttaatcattcagtaatcaatttttttctgttggtattgtaatcaccgattcttaaaattagtagagaaaggcaaaaaaaccgaacggaccagaaaagagaacattcgccaaaccaaccaacaaccgtttgggtgagcttgacgagaacgacgtcgcacccgccattttctccatccttgaagcaacaccttcttcacttcagatctcttcttcttcttcttcttcttcttcttcttcttctttgctcgcaccttccgtgctattgtatttctagggtttcggatcctgtgccttaccttagatccgacggtggagtagaaatcactctccctgtctcttcccttcttttttgtttccagtttttgattgaagatcccttcgtggatccactataatggcggattctcagccaatcacgcctggtcaggtacggtatctcctaactttgtttttttttgaagcttcagcgtcttcttaaatttcatttttttgctacggtttcaaggatttgaaatgaatagtttctgttgaacgagatttctactataatcgataggttgtggagtaattgaatttacaatttggattagtttactagagggatcaaattttgctagtgtcttcaaatgtagtagctttcaactttgaattttgaaaatgtttctcaccagagatttggtttggatgacctttcatatttctttaatgcaggtttcgtttctactcggagtcattcctgtcttcatagcatggatttactcagagtttctagagtataagaggtcttcattgcactctaaagtgtatgtatcaggactctaatttaaatggctctcttgttatatgtatctaacctcttagtaacctatacttcttacttgcagtcattcagataataatttggttgaacttggtgaggtaaaaaacaaggaagatgaaggagtagttttacttgaaggaggtcttccaagatcagtctctacaaagttttataactcacctatcaaaacaaacttgattaggtagttttactgatttcttcctttgtgtttttttgtttcttagagtggagtgttctttcaacaaacataaaccatttacgtttgtctacttgtagatttctgacgctggaagactctttcttgattgaaaatcgagcaaccttgagagcgatgtaagttccttaattttatcagaatggattcatactgttcttcattccctctcatgaccgtattacttcctttcagggctgagtttggggctattcttttttacttttatattagtgatcgaacaagcttgcttggagagtctaaaaaggtgcctcctttaaatctatgtgatggattcttttctcagtttcaactggtcatcaaaattctaaaaccatttatgtgttatatatagtgttatagcacagatgtcgttaatagtttagagatagaaatctaacatctgagtctaaaaatggttctgcaatttgtgacacttttttcgtatactttccattttgcagaattacaacagagatcttttcctctttctctactgtcttctcatcatagtttcagccatg

SEQ ID NO: 26185 - DNA, 3003 bp, Unknown
  misc_feature (1)..( 3003): 2750-1469P.txt file - cDNA_ID_2711279; gDNA_ID_2214514; Annot_ID_133921
actgataaagaagtcaacttaatcatccaaccaaggccagccaagtcggtatcgctaccactacttttcattatttctatatactataaaaaaaaattaatctggtggcgtcacgattaattgcaacatttttgtttgacttttacattttcgattaatctggtggcgtcacgattaaggattggccccattagctaggtggatactaattgcttagttcattcgaagtctaccattttccagtttcctttatatatgttattgaactaattaaatttaattaaatattcgagcttatgaatgaaattcttatgagaaacgatttttttttaaactagagattagaaacgttttggaaacgtatacaaatatatatatatatatatataacattaacataaaattagattgaagaaaaaatggtttaaaccatacaaatctaaactatcaatattaaataagttaactaaaactctaaagataaagattaaaaggtttaagttcaaatatttaatttagaccaacatttttattcttattttcattactttcatcaaagataatttaaatctctcttcaaatctggtttatcaaaagaaatatcttaaaactgagagtcttccaaaattagttatatgtattaataattttaagatttctattttttttgtttttgtaatccgaaaattaattagggctcaaacgagccaaacctgagaaatgttgtttacaaatttaatataaagcggttgggtacgaactcatatttccagttttagttattaaattttttaagtcaataaaaaatatttgtcgtatgtctattttagaaatataagtttctattttggaaacttgagtttctatcgtgtttccaaaaataaatttttaaaaaatatgttttcgtgacgattttcgtatttccgaaaagtttctgtttccgaaatgtttcgaaatataaaacagatctaagagcgaattttcatgcaacctagatatacactgcccttttaatttgctaagttgtaaatttcctcaaccgatatatggaacaaaattaaaattagatttctgttattttaggtataatctccgggtatacgtgatgagttagtacttttacgcagtagtgatatacaacaaagatctctgataccgaacgtgaaaagtaaaagtccttttacatcatcgttttatatcttgaattaatataacacacaatgactattttttttttagaaacacaaaaagactgttgagaaaattaaataactaaagtctatcaaccatcttagctgtacttaatcgtatatatgaaagttggccaactctcttcatatggatgacacatcatcacacaagaaaatgacatgtgtcctttaacattaattaaattaaaaatcagcaaaattaattgagagaaaatcaaaagtttcatattctgttaaatcgtccattaattcatttctttaactattttttcaaaataaaaataaaattataaaattatttatttaaataaatcaattactacttttattttacttttattatttctatttttttttaaattaatggtcaatggtcatcactctataatgactaaatagttatttgtgttgtagtttagttgtttgctaccttatattagtttagttattttaccttgatttttttatttttacgttatggttcatatcttatcatatgaaattctgtcttttcatttttgtatctttaggtaagttcgtaacattgacattcaacattttcaagtaatagacttttgagacttttggtaagtttataaattcaccttagttgtatatcaggctactatagttaattaattatgtaccacattaagatgattagtttgtttccgtctttattgtacattgtgatttgtgaagatagcatttaatcatttagttagctagctaacccataagttatttatttgccactgaagctatatgccccaattaacaatcacgattagatcatttcataaaattattacagaacatgaattatatataatgtcctatgacacatattttatttattaaagaacttaatcatctatgtgtaacactacctttcattgtttcaagtaaaacttttggtgtatattttcgtttttctttggcaatgttaattgaaacatttgcgattaatcgggtggcgtcacgaaatccgattgtgaaccgggtaatagccggataagacgttaatttggtgacgctatcacacgtaaaaagccaacaaacagtcgaattttaaccggtccaactagttctacttgattagatcatttgaagtccaccttttgcaagattttcttcgtgtaatttacttatctttaaatcgaacatatatatatatatatatatattatatatttttgagtactaatatattgcctttataatttgataaatatacttgtatgtaattaaatcttcctcctcactatataaattcatgacttttaaaactgtttctgtttatatatatatatatactaggatttaacccgtggtataccacgggacaaatattttatttatatataataatattaaattttacggttttaaatttagtattaaaattatataattttatattaatattgtaaataaaaaaattggtgatgataaaataataaataaggatttaactcgtgttatatcaatcaaatccgtcccgctatacaactcgtctcatgatagttttaatatttttttataaggataaatattaataaattgtaggtatgtaacctagctgtaggtatgtaaagagttagtttaatgaatttgtacgttaagattagactatttattaaagaaatttaaaaacacaaattgcaaagaaagctggaaaaattaaaacgtcatctctgtgaacgtgtatatatcggaaagaaggagaagaccagtatcaatcctaaaccaaccaaaaaaaaacaccaaaatctccgattgagcagtcatg

SEQ ID NO: 26186 - DNA, 3000 bp, Unknown; identical to SEQ ID NO: 11794
  misc_feature (1)..( 3000): 2750-1469P.txt file - cDNA_ID_2711293; gDNA_ID_2214517; Annot_ID_133971

SEQ ID NO: 26187 - DNA, 3003 bp, Unknown
  misc_feature (1)..( 3003): 2750-1469P.txt file - cDNA_ID_2711297; gDNA_ID_2214517; Annot_ID_133968
tatgtttctatataacatttagtaatcaaaaatgattagtttatcaaaaatctgtgtaagaaactgatcaatatgcttgatttaatttttgtacattttgctatatacgactaattaaggttagagaaaatcctttatgctcgaaaggacgaccacgcttgaaaactgcgtatgagctcttaaggatcagcaacgacttggagaagagacttcaagaggtaaattataagtgattacatatatatatatatatccaagatttccataaatgcatatgatattcagattggactcaaatagtggtaattaagattctaacgttagattttttttgtctctgtaaaatataaatcatccgatcgagaactaatgcacataatgatgataataggtttcattgccgtttttggtattacacggagatgatgataaagtaacagataaagcagtgagccaagaactgtacaaggttgcgttgagcgctgacaagaccttaaagttgtaccctgggatgtggcacggtttgctcaccggcgagacaccagagaacatcgaaattgtctttgccgacgtcatcagttggttggaaaaaagaagtgattatggaaatgataggtttgagtcagagcttaaacagcgtaatgatcgtttaaatttcaagaaatagtcgtttgacttattttttacacataaaagtgttttaatgaaattctggtgttttgcattttgatgtttaacgttgctattgtgaattgtactatatattttaagaaaacttatactatagtccaataatatttcctaaatagtccaacaaaataaagaaaaagttttcatcatctagtatgattttaaaatgagatttgatataacatagccaataagactccagaggaaactctctgattcggcttggtttggctaatgtttttagacgcaacgatttacttagatctagaaccatcagattaacaacataaaacaactttaagctttcgagaaacggaaaaccacaaagattcttagcaaagaattcatcaatgtaaagaacattgtctaaaatattttggtatagaggtgaaaactcataatcttgggaagcttgtatcgagctagggttttgtttatcgtatcagccttcagtcccctatacaaagttcctggtccatcaaagtatatgtaaggtgtgtcagaccatacatgcctccatcgtgtggacaagactgaagttctgatagctaaattggtcggaagagaggagaggatttgttggaggatcacatcaggaagcgagctgattgagtctatattttcacttgcatctcttgctagtttgacatctctgtagtgatgatgagcgtagcagtcaccggcggtggcaccgtctccgtttccgccgtcgtctgcctctgccattacgttatcaaccaccgattgtaaacctagatatttgtttgcaatgacatagctttttgagtttttgggtttatcacaaagcccagctatatatatccaaaatattttaaaaagcccattactaaacacgcacaacttttttcttgtccggaactcaaaatatgtatgtacttaacaacttaatctgtgaaaaaaaaaaaaaaaaaatgtactaccaacttagtcatgttgatgtgatcatcttcttcttggattgatattactagttgcagaaagtgacaatttgatctattagaaaataattgcttatactacacatttgttttctttcgtaacagattggtgggatctttaagaatgtatcgtcatgattctgattttatagaagaacaactttatttaagatgtgcttacatattctgcgaaaaaaccggcatgttgaatggttttagtctctctgaaccgacaacaagttttgtaatttttaattttatcttacagtcgtcacttgaatcttgatcgccaatttttacatacttgagaagaaaaatatttaaaaagccaaccgatttattcgtcaaagcctcaaaggctacagatttttttagccaacgagcaaatgatatgcacacgcggatatgggggatccaaaaattaaaatatttgttggtgtaactttgaagcattgacttaaaaaatagtggttttatcatatgaaattaaacacttaaaaatttttgtggaagttgatacgggatcacaattttacaaaaacaaatagttagtcaacggagtataacttagttttacgtctaatattgttagagttgacattttataacatgttaagtagtagaaattgtagatttgactttctagattcttcatttgatggttcttatgatcgttcgtttataaatttgtactacagaaacgattaatctaacattattttacgatgaagaactaaaatttgaacatatagtgtcactaggaaaaaagattgattttcaccttaacatctccaaacgtagtaagtagatgtgagtttgatttgctaaatcctaaatgaaaaaaaactaacaaaacacagtcaaacgtgaaagaatttttgagggggtgtttctgataaatttacgacttaaggtactagtttaatgttattttgaaagtttagggggtggttttgaaacgtcgccaaacttgaattgccacttgtcagggaatattttatcattttaaaaagaagtaacaaaaaaaacgtgttgccgtgtagaggggtgcgaggagaatctgttaaatcgtcgctatcaaacaagaaacggtgtcgcattatcgtatagtcctcttcctcaaaatcctacccaatataaacagagccgtacaacaaaaaactcgatatcttatcaaaaactcgctctccatccaacaaaacccgaagaaagagagattcagactcaaatctctcagtaggaatggttagttacgttaagatcaaatactctctggtttatatctctgtcagaccatatctgaaaatgttttaaatttgttcttcttatgtaacgaattggggtatttggtatg

SEQ ID NO: 26188 - DNA, 3003 bp, Unknown
  misc_feature (1)..( 3003): 2750-1469P.txt file - cDNA_ID_2711312; gDNA_ID_2214519; Annot_ID_134020
attccgattctctctgtgactcacatcgacatcgtactggtttgttgattttgattggtaatcggaagtaaattacgacgttgaagctccctcagtctaaaggattcggaggttgacgctgaactaaataatgggagaagagctgcaatatcagcagaatggttcatctgtgacatctaattatggttatggaagttcgcttgcttacgatcaatctcaagacattgaatctgccgcaaacactgctcttctccgagaacaagtacacttttttttgtcttcttcttcttcaatataagcttctaaattccattcccggactttgccaatggttaccatgttgatttggttttgtgtgttttcaggaaatagaaacgcagaagattatacaaggtcaaaggttctgtctttctcttggtttgttctttatatccatctgttatatatgcttaatgcttgtattgatcatcttgctgtttctcattcttgggcaatgagaaatttcgtgtgtttaggtgctttgtctaacaatttgtgtttaattggaaacgttctcctattttcagagaagctgggacttcagtagccggagactctaagcataacactgatattcttcgagatcgtgctgaccccaatgctctaaaggttctgattcactattttttttgtttatcatcaagcggctattggcttaataagtcctataatcacatgaagttttgatacatattatctttatgcaggaacatttgctaaagttcactgcaaatcatagagcagaagcagcggcaaagcgtggtgggagtgtgagtacatgcggagaaggttagtcataatagcttacgagctcagtcatttaggaaaattcaggaaactgatccaattatcgactttattccgttctaggtaatgtggatgttggaaacggttatggtataccgggtggagttgcatacgcgggtcactccgagctcagtgggaagcctgaacctaccaatgcttcaaacaatttgcctgaatatctcaaacaaaaattaaaggccaggggaattctcagagatggtgcaggggctgttacatccaacccagaagatgtaattattcatccctcagactgtaatccagggtgacatatgtctgcaatgacttgtccatatttcagcccctttgtttcagtttatcttattaatatttgttaaccttttgacgtttttgtttgcttgtgtttcttctcttttccagacatcagcggttagttggaatagacaggcaactttaccttttcaggctaatgcaagcaccttaccattaggatgggtatgaatgagatacacttaaaagtcttttcttcttcatttttgtctttgctttactatctggtgcagcaatattttctgctgtgaaagtgcggtaatcgtttgagattctccaaatgcatgtgataatgtggtcatacacaaatagtctttagatctcaatccttaaggatgaccacttatggttctgatgatgtgtttatagttgttataccacttaaatttgttctgtttcattcaggtagatgcaaaagatcctgccagtggtgctacctattactataaccagcacactggaacatgccagtgggaaaggcctgttgagctttcttatgccacttcaagtgcaccacctgtactttctaaagaagagtggattgaaacatttgatgaagcatctggtatgattttcacacatttagtcatcataatgactagctcgttgctacaatattcatatcaaagattataaaagtatgatatctttctccttttcttattgtggtattatgctgttagcaaaatgaatttaatagcttatgatctttttcatcttggaaagaaacttacatcatcacatgttagaaataagaatgaggaaatccttgtgttttctgctggaagtttttgcctcttattgaccagcttcttctgatttctgttgtactgtacacgcaatgcttgcttaatctttggatctgttggttgcatctttgaactctgaaccttttgattcctatgcacaggccataagtatttctacaatacaaggacacatgtgtctcagtgggaacctccagcttctttacagaagcccgctgccacaaactctaacaacgctgttacccaaagtacggctaatgggaagggggagcatcctccatctcagctgccaagatgcagcggatgtgggggctggggagtgggccttgtccagagatggggttattgtgttcattgtaccaggtaggaacccttccatttcttgttatgctttttgagttagattgctgcatagagactgcttcggttgaagactgttaataatgtatatacctctagtcctctaccatgactccctttttattactggctcagatttgtgttataggaagcatttattagtgtgcatcaagaccttaaatacactttgtttacttgcatattttgaggcttaagcccctctgcctttggttaacgggactcatattatatgggattcagggttttcaatctcccagaaaagcaattcttgccagcacatttaaaccatttcacaaatgcaggcgattctggccaaaaggatccgaatcagaggtacgcatctctcaaaatcttagatttagaaaaaatattcttctatgcccgtcatctttctaaaatacatagtgttccataagagagctattggtggactctggtcatcttcttaacatctgttaccagatatttagacaacccatttggatacaaatgttgcccctcttttcggagggacataatttctgttaaaaagcattccatttatcagcagtaaaatgaagatggaacacattacatgtagtagtgaaccaggaggttcccattgactatgtttacattgtacttactcttgtggtatattctttacacatgatggaaaaatgaaaatggttgaaacaggtccagttcaaaacctcccatg

SEQ ID NO: 26189 - DNA, 3003 bp, Unknown
  misc_feature (1)..( 3003): 2750-1469P.txt file - cDNA_ID_2711317; gDNA_ID_2214520; Annot_ID_134042
atataattatttttcaaacgacaaccgaaaacaagagaattttttcaaactgaaccaaacccgaatggaactacaaatggtttttttttttttttggatatagtttctgtaaaaacataaaacctaatggatcataccgaaaccaaaattgtaatctgaggttttatacaacttgtctgatttatggtgaacagtggtgatcacgacatcgcggtcccttttcttgcaactcaagcctggataagatctctcaattactcccccattcataactggaggccatggatgataaacaatcaaatcgctgggtaatatatatctatttttcctgttttatatatgtctctcttgtttattcatatttgtagtcatatcacaaacttatgaactcacgtaaaaatcattttttttttacagatacacgagagcttattccaataagatgacatttgctactatcaaagcaagtgttattatttcagtttaaacatttttttgtgtcactacattacaatgaaagtgtgtttattaatttttttttttttactgtttggattatagggaggtggacacacggcagagtatagaccaaacgagacctttatcatgttccaaaggtggatcagtggccaacccctgtaacaaaaggcttatgaccttcacctataattatctaccaactaatatccacgttaagcgcagttgtttgtgttgaaatgtttttgttgtttgctttgttgcattcttttgtgctttatgttacaattttatgtgttttatgtactacagttcattattgtgcgttgtgcaattccttttacatttaactagggactaacccgggctagccccggtatatttcctaactatacgtgcaagaaaatgatgttctatttaacatttcagtttaacttatatggtacaagtaattgtttaattttatctatccaaatatttttcattgtaaatttttttttcaatacatctttttaattattaatgtgtatagtattttctcaattatacttctctcgtaatttgttttacgatgttaattgaacatcgttctataataacgaatttgccacactttttttggtattgacaaaatttcctcaaatagcttggtattgacatttgccccacatcttttataatttacgaatatgccccacgtcttttcatattaacgattttgctacatatctgttggtcttaacgattttgccccacatttattggtattaatgaatttccctcacagcttttggtatttgcaaatttgttcccatcttttcgtatttgcaaatatgtcccacacttttcgaatttacaaagttacccaacatctgctggtattttgcaaatgctttcgtcatttccagttatcgaattaggctattgatgttgattcattctatctgaaattgagtttaaaatattcttctttttcacctaaattaaaaaaaaaaaaaaaaaaaaacttatagcaggttgaacctagagatttgatgttatgaaaccaccaattcttaaattaaatatagagatctttttccatagttgaacttgccctaccaaaaaagaggaagaagattttgaattgtttatcctttatagaatcaatgtttgaactcgaaaaaattgaatgatatgtcaagttcttgtctgacattaactacaacactctcattgtgttgactaaagcttgaagatagcttgagtaacaagctaaaggatttgtatttaggaagtttgcctaaatgcttttatgtgtattttcctaataggtttaggaagttttcttgttattctcttatataaggagataccaatgtgtggtataacttatgagtttgagaaagagagattgagaactttagggggtgttatgggtttattgatttgtaaggaattggaaatccaaacaaaaatcatttgttattcaatgattgattttaaaattcgaattaaaatcatgtgttattgattcgatgatttataaatactagttaaaatcctttgttattcgtttagtcatttgtttttggatttgagaatacaaattatgttttaaatagaattaaatggatttgaaagagaaaaatagaaggattcaaatccatgggtaaacacatgttatttcaaaatccatatatcttgatttcataattaatagagattatcaaattctatatagatttacaaatcaataaaccaataacacccttagttttcagttattttttaaagctagtaataaagagagttattctttgttaatcttgtgttcttaatcttagcttagtcaatacattgcacctccattgttaatggtcttaagaaataatgaagccactttatttaactaaattaaaatgaccagttatataactgattgtttcgttaatttaatttcgacgcaaattcagatgcatttttttatggagtagatgaatttcaaagatttattatgggagcaaaaatctaggtttaaagtggaagtatataaaccactttgaacgttttaatcatattttccttttttacaacctcaacaaatcgtcttgtcaaaagaatgcagaataaattagttttttttttttttgtttgggcagcggaaaactttggaccgaatgagggttaacaacaaaagaaaaacgagagcgttagcttgtccatgattgatcaatggtgttggtgattcgctctaattttagccacaaaagcaatgtccctacattactaaatttgtggcaagtgtaatgatagatatatcatataaaattataaaccaatgtaaaaacaaacgattaaatacttgatgtgatggttgctgcaccaaccacgtgactccccgaaatggttgttccacacaagcaaatttgaagagagcctactcaacgttaagcgacttgtaaaaataacaaaagggcagtctaactttccttttctaatgattataaatatcctttttccgtaaaaagaaattaaaagaaaatg

SEQ ID NO: 26190 - DNA, 3000 bp, Unknown; identical to SEQ ID NO: 11910
  misc_feature (1)..( 3000): 2750-1469P.txt file - cDNA_ID_2711325; gDNA_ID_2214521; Annot_ID_134077

SEQ ID NO: 26191 - DNA, 3003 bp, Unknown
  misc_feature (1)..( 3003): 2750-1469P.txt file - cDNA_ID_2711331; gDNA_ID_2214521; Annot_ID_134061
cttaaacgtagtttccgccaaacctttactgttgtgtctattcaagaaagaaggatcatcaacgatatcgtttcgaaaagacccagtgagtgtctcagaatcaatagtgcttgaatcaatggtgaacctctccgagttagacggagtaatatcaggagactcaaagatgcttggcctaacgtagcaaaaggaatggcctaaaccttcatctaaaggttccagaaactccaaatcaacaccgtttttgtcattagacggcacgaaacaaccaacaacacgggaagtcccgtttcccatcactcaggcaatactacaaacaccttggaggcacaatctcatcataaacctctaaagagtttccgcaatttccagcaccacaacacttaacaagaggcgaaattcttataaagcctacaaagattcgacgcgttatgcagaatccaagcatcatctgaagctcaatctctgaacattaaaacgcaaacaagcacctgatagtatcaaattcggatttttttaaaaatcagctgaatgcccacaaaagctttggattctgaggtcttgaaatggaaacagaaacagtgatctgacctgttgaagaaggagatggatcatcaagcagaaactggaaacagatctaaaggagcggcaaagagaagacagtgttgtattgaacacatcggaagcaaaatagagacagtaaacaaggggaaaaaacacccctttagatttcttctatgggaatctgacaaaaagtacccatttttaaaaactaattatacaaaaacaaaaaaaaacaattatacccattttttaaaaaagaaaaaaaaaaaggaagaagacccagattgagattgaaccatgcagagacgaccagctgttaaagatccaagcttttcaggggaaaaaaaagaagctaaaacccagaaacccctctttcagatatgttacggagaaaccaagattcaaaatcgaaaattagtagagtcacaatccaaatagagctgaagaagaggggaaaaagaagaagcttgaagctgctgcaacaggtttgattttgatttaagcaggtcaagaattatgtatgatttcacctttttcttttaatttccttaagctcataggtgagagtgagcagagaagaaaagagttgtctcgggcttttcaaatggtttcggagggtaatcaaaaaaaaaaaaaaaaaaacagagtaaaaagtctaaaaactgcgttgaaaaatgtaaaagcgaaagatcgtctttttagagtttttatttttattttcctcttacatctgatttattggatattttttacaagaattgatacattaaaagtacttttttttttacgtacattcttagagagtaaatacataaccgatcattaaaaagaagagatgaagaagtgaatttccacaatgttttaaaccttcagaatttatattaatggggtttgcaaatgattggaggtatacaattacaggtgattcacgtcattattgttctcatcgatggaccctttgcatggtttcaattttttctatgcgggtcccgttttttattcacacccattttatcaatgttttttttttgttatggtcttcaattttttatatttggttgcattgaatcttgctcctcataatcggaagatttgaccagtgttaatgatattatatagtttgaacgttaaagtatgttaacatgttagtcttcttttttaatgttatcatattctgtttaccaagtaggtttattttaaatctcaatgctctatatactatcttattaaacgaggtaaacttaacatttttcatgtctagtaataccgtaagattctttctatgtaacgaatgagatttatatatatatatatatatatataaggaaatttgtaatgatgcctaacatgcaaaagaggccaactccacgagcacatagagagagtcacgctttaaaccaaacaaaacaaatttgttgacttaaaccaaatccactctctcattttttttgcctttgagtttctgactactgacaaactctttcaacgccctagaaaattatgcttttggtttcacattgtttgttttttgttgtattcttttatttattagtaattgcgtccacagatccaaaaccaaagccattatcatcaattcatccactaacttaactatttatattatactatattttatttcaaaaccccagaataaaacaaaagttgtatattggagtgggcaggcacctccacaaaaatgaaaacttcccgttaaaattcaccgttctgttttacggtttttatttatttacatgacttagtatcatagattcatttagtagtaatataagactgcgtaagagtgtctgcagaattttcacaatcagtttcaatgtttcatccaaaattgtatcatacagttggatcatacggtccttgaaagagctaatagtgaggtgggcttgtgatgattaaataggcccagtgattataaaaggcctcgttacagaccattactaacacgtgtgatgcgcggatgcggcataagatactgttaaacagagccgatgccgacaaaaatgaaataaactatttaagctttttaattaatgatttaattaattggttttggcagtaattgaggaggaacattcaaaagacagacactttttgtcatgttaataacagtaaaaatcctctaataattatgtctcaaataagataaattaaaattgcaagaaaattagtactgtatcttgtatttttagaaccatattaatttcaagaaaatcaattaattattcaaagatttggttcgtgacgtaaatcaatttattaccataatgatgaaagcgtgaaagaatttaaccagaaaaagccataaagacttctctcgctatcaatcacacacatgcaacagtacaagatttgtcagagtccacagaaatcgatcttttcgagtcaagattttcagctctgttcaggactccggcggagatg

SEQ ID NO: 26192 - DNA, 3003 bp, Unknown; identical to SEQ ID NO: 26191
  misc_feature (1)..( 3003): 2750-1469P.txt file - cDNA_ID_2711331; gDNA_ID_2214521; Annot_ID_184612

SEQ ID NO: 26193 - DNA, 690 bp, Unknown; identical to SEQ ID NO: 11872
  misc_feature (1)..( 690): 2750-1469P.txt file - cDNA_ID_2711335; gDNA_ID_2214521; Annot_ID_134053

SEQ ID NO: 26194 - DNA, 690 bp, Unknown; identical to SEQ ID NO: 11872
  misc_feature (1)..( 690): 2750-1469P.txt file - cDNA_ID_2711335; gDNA_ID_2214521; Annot_ID_184601

SEQ ID NO: 26195 - DNA, 3003 bp, Unknown
  misc_feature (1)..( 3003): 2750-1469P.txt file - cDNA_ID_2711345; gDNA_ID_2214523; Annot_ID_134120
ttgtgaatgaaaactagtatgtaatctagtaacatttgctctttcagatttttaattatcaacggagtatgtgataagttcgaatcttctacacaattaaaaatatgataacttcgttaaatagtttaagaaagctaagatgaattaacttatgggaagttggaaacaacactttttgtgtgttttactgggaaaggaatctaaacgtctgcgggtacagacacatcagggcattgctttcggcccacgcgtactattttctatatatatggtgctgtgttttaacgttagcggccggtagcagagtacaaaataaattcattttattaaacatagaaacaaaaaaaataattagtagttctaacttttagtaatatttgaaaaaggtgctttttagttattttcaactcattttgataattagattttcgttctttttaattatagaggttcaattatgaaattttacaatgtttaagactttacaatgtttaaattttagtactttttatacgaaatagtattttgagatcaaactacaagataacaccacaattattttgcaaaaccaagtgcttaagacagtttaataaagacaaaaataattagtaattaagaacacctaatgatgaaagaaccatgaaagattgattcaccataaacacaaaaattcatctaaacaaggttaacaattgtctccttatagcgcttagatttcacaatttatgatgattgatgactcaattactaaaatttctattttgttttcctaagcttatttttcaaccgatatataaggaagaaaaaaacacttgaaactacagacgctaataagtactaaagtgaatgacatctcttttatttgtttctcctttttttcgttgattaacaagaaatcaacaaaataatctttggctcggcatttagacttttaggatctgaaaaatgaaaattggcggagtctacgcaggccctacttttcagatctatcttgaaatgcgaatattatatactctggaagatttaaattatctggtggagtaatcatttcagtgagaaatagtaataaattaatactactatagtacattagtagtactatacctgaatatgcattggaatttgtggtagaagactagaagtagtaagcttcttttgtttttaatcaaacaggtagtaagcctcataaattatgtgataaaaactgataagaattttcttttgcaccaaaaaataaaattaaaaaaatgagaaaaaaaaaactgataagggttccgattttgggaatagcaatagatgagagctaaactgaaattgttataggagtttagatattgtttagttatacttatatttgtatgtcgataaaatataaactgtgaagtcatggtgttgtgctggctacggaacaaaccacgtaaacgggtttatcctgattattcgttgcttacagttttggtttaattcaacacgtacgcaaataccacatgcaaatctaattaagtaacacaaaaatctggatttagtttggcaagtaaatggccttcgccaatggataatgttttccttaagattcttaaaccttgtctttttaacttttaagcaacgtatgcttggataatatccaataggcatctcttgcaaatatgataattaagaactcgtacaatttatatcgattgtcttctaatgtacgtaatttcattagtttactccttgtttatattcgtgtttatgagtttgagtttatattttagtacattaccgtaaacaatcctttatacgtgatatactgtttttgtttgttaacagggaaatatataccattttcgaactaccctacatatatatggtagcctaatgatatcgtcgattgtataactatgtttggataactaacaaaatgcttaatccaatattataattttatagtcattttgagaagatttgttctaagacaaaatatatatagataagaaacataattgcatttaattttaatagaaattgaatgtaatttttttgaaattaaaagttagagaggtattcaccatttcacctagtgatttgaaatttagcaacaaaaaggaataaatcttatgttattcaccattttacctagtgatttgaaatgctactttaaaattcactgctattggaaactttttaaatattggatttttagtgacatcaagggtttatagaggattttttagttaaaaatacaaaatctaaatctcctagtttcaactttttaagtgaaatttgaggagattttacaacaaatcataataacttcccaaaattcacctaaaatcatctaaaacttaaaatcatttaataggattgaataaggttcattttactacttggcagttggcacataatataaaaagatggttagttaagttattgtcttaagttatatgattgtgcattgctgttgaaagatttgctgatctacgttgttgtcatcgattcgtcaagattatacgaaccagctacatcctacatgtctggtttttataatcacattgaataaaatgaataaatatattttattgaaaacgtcacgtttaaattcatatacatttgattgattatataatgtagtccaattaattaatctctcctctatacagctgtttctatagattattaattaatggacttcctcgtttcacatggtagacatttcagatttagctttgtgtttacccagatctggattcaggtatctcggtttaggaattgtaaagtttcgtgtagttttatggggttgtgttatcggttaaatttggtttagtctagttggaactcggtttgcttgtcccgtttgttttaattatccggttatatttggtctaacgaggccaattaatgcccacgattatacaaacttttcaatttaaagttgacttttactttcattttaagacaatggatactcattttgatcgatgtagatagacatagagaacaagagaaaaagagagaaagatg

SEQ ID NO: 26196 - DNA, 3000 bp, Unknown; identical to SEQ ID NO: 11940
  misc_feature (1)..( 3000): 2750-1469P.txt file - cDNA_ID_2711353; gDNA_ID_2214523; Annot_ID_134115

SEQ ID NO: 26197 - DNA, 3000 bp, Unknown; identical to SEQ ID NO: 11940
  misc_feature (1)..( 3000): 2750-1469P.txt file - cDNA_ID_2711353; gDNA_ID_2214523; Annot_ID_184682

SEQ ID NO: 26198 - DNA, 3000 bp, Unknown; identical to SEQ ID NO: 11968
  misc_feature (1)..( 3000): 2750-1469P.txt file - cDNA_ID_2711378; gDNA_ID_2214525; Annot_ID_134140

SEQ ID NO: 26199 - DNA, 3000 bp, Unknown; identical to SEQ ID NO: 11968
  misc_feature (1)..( 3000): 2750-1469P.txt file - cDNA_ID_2711378; gDNA_ID_2214525; Annot_ID_184723

SEQ ID NO: 26200 - DNA, 3003 bp, Unknown
  misc_feature (1)..( 3003): 2750-1469P.txt file - cDNA_ID_2711382; gDNA_ID_2214526; Annot_ID_134162
atgtccgttgactttgtttcttccatgattaaaatttaagaagtaaggaagagaaacaaatttgaaccattgattttgttactcttaactaaataatcatttattcaataactaaaggtcggttggtcttcaggtacgaacgttcttctatactaacttgtaaattgtaaacgtaacagattgtgcagtagagattgcggttacaaatgtttgacaacgatcacaaaaattgtttaacaccgcgtattcttccgccaacgtttgcggcagcgggtggttaaaaattacactatttttaagttttaaattcaaataaatttaataacttttttgactcttggagtcatgctctgaacacaaatgattcattttccggagaacataagtgcattgtatccgtctaatcgtcccaacatacttcactataaatgtaatttaatactaacaattaaattgaagtgttgttcgtcgcatgcatgtatgtacgtacaataattatatagtttcattatcatagaactgtcggggaaattgtgaatcatcaccagccgccacatgaacttatttgccgttgttctggtttaaggctggtaagatttattcggcggctgtaggcctgtagcccttgaaatatggtagacaagatcgtccatataattaagattttgtttttcacttctaaattaattaatgggtgacttgggcgattttgtattgttgtttagtggctagaaagaaaacttttaacgataaatttacttatgcaaaaattatattagtttagtttagcaactttatatgtacttaattagtaaaataatacatttaaatgtaaactatttgtacatattaatgttgtccaaacaatatgcactttttgaatttttttactgtattctccacctagtttttctaattcatccaagcattttgatgaatttgcatgtctccatagatgaattagtatctactatctctaaaaactcaatctccaccgaagatattgcttaaccaatgtgctcctagaccaaatccaaaaccttagccgcttcatacttaacatccacttttgtagcatcctcaaactgttttacaaccttttcaaccgggacacaatcgccttgtcttagtagtgaagcgtaggttaatcatggatgatgatttttgttctttgacaacatctggtaaggtttttggtttatggctcaccctttttactttttcggtctttcttatatagtgttttggtgggttttttctcgttcatttttcacgaccttcttatcctattactagggtcattaaattgttcgttaggttaaagagatttacaatatgaaaccgattatgtccattaaaacgtgaataagacagaaaagagcaccaagaaaatgaaaaataatttaatgtatgttcaggaaatcctatgaaaacataatgattgatcgggtttattggttttgtagctggtggtttaagtggttagggaagctatgtatttataatttattgattcaatatggttttgcatctgaaatatatttaagcccaaccaataaatataccatcactcgccaagaccgtttctcagtggaaacattttgtgagaagttcaagtcgatgttaatgattgtaaggatttaacggatgtgatgtttttgtaggttgaagatttaaagtactatatgatatgttgtgtttttatcgattttgaatctttattttctttcctaaatcaaaactgcaatatatttcctaagctagcaaaacccattctagatataagtagagtccagcttgtaatgcaactgcaaagcaaaaatcaagatatttcgatacaaggacttgatgtcataaaattccaaatttgttttgtcttgccacacttagtaattctcttccaataatggttaacttaatagtatataaaataaaaatgcatataggttccgtaattaatcttctttatcgtcacgagaggcacatcttttttcaacatttgaccactctctctctctctctctcaggacctttcggcgtaatttcgtcttcccctttgcttaacattttctttctttctttttgaccaaatattaaaaatatatccatttttattttatttttaattaaattcataatttgcattttatgtatttataataaaaaggagagaataaatccaaaagagtgaagcaaaaacattaaagcggaaagaaagtggtaaaacaataatagaaacaggagaagcagaagtactacttcttcttcttctgctctcttctcagaccttgttttgtactttcttcttcttcttcttcttcttgtttgcgaactccgatatcttcttcactacctttgactccatttctttttcttcttcaggtgaattctactttacttttcttcttaccccaaatttactcttttgggttttatgaaagttttgttttttattactcagatcttgtcctagttctcctccttgttctgttgtttttctgtttcgtttcgaattggttttgtttttcaagtttagggttttgtagatcagttcgtcgttactgtagattggaaatgaaaattatgattctttggatctgattatagcagttcaagtgtgaactctatctattacttgatttgctatctcacagtttttgaatttcttaatggtgttagctactcgacttttagagctcattttcttaactactgaacttgtttcatttgagaggtactaatccagtatatattataaagtttaatgctttttcttacttgcattctttgaacatgtttgctattttggtgagtgaaactttatgtatatttatgaattttgagctaaagtattgattgtttcataagtaggtgtaggcattgtcttgttatgagaagcaactgtagctggaagctcaagtatttgtttttagctgtggagcttgaatcttgatagttttcgacttctatgttattacctgtggggatatagaaacaatcatg

SEQ ID NO: 26201 - DNA, 3003 bp, Unknown; identical to SEQ ID NO: 26200
  misc_feature (1)..( 3003): 2750-1469P.txt file - cDNA_ID_2711382; gDNA_ID_2214526; Annot_ID_184765

SEQ ID NO: 26202 - DNA, 3003 bp, Unknown
  misc_feature (1)..( 3003): 2750-1469P.txt file - cDNA_ID_2711390; gDNA_ID_2214527; Annot_ID_134180
aaaaaatgaaactagtaaaagaagtgttttcaaatagaattagcatcatatttaattatttttctacagaaactatagggaagccaaaaacagaacagaacagacatgccgacaaattaaaactttcacacacacagacacatttgcgaccaaattaaagacatatatatggctcacgctatctgtttagatattctaactatatgatgtttgtataatattatagtttagatttatcgtcagttgattaatcacaaatcataaacacattattttattccgactgtaaattaaaaattaaactaaaatgtactagtgtaaaataatagtgatacacacataaaactttatttaaatcaagttgttgttgtgtgtcatggaggcaggtccatagctgtttcgttatacaccttctttgttatttcaatattcaagtttgttgttaatttaatgttattgactaaccaacaatccaatatatttataattatctatatataaataacccgccgcagtattattccacggcatacgaattattttggttcaaattacagatatctaaaaaaggatcaaatcttttctcaatcgtttatagtttcttcaatggagattactcaatatcaaagttttcatgaaggttcgagttctagggtttccatgaacaggaattcacaagtaatatccaagatcaaacccaagattcgcataatccatatatttgcaccggaggtcatcaagaccgacgtcaagaactttcgttcactcgtccagagtctaaccgggaaaccggcaccgggagaagccaaaaccggtaaaaagagagccaaatcaagaattacgactccccaagaaccggtttgcgatgatcatcagccggtcaacaggctttcgggtttcaccggtttactagcaaacggaggaaaccaccaggtgaaagaagagtggggatcaggtgatcagagtacttcgaacacaaacacgtactttgatctagaaggtttaattcaagatgtcggagaagattacttctcttcgtttcccatgagatcctcttcttcttcacaagtcgaaggtttcatcttcaacaacaacaacaacaacaacaacaacaacaacaacaacaacaacaacaacaccaacttcgatacaaaggctcataattcgtcttaattaataacagattaatttctagggttttcaatcttattgattctgcaaatcgcatttggtgagatgagatctaatcgcaacgataaggtcatattttgtgggagaaaaaaggcatagaagttgtatatagatataacaaatgggtatgatgagagacataaacttttggcgggactgactttgccaaggttgagagttgtgatgaagagagtttaatctacgtgcagcccttctaggagaagtggctgtatctaattaagatgtggtcggtcaaaaaagccctagttttattatgtaacttcattgatgtgctattattggatgtgtattaattctttggtgtgcagataaatgtgatgattgctgtactttaattttggggaaaaagtttgtatggaattagaacaaggatcgacttgttttcgatatagatactctgattgattgtgtatattgaatatcgatacttacataacggttattcggttaaagtacagttacactaattaaattaaactgtaagttaacaagaatattctggctcaagctaaattattttttttattattattgtttactaatcttttgttacaaatgttgaaaatgatatttattatacatgtagtacttcaactaaaataaataacgtgttttcatatttgatgtacgtgtataatatatcattttcaacagtgagtaatattaacccttttatcaaaataaagtaaaacaaaatgatataacctatcaacaaaatgcaaagaaaattgatccgaaccgaatatagccgtaacggtacaccaaaattgttttgagattttagtgtccgttgaccttttcatataaagccaaattattcggtctggtttccaaaagaacgaaaaggtatatgattacggtttactcccttgcttctgtgttttggtttagtttggtttaccttctcaaagttctcgaacgtcaacatttattttatcttattttgtaaggttctgcacatgttatacttattaattagtctactttttcaggcattgggattatttgttttagtctaaatcggttttggttgcataatattggatgaaaacattgtaaaggacaatttcaaacctgacttttctagatttggaaacgttccggctgcttgaaaagctcacataaatattagtatgatttcttaaaccaaaaataaatgatgattatcaacaataccgtaaataaggcaaaggaaataaatgatgattatcaacaattgccgaaaataaccacaccggtacaccgaaattgtttttgagattcataaaaccggaataatacgcctaaaggttattttctccaataccggtttagtttggtttgccttctcaaagtactcgaaggtcaaaattggaatttagtaataaacctgctccagctatatacaaatgtcatttgctcacctttcgccgattgattttgtacatcacacgcagacgcagcttttagtatttttttcaacaatcgcttttttttttctcgatctccgtgaagctctcgaatctctggtatgtttcttcgcttcttcatagtgtttctcatttccttttggtcttccataattttcggagaatctagtcctgtttttctcttcttctggaatctgaattcgccggtgaattccgctgatcgaatctctgagttttgttgaattatttgattcggcgataaaactttttttgtttgtttctgattttggtgagtgttgattgcttgagttttttcacggatcgatttgttttgagaattgggtggatactgtctgtcacaggttttgagttttggagaatg

SEQ ID NO: 26203 - DNA, 3000 bp, Unknown; identical to SEQ ID NO: 12049
  misc_feature (1)..( 3000): 2750-1469P.txt file - cDNA_ID_2711397; gDNA_ID_2214528; Annot_ID_134234

SEQ ID NO: 26204 - DNA, 3000 bp, Unknown; identical to SEQ ID NO: 12049
  misc_feature (1)..( 3000): 2750-1469P.txt file - cDNA_ID_2711397; gDNA_ID_2214528; Annot_ID_184851

SEQ ID NO: 26205 - DNA, 3000 bp, Unknown; identical to SEQ ID NO: 12038
  misc_feature (1)..( 3000): 2750-1469P.txt file - cDNA_ID_2711401; gDNA_ID_2214528; Annot_ID_134232

SEQ ID NO: 26206 - DNA, 3000 bp, Unknown; identical to SEQ ID NO: 12029
  misc_feature (1)..( 3000): 2750-1469P.txt file - cDNA_ID_2711408; gDNA_ID_2214528; Annot_ID_134219

SEQ ID NO: 26207 - DNA, 3000 bp, Unknown; identical to SEQ ID NO: 12029
  misc_feature (1)..( 3000): 2750-1469P.txt file - cDNA_ID_2711408; gDNA_ID_2214528; Annot_ID_184835

SEQ ID NO: 26208 - DNA, 3003 bp, Unknown
  misc_feature (1)..( 3003): 2750-1469P.txt file - cDNA_ID_2711412; gDNA_ID_2214528; Annot_ID_134216
attttcgtactacgtctacccctctcacggatatgtgtggtcgagcagtcattatcataatgtggaattttgaattgagcgaggtttcaaagttcaaaactatcacaactagtcttgatcaattctatataagatctgtgatcttggttgaagaaaagaatcgtcgtaggttgatatttaacaaggaatggcaaaggaagggggcttgggagagaactcaagatggagtcttggaggcatgaccgctcttgtcactggtggctctaaaggcatcgggtcagtccccattgtgaatcttgactcccattttctatgctcttttattgtattgtcatgtttagttatggaagaactaactctgtttgtgtgtgtcatgaatagggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtaagtatacatatataagcttcgtcctcctcggtattgggatccacaagaacccaattatgttgtgttttttgttgtggatctatacatatgtaggtcaacaatgtgggaacgtcaatattcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggtaccgtatataagtacatccttaacacaatatgttcccatgggttatgatgcttacacatatattaactcgttttaggagccatgaatcagctggctagaaacttagcttgcgaatgggcgagcgacaacataaggacgaactctgtttgtccttggtatatcacaactcctttaagtaacgatgtaaggccaaagtttatatttctccttcgtactatgaaaaacaaaaaaaatacgtaaatatgacttcgggctttaatttatgtgtgaaaatctcttagtttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataaaacacatatgcatgtgtttggatcatattttcaataatttaaacttacgggttatatacatcgtcaatatgtaataaatgtaatttagatgtgtccacatgttctgtttctaagagattcttagatatttatgcttgcgtggtgaacaagagttcactctccggatggaccgcatccataatctatgaatttgggaattatattaccaatttgacggcagactagttggccaaacttaactcttggttctttccggttatatatgtttgcagtgtctaatatttctcaataaaactttcaaagatgacgacaaaaagtgtctttctatgattctctccacatgcgtataatactattcgtcacacatcgtgacttaaaaacttgtcgactagtatataagtgtatggaaattctccacttttgaactaacttttcgtgtgagttaggcccacacttagttaattcaagacttacctcttccttccatgcctttggttagcaccggtgggttgtgttattggcatgcttggttgggacacataatggatattttcagttttctaaactaacatcaagcgcaaactggtataattctagggcttcagtcaagagtaatccttccatttcttatgagatagttgtaaaggtttcatcaaacgaaacttgtttcacacccaagaaatgaaaccaaaattaattacatgagacgaaacaaaaataaatccagaataaactactattatgaataacttttttgattatttaaacagatctgtttgattgaatccaaacctgttatgttatttatttttgtttttatgaataccaaaaagttttggctcagagcccgaatatcctcggcccgaaaccattatgtaatattacttactagattttcattaactttaaaaagattcatcataatatatagctaaaccccttttgttttaaattggaagacgcatcataagttacgtcattaactcatcatgatcactttcccaattaaatatgttaacctaaactaattcagtcttatcattactttgagatctctaatttgtctcagccacaaagtcattaattacgatatatatcattccacaacttctttgaagattctcttaacctcgtatcatttattctaacccattttcccattatcatttgtcatcaaactagaagtcaagaacagaaacatccagaacaatggctaaagtagaacagagcagatggattcttcaaggcatgaccgctcttgtcaccggcggaacgaaagacattgggtttgtcttccatcatcactttccaagtcatctttcttgcgttccaagcaaccaaagaaaataaacccaactttgcttacacatttatattcttgatgaatctctcacctatgcaactaaaattcaggaaacctacattgctctcaaacaatgaacatgtctcgatctcatgtagttgggcctaacccttaatcgaggcccatttgtttgattaacctaacaaatacatgaaaaggcctttcttacactgtcattatcattcattcattatggatttttctctaccagacattcagatctccaagaaaagatctttgggttctgtggttcataatcagaaatg

SEQ ID NO: 26209 - DNA, 3003 bp, Unknown
  misc_feature (1)..( 3003): 2750-1469P.txt file - cDNA_ID_2711416; gDNA_ID_2214528; Annot_ID_134210
tcttcttgttattctctatgttttgtttcctgaaatatttatgcttgtggtgaacgagagttcaatatctgaattcattatctactttggccaacgcctaatggtatcatttggtgtctcaacatgtgatggagtgtctaatttggtttgaaatcccaaaattcaatatccatgggtattctctagtaatttataaaagaactttggtccaaatcctacaagtggtcatatactgacataccacatagtggaagaactagctagctgggtttgaaataaactcaagataagacaagtggtcagaattgatgttgagagatttttttcctcagcatgggtgtcaaatgagggtccatcaaagtatgcagatgtcactaagggtttccatttagagtaatgagacatgaaatagtgggttttgggttttgagtatttgggttttgagtaagtattccaatataatatatgttcggataattttgatagctaaaatcattgtccacggtcccaaacgcccactagtttaggtaagatggacagccctagatgtaactatcaggagttgcccaatgtctatcatgtaattgtatcttttcttatttacaaagttgttagtaatctatctttatatacaatttaaagaagctcttgttagttatgtgatagataaagatggataacagccgatggagtcttcaaggtatgactgctcttctgaccggtggagcgggaggaattgggtttgtcttcttaccccatttttctacttctatttgatatccaaaatggtcaagaattcaaggagtttatgtttgtggaatgttttaggcatgccatagtagaggagctagctggttttgggccaaagtccatgtatccgacatatctgaaacactgctcaatcaaagtttaagcgaatgggaaaagaaaggatttcaagtgagtggtacaatctgtgatgtatcctctcgtccggagagagaaacactctgcaaactgtctcctcgttgtttgagggcaagctcaacattcttgtaagacgtttgtgagtgaagttaatggaaatgacaatgagcaagttttgctcaaatattttgactataaaatgtcaattttggttaggaccactatcttagatttttttcatcttcactcgtaaggctacgtattatttccaccacacatacaaagataatcactagattcatacttatccgttccacattcattgtatatacaaaatctgtggcatttctggtcacttcaagtaagatacaagaaaaaatggataaaagatggagtcttcaaggtatgaatgctcttgtgaccggtggcactaaaggcatcgggtcagtctccattttagatgctcttttattgcattgtgatatttagttatggaagaactgactatgtttgtgtgtgtgtgcgtgtcatgaacagggaagctgttgtggaggaactgtcaattttgggagcaagagtccacacatgtgctagagacgagactcagcttcaagaacgtttacgtgaatggcaagaaaaagggtttcaggtcaccacttctatctgcgacgtttctttgcgtgagcaacgagagaaactcatggaaaccgtttcctctctcttccaaggaaaactcaacatcctcgtaagtgtatacatattagcttctcctccccgggcttgggatttacaagaaccaaaccatgttgtgtttttaattactttttttttttttgtaaagatgtttttagttgttggtctatacatatcttatatataggtgaacaatgtgggaacgttaatgctcaagccgaccacagagtatacagcagaagaattctcgtttcttatggctacaaatctcgactcagctttccatatttcacagcttgcgcaccctttgttgaaagcctctggctcagggagcattgtgctcatgtcctctattgccggagtcgtgcatgtcggtgttggatccatctatggagcaacaaaaggtactgtatatactctttaaaacaatatttctttacattatgatttatatgcaagtgtatataaaagcattttttttcaggagccatgaatcagttggctagaaacttagcttgcgaatgggcaagcgacaacataaggactaacgctatttgtccatggttaatcacaactcctttgattagtgatgtaaggacaatttccttagaacaacggcgaaaaaaaaataaaaaataacttttgattctaactttttaacttatttgaaaatccctcagcttctcagtgttgaggagatgaaaaaagaagcagaggaaaggacacccatggggcgtgtgggagaggcaaatgaagtctcaccgcttgtggcatttctttgtcttcctgcagcttcttatattactggtcaagtcatttgtgttgatggaggtctcactgttaatggcttctcctatcagccacatgcttgagctaggtctgtgttgtgtgtattgtccaatgaaaacagtaaaccaaacaataacatcggaaaatgaatgatttgaatatttaggttaagccttaaaactaaattcattttggtatgttgacatattgtaaaacgtaatgaacaagaaaccttaacagaagatgtttcttttaagagtacacgagccttgcagaaacagaacacaagttgaactcaaatgagaagatgggcttcgacactcatcaacttacaatgctcagttgatcaagcacaaagacagaatcatgcaatgatgactcaaaaggacagatggcttcactgttgaagattttgactatatgtcattttttgcttgggacacttcgatattttagtcatgttttctaacatacgactacatagtttctcaacatgccacgtacaaacaagacaacaaactcattaattcatacttatctggattctgatccacatttactgtatacataatttgtggcatttctggtcactgctagtaacaagcaagaaaaatg

SEQ ID NO: 26210 - DNA, 3003 bp, Unknown
  misc_feature (1)..( 3003): 2750-1469P.txt file - cDNA_ID_2711424; gDNA_ID_2214528; Annot_ID_134200
aaattttgatctatttgagcgtttagatcattccctcctccttgttcttctttttctttgaatgccgcatacacttcttctctagattttttccaacgaattggaaaacttctatccatcatcttgatgtccaagatcttctttccttttaagtcttgaatcacacacttgttgtcttcaaagatgactcgatatccgttggatatcatttgagagacactaagcaaatttcttgctagttcgggtacataaagtacatctttgatgacatgatctcctttgtttgtggatactcttatatctcctctgccttcagacacgacctttcgaccattaccaatccttatggtaattttcttgttgcggtccaaagtgatgaagtgtctaacatctttagacatgtgattggtacatccgctatctaccaaccacgtttcttctccaattgttgagatctctttttcttcaacagcactaaagagaatatgacactcatcttcttcttcatcttctgattcttcactacttagatgtgctctttcaccttttttaagtttccaatctctggctatgtgtcctggcttgtcgcacacatagcatcttctttcatagcttccacctctttgtgaaatgctttcactcttctttctgaaacagtctacctcattgtgattgttcctcttacacacgctgcaccacatgttggtcttcccatggcgatttttgtttgcttgttttctgctcttgagccaagcttttctccataaaacgcaccctcattgatacgttcttctcggagactcaagcgcttctcatgcgcattcaaagtacctatcatctctgtcatagagaaagttgatagatcctttgtttgttcaaggaccgcaacgatgctatcaaactgttgcggtaaggagataagaaccttttgaaccaattggtaatcggttttctcttcaccatgaactcttagttgattactcatattaatcaacttggttgtgaaatcatttatgttttcactctcctccatcttcagattctcatattctcttctcaaggtctgaagattaatcatctttacttgtgaacttccttggaactccatctattctcttgcgcttgatgccggagcgattctcggaaatattgaatcagaaactgcactttgaagaatctgaagagccatcatatccttcatcacttgatcatcacgctctctagttaacgccggtgagttttcagacgacgaactcaacgtaattccattttcgataacatcccacaacttccttgttttcaagatggttatcatcttgattttccaaaagccatacgattcaccattgaagattggaataacttgctgcattgttgtctccatagctctgataccatgtagaactttgaactctcaaagttgttaaggatcggacaacacagattttactctgttttgtcttactctatatttcactctgtttttataaaacgaaaaccacacacttttattacatatacaaactgtatttataggtttacatgacacactttgactaagggacacgtctctagaagacaacctaatgtagagacacatacacacatgtaactgttttgtagttaacaattatatttgtatctcttcgatgtgtgatacgaatatatataaaccagttacttcactatataatatatctcttctaaaataagatgatgacttgatcacttccaacaaatacacaacaaaaaaatcacttgatcttgctcaaaaccttatgcattatgctcttatacataaacttacaaggatgttgagttttccttggaagatagaggcaacgttttccatgagtttctctcgttggtcacgagaagaaacgtcgcatacagaagtggtgacctcaaaccctttagcttgccattcacgtacgcattcttgaagctgagtttcgtttctagcacatgtgtggactcttgctcctaacatggctagttcctccaccacagcttccctattcataacacagttgtatacatattgacacgtgcaaatatgtaatatgacatattaatgtattcaatattggattagtagggggactgacccgaggcctttggagccaccggtaacgagagcggtcatgcctccaaggctccatctacatttgtctctcaagttttcttctgctttagccatttctggatactattttcttcaatgaaggtcacatatttaaggccaagaggtggaagactagtcgtgagggtggccaaagatacttttacgtgaattgtttaactttgtcctttgaaacccctgtctgaatgtcttagccacctctgattatgagccacagacccaaagatattttcttggagatctgaatttatggttgagaaaaattcataatgaatgaatgaatgataataatgagtaatgacgttcgtacacagtaaggccttttgatgtttttcttaggttactcaaaataatgggcctcgattaagggttaagccccaactacatgggatcgactcatgtttcattgtttgagaaaaactaaagaccccatgtaacatgggttgagctctgttctgctctagccattgttgtgtaatgatgtattttgatgagaaatgataatgaaaaatggctatttatgatgaattaatgatacgaggctatgagattgtttgaagaaattgaggaaagctaacgtatctcttgacgttgtgactgttgtggtgggtagaaaaattagagatcaaagtaaacaatcttaagactgtagtttagtgatgatggcgtaactaatgatgcataatcaaaaactaatagaaatataaggcccacgaaaataatatattgggcttttcttggcccatcaataatctgttctcaatctcaagaaaacatgaaccgttggatgtaaccaaacagaagtgggttatgtccagaatctgaagagatcagagagtgtgggagtggacggaaagatg

SEQ ID NO: 26211 - DNA, 3003 bp, Unknown; identical to SEQ ID NO: 26210
  misc_feature (1)..( 3003): 2750-1469P.txt file - cDNA_ID_2711424; gDNA_ID_2214528; Annot_ID_184821

SEQ ID NO: 26212 - DNA, 3003 bp, Unknown
  misc_feature (1)..( 3003): 2750-1469P.txt file - cDNA_ID_2711439; gDNA_ID_2214530; Annot_ID_134270
aatattatagtatactgatattataggtaattattataggctaaacaatcagaaagtgcctattctgaggaattgaagcgaaggaaagatacggagatagcagtagcgaaagagaaagagagatttataacaataaaaaacgagcaagaggtgatcatggaagaacttcaaagtgcaatggctcagaaagcgatgcttgagagccagatagcaaaatctgatggtacaatggaaaagctaaaccagaagcttgatatagctgtgaagttgttgcaaaagttgagggatgaacgagaggagttgcagacagaacgtgacagagcactcagagaagctgaggagttaaggagtcacgcagaaacctcaaccctacagttgcctcagtacttcacggatttctcattctccgagattgaggaagcaactaatcactttgattcgaccctgaagattggggaaggtggatatggaagcatctacgttggtttactgcgtcatactcaggtggctataaaaatgttgaatcctaacagttcgcaaggccctgtagaatatcaacaggaggtattttcttgacatattattagtgaaatttcttgtttagtttcatcatcattgtttactggtttattgtgcacaaactgctgcctctacgaaaaaggggactttgaaacacagttctactgtagttttgattttatagtgttcgctgtggaggagctttgacttattcttgcggcattgcaggttgatgtcctaagtaaaatgaggcatccaaatatcattacgctaattggagcatgtccagaggggtggagtcttgtctatgagtatcttccgggtggaagccttgaagacaggcttacttgcaaagacaactctccacccttgtcgtggcaaaatcgtgtgcgcattgccactgagatatgtgcagcacttgtctttcttcattctaataaagctcatagcttagtacatggtgatttgaagccggcaaatatcctactcgattccaatctcgttagcaagttaagtgactttgggacctgctcactacttcatcctaacggaagcaaaagtgtgagaactgacgttacaggcacagttgcctatttggatccagaagcttccagtagtggagagctaactcctaagtcagatgtttactcgtttgggattatcttattgcgcttgttgaccgggagacctgccttacggatatcaaatgaagtgaaatatgccctcgataatggaacattgaacgacctcttggaccctttagcaggggactggccctttgttcaggctgagcagcttgctcgcttagcattgagatgctgcgagactgtcagcgagaatcgtccagatcttggaactgaagtgtggagggtacttgaacctatgagggcttctagtggaggatcttcatctttccatcttggccgtaacgagcaccggatagcccctccatacttcatttgccccattttccaggtaactaatctgtatatttgagtatggatttccagtattattatcaatctgagaagacttcgatcacaaagtcattaaaatttgcttatctgaggtctcaaaccgttatgttgcagtctaatggtactcaacccgttcttcctctgctttgttttcaaatatttcaggaagtcatgcaggatccacacgtggctgcagacggtttcacatacgaagcagaggctataagagcgtggctggacagtgagcatgatacttcaccaatgaccaatgtcaagctttctcacaccagcctaatagctaaccatgctcttcgttctgcgattcaagagtggcttcaacatcatttgtgaaaataaaatccttcaaaccctcaatccctgttctcttatgaaaaaacgtttttgccttttctgcgggaggcaacagagtaagtgagtaagattagtgttttcagtcttccttatacatatacatacgatctaatcatggatagcagcatatttgtttactttttcaagcatagtgtaagtcctccatatcagtcatatatgaaaagaagaagctggtgagatttgtatgtggatatgtatatatatatatatatatatatatatatatatatgttctgtatgaaaaaaaaagttatatgcttattcggtttgtgtgagaagaactgccactattttgttcttccattatgttcggctctcttaagaacaaagattagcctctaattattggacatgatctcactgatgatgcctttgcttagctaaaattaggatgagtcttacatttttagtcaagactatcgtgtaagacttgttttccacctggaagaagttaccttggattgcctatagtgatttttaatgaactcttaaaattcttgtgattaatcttacttaattagcagtggggtcaggtcgttttggcggctagtggcataactgtataaaaattcaggattgcactgaggtaagccaacctaacgcagcctttaaagacaccaacctggaaaatgctgagagtattcttcaggattttctcaaaagtcttgtgaaattcgtgtatttgtgtcaatatgtcgacatttctcttcatacacagatactgtcgcttttgattcctggtttggcttgttgaaagtcaaaaagccttcattattttaatacatgattcagcttctgcgttaaggctaggtttcgtcattggtaccgtggttgacttcgtgtgcatgttataacataagaaaatgttcttgcttgttgattgctccctctgttagataagtcatctcttttctcgtattgcaaattttaagtttgttcttgtttattctcttgagtgaattagaggtatgttttgagtgttctcatatggagtgtgttggagataggagcttcgatccaagcaaaggggaaaagtgttggcttcatgaggcttcgatgcagccttaaacgctaaaatccaggccaagcaagatggagatagagagagatgatg

SEQ ID NO: 26213 - DNA, 3003 bp, Unknown
  misc_feature (1)..( 3003): 2750-1469P.txt file - cDNA_ID_2711443; gDNA_ID_2214530; Annot_ID_134269
attactatatcattttattcctaattaactgtacttctatttctaattaagattagtattcaaaaattcggcttaaagagattaagatacctttaagtagctgtatagacagacaacccctaattagaaagcagctactcttttttttttttatatagtagtaccaagataaacgacaaaagcaattaacaaatgttcgcaatgtcgacctcatcaaaaacaaaattaagaaaccgacaacgtttcttgtatttttactcagcatataacaacaagagaaacgacgacatagtggagaatacgaagcatatagtttcttaggattcttctatcacaggtcactgccttttttgtctacgtatcttgtcctaatttgcatgtgaagatttgatgggctttttgtgcatcgctttcagcattcggaacccgatcatattcgttttatccgactccgacccgagggttatatgcaagcaattaatatttcgttgttcttgttcgttcctgaggaccatcgccgaattctaagacttgtgattacttaaactggaatttaaaagattagaaagctaacaaaagtatatggtaacgtcatgtgtaattaaatgcatgattagtttttgacttttaaatatcatatagtttttgtttttgtatgttatacagaattctttcattatgttctacctaacagaaaagagatataaatttagtgtaatcttataaaataagcatggctgcggttgccatattacaactctgtctaatcaccacaatcattttagttaagggttttggtaacatataattatcatggaaattaaagacggtgatagcgtaaactaattaagaaaatcacatcacatacttgatactcctaaaagaaaacattaaagtagaaagaaagaaactaaaagccaaaaatgcgtgtgtaatcgtatgagtgatatttggtgtactacaaagcctgcaatttgaaaatgttgacacgtacgtccttaaaacatttgagactattggattcagacttttgaaaagcaaaactttggattcggaaaccaggcaggcttatatggataccattaaggcccgtgaatcatatattgcccatttaaggaggtatttatttttgatatattttatttttaatttattataagttcatcattatcccggttatcgtgaagactagtcatatccaattaacgttattgctctaacggaaacgtgcacaaacaaattcaaattgcagtttacggtgaagcttttgacgaatgaataaagagatgctacatccccaaatcgtatatcctaagttgaaatattccatgataattaaactcagttatatatataacttggttagttaacaaactggtgtggatgtgcttagcctgtcttcatatcctgagacaactttttctttatttttaaaacctgtcaattacaaaattaacgtaatattcaataacaaataaaattctatttcgaccccggaaacatatatatatatatatatatataattcaaatgaaaatgacaagggaataagcatttcggagaatatgcctattaatttacattatataacatagtacaaccacacacgccacattaacaattcaactagctagtttttaatttatcagaaaatgaacttgaaaatatgttataatctacactaaatgttaatagaagactttttctcatctattttcaggaaaaaaaaaataacaaatttcttgaaccaactaacaaaattagcaaattaacgtacaatgatccattttttaacaatcattagagtgatatagtagtaatccgataccagatcctcaaaatatatggagacatagtcattcaactgctggtttttgcataatccatgtgtattagcctaatactattaggtttgatgcatccagtctttctaaaacacgtcattataactcacgcgtttagtttgatagacatataatgatgcacttaatactttcatattcgttgtcatctatgtgtagcagcatagtgcacttgttcgtctcagactttatagaattttagattcgtgagtagaaaatggcttttcgcttaacttttcataaatcttatgtcacacttaattaaaaattgactagcaccttaaaattaacatatatgtgtaacatgaagaatattgatatcttgcatgatactaactcttttggggtcttctgaaaaatagattgcatgcatatctgatcaaatgcaaatagattatgttataaaaaaaagtcatttattctactgattggaatggaaataagttttcaccggcgggaacaaaaaaggtgaacacgtcggcagaaatagagaattaagaaagactgcgagttggtgtaccaaatctcatccgtgcttctcataatcaggtacacgtgtcattaatcggttaaggtggaccaccccatagataagtactactgtgtgtgtgtccacagcagataaataaacctcttctttcatgttctcgaccacgtcagattttttagcagcaaagcacacaaatccccaagaagcttcgttttggtatgttaaagtaaaatcgaataaattttgcacacaaatctcaattttaattgtctttccctcttctcgtgaaattttccgacaaaatatcagtttcttcttgccgtgagttttggttggtctgaccaagagtccttttatttggtcaatacgtttcgaaatttgataatcaaactctttcttcctcttcttcttcttccttatccgtagactctagggtttcaatacgattcgagtgtgtctgtttgctctctagtcaaaaatttcactctggttagaaactttcccttttggattgtgaaactgctattttaaatcactgcttattgattcgtgttccggagtgatcttggtgaatattcttaatttgtttcgttgttttgtggttttagatatcaaacgatctggtttgtcggatttgatattggagcaatg

SEQ ID NO: 26214 - DNA, 3000 bp, Unknown; identical to SEQ ID NO: 12087
  misc_feature (1)..( 3000): 2750-1469P.txt file - cDNA_ID_2711451; gDNA_ID_2214530; Annot_ID_134266

SEQ ID NO: 26215 - DNA, 3003 bp, Unknown
  misc_feature (1)..( 3003): 2750-1469P.txt file - cDNA_ID_2711455; gDNA_ID_2214530; Annot_ID_134265
aatcctggttcttgattcaatatataatggagctttcttttttcaagattgcaagtttcagagatagatagttaattaccaacggaagccattctctgtttcttgccggagcccggaggtcgaccacggccgcgtttgttagagttgttgggagtaatggtcgaaacagaggaagacgacagagccaaagaaacagagccgtcttgaccgtattttctaggccgtcctctctttcgtttcatcggagtttcactgggaggtggaggaggagcaatcatattaacgccgatatgatgaggaagagctccggctcctccggctgctgttgccagagaaggatcaccgtgtaaagaaggagatccgaaaccagtggagcctgacccgaatggagagttttgattaggtaagtgacgaagaccttgctgttgctgtggtgatccatgaaacgttggaggacccgacccggataatcctctatggatatagtaagaacctgacccggataatcccattgcatctcttcgatccatttcgcatttacaatagttgaagaagaaagactcttttcaactttttaagtgaacttgtgaaaccctaaaaagattgtggctagaattatgaggagagagagaaaaagaaagaggataaatggataagaggaaaaaacagaatcaaaggttgagagactttacgatgaagatataaacttggagagaaaggaacatgcaaagctctaaacactttctctgcttcttacttctcctcctctctctctttcattctttcaccataagcaacaagaaaagaaaagctttctcttctatcaacaatggttaggacttggttttgaggctatctctctctctctctcttcttgaatttgtttgctttttagttttctgggtgacagaaggaaacagaaacaaacaaaaaacctctaacagactctctctcaagcaaaagcatttactgtgaggataacaacaatgggatcttttaattcttttttttctgaaaatgtatttggaaattcaaaatcctaatgaataaactgactttgactgtagctctatatagcaactaggcatctgtatggcacatgactcttatggccacactctttattcaggcgcgtgcaccaacatgtcactcttctttcttctcaaccagaaatcttggtgaacagattcctccttttcaagctgatgctacttcttactagtctctctactgtttctatagactgattgatctcttcggaatttgatctgagacggaagaatctgtagagacagtggaggccacgcgccggagagtgagaaaagatttgggcctgtctggtcagagacttgcccactggcttccactttgagaactattttgacgagagagagaggctgatcagaagaaatctataaaatatctcgcaaggacccattgatgggatgatataacctctcaaagcctttgagattttttcctattaggattcaactttaaatgtaccatgtaatgtgtgacactgtttgtataagacttttgattatgacaaacataatttgactttctaaaagacagtttttttcttcaaaatatgtttagtggaatactggaatgtactaataaactagaaaagatcttgggtctgactaatgcaccatgaaagtcttatgccaattataaacatacttgtgtctttgttttgtttacctaaaagttgactttttctcagagaaatcagaatctatgctgaatttgaactttagaagcaattaggaaccatacacatttcacttcatcaatagctacattccacaatgatcccgatccggttagatagcaaaatcttgcattcaaaagagagagtgatacataagagtttaacctataagaagaagctagcttcaacatgatttctccaaagtaaagacgaagatcaatgaagaacaattttacatacaagtgaaaaaaaacgaagttccttgtcaattgtctagctccattgcctgagcagctttagctttagcagttggagtcagttttgtctttaatttcttcttgccaacagaaaatccacctttcttcttcttcccacttccatcaacctagacaacaaaatcaaccaactcacagatatcataaactactctagacttcatttaaatgatttggaaaactcaaacttattcgtcagatgttctactaagaagattcaatattattatttttaccccacataagcttctgactaacactatcgaaatcaaattgaatccaagcgaattcaatcatttcaccattggtaaccaactagagtaatatatagctagaaaagaccattctctgcaacagaatcggtttgctacttaacgaacaccaatgtatatgaactaaatatcagaattaagagataagagagacagaaaaggtccttactttcatcttattcttgttggcatgaagcttcttgatcttcttgtcctgtaactctttctcttctgcaaatcgaaaaaattccaagttttgttgagaaacacatgcgtattgaattgaaagcgtttaaagagatttaaagaaacctactttggagattgtactcgtgctgcttctttctcttggctaaattgttcttcttcgacattttttccgttccaatttcacctctccaaccagataggcgttctctataaaccctaaatttcaactgacctcaaagggtacggaactttaatgggctgagataagacataagcccatttagaagatagaatagaagtttcagtataagcccatttaagcccagataaaagcttagaaaccgaaacgttgtcgagcgcacaactgttcgttccaactacctttctccaagtcacacttgtctctctttacttatgcactctgcaatttttgcatgtgtctttattgttgtctctgcttcttcttcttcatcgtcgtctccaccaaaatccctaaccctaaacctcgattttcccgcccaaaatg

SEQ ID NO: 26216 - DNA, 3000 bp, Unknown; identical to SEQ ID NO: 12103
  misc_feature (1)..( 3000): 2750-1469P.txt file - cDNA_ID_2711491; gDNA_ID_2214531; Annot_ID_134279

SEQ ID NO: 26217 - DNA, 3000 bp, Unknown; identical to SEQ ID NO: 12102
  misc_feature (1)..( 3000): 2750-1469P.txt file - cDNA_ID_2711495; gDNA_ID_2214531; Annot_ID_134278

SEQ ID NO: 26218 - DNA, 3003 bp, Unknown
  misc_feature (1)..( 3003): 2750-1469P.txt file - cDNA_ID_2711511; gDNA_ID_2214532; Annot_ID_134320
tttatcaagtaatttgcggagacatgtctgatattgttatctttatttacttttgtcagataattcgtgacttgtaatctatgtatttgcagttgtactatttttgggtgcatgcacaaaacctccacgcttatccatgatcacggagtacatggagctgggatcgttgtattatttgatccacatgagtggtcagaagaagaaacttagctggcacagaaggctcaggatgcttagagacatctgcaggtatttaagctaccctgcatagctcccttgattatatgttttaagctacatatgcttatctcatgctgttttgtatttcttatgggatgcataaggggtttgatgtgcatacaccggatgaagatagtccaccgcgacctaaagagtgccaactgtctagtggacaaacattggacagtcaagatctgtgattttgggctgtcaagaataatgactgatgaaaacatgaaggacacttcatctgctgggacaccagagtggatggctccagagctcattcgcaacaggccttttacagagaaatgtgatatctttagtcttggggtcataatgtgggaactttcaactttacgtaaaccatgggaaggagttccacctgagaaggtataatatgctgtgccatgatttctctagagatgtgatatctttagtcttgtgattacacttaatgaaatttgcttcttaggttgtctttgctgttgcacatgaagggtcacgtttggagattcctgatggtccactcagcaaactaattgcaggtttagtgttgttgaataccatgtttcttgaacttttttgtttattctcttatatttctcaactgcttcagtctgagttaaagttaaccacaatttctgtgcagattgttgggcagagcctgaagaacgcccaaattgtgaagagatacttagaggcttactcgattgtgagtacacactgtgctaacaacacttctctttcggggggatatgagccggaagatgttttagctcagaaaacatcccagcttcttttaaatctcggctcttaaattatcaacctgagtggcataattttttaagatcatgagaacttagaggctataatgagacaagttcatagttcagttttgatagctgtggaacaggcagagacaccaaatgtaggatacaaacaagcatgtctattaagctgccactggtgtgattcatgttctcacaggcaatacttcttttgttggctattgaagagcattttggtctatcttaagaaaatatataatacacactattctttgttgggagaataaatagctcttcgatttctcttgtcttcatgacttcatccattattctcttgtgtctagccactttctttcttcttttctttcgtgtcaagcattcgataatccgactttatttatagactcatatcatatcccaattaaattttatgaagaagagtttttttttttctttttctgtcatataactttataaacttataaacgtatatgtggattataaactaaaaacaaaatatttttattacaaattatctgcatcatgttaagaaatttgaatcaaaatttattttgttgttatgcattagaaaaatctgagatgatcgggtcaaactatctaagactatactataatgtaaacgagattggtcggcaatcagctctagtctgtagtagtgtcggaagacgtgaacccaagtcaaaagaatatttataactatttagaccaattaagaggaaaaattagcctttattttaaaattataattttgtgtccaatgtttttttttttaaattatatctatacgtgaaattacttatcttaaaaaggtgattacaactaatcttcaattttctagtgcaacagtatttttaaattttggaaaaatctttggcagcggagaaacagatcgtgactttttatttttaataataaaaccattttatgccttttcatattccgcttcaaaacttttcttttgttatttttttttccaggaaagatttagatttgtccatatggtttcagtcaaacgaataataaaaaatagattagaatagaggacccatttaatttgtagaatagatataaaaatgaaatcaaatcttagagggctccacgttaatttgattgatagttaaattccaatgcactcatacttaatcattagggggctaatgggggtgtaaaagcacagtttggttttatataatatactctatattatacttaaatctcttgggttagataaggacttacggtcatacatatataatttcttttacttggatgattggatccattaattccctatacttttatcaaaaaaattataccaaaccaaatttcaaatcactcaagtgaaaatgttttgtacattttaaaacgaatgtagtaatgtacaatgtgtcccacatttcccattggaaccctgaagcggtaaagcctataaatattcgtgataaaaagtaattatattctcaactaaaattactatatattgtaatattcatatgggcatttttattcgtcatgtaaatctttgtgctttgtttattcgcattttacatagttgtttctgattacatcatgataagcactttatataataaggccttacagttgttacataaatacaacgaaatgataacttttttaatattggataaatataaagtctctcataagataccgttgaccataattaaagtccttaatgatagagacaaaatttataaattcaaacttggcttctctccggtgaagtcctcctctctgtttctatccaacttcttctctctttctctataaacttcctcatccgccgcaactgtaaccgtaaccgccatcatccgccgcaatttcctacaacatttccatgtgctctttcttgttgtagaagattgttcttcacatgcatcctttctgttgtgtctccgatcactccccttccacgccgtcgttctccatg

SEQ ID NO: 26219 - DNA, 3003 bp, Unknown; identical to SEQ ID NO: 26218
  misc_feature (1)..( 3003): 2750-1469P.txt file - cDNA_ID_2711511; gDNA_ID_2214532; Annot_ID_184982

SEQ ID NO: 26220 - DNA, 3003 bp, Unknown
  misc_feature (1)..( 3003): 2750-1469P.txt file - cDNA_ID_2711515; gDNA_ID_2214532; Annot_ID_134319
gaatcaagccctacacaccagggatcagaacttgcggaaagggtgaagttgctttcttttgaatctcaaggtgaagctttgagtaaggactcccctagaagtgttgaacaggattgctctccaggtcaaagagcatcacagcatctttgggatactggaatactctctgaacctattcctaatggtttctactcagttgttccggtgagcttttcagattttttttatttctttgtcatttggttagtaggaagatgcagtttctgaaatttgaaatcttgctccaggataagagagtaaaggagctatataatagactacctactccgagtgagcttcatgctttgggagaggaaggtgtcagaattgaagttattcttgttgattttcaaaaagataagaagctcgcaatgcttaaacagttgatcactacacttgtcagcggcagcggcacaaatcctgctttggtgattaagaaaatagcaggaacggtaggatttctgtaatgactcttccctctttgtcacagttccgcattgcatattctcctagctcgacatttatttctttaaccgcgtccattgttatgttctattgcactctctgccagtgacttactctattacctcaatttcggttcttaaaaaaaagaaacgggagttgatgtcctcatgcaatcttttcagcactgacttgtcctatactcacaaaattcattctcctcaaacaggtctctgacttttacaaacgtccaacactagaaagcccttcaaaacttgctctagaggaaaatgcgttcttgtttgaaaaccatggtgctcagttgcttggccagattaagcgtggttgctgtcgagctcgggcaattttgttcaaagttctagctgatactgtaggacttgaaagtcggctggtggtggtaagcctcagtttctcatatttcaatttttttctttacctacatttatgatctagatgattggatcttatgctatttgtctcttacaaatcaacttggtttcccttttgattcacatgtgcagggtttgcctagtgatgggactgtgaattgcatggactctaacaaacacatgtctgttatagttgtgctgaattccgttgaactactagtcgatcttattcggtttcctggtcagttggtaccgcgatcagccaaggcaattttcatgtcacacatctcgcctgctggagagagtgattctgcagaaaacgactcttgtgactcacctttggagccaaatagtcctttatatgagagaagagatcctgagaggtcggcttccgttgtgtgatttttctttctaaagcatattacagtaagatcattctaaaacaactcttgtgataagcgtcccctagagtgatatcgtttcctctgctacagtacagaaaaagatgaaaatcttcaattttatcggaagttagaaggatatccaaatgcatctggttcatcactgcgtagtttgatgctcagaccttctacagctattgaaaggaaattgaggtaaatattacatatatatttctgacaagttgtataatggaatcagtacaatgattggtataatagaaatgtgcttttcttccttcagcaacacctcgcatagtgaaccaaatgttgctactgtattctggaggcgtagccgcagaaaagtaattgctgaacagagaacagctagctcaaggtttttccgtaccctttctggcttgtattatagttaatgaaaaagaaaataatacattggcacgacctcttgttgtctttagatacagtaatgagatggaacatataaaattatgtttctcttctttttgctgattctatatttaaatctcttgattagcgattctgttatctgaagtgtgcctttcaagagctaccctttttttctctatacctaactgatgatagttggccatttgttacatttgcagcccagaacacccatctatgcgacgtggacgatcaatgttgagcactggtaggaattcttttagggattacactggtgaagcatcatctccttcaaggtaactcatttttacattagtgcatgcgaaaattttcagtatgccgctcctatcatatacattccagtattagttaagttgcttatacaagtctgcatgtatatatttgattggctgtgcaagcaattttttaatattctctagctttcaaacagttcatccacatcagaaattcgtaaaactagacggcgaagttttaggatcacaccagaaattggcgatgacattgcaaggttggtattctcatccatgtgcattgtttctactttcatcgtttagcagtttttttctatcattttcaccttgcatttaaagagctctatattggagtttattctgtaaatctagttggtaaggtatttttaaaatctacaatcatctgagcagctgctagatcacatgaaagtatggcatgagtcatctcgaatgcaaaactgctatctccaaacttctagatgcttaggttaggtgtctgtaagatggttatatgataaacatggaactatatatttactttgatagtcatagaagctgtaagccatttgatggtactccttttaattttgtaataatgatactgagattcgtgagaactaattaagaacagtgattttgtgatttgcttgtgtattgactctgatgttacaaattattgaagcgctgtacgagaaatgtatgagaaatcaaagcaaaaccgtctcttgcagggtcgagaggatgaaaacagctcagttatcgataacaacgtaagttttggctctgttagtaagagtgattgttttgttgtgttagttcctttctcattgtataaccagtctaaaagttctgagtttcttctgaagttcactgctctattagctcttacctctaaatttcttgtgatttttgtttgtgctttctcaggtgtctggtctccatcttgatgatgagttaaattctaagaagacaatg

SEQ ID NO: 26221 - DNA, 3003 bp, Unknown
  misc_feature (1)..( 3003): 2750-1469P.txt file - cDNA_ID_2711538; gDNA_ID_2214532; Annot_ID_134304
tttcaagtggttaggattcagccctaaagcttctgataaaagctcaaagattagttcccctagtttcatcactcgtttcgcatattccaacatgatttccctaaaacattcacacaactagataagtcttctttctttctttctttcttctatagactaagaaataaaggaaatttgtatttcgtacccacaaatatctggtaagtcctctgtttctggaacatcaggagccataaagcaactcaaggtatctctccagttcgctgaaggagagctataaagatcaaaattactgttatacttaactgttttggtgacgtcacgagtataaaactttttcctaacgtctgagtcttgctcatgaaacccacgaatcccatctttcatcttctccataacatcattactaatcccatggttaatcacctggaaaaacccgaatctctcaaccgcgtctctgatcatcgcgatgacgctctctcgcgtgactgtgtactcgtcgaacacgcctcctttaagatcgattgttggtataaccatcgttgtagaggaaagaagtagatttgagtcggttaaattaagatgtggatgatggaagatacgtgggatctgagtaactccggcgtctaggagaccttttacgccgatcttcaactcgtcaaaagcttttacctcactagcacgatcgtatgttgcttccatcttcttcttcctttgtgtcaagaaacagaacaaagagaaaacgttttctaagacaataggtatctgcctactactgttgaaatttggtacctctgtgtatattataatagaaaatgaggtaatcgaataaaagtcaatggaattaaatttttctgattagccaatagatgagaaaaggcaaaaagattcttcgctcaagtctatatggctctgttcactgtcggaaaatgagtgaatttgaaacggcagctgtttcttttcatccaagtagctgccgggaaaagaaaagaaaaaagctcaggtaacttgtgggtcttgcttgagactcacggagttttcacctatctttcaatagttgactttttcactaaataacaaaactgttttaaaatagtaactaagtggagatgcggggtatcgatccccgtacctctcgcatgctaagcgagcgctctaccatttgagctacatccccacgatgactatttattaaaatattacaatatttaatactttcaacgtgtaactgatgcaaaatacgagcggtgtgtgttgaaaagggactaatgattgagagaattggagataatgactaacgatattaatagagaaatcagaaactaaagtcggatactatctaatcagtaaagtagagatgtgtgtgattgactaaattttagaatagttatgttggaaagagaataaagaaaagttaggaggatctagggtaaaattttcagtttgtattaagtaaaataagtttttactcttactatctcaattggagggatttttttttctttctttcagctgattagtgtagtatacatcaagctaaaacaaaagtaatttgtttttcaatccactattgttacgtcaatagacattaatagttacactctacatgtcatgaatttttgtcatttcatgtatagcttccatttatatattaaaaaaaaaaaacatattagaagaagtaaatacctaatagataatctttactttgtttattatttatgattggtgtattcagcttataaaataattaatatgcatcatatttgtttttacaaaaagtacattgaatatcatatgatttttagttttttttttttttttcatttaccctcgatcttacaacaaataataagtccagtcatacgcacctaccaaaagaaccaattgaggcatgtggttcagtggttagctaaacggatgggctcattctctcacgttttattttggctccacctacccacttcaaaccactaaccatctttgtttcattctctacgtctttccttcatttgattttccttttctcataaaaaaaacaaagcatcatcaatcaattttatttttattatgggatccctttttattatattcaacgaaacctagttctttttcttaaacgtcaaaaacaatgagttcttttactaattgactgtttgagtttagaatctagttttgaacccaaaaaatgatacttatataacttcatggaaaactttgattctaaatattgtatgtagaagtatcctcaatatacaaagtagatttgcattgttcgacttcaatgaaatgacatatacttctaattgagtgagatagaaatatctaaatgttttattttcatcggttgaccagatattacgacgttcttacaagagttttgaacccaaagatgggttagggtgggtgacatggatagatattgacctgtgggctctggccaatcaactccgacaagatagaaatatctaagttattattatttggtaacaaaattgtatattatccacacaagagtagcaaataatttgtgttctacaaaatggtgacaatattcattttcaaagtaacaactaacaagtgttcagttcacatttttaaaaatcaacattcaaaaaaataaaattcaacagattgagattttgatttcatacaacattaaaattcttaatatagaaaataaaaattatatgcaaagaggataagtaatattaatgttggaaaatcagttttcaataccagtaatattttatgtaattagttttccgaaatagttatatctgataaattttgtcataatttttttgattgtatggatttgataataacacacgtttccaccaatcaacaacggaaacgcaacgccacgttccgccacgagtcgcgattctctctcactctctctcccatctttctctataaaacttgtgtcgtggacactcttaaaacttcactcaacaaagcttaaccataaactgtgagtaaaaaagagaagaaagaaaaatg

SEQ ID NO: 26222 - DNA, 3003 bp, Unknown; identical to SEQ ID NO: 26221
  misc_feature (1)..( 3003): 2750-1469P.txt file - cDNA_ID_2711538; gDNA_ID_2214532; Annot_ID_184964

SEQ ID NO: 26223 - DNA, 3000 bp, Unknown; identical to SEQ ID NO: 12153
  misc_feature (1)..( 3000): 2750-1469P.txt file - cDNA_ID_2711553; gDNA_ID_2214534; Annot_ID_134348

SEQ ID NO: 26224 - DNA, 3000 bp, Unknown; identical to SEQ ID NO: 12151
  misc_feature (1)..( 3000): 2750-1469P.txt file - cDNA_ID_2711567; gDNA_ID_2214534; Annot_ID_134339

SEQ ID NO: 26225 - DNA, 3003 bp, Unknown
  misc_feature (1)..( 3003): 2750-1469P.txt file - cDNA_ID_2711582; gDNA_ID_2214536; Annot_ID_134396
gagttacgtatgtttcttttcttctgcatctagttttttttttgcatattcatcaccttctctcagttttcttctttcaatagaattatccagaaaacttttaagagatggcagctccgattcgattctttgaactgaacactggtgccaagttaccttgcgtcggtctaggaacctacgcaatggtcgcgacagcgatcgaacaggcgattaaggtatcaccttcggatcaaacttcgaccttattattatgccattggatataaaatttaactttgacacttttcttgtcgattattttagattggttacaggcatatcgactgtgcttcgatttacggaaacgagaaagaggtaaatttgctatctacaatatattttaatttatctctctttaaccatagatgtcatttgactggtcatcaaatgtattctctacaagagtgtatatttattatagtttttgagggtcatggtggaacaagaatctcacagtaagtgtagcctctatgcttctaatgaaagagttttttttttggtatgatgcttctaatgaaaaaggtatatgaatgtttagtttgtgggaactaaatgtgttctgctttcttcctattttcgttgttctcacactatgattgatttccatttattagattggtggtgtgttgaagaagctgataggtgatggttttgtgaagcgtgaggagttatttatcacttccaaactctggttggtgttctgtttctaccaagattctctctggtctgcactgcacacacacacacatgttcatgttttttgttttgttctgtaggagcaatgatcatttacctgaagatgtgcctaaggcactggaaaaaacgttacaggacttacagattgactatgttgatttatatctggtacataacttatagcaaatgaatcttgtttacgtgtaattttttccattttgatgtgtttttgcttttgttgaagatacattggcctgcgagcttgaagaaggaatcactaatgccaacacctgagatgctcacaaaacctgatataactagcacatggaaagcaatggaagctctctatgactctggaaaagctcgagcaatcggtgtaagcaatttctcgtcgaagaagcttacagatcttcttaacgtggcacgtgtaaccccggctgttaaccaagttgaatgtcacccagtttggcagcaacaaggtcttcatgagttatgcaaatccaaaggagttcacttatctgtgagtatacttacaaattccaaaatttactctgtttttgcaagtatgaattaacgaagatgccttttcatctgttttggattgatgatagggttactctcctttgggttcccaaagtaagggagaagtcaggctaaaggttcttcaaaacccgattgttaccgaggttgctgagaaacttggaaagaccaccgcccaagtggctctccgttggggactccaaactggtcatagtgttctaccaaagagctcgagcggggctcggctcaaggagaatcttgatgtttttgactggtccataccggaagatctgtttaccaagttctctaacattccccaggcaagttctttcatctttctttttttttctcgatgaatcaaacgacaatttcggtttggtttcttgtcattattgatcttccctcctcttcaccatcttgttttcctcgaccccatcatgttgattatagatcgtcaaataatggattttaccaatccctataaatcttgcaggagaagttttgccgagctactgagtttgcgcatgagacacacggcttctataagaccattgaggaattgtgggacggtgaaatttgagataatgtccctcctttctacttgtttaaccataaaccattaaggacattgaaataaatatgttatctttttatatttaatctttctatgagaaaacactaaacacatgcttgggatttcatgatgtttggcaaatgttgttattctgcattcttcaaacaataaaatgttttcaactagttacaacttcaacatgacatagtcgatagaacctaagactatttccttagttcgcgtcgggaattttctacataccgcaaaaaaatacgtgtatgataaaaagtaaaattcaaaccttatttcaagactagggaattgccttcttctttttgattctataacctacttactgaatccaaggatcttgatcaaattagttatttctcatgaaaacttacattaacatttccttaaataaataaaaacttacattaacaatttaaaacatccattgtgaagggccggaatgaagcattatagtaagtgttcccaattattctccaattttttctcttcaaaatgaattactacaagctctcaaccgtcgattctgcatttcgctcggcgcaatatatatgcgttcacccaaaaacgtgttacttggacgttcacactcgagataatctaaatgaactcatatacactcgagatgttatataaactcatctacaattttgttgttgttgtaaaaccacataatttttcttatcacaaagatttttgaaaaaccaatcacaatgtataatattctactattgctacattatttatgaaatatataaaacttttttcataatatgaaatgaattataaatcatgtacgaattgtcttggttgtttgagagttctgtcttctgtgatacgtgtgaattgtggacacaaaaaagtgtcagtcacactcgagattagcaaagaggaaatctaaatgaacgaatttaactcagatacgtccaccgtccattggtccatgtaatgatcaatatctgacgtgacaatatactaactaagaaagtactagtattacagaaagaagaaatcaatttggccacgaatctcccgcctctgtcgctctctcacttcttctcaccctttaatagctagtgccgagtgcagtgtgcgttgaacaaccaccaccacatctgataatg

SEQ ID NO: 26226 - DNA, 3003 bp, Unknown
  misc_feature (1)..( 3003): 2750-1469P.txt file - cDNA_ID_2711585; gDNA_ID_2214536; Annot_ID_134395
tggctacccgcaaatgaacgtaatatttttccttgaatatacagtaatttatagtattgtaattaatgtagtacatatatctgttttaatttttttttgaaaccaattataaatatcctcacggtaaaatggattatatatatatatatatatatatatttgctaaatgaaatatcatttcaagaatttagtttattagaaatattttattaaatgaaatataatagtttattattaaactaaattgtttcatttaaccaaaatattttctatgatgctatttcatccctgatttttgtgattatggatatattgttaactttataacaaaacaagagaattcaagggactgaaacgttttatgacttttaaatggatgactatatacaatggctgatccaaaaaaacaattttgggtaaggcatattcagtgagctctaggcttagcgccatatatgttacatcaaaatttattttgtagagtaaaaagctttttagaacaaaaaaacaacaccttaatttatgtctattttcgttgtaaatgtgtaatatataatacatttaatgaattacaacaaatggtaaaactcatgctgataaaatactgcaaactagttcataatcgaactcaatagaaaatagaaaaaagaatttatacttttgtaaaaaaaaaatgctactttgtttttctgttgtatcggtaaagatgagaacaacactgaccaagcgaggttttgggctttaaccatacaaggcccacatgaatacaaagtatagagtttagttgtccactaaaaacctagttctataaggagattattgccttgagaacaaaatgattttattcccaatgaacaagcaaacaagaagttcaatattttcttgtcgaactttttgtcttcatacctttacaataaagtgattaactcattacaaataaattgtgaggaatactagaaacttggatttattgacatatgtttattgttttagacattttatcttcatttgtaacatcgtgataatgacacatgttctagtttttttttttttttttttttggacaaacagatgttctagttttatctatcaaatttgaggagaaaatattttagtgttacaaaaatatatagaaaggtcttttgtttttcaatgttactgttaaccttaaagtcaagtttcaatcagataaagaactatatgatataatcacagtcatcatacaggcagatgaagataaccattaaatcaagacgatagtcaatcatactcaattggcttcttcaataccaacggattaattaattcctcaatagctaatatatatctttttaatattttgactatacccaaatagtttagtgggcacaatttcgtaaccttctcttatttttttacacctcaaacagtcaaacgtcatcatatatataacaaatcttttgacatcatacgttattttctataataatccaaacacatcccccacctttataaatatattatgatacacttcccattattcaaagattttatagcacaattttgttttttaaaagcaattaattaactactatagtatactttactaacaacatttgaaaaaatatacaaaaattaaaattttatcattatcaaagcagtccagctgcataccattatcaaaattggatgtggataaacttaatttgataaatttctgtataacttaacaaatattaaatatgtgttaatagttatgtcaacttatgttgaagataaatccattggaccggccgtggtttttatattagtttgaatgtagctttcagattcttcctatacccaaatttcacattcaaaggttgcttatctttttaacattcaaactcatttaatatttaaatacactaactaatgacgtgagaaaacttatggatgcagcaacaaatcataagacgccacgtgacaatcttgatcgctctataaaaaaccaaacctgctcttctttggtcgctacagcaaaaataacaataaacaagataaatggagggtctaattccgttagtatacaaagccgtcatgcaaatccgttacggtaacgagtcgcagcaactttcttcttcttactacgttcgtcttcccggtgattcgggtcggtttgtaagatccgatttagatgtatcgggtcctggatctaattcctccaatagggcgtcgtcgtcgacaagcacaactacgtttgctgtttacgcgggagtccagtcacctgtttctcgtcaggttgtcacgtgattcacacgcgctttttgaaggaacctgaagttgcgtgtgagggaagggttcgtgacttttgttttgtgcgttttttttttgtaagttaggcttggaccggtttaataaacctgatgtaataattcggtttggaaaattgatttctctaagcgtagactttaacccaaaagggtggtctcgtggcttttgatttgtcaattgtgtgttttcttttaattgtataaagtttctatgaatatatttagtttattcgagaacaattgtatgaaatgtttagttaatgttttcatggtatataggttgtaaaacaggttaattacgttacaatttcctagttttggtattaatatgcaaaaatgacataatatcaaacttttaagtaaattgatatttttcactaatgttaataatgaaaccaactaacaaaaaaaaaaaagaacaaaccaatttctatttgtttaagactttgacagtacatcacttttagaaataaatgccataattatgttatgtgcacactgcaaaagaaaatgaatacgcacaattgactataaagaaaacgcctttagtggccatacgatttttagcattttatgcggaagaaacaaagtgctatttctccgagttacgtatgtttcttttcttctgcatctagttttttttttgcatattcatcaccttctctcagttttcttctttcaatagaattatccagaaaacttttaagagatg

SEQ ID NO: 26227 - DNA, 3003 bp, Unknown
  misc_feature (1)..( 3003): 2750-1469P.txt file - cDNA_ID_2711609; gDNA_ID_2214536; Annot_ID_134377
aacttttatgattccatgtgtgagagtgttcctccaggagactttaacgctgttcaaatccacaaaaggaaggctgattatgatcaagtagccttcttcgtcctcatagatcgtttttgcagcagtaacaggtccataaacgtttttcatggccccagtaaactcgtttgaccaagtaggtagctcattctggtgagcttcgataacaggaggttgtgggtttacagttaagcaacactcctcctcatgaatcccatttgagaacaagtccttcctcttcttgtggctcgaaggagataaatcggttgcttcaccattagaatggttggatggttgagtcgagagattgagccccgagccattgagtagtttcttagagtggtttgcagtaggattcttcaaagaaggtgtaggcctctcaagctcaaagtcagtgttgggaaggtttctccaagaaccaaagtcactagcttcaggtggaatggtgaaattcaaatcacgacccgtaagctccatccaccttttcctctcttcttcatctagacacgtgaggtttggcaaaggaacaagctcaatcccatgaacgcactgcggattcgacaaacctctgtagtgtttcctctgcattctgtgagacctaacaaaccctttctcaacactaaatggaaacaaacgatccccttgtctagaatgaccattcatgtaactcctcaactgcatcttccctagtgcattctcaggtctttccttaaacacccacatatacatattctccatatcatgctgaactaaaaacacatcaagcttcaaatccgacttgtcaaaaccagatatcccattactatcccggacgattttcgcctttgatttctcgtttaacgcaggcttgaagtagaaactgaagaaaaaccaagcaccccagatactatcaacacgtttagcacatttcctcccaaccttaggtacaacactcatgtaattctcagtctcataagcttgtgaacctaacccaacatccaaaatatcacaagcatctaaattccacggcggaggaggaggacttctctcagctgagagaggtaaattgatatcaggagggccagagagcagagattgcctgttgttattcatctccaaatcaagctcctcatgagaagaagcacttgaatccatagacaatagagtagaaggatgatgattctccatagccaagacgttaaaacaaagtatctaccaccatctcagctcacaccagagacaagtctcatagccaataaccataacaacacttgtaattctcatcttcctctcccaaagttaaacacttgctaagaagaaccaaaccacttacagatatatctaacccctattttcccaattccaaattctccaattgttaacttctagattctaataaacaccaaaaaaaaacgaaactttgaagaagatatgaaaaaaggagcactctttttttgccttaagcacagataaacccagaaagaggagaaagctaagatgagcacgatgcagatggtatcgtcatcatcattagcaaacaaaatcgaatcgattactcagtctctgtggcttcgccaacacaacaaatcttgatttttcttcttcttcctctttttttttctgtagagagagagagaagaagatacggacccgacggagaaaacgcctgccctggatggaaccgtggagacttcctccgttacttaacggtgacgatgtttttttttttttttaataagaaacgatgattgtatattggtcgcttctcttgcttcgtataacagttttttctattaattatgaaatatgttaaatttttggtgataagaaagcatataaaagattgatttttcagccaacgttgtttggatttgtggtaaataaagaacaacaacatatttgtgtctacatcattactctaaagtgtctttatctttgtggtgaattgtatgtttcttatcacattttcttccatcaaacaacacttcatgaaatttgattattctggatttcttttttagaacatgtaattcatgtgactatttatgtggttagagtctctactatattttggagtatcccttaggtcttagctgtacatgactacatcatgttaccttggatagagatagctagagttttagatataaacattgtataatctttttatatgattctgataccgatcataaaccaattatgagaagtagcaaaaaaataaaattatctagtgattatatccatcattttaaaatttaaatcttcatttatgatcaaattagggcaaagatcttcactctcttttttttgtcaataaagatcttcaccctctttagtttcaaaactctcatgtaaaaccaaaatttagatatgagaatcgtgtaccgctaaaatccatcgttagtctccaatatacctcaaagctgaaaaaatcactggcccattgagtttacgacccaaaccaagagtcccaggtaaataaataaccaaggtggaataaagaataaaaatcatttttggtgacaccgacaaagcaccaaatttccaaccactacttccatgtacccatcataacaaaacaccaaagaagatcctacttcatatctcactcattcatttattaataccaaaattaattatacatgatattttgattacgaagacatgctgaatgaaagaaatatactatattgttttacaaaaagaaagaaaaaagactttaaaaagagttatgtaataccgaaagtgattgttgcatttgagattatcaaattatacactgaatactacttaattatcgttacaaataacatttggaagacctattggccggttttatttttgaatattccactcagtttaacaaatatataattttgacctttcgccggagaaaaaacaaaccaaacttacttagtaagaagcactttccattattattatctctgttcccccaccacatttcatattcacataataataatg

SEQ ID NO: 26228 - DNA, 3000 bp, Unknown; identical to SEQ ID NO: 12216
  misc_feature (1)..( 3000): 2750-1469P.txt file - cDNA_ID_2711616; gDNA_ID_2214537; Annot_ID_134413

SEQ ID NO: 26229 - DNA, 3000 bp, Unknown; identical to SEQ ID NO: 12212
  misc_feature (1)..( 3000): 2750-1469P.txt file - cDNA_ID_2711624; gDNA_ID_2214537; Annot_ID_134408

SEQ ID NO: 26230 - DNA, 3000 bp, Unknown; identical to SEQ ID NO: 12208
  misc_feature (1)..( 3000): 2750-1469P.txt file - cDNA_ID_2711636; gDNA_ID_2214537; Annot_ID_134403

SEQ ID NO: 26231 - DNA, 3003 bp, Unknown
  misc_feature (1)..( 3003): 2750-1469P.txt file - cDNA_ID_2711640; gDNA_ID_2214537; Annot_ID_134402
aggaaaggaaaaaaggctggtgtcgtgcaaattagagtacgggcaaaaggatttaatagttgactttgcatttaatcatatgttcgaatagctagcacatgcctttctccacgtgatattagcttaaacagtgccgttaattaaaatattcgtcatagcatttacttgttgtcaacattcgataatattagctataaccagtgtttttacgcccgaccggttaacctgtgacccgaacacttttccggtttgggtttagtgctaaaacccaacaagttcaaaatcgaaaaaacccacaaaaactcgcaattaacccgtgacccggtgaaccggttgaaccggccgggtgtgggttttaaaaagttctcttgattttacaataaaatatgggattttagactttattcaattatttttaaaagttttttcagttcttaaattcatttgatattttagattttggtgaagactttacaataccgccttaaaattgaatcgaatggtgagagagacaaccgagattagttgtttgaattcacgatgttttattaatttatttctgtcattgatgatctcttaatatatttgttacggtgttagacatttagttggatttcaaatttttaaccactttattattattgtttgattttttctatatatttgggtataaataattttatattttattaaacataatataattttatatttgattaaatatgatatgattatttttgttttatatttataaatactaaattttttttatataaaatactctaaaatttctattaatattaaatttattaaataaattttaactaattaatccgtggtccaacccggttgacccgatgacccggtgacccagaatgtagtccggttcatcgtccgggtcgggtttcaaaacatgttgtttcgattttgtaggattggattcaattgtttataaggtagttccaagggaccaaacactaaatcaaatctttgatgttatatgatttgcctaaattacatgaagttatacatggagtaagtgattcgcctaaactactttacatatgatgttaaaattaaatgattcaagttggatgacaatatttagtcgaaacagtagttatcactggtattttctctgttccaagttatttgatgttttgagttttgttatttgtttgatgttttggaaaactatcattatttttttgtaaccaatagtgaaaggagagaagtaaaattaatattattaaattaagccaaatattaatcatcataaattcaaaggtgactaattaggtagactcctttctgtttttaccctcttgattttattttttatttttttgttaagagaggatgagctcaactttctaaagcatatattgtaaaaaaaaaaaatcatgatggaaagactcgaattcttattcttcaattcttatcttcaacttaaccactagctaatagatcacggtaaattaataaattgattgtttttttttttgggtcaaatgtaatttgattgttcatttttaacactttatgcattaaaaataaattactgataagagaaaccaaaacattactagtgcgcaatataaaacctgaatactactcaacatattcataaatttccaataaccacattatgatagtagtcaacatttctcaaattgctcgcctaagtgcgtttacccatactttcattgaaaaaatggtttgttcagtcatcagtgtatgtataaagtacagatatcaaacacgagtttgtgaataatgttggtgcgttccgaatttaccgtgaaacgaacgcaccaaacgtggtcatatatattgttgatagtcgaattaaaaacttatttaacgtcaagtctccgattatgtgcttaattaaggttacgatctgtacattaaacgccaacgagaaactacgtaatagcatgtgagcattgaattaagaattaaacaaaatcaagtgtttaaagataataatataagaaaatcacacacaggatcacacaagatttagggcaagcttaaagagagaacaatgtttggaagggagagaacatcggcttgtgttaagtgggtcaagtagatactgtcttctctgtcttttactccaactcatattcatacatgatacatgcataaaattatttataatacatttatacaaaccacttgtcttttttttttttgatatgtaattgagttacaggttgttcttacatatttttgatttaatatatatatatcaataagacaaataaaattctcgattattaggaaataatataatgaacatttgatttaatttcacacataggtgggttgtgtccggtcgtcacgggacgagttagaagaatcgtaggttttgtaggctaaacatgccgcagattgcagactgtagaagtcattgtttcatacaaaattgcagaccagaccagaccgtgaaccttttgtatttgataataattgaagtacagatgttaaataatatattgtctatgctatatttaacttctataaagcgataaacaatgtaagacatatatatgtttatcaatataaaggtgataaaatatattattcggtttgatatgtttgtgaatgtccaacatatatcataatcatactattaatcaaagcgtatacgttttatgatttggtttagttggaatggttagggtttactatggtttggttacatattactcttttaattgttttgtttggtttagaaattgggccgataggcccgatactgccatattcttactgctttgacccatttatatatgagtgtcaaaattttcaaccttatcgcgacgactctttgaagcttccgttgctgacgtggatcactcctctccgccacaaaaacaaaacagaaaaacaaactcagacatgagcaagagctagccgtcactctcactctctgatgtctcacgaattccgatttcaattctaacttaaaccatatttctccgatcaaacatg

SEQ ID NO: 26232 - DNA, 1864 bp, Unknown; identical to SEQ ID NO: 12229
  misc_feature (1)..( 1864): 2750-1469P.txt file - cDNA_ID_2711648; gDNA_ID_2214537; Annot_ID_134397

SEQ ID NO: 26233 - DNA, 3000 bp, Unknown; identical to SEQ ID NO: 12237
  misc_feature (1)..( 3000): 2750-1469P.txt file - cDNA_ID_2711656; gDNA_ID_2214538; Annot_ID_134427

SEQ ID NO: 26234 - DNA, 3003 bp, Unknown
  misc_feature (1)..( 3003): 2750-1469P.txt file - cDNA_ID_2711660; gDNA_ID_2214538; Annot_ID_134425
atatatttatataaatatatccatattaattcctattttatttgtaatcatattttgtcgtgcgtgcaaggatcgtctctagtacaagaattatctcgaaaagtttgcaatcaggagtataaagacaatatcatatttggcaaccccaattctcctcttatgatcaacaaaaaagtttctctaaagatgtctaaatttaaacaattactatgctttaaggaaaataggaagagactaatattaactttccgtggcaaagtagaaaaatatataatagagaacctaaaggaaatttttgaagaagtcacatgtaatacaaatataacaatttggctctactgtatgatggaaagagatggttgacatataattttttattttattttattaacaattattgaaaggtgaatgttttaaaggctcaaaattttaaacttgaattttgttttaatagcaaaaaaaaaatatgaaaactgaatcattttattctgtataaaaaaatattattcttttttacatagattactagattctgacccgcacgttcgtgcgagatttcatattttaagaaatgtgttgtataaaatttatattcaatatagttttttttgtttttgtcatatatattgtagtatatatattataatatatatatatatataaacaaaattatcgattgttatttatgtttgtttatgacataatagctaatattgtgaactataagtcaaattctggagtttaaactgaaaagtagattagaaatatcttagatggaaaattatgctaggttataatgatgtcaagtatttttatataaaaaattatggttagagaattgcaatagaaatttgtgttatcgatggtgaaacacaagttaattttgataatgttgatttttcaaaattttaatggtatgtgtgaactaagaatttgtgttagcatgttaaaatatttaaataccgatgcattttttgtatatgtgttttgggctatatttaattggctgcttgtaaatccgtgttttgccaaagtaacttaaacaaataatggcaaagagaaaactctaatatcagtaaacatattatctatagttggtccatgtagaatttgtaaattgttttgtaagtatggattcgagtgcaaagctgagctaagtcctgttttctatcattgtatgttgaatttgttttatgcatatgtatagttagaattctctgatttaaatgattcttgttatgtcaattaacaaatccgcataatatgcttcattttgaaggatagcaatctttaaattttaattaaaatagaaatatttgaattaatgctagaattattttctagatatttaaaaatctaaaatccaaaaagtatttgttgaatatgctatattttaaatttaaatgatggtagtttagattatatatgataaatataataaatgttttttcatatttggaaaatcaagaaatcgttttttcaatgtgtaccaatcaaaattaatcagtttagttttattatggaaatttttaaaaatctaaactaaatgttatttgttattaaattgtattgttgttttcaaaaatatctaataaattattaccaaaataaataagtttacgtatatacgatttcgaattaagtagtttgatttgttatggaaactttattaaacgatttacaaaaagtattgggtagttttttttttttgtcgatattgggtagttattcatttattgatttaatttcggatttgttttttttttttttaattccaagatccgcttgtttatccgaatcactacatttggtattttattcccatatatttatagaaatgtattggaataaattcatattttttcctttaaatataattttggatttgtgttttttttactaataatttaacgtttatataatatattaaaggaaaaaacaaataagatcgtgtatctctaaacatattacgatttgatcaaaaacaaaatattggatagaatgtatgtcttttggttatgtacttaatttgatatagttggtaaataagaaaatatcagaatattctaatatatttataacattaatattattgttaaaatatatttaacattattctaatatatttatagattttattgttaaaatatttggtatttttcaattaatggtatttgatttatgttgaatttttttgtttaatctctaacaaattgaaaaatacaaaatatttcgatttatattcaaaataaatatattgatcctgaatattcagttatcatttaatatttaatgttatttcctttttttatttttgtagacaaatcataccaaaaatattgacgaaacaaatctgagaatatattagattatttaatctcgttatttgttttttcaaaaaaaaataaaagaaggatccgaatcaaagatattcatttaattgatatatttgttaatttattaaattatccatgcaaaaaatcatttagttagtattaaaagaaattttcacaaaagtggacgaaaaaagatttgtactcaccgtttgtcaaagtgagaactggtttttacgttttgtcttttcattcaatttcggacaaaattaccctggaaaaacttaataatggcacaaaccaaaccgtgcagcagttcgtatcggttaagttgacggcgtaaaccaaaccctacagcagtttgtttcggtttagttgatgcggttcagttttgaaaaagacaaaaaaaaaaaactgaaacgaagaaaccgagaaaacgaaaaagagaataacggagagatttgagagagaatcaaaaagcgaaacgaaattcagtatccattgcttcaaaattcgacataacttcgaattgttgggtagttgaattgagccactgaactcccacatccggtgaagtgaaagttactgtttttcccggcgaagccaagagaaagttactgttttttccggcgaaatttgaacctccggcgagatagcatctttagctatg

SEQ ID NO: 26235 - DNA, 3000 bp, Unknown; identical to SEQ ID NO: 12251
  misc_feature (1)..( 3000): 2750-1469P.txt file - cDNA_ID_2711674; gDNA_ID_2214539; Annot_ID_134446

SEQ ID NO: 26236 - DNA, 3000 bp, Unknown; identical to SEQ ID NO: 12263
  misc_feature (1)..( 3000): 2750-1469P.txt file - cDNA_ID_2711678; gDNA_ID_2214539; Annot_ID_134445

SEQ ID NO: 26237 - DNA, 3000 bp, Unknown; identical to SEQ ID NO: 12252
  misc_feature (1)..( 3000): 2750-1469P.txt file - cDNA_ID_2711678; gDNA_ID_2214539; Annot_ID_185192

SEQ ID NO: 26238 - DNA, 3003 bp, Unknown
  misc_feature (1)..( 3003): 2750-1469P.txt file - cDNA_ID_2711682; gDNA_ID_2214539; Annot_ID_134444
ctaaattatttcaacattaaccaaaaaacaacattcatcaagaaattatgcaataaacaaattcataagaaaaccaaatagaaaatagttggatacttggatgattagaaaatcaaaattgaactatacgtatcaaaacgtttgtttatttgtcaatcctcttattaatgagcttagactcaaattccagaccaacgacgagtacataaagtaagtaattgatggcaaagatttctgaacaggcctactctctatacgataaacatgacggcccaatcatcgccaaggcctaaacctctcaaaccttagaatgaacgaaaataaatcaaattttttatttaatatatgagaacaaaagggtattcaacaaaattgcaagaatttgggtccgttacaaaactatattggttcatgtaactgtagtactgtattggtcacccgttaacaatattatcccccaaatttcaacagatcagtgagatatcaatatgagaaatcagaagaagaaaaaaaaacacacaaccataattaagattaacgaaatggagaaatatatataccttggctgaagacgtttagaggaaaatgaaaacgatggagtttggtatcaaacagtgaagattgaaattttgattctgaatgcacgtttatgtgatttctatggctttttataagctactactcttagaatatgtctaatctcatttgaccaaaatatccctctcttttgtattcaacgtttttcacttttcttagtaaagaaaacatcattgtctttcttaaaaaaattagatcattttccttagtgctgcaagtcaaatttaacaaggaaatataattcaataacattcaaaaagtaaggaaatcacaattttcttgtgacttaactttttaaagtttaaagtaaaaaatctaataataatatttatcaagaataaaaaatctaaaaataataagaaaacatttaacataaactagacatatactttagatctaaagaaaatatacaaatatcacttttgattacatttacatgtattaaggaaatagaaccattaattttgctcttaactattatttttaaatattcacatatagattttgtttttccttaattcagataatacagcgcggacaacagtcaaaagtattagtaaataacttactaatgacacataacttttgtttaacttaaatttttaaaatatgatgatatcactagtcaaaattgagataatttactactaaatacgcaaaagaaattacttaatttatagggatttagtacctagtaagtcattactagtcaaaataaagataataaattactgaaaatctttgttctaaaacatggccatggagaccgaggtctctagacgtcggaaagcatgagatggtttgaagccgccgcgatgtaacataacttattattttttgtttgttacatgttagaaactcacttttctatatggatcaacaatatttgagtgcaaaaaatcaaagaatatgaaaataaatattacaaaaaattcgtagcgaccataaattaggtttggaggattagtattcataagaagaagatggatactaaatgaccaatataccattcttcgaagataaattgaaaaaatttcaaactgttgattgttgaatttgagattcgaacctgtcacctctgacatgatatattaaacaaaccactacagcaaacaaaagtatcttgaatctacagtaaaacctctataaattaatacacgataaattaataacctctacaaattaataaattcttccggtcccgagttgggatcagtgtaaaaattgatacaaatcgataaattaataagataatattttttttgaaaatcctatgtaaatatatggtcccatcaatattataaattaataattgtataaattatgaatatatatatatatatatatatttatatttatgaatatatcatgtaaaacttagtaaaatatgactttagtattgtttttctttaatttatattaattctttgtaaaatttaattctaataattttactacgtataaaaaagttttttttcttaaatctaataatggttttctacttgtaattgatttttagaaaaattattgattgtatagagaaactaccttttagatcaaatttttgtaaaaaattacaaaatttgtaaaatatctccataaattaataattattaatttatcgataaattaatattttctctaaattaataaattttcttggtctcgacattattaatttatagaggttttactgtatatattattatatttctaacctaatcccagattgatgtttagcggtatttaaaatcaggctaaaaacacatattttttactagaatataaaatagataatattgtgctgatgctaatcaaaattaaaaggtaacaaattattaaagacatatatttaacttaatttaaatgtacatctgcggtgctagcactagtttatataataagaacaaaaaacctaatgatttaatttgaaaaataaatttaagaatatgaccttcgagttctaagaaaattagcttgttaatattttttttattagaaatgaaaatttatcttagaataaaaatctcctcaatatctattttcaacctctttcaaagatttgaaaatattttttttttaatattagtaaataaaactaattaaataaaattagaaatcaaattgattttacttaaaaacactttaaagtttaaacctctaatctagcttttatttttgtaccgccattaaaaaataacgaacccaaaccgaactcaaacccagacccaaacccatgcccatacacaaatcacgaatgcctaggcttacttgtgaccgaaaccgaattgaatcatatatagtttcaggtcacctgttgcacaatctctgctcagccctaaaagcttactcctttcaactttctggaggccttctcgtagcctagcgtcatagatggatttgatg

SEQ ID NO: 26239 - DNA, 3000 bp, Unknown; identical to SEQ ID NO: 12253
  misc_feature (1)..( 3000): 2750-1469P.txt file - cDNA_ID_2711691; gDNA_ID_2214539; Annot_ID_134441

SEQ ID NO: 26240 - DNA, 3003 bp, Unknown
  misc_feature (1)..( 3003): 2750-1469P.txt file - cDNA_ID_2711695; gDNA_ID_2214539; Annot_ID_134440
atacatctgtaccacctcccctggaggataaggcttgtaagtggaatgcacttcatcgtcacatagttggggcaaagatatccagggaataaacgcattgagtaagttttggtccatgtctcttcttgtgtatcaatgtccatatggctaatttccaatcagaaagttcagcactgccactaaccatggctagaagatcttcaaggttgactagcggccaggtgtaggtaatgcgcgcggtcttgggacacatcatggaactgttcagtgtgaagatccaaagatagaatcttgtaaccattaagtacttcgaaccagtagatggaaccattcacaaagaccgaatgatgtctggcttcgacatagtaaggaggcggactcggcattgtccgccattcaccaatgtttaaatcgagaagttgtgcttgatctcggtttagttggatgagccacgaatgctaggcaatgcgtagggcattgaatatcatttggagtgaaggttttgaatccctcaggcagcttgtgaaagagcttccgtttagcgaagttatataaccaagacattcatgttgcttttcctttatgggctatgtatatcacggtttttccagtttcccggtttttcaaaatcgttatcattgcatctcgacaccgataagattcatagcttaaagttttgtcgatgcactgaagtttgagttgtttttgctttcatgtttactttggacctttaaaactggttttgcaatctgtaaaatctgtaaacgtacactgattaatgatatttacattcttagaaaagaaaaatgaatcatcagcccatgtgaacatatcgaacaatgtagcactttctcaaagccaacacaaccgcccgcttagcttacattagatagatcaggcagcctttcatatgtaaagataagtggcggagaaaccagccatcaactattgattagtcaacatcttatcttctatcattagctatttacgatttaatatctacttgacatgtaaaagactaactcttcaccagttcactataaatagaggttgatattgtgcttatatcttcacactacacacaaatacatacaaacatacattaattggaaactgaaagtaatataatcatggctaagtctgctgccatcatcactttcctcttcgctgctcttgttctctttgctgcttttggtgagtaatgatcttataatattatatgcatgaaaaaataaattctgaattttcctctttagatttattggtaattaacaagatatttatatatgaatgcagaagcaccgataatggtggaagcacagaagttgtgcgagaagccaagtggtacttggtcaggagtttgcggaaacagcaatgcgtgcaagaatcagtgcattaaccttgagggggcaaaacatggatcttgcaactatgtcttcccagctcacaagtgtatctgttacttcccatgttaagctaccaatgactaccaattatacttggtgcttcatggtgtgtattttacataaaataagtctttgtcattctatgagtgactttattatgacatgcatgtttatgttttagtgtttcgtttgctttgttgttgttttctttttttcgtttgctttggttttataataaaaataaaagaattatgtacgaagttttttcttcttctatcaatatttgtcacgttagatcattaggtgaaactaaaccccaatttattgtttgatcagactaccaaattcaagcttgacaaatgaaatattaattgagactttgaattatatatacggtaagaaactagagatttaaattacctttttatagcatatgttctaatattgtcttgctagcaagtaacaataatagcaaacataaaatgcatataaaaacatgattgggaatttgggatgaagcaagaaaaatatataaaaagattgaataaaaatgataaagataagagaattaaatctcaaacggaagtgacgagaatgttatatatgggacaatgggacgagcattacatacatcaggcatcgataacagtttgtttcatgtctccgaatagtatttatactacatacgactgtttcatcggatccatatttgtttgaatttccataactaagaactactcacaatatatatatatatatatatatatatatatatatatagcattttgcctatgtaccctaaattcatagccacgaccaacaatggtttgtttatacatagcaacttagctagtttgaaaatttaccaccggcgcaagagattgatgaatcatccaattttcgattataggtgtttcctggtaaaatgtaaatgggaaacttcgacagcatgcagtttcttattctgaaaacttggttgaacgatgctgctcttgagatcaaccaaaccatgtcgatagtcccttatgttgtatgtctaggggtgatgctcaaatcggaaaattttgaccgcttagttttatcttgttcatatatatagttttcacctttcaaaaattttgcacaaattatgaaatagcttacactattactatcaaggtatttattcgacgaaggtcagactaccaactacacttttcctaactgtgaaaatctctgaatttaatatacttgtgtaactattggcttggttaagatcttatttcttgcatcttgtccaagtcagattaaccagccgcccatgcaaagccaaagcagccgcttaggttacattagatattgagagagaaaaatatgtggtagataaacaagccatcaactattaataagccaagatcttatcttttaatattagctcgagaaggcgtacgtggtgtgtttaatttgtggggtacaattagctcgttattgtaccatgcacaagtagaaaataaactcaccatcatttcattataaataaaggttgatctcttaagcttatttcttcacacaacacatacatacatacattgaaaacaaagtagtaataatcatcatg

SEQ ID NO: 26241 - DNA, 3003 bp, Unknown; identical to SEQ ID NO: 26240
  misc_feature (1)..( 3003): 2750-1469P.txt file - cDNA_ID_2711695; gDNA_ID_2214539; Annot_ID_185187

SEQ ID NO: 26242 - DNA, 3003 bp, Unknown
  misc_feature (1)..( 3003): 2750-1469P.txt file - cDNA_ID_2711699; gDNA_ID_2214539; Annot_ID_134438
aaaaaaaaagagttcaggtagttctatatttaacatgcttaccgtttgtgtgaaacctttacccgagacaccatgaattggtccaacaactgtttgtccagctttgacatactcaaacttgatgaattggattccttcaagaccacctcgtacatgtatctttgttacattttcatggtcggctccatcatcccattgattccctccctttccgccttttgcctccaacctttgggccatcgagaactgattcaaatcattattcaataaaagagattttattttgttccttagtcattgtataatttctttatatccattatacccacttgagaaaatatatatgcaaaatcattttcagttcttgggtgaaaaaggaagactttaaacatttaagatatttctcacgttctacaattttaagtaagttacaatacgttttacaaaaggttgtttcaaactattgagagattacctcttatgcttggagtagagagatggagagagctggtgaacaatgtagagaaatgatgtataatatataagtaggtagagaaggtgtccttttatatacacgattggtcagtttacaaattaatatggtcattttttaacttatactatgtgtgtgcatgaataaaaaagaaccagatttttttctttttcttaagtagtatattgatttgtgagttttatattagtcttgatcttaatgtacatgatagacatgcagttagacacgagtataggacgatattttaacattattagtgtcagtttactaataatggctaatactgaaccatgttctcgccattactatacaaacttcacctatataggctatatatatatagatagcttttttagtccaaaacatgtatataaattgtagaagatatgaaagtcaatgagaggttcttcagatcttgtagagatctcatctcggacgaatcacttaattaagaaggcacgtctctcaacacacctctcataaatttttctcatcgagagtcgttcgttgacgatcttaactgatttttttttccaaattagtatattgatttgtgttttggtattagtcttgattttaatgtttatgatagacacgagtatagaacaactatacaaacaataatccaaaacaaacgtttagcagtgacaataaaagctaaacgtttagcagagatgagaccgcaagttaatggccggttcgcaaagagagaaattgaaaccgaggaccaagggttcaacacgatgctaatgtacaacacatgatatcgagttgttccttctttctgatactcctatggctaaaaaatataactagaatgcaagcttacttttagtttggaactttggatgattgattatttcgtatttccgttggaccaagtttcttcagaaaaatggtgcaattgtgctatttatttggttacaaattatcttgttatagttaatgtttgtaatttaggaagtttgtaatttatgaacattgttttgtgattatatttttccgtcatatatatatatatatatatatattattttatataagttttaaaaaaattaacagagtttagatgaatatatagaaaattttagatgaacatgtatgaaaatcaatacatataaataccccaaaaaaaaacaaaaaaaaactcaagtataaaagttccggtatccacaggcccagtatctatcgtttttttttttcaggtctacctactattaaatccgatacacatcagttttttttttaatttgggcttctggtgggcgggctcaattcagattcgggctgggctgggtttttttaccaactcaacatcttcaactaaacaattacacatcggttttcttctcttctctctcacacgtcgattttgttctctctcggcgacgaagctctctctcgactcctacttctggtaagttctattagaataggaatccgttgattagaataagttctctctgaaattttcgttcatgtgatagtctcgtcgattttgttctctcagtgttgatgcaacttcatcgctttgttctttgctattcttttaattgtgattctgcatatgcttcctttgatttcagcttgtgggtttgtccaaatttcacttgtttgctattttctctctcccttcctttgatgccaaccatgtgtttgatgaaatgcctcacagaatatgtagagtttgtttttggtagagcttgtaattacttgtgtctgtttatttttggatatatgctgcttggtgtttatgtatggagctaagtgtgtgttctctaatgtttataaacgttaattcaagagatacaatctaatcgggagcattacagatacaagctaataattattgatactggattttagatactctctgtactacttgttgattccgtgtctgtgttggttatgaaagctctcacttgtgatgagatattagagatcaagtttctgttttcttgtgaatcttagatgaatttgtttattacttgtgtcttgatactttgtttgtcgaattatctctgttcaaaaaagctttgcttcgtttagcagcattattaagctcagaattcaagctttggttgctttagtttaatttgcttctaaataaactcgagatacttattgtctgtctcttgctagaaataggtttgttgtattttatatgaattaaaatacgaaataaggtgatatcttgatagaaacaggttcgttgtgttttatatgaattgaaaatcaaataagggttttgggtatgcgtaggtttgatgatctgtttggttgaattcaaattttgctgcttgagcattgtttctttgttagagggaacattgttttttatagatgttcttcattatgtactaaattctctgctgtattactttccatcctcattaactgattcgtcttattatttcatgtgcagtggatcacatcttttgttttctggagaaaaaaggctcgtcgaagcaagtaagtgaacagtcatg

SEQ ID NO: 26243 - DNA, 3003 bp, Unknown; identical to SEQ ID NO: 26242
  misc_feature (1)..( 3003): 2750-1469P.txt file - cDNA_ID_2711699; gDNA_ID_2214539; Annot_ID_185185

SEQ ID NO: 26244 - DNA, 3000 bp, Unknown; identical to SEQ ID NO: 12247
  misc_feature (1)..( 3000): 2750-1469P.txt file - cDNA_ID_2711703; gDNA_ID_2214539; Annot_ID_134436

SEQ ID NO: 26245 - DNA, 3003 bp, Unknown
  misc_feature (1)..( 3003): 2750-1469P.txt file - cDNA_ID_2711729; gDNA_ID_2214541; Annot_ID_134479
atcatgtatttgaacttatttacaaggtcatgacactaacattaattatttaggaattaaagatttaaatcttttaaatccttgcttttagagttattatatcattatctaaaaggctcaaaatataaaaaatttaaatattattatttatatatttaaactttataaaacattattaatatttaaacttataaaaggtttaatatatcatactttttaacatcattatataatatatggagtttaaaaaaatctcaattcttccgtcatattttgtgactcaaaattttaaaaatgaacatgtattaaccaattggcgaaaaatgtgtgagtttaacgtcccacatcgactaaaatatttagacaatgattcataaacatatcataaataagattaacatgaggaaaaaaaaaagattaacattaataaaataatggtatttttacgggacgggtttggcgggacgggtttgacaggatgttacttaataactattgtaaactataaaataaaaataatttatagatagatacagcttgcaaaattttatatatactaactttaaaatataaattgtccccgcggtgtaccgcgggttaaaatctagttattttcttatatgtattaataatttaacacatattaatttttatttgcgcttacaagaatttttaatttcatcacaacaatttcttttaaattagtaaagttaaatgattttattttttattttatttttatttttgataaaggaagatcaaagctattttttacttttcgtgattaatcacaatgattttctttgattcattatgattggggctatcaatttgaaagcgagagttaattagtgatttggaattgagataaagatatttgaagctagagagcaaaaatgcatgtatcgattcagagtgatattgatgaagccctatataattgagagatgacctatattattatttggaaactacatagtagaaagtaatcttgcctttgtaaataattacattagaaaaaaaattaagagtaaattaattcacctcatacttggtaattatgaacaccaggatagtagcaccctttgtgatgtataaacgttttgcactgagcatcttttttggctcgggaagttggtctttgttttctcagttcgtggcacatgcttcgttggcttatgcctctttcccagcaactccattttctctttgtggacgacgaaatccgaggcccgatataaggcgtcctgaatttcaagggtttggataagttataaacaagccaaatactaattttgcaatctaattaatttaaataaattattaaaaatgaaaatacatttttcttaaagaatgattgatcaaaataaacatatgaattttattttataaattatgtttacaagccaatgctttcataaatctagattcgtgatccaagcaattctatttcttaaaacataaactatacaataaaaattattttttgataagacaactcaagttttcatattgagtacatttatagacgactttatgttttttctcctatttttttttgttggacttaacatcatattaatttttttctatttttttatttcctcctattagagttttgaaggctgttctataagtctgtagagtgtcatcgagtttggtggaccagtatattcttgaagttccaaccattctattcaagatagtttttatctgtttgttgctgacttcaccttgaccactagtctagagatggtaggctgtcgcaaccttatgctgcactccatacttctttagcaagttctcaaacatcttgttcatgaagtgagatcctccataaccactcttggtataccgaagatggggaatatgatactcttgaatagtttcaaaactaccttagaatcattggttggacttgcaactatttcaatccacttggagacataggctacgacgaccaagatatacttatttccctaagaagatgggttaaaagttccatgaagtcaatcccccagacatcaaacatctcaaactcgagtataggattctttggcatctcattttttctggtgatatttcttatccttcggctataaacttatgaacattcttgaacatggttggccattagagcccaacttgcagtatcttctgaacagttttgaaggttgcaaaatgtccttcataagcagagccatgtcaatgttctaggactccttggactttttcttcaactatgcatcttctgaataaaccatatacgcctttcttgtatatagaaggctcatcccataaataatggttaatatccctaaataatttctttttctgataaacatcaaggctttaaacaaatcaaatactaatttatgcaatataattaatttttaaaagttataaacaaaaatatattattaattttttaaaaatgaccgatccaaatgaacatatgaattttagtatataaattgtgtttacaagccaatgctttgataattctagattcgtaatccaagaaattctatttcttaaaacataaactctacaaaaaaacatattttttttatgggacaactcaggttttcatattaactacatttatagactaaattttatttttctcctatattctttggacaacattaattaatattttctctattttttcaagctaatggttgacaaaaaaaaagaatatttaggagacaaatgaaatttacaaaaacaagaagaagttactattttgcaaactctctcttttaattaacagctttaaaagaaaatagataaactcataaaaagcccataagagaaaacttgaacagaacaaaaaacccaacaaaacccaacttagtagcgtctctccattctcttcttcttcgtcgtcgtccctgtcttttccaaacttttttgctgtgcgtttttttttgtccaaagaatcatattcttttgccctctcacacgagtcatatttacctttttgccacaacaatcatg

SEQ ID NO: 26246 - DNA, 3000 bp, Unknown; identical to SEQ ID NO: 12283
  misc_feature (1)..( 3000): 2750-1469P.txt file - cDNA_ID_2711733; gDNA_ID_2214541; Annot_ID_134478

SEQ ID NO: 26247 - DNA, 3003 bp, Unknown
  misc_feature (1)..( 3003): 2750-1469P.txt file - cDNA_ID_2711737; gDNA_ID_2214541; Annot_ID_134477
cttcgtcatcatcatcatcttcttcctcatcactaatatcactatcagagtcagaatcaccagctacttcgctgacaacaccaacactaccggtctttttgtttttgacaatatcttgtcgataaatattaggatgctctgaatcacatatagagagacttgccattgaatcatcaactgacgagtcaacccctacatttgttgatgtaccagggtcatcttgctcatgctccatctagaaaaaaaaatgccaaagcaaaagttttgatgagagagtagtgcaaaaataatgaaaataacctacaagagagtaaggatctaaaactatgatgcaacaacaacaacaacaacatcctccaagctaacacagattaataaagaaacaattctcaaagcgaagacattccatgccaatagaacattacattccgattaattcatcatcgaaggaaaaaactaacaagatcatcaaaaactattacagagattctacgcgaatatataatgacattgagctggcaacgaacagatttgtgagtaccgaattggaaccttggagaagaagtggtgatcggaggaagatttcaatcgattacgttttttgatcgtctatgaattgctttttctttatcagaagaagaagaagaatcgaggagaaagattgaacaaggcaagaggaaggaggaggagctcagcggcgtcaagggtatagtcgtcattattgtctctaattgtttctttttttttatgacatcccaccaggccactcaccgaatctcagccgttggatctgcttaccaagtcgccggattcaggttctttttttttttttgtatctatctgattattataaaaaccaaaattgcataaggtaataagaattatattcgttaaaatattttgtaatcaatttcgaataattgaaaacattgattgatagcactcttctgttcaactacgaatgtgacaaagatagttaactttctcttgatttctaggctaaataattaaaaaatgttactacattcttatgaaatctaacagatattgagtcttatcaatcacgcacaatatcgagaattaaaaatacaagaagctggttaaaagcataaacatataacaattggcatctgcggttgaaaaatgtgggcctgtgttccaaacgtggcccaaaataaaataatcccagcccaaactaatatggacgtggcaatttcgcgtttaattacctgacgctgttagcaattttggggtagtgatttttgtggtaaacatattttattaccaaattaactccaaaatttgattttaaaaataaataaaaaactgtagcctcgttttatttttcttaaagatcaaatccaaatccaaacaagattttcagaaataaaccaacaagaaacactgattcttttaaaaaaaaaaagaatctctatagaggagtattttggagtaatctcatctcataaaaactagtgacttgatcagcaacaggcaacagcccacataatggcttgtcctggtggaatcctcattagcattggaaacaatcctctccataaggccaataatccttcctctgcataaatccttctaatggcatcacccatccctttatatctcaccccactttcacagtctcaggttggtttgagccatcaacctcgttttgaccacatcaaatggttcgagcaaaatgtatggctcaactttgaatttgataatatattaaattaaacaaaaaattcaaatcagaattttaaattgaataatttatatataccataaatctatatatacatttttgcagccattttgtgaaataaatcatgtagttggacttatttacaatggctgccactggattttgatgtttgtttttgataattagaaagaaaatcttcgaattaaatatttgacatttaacaatctttccaaaatctctccacattaactacacgattattttctaaaataaaacttccaacatttaatatcatttaattactacaaaattatcatttttgatattgcttttctccatgactataacaattgagttataataatcaaagcagaaatataatttgatagcatttaattactacaaaattacaaaatatttagacaataattcataaacatatcataaataagatcaacattaataaaataaatggttttgttttacgggacgggttgacggaacgagtttaataggacgttacttaataataattgtaaactataaaataaaaatattttatagttagatacaatttgtaaacttttatatactaacattaaaaaataaattgtttccgcggtataccgcgggttaaaatctagtatatttacattatttacaatattattaatataattaattaattaattaattaaatatattgggttatcgaaaaccgaaccgaacctacctatttgggttgagaaaaaatacaaccgaatggtttggtttggttcggttcggctctcttttctccaaacgctttttctttctctctcacttgaaaaatctcccggagacctctctccttctctcgcagccgacgatcccatccaaaaaccaaaactcgctctccggtgatcgtctttcggtcagattcttataagcgtgcttgattttcaaatcaagtttgtttctttatctccagagtttatcatctcttatgtgactgtgttgtatagcttcttctctataactcctttgtgctccttctctgggaaatttctctatttagagtgctttaggattcgatttcgtgtggatctgctttcaattcgtttattcgttgcgttccactgaattgagtttgtatagagtattaattctacttgaatgcttaatgtttgaattgatctctgttgcttgcagaaaatgaatttcttaaactcagctgcatccatttgcagaagagttagtctgagggaactcatcactgaggttcctgcttatactggcagcagcatttccggtatatg

SEQ ID NO: 26248 - DNA, 3000 bp, Unknown; identical to SEQ ID NO: 12287
  misc_feature (1)..( 3000): 2750-1469P.txt file - cDNA_ID_2711743; gDNA_ID_2214541; Annot_ID_134474

SEQ ID NO: 26249 - DNA, 3000 bp, Unknown; identical to SEQ ID NO: 12296
  misc_feature (1)..( 3000): 2750-1469P.txt file - cDNA_ID_2711755; gDNA_ID_2214542; Annot_ID_134491

SEQ ID NO: 26250 - DNA, 3000 bp, Unknown; identical to SEQ ID NO: 12296
  misc_feature (1)..( 3000): 2750-1469P.txt file - cDNA_ID_2711755; gDNA_ID_2214542; Annot_ID_185271

SEQ ID NO: 26251 - DNA, 3000 bp, Unknown; identical to SEQ ID NO: 12297
  misc_feature (1)..( 3000): 2750-1469P.txt file - cDNA_ID_2711763; gDNA_ID_2214542; Annot_ID_134489

SEQ ID NO: 26252 - DNA, 3000 bp, Unknown; identical to SEQ ID NO: 12298
  misc_feature (1)..( 3000): 2750-1469P.txt file - cDNA_ID_2711767; gDNA_ID_2214542; Annot_ID_134488

SEQ ID NO: 26253 - DNA, 3000 bp, Unknown; identical to SEQ ID NO: 12303
  misc_feature (1)..( 3000): 2750-1469P.txt file - cDNA_ID_2711775; gDNA_ID_2214542; Annot_ID_134485

SEQ ID NO: 26254 - DNA, 3000 bp, Unknown; identical to SEQ ID NO: 12320
  misc_feature (1)..( 3000): 2750-1469P.txt file - cDNA_ID_2711791; gDNA_ID_2214543; Annot_ID_134526

SEQ ID NO: 26255 - DNA, 3000 bp, Unknown; identical to SEQ ID NO: 12354
  misc_feature (1)..( 3000): 2750-1469P.txt file - cDNA_ID_2711842; gDNA_ID_2214544; Annot_ID_134543

SEQ ID NO: 26256 - DNA, 3003 bp, Unknown
  misc_feature (1)..( 3003): 2750-1469P.txt file - cDNA_ID_2711846; gDNA_ID_2214544; Annot_ID_134542
aatgatttttttcattttatgaatattgtttatatatatatatatacatatatacatattgtatcgtgattggattatttttaatgcatacgtaggaatataatcttgtatatagttgtgagtaaaaaaaattagatagcttctttgaatggttcttgtatggatttttcttcgaacgtgtacacaaatgatcacgtaagaattatttttctttatataaattttataaaattagatacagctacttggaaggttatttattcaatctaacagtacagttgacaatttgatatggaacctcacatttcgtataagtattaactaaagttaacttattctaatttaagaacacaattattggataatatatgtccagctaatagctagagcgaagggaggcaaagtagcgagagcaaggaaaggaccagagctttgccttggaaacataaccatcgtgaaagaggcagtgatgccggaaaattacttcggcgaagaagttccagcgaatctgaggatcataaaatgtcatcaggatgaagttttggagcttccggaaaatgcaaaactgttagcatattcaagcatgtacgaggtagagatgtattcaatcaaagataacttcctttgcattcagggacatcctgagtataaccgtgacatcttgttcgatatcattgatcgtgttcttgccggaggccacattaaggtttttttctaactctccctttgtagaatatccatttatttataatttgtatcctaaaacaattgctacttacctaattaacttaatgtgcagcaaaactttgccgaaacgtcaaaggcaacaatggaaaagaatgaagcagacaggaagttttggcagaaaatttgcaaaaacttcctcaaacgtcaaccctccttattagtttgactcacaaatcttcatcacacttgtttaatatatattccaactccatgtatcaacgttacaatattatttgtaatgtatgacatattgatgtgttgtatccataatataattaaataaaagctttaccctcactaacccagaagcttctttatgctccaataagttttactaatgccttgatagaaatgagcctcctttgcgccattaattagtgggagtaatcgtatgttcggattctggtattttgttatgtttcatgggcttttaactcaaaattagtaatttgttccatttccattaattatattcaagtcctttttcatcttactcaaaattaattggtcattagtcaaatgctccattcccattatattcaagtcctttctcatttttccaatgtaaaatatttcttcacattcaattgtcttagttatttggagtaagttattaagttttcatataaactaaatgtgaatatatatatatatatataaacaagtttgaatgtgtaccgttttcaacattccatattttataaacaatatttattataaaattatgaaaatattagaaaacaagtaagtaatgcactaacaccttatgctccgattaatcgacataggcgttaaacccttatcatatgcctagttacggcctaagagcacgtccaacgtgggtctctttatacaggctcattcacttaaaaataacaaaaatatttaaaaagtaaaagagggatgaaagagagtctctgaaagtcctcatttaagggacgttcccacaaacatatttgcacgtgtaatcttatcaatggtcaatttatattaaaaaactaaaatataattaaaataataaaatattattactttttacttttttagggattttgatagtcccaaccatggtacatgctctaagagcatccttatcaatgagttcttaagaacatgaaattttttcttaaaatattatataaaacaaaataagaattaaagatataagaaagggttcttaagagaggaaaatggtttttagataagagatatttggtacactttttcttcttgttaagagcctactaatatttagttattattttatatatcaaaatgttaagaattttgtctaagaacccaccaataaggatggtctaacgatttttttcttcaaacaattgatttaaaacagtgtattaaaacccaatccaggatcactacgagtctacaagtcaattgaataatagattttcaattaaataaaaaataatccatattagttattttttttgagcgacataatgaaatatttattaaaaaattacaacaaacataatttatacaatatattatataaatttaaagaaaattttaaatttcaattcatattttaaacacgaatagtttaaccaataatattatatcatatattttgatattgaatccgaacttgattagtaggattatgaggcttatcgtatcagctgtgatttgcggtcggatctgaatacattgatttaaaaaggtgggaccgtaatttttatagtcagtttatttttatttatcttatgtgaattttgtgtgaaactgtattttaatttatgctgatatttgtttttccttttttgcgaaatttaaatacattagctgtattattatttttgtttctaattctgcaactatccctatgtggctagcttgcctataaaacttttgttgatttctataaaaactttgactggaatttatcattaagccataaaattatttgtgctctttatgtcattaaattctcatagtcaaatctattgtggtcaaatagtaaaaactctaaaaatacaagtaaataataaaatataggaaaaatctgtcttttctttatctattatcttatcaaaatatccaataatattagagaatataataatcgaattaaaacaagaaaaaaatccacctagttaatttgttacttacaaatcacaacagatacgcaacaaagactctccagttggcttctgttacgatctctggccgtctttaaaacacacaaaaccttttcatgtaaaaacaacaacaacaacaacaacaaaaatg

SEQ ID NO: 26257 - DNA, 3000 bp, Unknown; identical to SEQ ID NO: 12352
  misc_feature (1)..( 3000): 2750-1469P.txt file - cDNA_ID_2711853; gDNA_ID_2214544; Annot_ID_134540

SEQ ID NO: 26258 - DNA, 3003 bp, Unknown
  misc_feature (1)..( 3003): 2750-1469P.txt file - cDNA_ID_2711861; gDNA_ID_2214544; Annot_ID_134534
gaaagacgattccgaattgcgagccaagcacaaaaggagaattttggcgttgcgtgagcgaaccaaactcctttatgccacgccctctgatttgatgaagttcggatatggttccatgtgtcttttgtggagaatctagccttaaagacgtcctctttccccctccagaggatggcatcctctagctctatgttccgatgctggtatttctgaagcagaatctcctcaaactcatttagaatctcaactcgatgtctcttccgtcttcttcgactccatgcttcagctagtgtcatatggcgagaaattcccatgtcaatcgctcctcgggctccagtcaggtttattaagggacctttctccgaccagttatcaaaccaaaaagatgtgttgactccattgttcacttctatcttgcagaaactttttgcaacttctctgtgttttagcaaccttctccaaatccaagaccctaacgttgagtgcgtaccaatggaccagaatgattctttcttgagtaggttcatcctagtccatttcacccacaaagaatcttgacaagatagcaaacgccaaatcagtttcagactactaaccttattcgcttctcgcaatgattgtaacccaaggcctccttccttctttggtttacaaatctcatcccaagagactttcgctttctttggatttagctccggtccagaccacaaaagagctgagctgattctattaatttcattaatacactctctgggcagcctaaaagcattcatccaaaagtttgtgatactccacaaaacagaatttattaaactcaaacgacctgcaaaagaaaggtaacgtgaagtccacattcctatccgccgacgaatttggtctattaagggagaataatctgatgttgtaagccgttttgtaactagaggtaggccaagatatcggaccgggagctttcctaccccaaaagagtacctacttgacatcaactgacgtgaatgatcggagacaccagccaaatacaatgttgtcttttccatgcaaatttttaaccctaattttgctgcaaactggttcagcaccttgactataccatcaaccgagcgaattttaccatcggtaagaatcatgagatcatctgcaaaacataaatgagttaatccaagagttttgcaccgggggtggtatccaaattctctcgcccctgctgccttatcaagcattctcgacaggacatccatacttataacaaacaaatatggagagagggagcatccttgtcgaagacctcgagcgcttcggaaatatcctgctaactccccattaacttgaatggagaaggatgccgtggacatacagagagagatccaatgaataaattccccggggaagttcattgcagccaaaacgtgagtaagaaaagaccattggagagaatcaaatgcttttgatatgtcaatcttcatagcgcatcgtgtagagatgctatctttgtggtagtcttttactagctctgttgctaataacacattttctatgagtaatctatctttaacaaaagctgattggttccccacaatgaacttaggaagaatcctcttgagtctgttcgccaaaatctttgaaatcgccttgtataagacattgcaacaggatatgggtctataatcctttatttcccgtgcttccttcttcttggggattagagctaagatagttgagtttacaccctttggcaaaaaaccctttgcaaaaaaagactgaattgctatgataacctcatcaccaataatctcccatgaagctttatagaactcacttgtataaccgtccggtcccggggatttgtcctttggcattgagaatatgacttttttaatttcttcccctgttaccacccttgtaagcaacctatgatcatcctctgaacaacgaaaaggtagcaaattttctagctcctctacacacatcccttcataatctgcagggattgtttgtaaaaaatcctgaaaatagttcactgcctccgtttggatatcttgttgactagttacaaccaacccgtcacgtgtaactatttctcttatggaattcactgcctctcgagtagttattgctcgatgaaatgttttattgtttctgtccccaacatctaaccagtgtagtttagacctctgcttcaaaaatttctcctcgattttcaaattttaattcaactagtgttctgctcatgaaattttcgattagcatgtaactatgttgacacaaattgatagacaaatccattttacatatccactgttttacacgatgtgacgcaacacctgtttgacacttgagtgagaatttcttgttgggagaatctccttgcaaagccaatactctatccacgaaatccatgaatctctgtcgatttcctttccttttcggtttattcgcagagtcatcaatctcgatacaagagacaaaagcaatgagatatcgccacctcttggagagaatcgaagtcagagcagcctcctttgtgttaaggaaggacaatatttgataaagaagctcgtctggtagactgctaacaagatccatcgtctctgaacgaaagaatagaaacaggtattaaaggttgggacttgggagggaagcaaagaaggcgaaaagtagatttagggtttgccaaagtgaagagaggaggaagtcacagagaaaaggttttagttttcctttacgtgccctacataacaaatgaaacgcagcgttttataaagtgatgcgttaaaacaaaacttgtttcattgggcccagaattaagattacaaagctacatagcccataaggcccaatactaaaaaagtcatccgaaatattttgtttcccggatttatctccgtcgacgataaaccctaaccgccattatctatttcaatgacgtcatcatcttcttcatcaaaatccaaattctcaagtccactctcagaaaaaagctgactttctccaccaatcactatg

SEQ ID NO: 26259 - DNA, 3000 bp, Unknown; identical to SEQ ID NO: 12395
  misc_feature (1)..( 3000): 2750-1469P.txt file - cDNA_ID_2711892; gDNA_ID_2214546; Annot_ID_134597

SEQ ID NO: 26260 - DNA, 3000 bp, Unknown; identical to SEQ ID NO: 12371
  misc_feature (1)..( 3000): 2750-1469P.txt file - cDNA_ID_2711904; gDNA_ID_2214546; Annot_ID_134572

SEQ ID NO: 26261 - DNA, 3000 bp, Unknown; identical to SEQ ID NO: 12400
  misc_feature (1)..( 3000): 2750-1469P.txt file - cDNA_ID_2711926; gDNA_ID_2214547; Annot_ID_134606

SEQ ID NO: 26262 - DNA, 3000 bp, Unknown; identical to SEQ ID NO: 12399
  misc_feature (1)..( 3000): 2750-1469P.txt file - cDNA_ID_2711930; gDNA_ID_2214547; Annot_ID_134605

SEQ ID NO: 26263 - DNA, 3000 bp, Unknown; identical to SEQ ID NO: 12398
  misc_feature (1)..( 3000): 2750-1469P.txt file - cDNA_ID_2711934; gDNA_ID_2214547; Annot_ID_134604

SEQ ID NO: 26264 - DNA, 3000 bp, Unknown; identical to SEQ ID NO: 12398
  misc_feature (1)..( 3000): 2750-1469P.txt file - cDNA_ID_2711934; gDNA_ID_2214547; Annot_ID_185463

SEQ ID NO: 26265 - DNA, 3000 bp, Unknown; identical to SEQ ID NO: 12412
  misc_feature (1)..( 3000): 2750-1469P.txt file - cDNA_ID_2711942; gDNA_ID_2214548; Annot_ID_134624

SEQ ID NO: 26266 - DNA, 3003 bp, Unknown
  misc_feature (1)..( 3003): 2750-1469P.txt file - cDNA_ID_2711993; gDNA_ID_2214549; Annot_ID_134643
tgttgatttctaatcagtcatcaggctatcaacaatggttttttcattcaacaccctccacgtcatcttcttttttccacatcatttcttctctcttccacataataattcaatacccacttaaattttatactctactatggtttgcttaataaaattcaacactctacccactatttttatttcatttttctttcttttatgttttaaatggataattagtaaaaatagatgtatttttttgtatccaaatcaaataaaacaagtctttatttatagagtttgaaatatggtgaattttaatataaaaaaaaattaaaacaaatatatattttataagataattgatctataataactcagaggaaaagtaaatatcagaaatttcagtaacaaataaaagaataacacatgtcctatctatatttaactcttctctcacaatttctgtctccaattatttaatgacaaatagcagtaaggggttcatttttaacaattcaaaattgttgaatccgttcaacaccgttgaatccacataagattcatttctttatttaatattccactgtaagcattcaattattgaattaattttttcaatagcccattgtatatagtcttaaaaaggggtgagtgaatgtgaatgaatggattgtattttcttaaaataatgtgtaagtcatacgtgacaatttcacaacaaaaatatttatatggacaaaagaaatttggtagacatatttgatattcccattaaaaaattgcatgagaaaaagaatatatatgaaatggtttggtttcctttctaaacaagaaaaaaaaaagtaatctccgaagaagaacaaattccttgctgaatcatggttaatttcgaatctctttctatctaattttataaatgtgatgataacagatcatcgtctccactcagtttccgtttgatagtcttatgttaccgatttttatcaggcgaagttgaagctctactcttactggagaagctcatgtgctcatcgcgtccgtatcgccctcactttaaaaggtaccagccaatgattttattcttttcttgtgagcaattctttgatctgaatttggttcttgttcgattttcattagggcttgattatgaatatataccggttaatttgctcaaaggggatcaatccgattcaggtgcgtagtttctaggttatattgaactttatttgaagtaacattgtaaagataagaatggtaagtaactgagatttcttatgttagacttagaagtttattcgttttggttctctagatttcaagaagatcaatccaatgggcactgtaccagcgcttgttgatggtgatgttgtgattaatgactctttcgcaataataatggtcagtagtaacacatccatttagtttgtttggttttgttgatgaaaaggaacattcgtttattcgtcttgttgtttttcaaatggacagtacctggatgataagtatccggagccaccgctgttaccaagtgactaccataaacgggcggtaaattaccaggtatcttcgatcctttgtcttcagatgatgatgtgttgccatcatctgcaaaaccatgtagttaagtccaaatgtagtgaacattatcagctttagattgcgagtgtgatcgttgttcttattttgtatatttcaggcgacgagtattgtcatgtctggtatacagcctcatcaaaatatggctctttttgtgagaagatgagattaatgtaatggattctactaatggaggttctataacaaagcaaacatagttacattttgtcattttttttaacagaggtatctcgaggacaagataaatgctgaggagaaaactgcttggattactaatgctatcacaaaaggattcacaggtatgatatctctaatctacctatacgtaatcaagaaccaagacatatgttcaaaatgtgattttgttgatattgtggttgtacaggtttataacgacctgtctgataatgtctcatatgtccttcagctctcgagaaactgttggtgagttgcgctggaaaatacgcgactggtgatgaagtttacttggtatgtctctaaatctccctggataatctctatggtactactctcttctttattacaatgaagcattgttttgcaggctgatcttttcctagcaccacagatccacgcagcattcaacagattccatattaacatggtacttttcctcagctaatctcttctcctggtacctagatattgcattgtatatccccccaaattccatggaatccttgatcagagttttaaggtagcatgaaccaaatgttatctctgtctcacactttcacattcacagagtaacatagacgtaatactcagtttcataactttttttcctcgcatcacttggttttcatctctacaattttgttgtataggaaccattcccgactcttgcaaggttttacgagtcatacaacgaactgcctgcatttcaaaatgcagtcccggagaagcaaccagatactccttccaccatctgattctgtgaaccgtaagcttctctcagtctcagctcaataaaatctcttaggaaacaacaacaacaccttgaacttaaatgtatcatatgaaccagtttacaaataatatttcattccaaacataaacatgttgtattcatcagagagattcagtgaaagcttacataaaccgaaaatctcggtttgatcgggtcggtttgatcggtttccaccgaaatcaacagggctctcagatagactcttttgactgaaaagaaaacaaaaatatttgcatctgatttacgttgaccgtaaaagacaaaaaataaaaataaaaaaagtctagtgtcgtcgtcgtcgtcttcgaattcgccacttcttgtatatacaaaacaaagtaatcgcgaaaacacacaacaatcgctggactctgctactgcgaagaacaacaaattccttgtttatcatg

SEQ ID NO: 26267 - DNA, 3003 bp, Unknown
  misc_feature (1)..( 3003): 2750-1469P.txt file - cDNA_ID_2711997; gDNA_ID_2214549; Annot_ID_134641
ttgaaagaacacggttggaacttaacttttgttgttcaccacataaaacctaacataaccaatcaatacaataaacaaccgaatatacttttatgaatttgaatttacctcttcggtcttcactccaccaataataccaatagatgagccgataatcgggttgttccgccgcattacttcagaggattttagcaggtcggatttcaattccttgaatgatcaagccacacttccgattgagctgcttagtctctaaagcactcatctcaatttcatcattatccattattcctccatcattgaagaactccccaagctcaatctccatccacccatcttctctctgcttaggtttcacaacgttcctccttcccctccttatagcttcactaaagcatattaatcttctagaaggctcctgtcccaccactcctaccgcagcttctatggccacattctgaaagccataacatttatccactcccttgaacacaatataagccgagtaacgagttcttggagataatacacgagtattcgttctgccacgaatctcgaaccaacatacatcgcgaagtttcgctactttttcaaaccttcataacacagggcaacaattgtccatcatcatcccaacgagtcattacaaccaaactaacgcaaagataatgaaaattagagtacctagattcaggaattggaatccattgccaatactgaggattatctccccatatgattgagaggttcatcgcagataacatcagacacctcttcccactcgctttctctaaccatacgctctttgatttccaaaataatcaaaatgattcaatagcagcaaacttcaaaattacaccaaaatagagatacaaattgcaactttaaggcgatgagatgagacagatcattcattattcataaattttgctacctttttgtcatcgtcgaatagaacaggatcgttacagagagagaaatagagctccttcttcgatgagaaaactcgcgatggaggaatcagagattcataatccgccggaagaaacttctcccatataatatctgacttcaccgtcgattcaaacgttttcgaaaccgtagcagcgacgcacgcatcgcgtggatttgtaaaagagattatgtaggagatgcaatcttccggaaatgaatcgaacggagacgactccgatttaactctgcgttttctccccatcgatcgacgcttgtatcttcgtcttcgtcttccacggaagctagtgtaaaatctcaagtcgttctattaatttacgaaagtacccctaaggattacgaaaatttcaagtcgttctacatattgacgaaaatagccctgatttgtgaacaatccacgcgtctacttcacgctccattgtttttttttggtcattattgtggattcgttggttaaggatttggttttgaaaatatccaaattccaaactaacaaaccaattaaaaaaaggtcaagtcaggtatgcattatggatcaacggtgggaatattatttgttttgaatttttataatatagtctgactcgttattccagaaaagtaaagcttaagctaacgaatacgaaagaaaaaattgataaaaaatgaaattaagtaaaagcaaacaatctatttttcatttgaattaaagaaaaaaaacaaacacaaaacacgcttctcttgttgagaagctagcaaaacaacactaaacctgaaacaaacgtaaatccgccgcaacaacccagttttttccgacggcgtacaagcttcctccgccgtaacgccgtcgtttaataccaagaagcttgattaggtttccgtagtgtgtgatttgtgagattcgttaaaccctagctctactactttataattcctgtgatgatctttagctagattgagagatcgaagtgatttgattactctagtgatgtatttgatcgtttgattttgggtttgaattttcccctttttagacgtaatcggaaatttctatgttcggagagttttgattctttctgtaattaactttactttttcgttatcgtttacttgtatgtaatctctttgtgtgtctttcaagttgctgaagttttttcaatactttgatttttaagctaagcatctttatcatctctctgtttatctattgatatagctatgttctagggtttgtttccattatccttgatcggttttggttggtttaatgtatagaacagtgattttttcctgttttgatggcttacaaatagtgattttatgtctctgatattgaattttggcttcagttttaaggttctgaacactgatgtcaaacccattgaaagagtcaagagaggatattgcaaattctactcctcacatgagggataatgagtatgttcggctagttgtggctcatgaagcctccccagctgaaaccgtgttgtctctatcgcaatcagaggtgcagagtaagaaatttatgtggtggttaaaagctttgggaatatgtgcagttgctctcttgcttacgcttgttttcggaaaatggggagttccgtttgtgtttcaaaaggtaatttctttactcaaatctcaagtttctgatgattatttccttgtgatgatccatgtcacatactctgctctttggattgtaatagtttgtttctattgaaggttcttattccaattttgcaatgggaagcaactgcgtttggccgtcctatgctcgcgattgtccttgttgtttccttggctttgtttcctgtgttcttgataccttctggtccttccatgtggttagctgggatgatttttggttatggtctcggttttgttattatcatggttggaaccaccattggcatggttctcccttacttaatcgggcttatgttccgtgatcgcctccatgtaagaacccttcacttctctttttctcatgtcatatgatcattttttacaagctcactgacttgtagatatgatttgttttttaacaaaatg

SEQ ID NO: 26268 - DNA, 3003 bp, Unknown
  misc_feature (1)..( 3003): 2750-1469P.txt file - cDNA_ID_2712007; gDNA_ID_2214550; Annot_ID_134654
gaaatataattaagaagaagaaggcaaacagtaagaaatgacatgttgtgctcatgccctttctatgatttgcagagggaaaactgatttactatgcacagaagaataaaaaaagaataggtgaaagtatagaaaatgaggacagaagaagagcttcggatctgcatgcttgtaagtaggacgcataagaccccttgtgtacatcttctgtacctagtagaatatatgcttttgttcaattacaagtatcataatagtgtatacatgatatatggaagttgtatgtgatcttttgggtatctcaaagctgttgtgtcggtcttgttattgaggcagagatgaaaactaaagttatttcagatcatacaaaaagaagtttagtattcatttcagaatcatgttgactatgcgtctatagtctatacgattcagtgggtagggaaaaagagttggtaacaacgctataacacgacctgaagctgcataatgagatggggtctagttttctacagtcagagtcaggaagttggaagtgcacgcaggtaacgactaaatttgttgacccattgtgtcatagtccatagtccagaacttcaaattgtaactttattttagatgtttaaagcaactctttgttttggtggtatatacttctatcattttagggtgcacatctgctgcggctacctgtaaacggtatgaactaaagcacaataagatgttggagttttctcgcaaggccggaatgaggaggagactgatctttagttgcaggattatgcagttgagaaaaaatgtaaataagttgaatacagaaatcacaagacttgcacatgggggttactgaaagtgttgttagagatatatacgagcatataagaaaagtgagctaccgatgaaattgaaggtccctatttctgtatttttgttaagatatgatatgtttttccttctttacccatgaatcttgtaaaatctatgcagactcaagaaaggagcttagtgtataacgagactgtggttgaccttttaaatcgtgatactgagcccgttggactattaaatgatctagaggtatttaaagggttggaagctttaagccaattgctgaaatagacatacactatctcggctacttggagaatgttgtctattttgcagaaaggaaccattttgccattgaggagaatctgatggaggaagtggttgaaagcagacagcatttacatcatttaattggcatttgtgaaggttatacttcctatcgcttgttaatatactttttatgcatttgatggtgatggtattctaggtgcatacgtttggcaaagcctcaaagtgtgttgatgacattttgaagatatgactcattgtctctttaatgagacacatggtaatcatcttttccatccatgtatgtgattttccatttgcttttatagctcaaaggcaactagaaaactgctttgaacgacaaaagttcaagatcacatacaggatctagaatgaaggaattctagaaactaagcattctacgaaagttttacctgtaaagatgtagtgatatcaaattcgctctcctattaacattactcctattgcttcaaacttgtctgtgtttgatgatgtgcttattagaaaaacaaaaatggttttggttgttcttggtaaaaaaagacactcttctgatggtcttcattttaggggtttgattttagctgattttttgttttaggttgtctcagacaaaaaacatctgcagcaaaagtagcgaaactcgagtcagagtaaaggagcctggagtccagttcatctacctccttgaagtcgcttttaactgagaatgagatgaaaatccaacagctatgacttcaagcaggttgacgaactggactcttaactctgactacaagcaggattcacatcttgagtgatctcttctgaaaatatttaaaatgtggacctcacttgacagactacaagcactgttgaattcagttttattaacaaaaacaacatggagattgatttatcacttgcaattattcattcatgttaaactaatggcagaacagcttaggagaaatgataatgtgatgtgaggcagttagtctttaacttagctggtgcctattgtgctactccactgatgctatacctctgttgatagaatcatacaaagaagagtaatggatcttgacattatatttttggacaaaaccacaagcctcgagtaaagtttccaattttttttttgatatttagacaaatatatcaaaaatggtgatttactaaatcttatactaactataaaaaattcattaccatctaaattttttaatgctagattttcattttttttttcattttttttcttcacaaatgtaacattatattaaacattcgatacaatacataaccaaaacaaaggcccttaaagagatacagaaagtggaggctcaaactagcctataacgggccaaatttgttttgaaaatataaaagaacgggcctataacgaacttataaaaaggctaatatataagcccattaaaagataatgcatgcgtgtcctctaacttgaacccttactactaacaaacatatcgttctctttactttctcttcttcacagcaaactaatcctcaaaccattctctcaagctcgtcttcttcctctatctgtgatttctagggttttgttttttccctttttaatctctcaattgcttagtctcttcctcttctctcaacacgtaagacacgcaaagaagaaacaatttttcaatcttcttgtaggtaaagtccgtcaatttaatttaattttactcgcttgatcgaatcatgtatgtgaattcgaaattgtagtttagggacgtgaaaatttcggttgattcatgttgtttttttgataaatctttgttattgttcgttcttcgtattatctctcaaagaatgtactaactaaaattacaaaattgaaaccagatgcatagagatatg

SEQ ID NO: 26269 - DNA, 3003 bp, Unknown
  misc_feature (1)..( 3003): 2750-1469P.txt file - cDNA_ID_2712033; gDNA_ID_2214551; Annot_ID_134680
actgcgtcaacaagattaaaaagtggaaggtaattaaccgaacaagccaatgattatttgacacgtacaagtgaatgagagaggagcgtcacgataatgattgtggactaaagtgacagtcgtcattatgacagaccgcgtggcatcatttatctcaccaaatgtcctttttcattattttcctgatcaaattaatcacaagtggagcaccctaattaacacgttgatatgacgaaccggacacattaacacttgccattacgttttagatttgattccttcagcttctttaagttttagttcagcaattatttgatcgatttggatatatattgaacctatgatgataatttagtagtagtgtaatgtaattttttagaaaataatgtatgaaattcatcagtttcatttttggataaattccggtttaacaagtatggtttggtaccaattaattaattgattaaaagtttcaaattcaataaaaataatacatgtggctgattatcgaatttgattcataaatagaggaatatttaaaaacgattattgaatagaggagattggtcactttaactcctcatagtagtaataattttctgatttcactgaatccaagtaaatgcctagaggaacaacaacgacgattctttccagctggaatattaatccgaagcacgaggcactgtaacggtccaaaaattccagctggattgcataactactcttaaaggcgcactctaacctactcctacttcactctactgttaacctacgcctctgtcagcgtactctagcatgacagttataatttcatcggcggcgaggttttattcgattttatctgcctttcgatcagttataacagaaacgcgactcgcaatattttaattggaagtaaacaaatcgacatgcgatgcgacgaataaaaattaagattgcgattgctagaagtcggcggttttccggtgagaagtccggcgacggggaagtgatttcgtcgtgaagctttccgtctcttgtaggtttcgtacactactacggatggatagagtatcggctctgataaatccagaaatttcgtcgccattttcgtcggatgattctagtggagatcaaaacaatcaaatcaggaactcaaattcaatgtgttaccaacagaaataaaattcgaaatgggaatcgaatctgcaatgtacctagatgtttcgaaggacgcatgaatccattaaactgagccaaatctgagaaaaattcaaaatcgaaaaaccgatcaaaatcaataaacacgagaagatcaatcaatcaatcaaaaacaggtggatcgtcggattttgaataggagaagccaacctgattgagacggagcgtaagaagtgaggtaaaggatgataaagcagatgagagtgagaatcggaatgaagtgaacaagcttctcttgtttctgattcgtcgtaacaaaaggagattgcaacgatgataaccgtcgcggcttaaagtctttgagctcgtgatcgtcgtaatctactgcggatgacgacgaagaaggagaagaggaagctggtttcaagtcatcaatatcgtaggtatcgtcctttcgtcctccatagctatggagcttcgaagctgatgagtctaacgatatcctctgcatcgccgacagagagagaaagatgagggaggctagagaaagaaaacttagtgaaggttatggttcgtatcaaataaatattggtgagtatcccataagtaaataaaaagtaaatatgcacacacatgagtttatcatatttaaataggaaataattattacgcgattattatatatctctgtctaataacgagagttgtcgtattcgctactcatttactttggaatctagtaaaaaaattcacaaaaaaagagagatgtatataaatatttaaaagaaagaggttgggatctatagagagtgtagaataactgtaacaccaacggaattgattcggattaatctgattgctgaagtttattctatttttagagcgaatatatatataaatcttatcgtttcaagcaaacaaattattattgcttcacacaaaaataataattattgctaaaaaaaaagaaaaaaaaacattgcataccaaaaattatgattggtgaacaaaaacctaaattatccataaaaagtttgtccgtctcgtctatatgggcatatttcaaggctacaaaagcccagcccattaaaacatttaaaataaaatcttgacgaacaagtaaaatggacggtcaagattgtatcgcagatcaagcaacctggtgctttaaactagaaacggaggatctgtgattccgatgggagtgagattgaaatttctggcggctctttcaaaggaaaattgtagattgtattcaaatacgttgaggaagaaagaaggtgacaaagaggaagacgaagaagaaagttgtagaaagtaatggtgttgtgggagttagctctaggaacagcttacttcttggggattaggcggacttaccggctcgcattgaagacccagcgtcggcttgttagccctaagcatccaaggattcgagattttatgcatcggtgaagtttctttcatctttacgcttttctttttgtggattttgcgatttggttgtttctgatttaggtttgactggaaatacgtttctttgtatatgaattggcctcttcaattgatgaaactgctttgttattgatgtatcgttctgattgtttattgtgtttaggttgatttcgattttctactgtccagttagttttgttctgactcccgtatcgctataaaaatgtgatttaagcaatgcaatgcaatgcaagtggttggatttaagtaaaatcaagaggtaggctagtcctatttccacggttttgattcgttgaacttacttatgtgatttcgtaattctatacattgctcttgaaccattcgatgtgagattcaagagtagagtgacacgaagctatgatg

SEQ ID NO: 26270 - DNA, 3003 bp, Unknown; identical to SEQ ID NO: 26269
  misc_feature (1)..( 3003): 2750-1469P.txt file - cDNA_ID_2712033; gDNA_ID_2214551; Annot_ID_185568

SEQ ID NO: 26271 - DNA, 3003 bp, Unknown
  misc_feature (1)..( 3003): 2750-1469P.txt file - cDNA_ID_2712052; gDNA_ID_2214551; Annot_ID_134666
acggatttgagacagttggaggagtattcacttgcgggtatggtttatttgttgcaacaagttaaacctaatttgagtaaaggtgatgcaatgtggtgtttgctaatgagtgagcttcatgttgggaggccgagtactatggatataccgagttctggaaaaggggatagtagtaatgtaggggttggtggtgctagtagtactgtaaatggggttggtggtgctattgctccggcattgtgtagattccatggaggttggggttttggtaatgggaaaggacccaagttttctggtaatgggttttctttgcacagtgaagagttaacgttgcagagagagattgattgtccaaggagatttaatctctcaccttcgatgaagtctttgttgagagagaatgttgcagcctttgctgctgggtatcgtgctagtatggagcaaaagaagcaggtgcaaatgcagtctgaaactagtggtactagcttgtcttgcacggctgctgctacacattcagagaagtgtgagcagccacatgtcttcggaagtgaagaatgtttcagttcagtgctggagaaattccgggatctgaaccttgatgacaatgttgattcggcacctgaggagctgaaggatgatgctttaataggactacttcagcaggttcaggatctcaaaaagcaattgaaggagaggaaagactgggctcagaagaaggcaatgcaagctgcccaaaaggtcagcgatgaactgtccgagcttaaatcgttgaggagtgagagagaggaaattcagcgggtgaaaaaggggaaacaaactcgtgaggactcaaccttgaaaaaattatcagagatggaaaatgctcttagaaaagctagcggtcaagttgacaaggcaaatgcggtagtaagggcacttgagaacgaaagtgcagaaatccgggcggaaatggaagcttccaaattaagtgcatcagaatcgctcacggcatgcatggaggcctcgaagaaagagaaaaaatgcttaaagaaactactggcgtgggagaagcagaaaatgaagttgcaggacgagattacagctgagaaagagaagattaaggcactcaatagagctttagctcagatcactcaggaagaaaaagaatatgaggtaccaagtaatgcattatcttcgtttacacaccgagatttttctggttcttcacaatttttgacactataacctgtggaagtccatttagttagaacataagataatgaacccttctctttgaaagcgcatctaattatctgttccaaggaattattattcctgtaaatacttttcatgggccaagtctttctctctatgctgctagatggatcatatttgcatagagaggttgtctttttcaggcaacttttcatcttgttaatatgtatttgcaggcgaaatggaggcaggagcagaaagctaaggagcaagttttggctcaagtggaagaagaacagcgctcgaaggaagcaattgaggctagcaacaagagaaaggtggaaagcctgcggttaaagatcgaaatagacttccagagacacaaagatgatctccaaagactggaacaagagctgtctcggctcaacaaagcctcttcaactgactcaagcctccaatccaataacacctctcacacaaaggtgaaatcagacaagtcgaagggagaaacaatgtctaagctgcttgaagagctgaataggcttgatggatcatatgagaaggaagcaaactatgaccgggaatgtctgatctgcatgaaagatgaggtttcggttgtgtttctcccttgtgctcaccaagtggtctgtgcgagctgcagcgatagcttcatgggcagtggcaaagcgacctgtccttgttgcagagctccggttcagcagagaatccgtgtctttggagcgagttcttagtaacaaagataattatctggggtccaaagattaatcacagcacaacttcttttgtcaggtgtaatacttttttgtttgtttgtttgtttgtttatggctccgtctctctacttcctattgtctcttatcttcaatctgagggggtttggactattcgcatcttttacattgttttgagttgttcaaagaagatgttgcctggtttatgatcttcccaggattcacaatgtaagtaaataaaaattctaccacctctacccaaccctgaaacgtcgtctcacaatttctgatacacatgaatcacttgatatgtttttcttaccatgaacctatcacaaaaatttcatttttagcttctaacttgtggctaaaacaagttaagcttcaatttctaatattagcccattgttcttctgtaacaagtttcatttgttatcacaaaagctaatttttcttttcacttaattttgtctagtaaaatttttggaaagaactctattgacatttcaacaacctcggaccaaaccggtctacaccgttacagaccaatcaaaatacggaaattcaaatctatgtattaaaaaaaatcactacagaattacgtacgtacgtataaatagaggttagtacattaatcggcgaaaaaacattcgacgtagaatccgccttcggagacttgagtcgccaccggtgagtacttcttcgatacattccgccgttcgtttcctcttacttggcgtcttggggtaagcttcttcataacctatcatcatcctccttctccagctcttcgagtttcagaaaacctagatctctaagtttttatccctaatcttttagggtttctaccttgttcgatcattctgaaattatttgtcttctctcggaattcaattcctggggactttctcctttttggttagagaagtttatgtatactctctaactctactgttgtatctctgaaacaagtgatttgaaatttatagctcttctgataatcgaaatctgtgttgatttcgtggtgttggtttatgattgtagtgcagtgagaatg

SEQ ID NO: 26272 - DNA, 3000 bp, Unknown; identical to SEQ ID NO: 12453
  misc_feature (1)..( 3000): 2750-1469P.txt file - cDNA_ID_2712064; gDNA_ID_2214552; Annot_ID_134710

SEQ ID NO: 26273 - DNA, 3000 bp, Unknown; identical to SEQ ID NO: 12462
  misc_feature (1)..( 3000): 2750-1469P.txt file - cDNA_ID_2712068; gDNA_ID_2214552; Annot_ID_134709

SEQ ID NO: 26274 - DNA, 3000 bp, Unknown; identical to SEQ ID NO: 12454
  misc_feature (1)..( 3000): 2750-1469P.txt file - cDNA_ID_2712076; gDNA_ID_2214552; Annot_ID_134707

SEQ ID NO: 26275 - DNA, 3000 bp, Unknown; identical to SEQ ID NO: 12454
  misc_feature (1)..( 3000): 2750-1469P.txt file - cDNA_ID_2712076; gDNA_ID_2214552; Annot_ID_185607

SEQ ID NO: 26276 - DNA, 3003 bp, Unknown
  misc_feature (1)..( 3003): 2750-1469P.txt file - cDNA_ID_2712094; gDNA_ID_2214552; Annot_ID_134697
cagcggtggaagagttgaccttggagttctaacgagtttcaagtagcacaacccggagctacatttgtgaggtgataggttatatttggtatctgattgtaacatcgtaggactatatgctgactgaataatatcttcttccaattcaatgtcgaattctctagtctcattgcccctcaaagcttggatttcggcaaagtgaaagtacacgttaaccttgtcactgtcgtcatctagagacacgtaaaatctcaatggcaagctggcattttcgggcgtgattcccatcctacttacagcttctggtacttgaaagggactcgaggatctcacgttgagggtggtgttcacatccgtttcaaattcattatatcggtcccatttgcgatcaaaaatatcatcaggatacctaaaaccatttttggagtagccatgcaaaagtaaatgaatcatgttagattgtttttttttataaaagagttgctaaagttgagtttacataccgtataaaaccggtagaattgctactataggcccgccggtagatgaggtctaagggaccgaattgagtcaaatatgaatcatttcttagtggccgtagttccaaggttgatatcattggtatagttgatcctgttttgacaagacaaatctgcaataagttcgacgttgtcatgtaaatgatctcacgatcttttccgaattccaaatcaaccgcaatccacatgttaggcccaacatgtaaatcaaatttgggatatacattaagaccatcataatttccatatccgaaccctgctcttatcaaatagttgatgccttgctctactttcagattatagcagtttcgtattccatcgggaaaatatctcaaatccttgtactgcctgtagatatatgtgttatcatccccagcttcaccacgtaaaccacttaaaataaaatcagcatcagatgagaatgttaatccggttcgtgggtcggtataaggagactcattaacgggtaaaccgcaatccaaactgatgaatcctggcaagatacaaaatgtattattagtgaaaaataatgttttccttttgttagaccatgaagcttataaggaagacaatcaaaagttttggaaaacagagaatcctttattttctttaaccaaatctcttatatctgtaatcgttaatattattttcatggtggctatgcgtacaacaaagtagaaatcggttagtgatctcgaccagtcgagcaagaacactcaactacttggctaatccttaagtctttatgtgtcaaaaactgaacatgaagcaattattaaaaaaaggtatatagagaaacctcgttgatcaggcggctgagcttgaacaagatgtgtaatggccaaagccccaaagatgaacaccagtaaacgttgacgacgaccttccattttcaagttaagttaacatacaaatttttgaaaccaaagacaatctgaaatatatgatacaatatattgattttctagtacaaatgatagaaatactttagatgaagatcaattaaaatccaaaacacatgttggcgtggaatactctccaattatagattcatatccaagcacgactgaagaatggtctaacaaagatatatacatttatattccactttgtggaaaaaagagagcaatttaatcataaatcaaagcacctgatgtaatctttgtttaaacaatgtaaaacctgccaagttgatctaatgtcaaagctttataaactatatgataattctgctaacgacttgtacttaacaacaacttggtggatttaatacattttgttgactttcactcaattataatcgcaatacctctgcaataatgtaaaattcttggtcttcaaaaataaactaagattagtcttttcttgacaaaccctaatattcgttttgtttgcctgtatatgcattatctatctatggcttactcatagacgttaagagatagctggcctcttatagttatagctcatattctcagtattactatacattgtcaaccaagaaattctacatcaacctttgttaatatcccttgttaggtgggatttagtgggaaaagagatcaaaccttattttggaaagatcatttccaaacgctactggaccattatccacttggttcacaatttgcttttttaatggagctttgacaatcggaaactgtatgtgttaactatataaaaatattaattatgtgataattcttattttttattgttgcttttttaacaagtttgtaatagttaaagtgtggttgtaaatatatttttaaaatttagtactggctaccttgatgcacattatttgtataaatacctgagtttgtaagaagcaaatcattgaatcaaacaaaatgatctttatctttattttttcctgtccatgttgtaatatacgaattctctcttttacataattattctacaacaagttacataagttacgtctataattattgtggatcagacgtaatgtttctttatgtgaatcagacgtaatgtttcaaataggttgtaatatgtaattgtttttcatatgtagtaaatccttttttgtaacgaccgggttcaaactaattacttaaatcaaaccttgttatatccttgtgctccaagtctaacgatcaatcgaagatttattatgtttggtcaagggtttaaagaagacatatacaaaccttaatacaaggaaattcctatacatgtcggagtcttatgatcataacctattattttaaacacaagttggggttggaacatgtcaaagaaattcacacaataaaccaaaaataaagcaattctcgcaattattcaatcttcatgtctggcttaagttgactttctttaatgtattattccttccaatctgtgtatgtgaggtatttctcatttacgtagctccttgttttcactaagcaagtcttttttatgttcttgatttccatattagctttccaagaagatg

SEQ ID NO: 26277 - DNA, 3000 bp, Unknown; identical to SEQ ID NO: 12473
  misc_feature (1)..( 3000): 2750-1469P.txt file - cDNA_ID_2712102; gDNA_ID_2214553; Annot_ID_134726

SEQ ID NO: 26278 - DNA, 3003 bp, Unknown
  misc_feature (1)..( 3003): 2750-1469P.txt file - cDNA_ID_2712104; gDNA_ID_2214553; Annot_ID_134725
atcgaattcaacagaatatgttttattggtcatctgattttggaggtaaaaatcttcaaacccggtcccaactgtgttgacatgcgaatgcgacccaaggatttttccggttcgatcgttgatccggtttaaaaagcaatgaatttcatgatttccccttctttcttatcccccagcccccaattcatttttctcatatggtcctggtaaaaatgttgaccatccggtttatgataaaaatcattttcggtttagattttaataatctcggttcgatttagtatttgtatctccccaccctttaagccagaagtgcagagacgcctccttctctcgcctccgtgtctctccaatgctctctcgtgtctgcccaaccctccgctataatcgtatctggtctgctcatgcgcgtgaaatgccacgcgccaccctccttctcctccaacccaacttcttccactcttcccccaaaactgctcttgtgaatcgtctcgatgttacttcatcggagttttcttccatgttccgtcggagcttccacgctttacgcagcaccgtaggagactggagaaagcttccgaaaccgccgggtcaggtttttgcggagaggagagaatacaggaagattagaaggagagctccgaagaagaaacaggaattggagcttagtgttagtatctgcatcgaagaacagcttcctgatgatctcgagattcaggtttgagtattctttgataatcgaatttggaatcaattagccatttctagttgtgttgttttagattcttatcaaattccaatcaatgtagaatattgcagaaatgcttcgtctcaatgtacctatggcaatgacattggctttcaatggtttgaaagattcaaagtataaaacaagagagactgatatagaagatcttggtgggtatgaaactgttgaattatcggtgatgctttgtaatgatgattttatttgtaaactcaacaaagagtggagaggtgaagatcatgctactgatgtgctttccatgtcacaacatgtccctgaactgaagcttccagtagtaagtgtttgtttttgatttactggtttttaacaggatggttccaatggttactcattatggtcgttcttcttgtagcttatgatgggagatctcgtcatttctgttgagacagctgcaaggcaagctgcagagagagggcatactcttcttgatgaaatacgcattcttgtggtaagattaatagttgtggagtttgtatccgttactgacttactgtgaaccaaaacattgaagtataatgtgaagtttctaggcgggtttttaggattcttgttgtttcaataaccatgtaagaaatcagtactgtgtttccataatgtttagaaagatattagaagggtaggagccaatttttgtttttttattcaggtggtttcatatggtttgtgtagtagtctctatttgctgataccttaaatgttttttcaaagattcatgggttgctacatctactgggatttgatcatgaaatcagcgacgaggctgagcaagaaatggaagaggaagaggagttgttgctaaaaaaccttgggtggaaaggaaaaggactcattcagagtgcatatgacattcaaaaaacaactacagttcagccggagaaatcagatggtatttttcctgtgtatactaaattgcaactgtgtaacgatcatttacactccccctattatcttcttgttcttgctaagataaacttacagactactgttattagacaggaaggaaggggatggcctaagattgtacaaaccaaagttctcctatatattctgtgatatggatggtaaggttacttatttaataatgtgtagttgtttgtttcggttttcttcgctttctcatgggattttgatgtgaactctattaggtacactgcttaacagtaaaagtcagatttcggaggcaaatgcaaaagctttaaaagaagcccttctgaggggacttaaagtagtcatagctacggggaaggtgagaagacagcagttttacaatgacttcatgtttggactattctttgatctgtccaacaatatctttccttattttttaatatttgcttgtctttgaaatgttttggagataggatatgttcctaaatttatttatttatcacagtcccgcccaggtgcgatcagaatcttgaagacggctgatctaactggatccgatggcattatctcagagtcctctccaggcgttttcgttcaggtttacttgctctaacatcagggaactagtgaggtgcaccaatatcaatgtagtctcactaaatatctgtttaattacagggattacttgtctatggtagacaagggaaagaagtgtatcgaggaaacttagaccgagatgtctgcagagaggtaagtccacttaggatttagactacaacgactcacagaattaattctcacatcctcggcttagttcacaaaccatgcattagaattctggaacccagtctctttgcatcatgtaattctctaccatgttaagcagcaaaaagctacctaagtacctatgatagtgctcaacttattatccctgtgtatcgtgattgaataactgagttctaggaatcctatcttatacttactaaaatgttgatttgttatatacagacctgtctttattctttggagcatcgaattcctctcattgcattcagccaggatcgctgcttgacattgtttgaccaccctcttgtcgactctcttcacacaatctacaatgagccaaaggtaggttaatgaaactgcacgctctctccccatctagttatgatttttgacagcttcttgctaatctctccatgatttttaacaggccgaaattatatcatcggttgatcaactgatagctgaagctgacattcaggtaattcccggagtcagaacttatatcttactttcttacatatgtataagccaaagtactgatg

SEQ ID NO: 26279 - DNA, 3003 bp, Unknown
  misc_feature (1)..( 3003): 2750-1469P.txt file - cDNA_ID_2712108; gDNA_ID_2214553; Annot_ID_134724
catgggtatgcaggagttattattggcataagatgatagcggtcacgatgattttttcgtgggtcccaaacaggaaagctaaggtcatcttcttctattgcacaaagcatgactggattcggccagcgccattgtgtatatactctaaaaaatcgagaaaccaacatactaggaatagcatttggataaaactggcaaaggcgtgcaaccagaagtgcccagtttacaccaccaagaaatccagtaacctgctcaatataacagagattacaagagctttaacctaagaatattgtcaacagatgtaatattcagaaagacaccaccttacatttgaatagaccccacgcttcttagcccagtacttcaggcatcttaatgttgtccggaagtgctacatttgcacatcacatcagagatggcttacatgattccttagtttataacataaacaactggcactcaacgactttacctcggaatttggaacaagtttaagaatctgatcagcaaccctacaaccattaagactgcggacagtttgttcatccacgtcacacagcacagaagagttggagatatccagatcctgttaataaattgattccagaaaaaaaggggatctgcctcagcaagaacttataaactttgtcgagaactcatctcagtactcatatataaatcaagcctgatggtgctaacacggcagttcaacatctccatgttcactaaggctaacaatttcttataagaagtttctttgacacctcaacccttggaggaagtgtataataatactatgtgaccatcaacacgcaatcaatacacgcaccaaacccaccaaatgaaatccaagataaacatacaggtatcatgaaccaccccctaactttcaacagaaactgaaaaaggctatattgatgttacctgtgggataactagaagcgatatgctagcatacagaagatcaattgatattccttggaacttaaatttcatgactgggacatgggcatcagtaacaggttgaagttcagtcacttcttccatttcagccaatatatcacggaagaaaatgaagaaatcctcctgtaaaaataacctgttagcaactaaactaacccaccagacctttacatcagtaagacgaaactcaatagttacctctcggttaacataagatgggccaacacacaaagtatcaatatcagccataggtccgtgaacctgcaaaccaacaaaataaaaatttcaccctcaactagtaatgtagagacgaatacaatgctacttctcttcatttcagtgataattcaagatactcacaaggctcaatagaaaatatatgatccaagtaaaacctttccccaaactgattagatgcagttgatcttttaactttaaacttaaaaagaacttactccaaggcggtaagatccaaaagtgaaaatgacagcatttgcatcctccaccatctgatcagtatagcccctctgacgagttaactgtttcacccagtgttttacaatctatacaagaagtttaaggaagaagatgtgttagattagatagttagtactgtaaacaaaacttgaccattatgcatttcagtaaacaccactgtgagcctctttgacatcgaagagaaagcagctaacccaaaatctacatttcagtaaagcagagtaaactatcaaacaaatgattagcgcctataagtcacttgtgttcacatggcaaatgagccaataggattaatagaaggactagactacatattgctacaatcatcttataattacggcatagaaatcgttggtctacaacactataaaaagaaaatgtgagaaccagtctaagcattatcatcatgagaaagcaataaaccagacgctcttaatcacctgatcaatgcgaaccacaacttcctctctccgcatagtttcttccttgctctcgtagagcccctcatcaaccagaaacttcacaataaatcagccaaaacgcaagtcaatatcacattgttcctgaaagcaatttttcattggaacaaaaaaacaaacaaacacaacgctaaccttctctagttccaaattacgcttaacatcagcagcagaaggtccagcaatagacagtggctccgtgatcccatagctcttaagagaagcttttaccggttgagaagagtcatcgtccgtgcgttgttgagtactcaccatgacaagacgcgtaaacactagaaaatcctaggcgattcaagcacaaaatatagatatctcgatctgattaagcacccagatcatgataattcggaatctaacaggaattggagactttagagtcatgggagagagattgaagaaggagaaaagagccaaaggaggaaagaaaaagtgagagaagagcgagaaaagctcgaaaacgaaatcggaaaccctaaatcgatggatagggaaagctctcgactggaattttcaaagggaagtcaaagaaagcggaaaatatcatacggattaaaatcaattttgacttgttcaaagaagggagagaaggagaagcaaaggacaatagtttttattggttaaatcgaattcaacagaatatgttttattggtcatctgattttggaggtaaaaatcttcaaacccggtcccaactgtgttgacatgcgaatgcgacccaaggatttttccggttcgatcgttgatccggtttaaaaagcaatgaatttcatgatttccccttctttcttatcccccagcccccaattcatttttctcatatggtcctggtaaaaatgttgaccatccggtttatgataaaaatcattttcggtttagattttaataatctcggttcgatttagtatttgtatctccccaccctttaagccagaagtgcagagacgcctccttctctcgcctccgtgtctctccaatgctctctcgtgtctgcccaaccctccgctataatcgtatctggtctgctcatgcgcgtgaaatg

SEQ ID NO: 26280 - DNA, 3000 bp, Unknown; identical to SEQ ID NO: 12471
  misc_feature (1)..( 3000): 2750-1469P.txt file - cDNA_ID_2712112; gDNA_ID_2214553; Annot_ID_134723

SEQ ID NO: 26281 - DNA, 3003 bp, Unknown
  misc_feature (1)..( 3003): 2750-1469P.txt file - cDNA_ID_2712116; gDNA_ID_2214553; Annot_ID_134722
ttcctgtaatgtatattcttttcatttttggtcgatataaacagcatcaacatcatcaagttctagtagtttctgcattagctctttgttcaattccatggcctcatcatccacctgcaacaaccaacaacaatcccaagtgattacattttccaagtgaatcgttgatgaatactgataagggtgtgactcttatttgggcggaacaagaagttaaaattaacgaacgaagaacacaaacaaattttctataagtttattgccatttccaattatgcttatgtagcatatgcaatttacaatgtatttaacacgttaagagaagataaactacatgttgacgataaaaatagaatcaataagttaatattagacagggcacagaggttacagaacagagcgggagatttgatacctcaactgtagtcagagggagcagttcagagccattgtcaggctcgaagttcactccttcatcacgtagctttgataatattgttgagtagttctcattagaagttacaattttgtagtacctgaacagatatagagacaagaagctgatgaaacaaaaaaagagcataatagttatgagtcacctaggtatcatctcgtcttagattggcaagatggatttcttatttcaaatcgtttggtgtgaaacttttattgcaatttagctgtttatgagaagaaaatacactaggtctaccttcagtcgcttgattactttttcaattcaatcttgaaagaaatttctaacgcatttgaataagtgagtcgactatctctatcttccctaacttaggattcaccagcaacagaaaataataaatgtaatactgacaagaagaaaagaaatgcggaaagacattatattggttatatacctctcttccctgtcttcatcagtatcatcttcataagttgggggttcaataacatcctctgctccagcatctaaagcaataataaggagctgatctttgtcagcttcggtgacctttatattcactaccctaactcttttaaacttgaacatgacagatcctgaatcagccatttttcccccataatccttaacaaccgatctaatagctgccactgatcgattaattttgtctgttaagacctcgactaccatactaacaccaccgtagccatatacctaaagcattgaaaacaagtttattttagagtcatcaaatcttataattggacccaaagaaatgataacgaggaactggatttatggtcctgtaaattgaacaaggtgctgaggtagtgaagttatattagctacagtaaccacatacttggcctgatagagtgatgaactaaaacagattcataggttttaaattaccaggccatttccccaccttactaggatgattcaccataacggccccacttacaaacataaaactagaattgaagctcatgacctcacctcgtaaatcttctctataaaagcttcttgccccttctcagaagccctcttaatattacgctccacaatgtctttcggtacatccagttctttagctttgtcaagaatagtagctagagtcgtatttgaaactgggtttggaccccctttcttgacactgcatgatgataaacccacagatgatactttttctagtaagcatatgtccataacaaagtaagaagttgaatccaacaaactaaacaccatctatatctacaactaatgtgcaaaatttcatctcaaaaaaaaaagatgcaacattgtgaaaaaaatgttgaagacttacgcagatacaacctccttgccaattctacagtatagcttcgccttctttgaatcttgagcgccctgtaattcaccagaaacttcaatctcaaaagttcttaaatacaatcttcgtcttggaaaaagagttttatctttctgctctgctgtaatatgtaattctcatttacaaaaacaaaccacaactttcaagaggaagattgttattcacattctgaaattcatactacacgagcaagagaaacttccactataggcttcacaattcaaacatggtgaattagctaatagctttcaagagtgacataacactgaaagctagactctttacaataacacaattaattgatataaacccataatcaaaacaactctctctatctgaggcatttcatcaaacaggtgtttggcataaacaattacgagctctagactcatcaaaacctataaattttatatttttaaaacctagtaatagcaccaacgcacttctaatctatatgaacccacaaactcagaagcttaacgaacctttcgaccagcgattttggaagaacgacgacccatacaaagaggagttgaaatcgaaatctttctgagttgaagcttgcggaagcagttctggtcatctgattgttgtgacgcagccgtgaaatgcgaagtagtagtgtggggagagattgaggaaagagacgagagagtgttggtcatggtaagactaagaagacgatggttagtggagttgagaatggatctggaagagacgccattggagaatctgaggaggattactctcatggagcaatgggaggccatatagtctttggtgtggattgagaatagagggaatgaggtaatcaatcgatttctcaatgttatattggtttaaggtaagaaactaggataagcgagtaaaaaacttctttttgcttggaaaaagttgcgattgtgattttgacttgaaatctgttgttgagccgcgtgaccctcacggactcaaaaaccaatccttcctttgcttataaaccccaatcttcttcttcgagagagagagtgaaagagaagaaaacgacaatgggacacgccacgagtctctctcacttcctcatcctctcttcctccaggttctctcgtctcgggtctctcactagattactctccaaacccacctctctctccggctctttttcttccatttcggtcaccggacaagggttccgatg

SEQ ID NO: 26282 - DNA, 3000 bp, Unknown; identical to SEQ ID NO: 12469
  misc_feature (1)..( 3000): 2750-1469P.txt file - cDNA_ID_2712120; gDNA_ID_2214553; Annot_ID_134721

SEQ ID NO: 26283 - DNA, 3000 bp, Unknown; identical to SEQ ID NO: 12468
  misc_feature (1)..( 3000): 2750-1469P.txt file - cDNA_ID_2712132; gDNA_ID_2214553; Annot_ID_134718

SEQ ID NO: 26284 - DNA, 3003 bp, Unknown
  misc_feature (1)..( 3003): 2750-1469P.txt file - cDNA_ID_2712136; gDNA_ID_2214553; Annot_ID_134717
attgttcttagggttctagaaacgtaaaaaaaatatgaagccaacagtttttccaaatggttctgatcccatttataaccgttctggtcttcatttaaaactaatttaatttggaggtcttggactgagacccataaatatttttaagcctcagttagttttttttttgctttctttggtgtagctttggagaaaacaaattattcaaggttcatgatcttacataaaaaaaattccatatatcttttgtattctttcgaggactggttcttatatgctttagcttatgttatcacatgtttatggagttgttcttttctctacatgaaattgcctatttatatgataagggatatatgttacccttatatggatattcttagtttatcagtctatttagggaggaagttggaattatttcattaaattaagggaagaaaacaaaaggaagagaacaagcgtggggtgggagaaagtgggcgtgtgggggaattgcaaaaccctagaaaatggaattaagcaaagcatgcccttccatgacaatgaccactctctgtatattctctccataaaattcattctttttgttttatggacccatttttcctttgcaattagttctcgatgtgcgttttggtggtacaactctattcataaactatacaatttcgatacgataactcaaaacgtttattttcttaccttccgggtggtacactcatagttttctcatcagaaataaaagcaattaaaatccattggaatttggttagaaatgctcttgttttatatatatatcatcaaaacaagagctataccagtgaaactaaactatataacgttggggtttaaatgtaagatgactcgttaaacagttatatatgttcagaaaacataatatatgttaatagaaaacattaggacgctctatgtttaagaaagatgatttggttaagcttgatgagagataaggtaactacgtagataagtcgtttaaaaaaagacatatgggttagaccacagaccactacatataccacataaattggaattaactcatcaagtttatgtgtgaagacatagtttatgtaaagtaggtgaaacatgattgggattgatatatagcatgacttagtctatgctaatatttggtctaagcttaggttatttaagccaagctgattagacaagaaccaagtggttatttttttatcaagtggaaaatatatagtagtatgagagctaattgaataaattagacatgaattgattatgtatttacctaggtagacgagattattatactcactaagcttaatagatcagaatcctgtttaattattaagacggctagtgagcgagaccaaagattcaataaagaaggacaatgaggataggtagtcaccgaatatagcacaatgttgtagcctaagaccattgcaaacattgtatttaaaaacaatggttaataaggaatgatttatcaataaagttctaaatttgagacttatatagtgcaaaattaaatttaagtacaacatgaatttaaacaaagaattggactcgaagtgaatctacatgaattactctataatacagtgattgacataggttatcacatttttacgtacatatatttatattcgtacaaattgttttgtagccaggatttgaatttctatttatataaatttatacttaaaaataacagaaatactatagagaaggtcaaattaactaggaaagatttaagtacaaaaaaatgattaagtgcgtagagtgggaaaatgcttttcaacgttcacataagatgtttagtcacaagaaaaagtgttttgattttcttcagtcaaaagaacatttcgatagtaagccgacaaacatctcagaggctttttgacgacatcaatcccatcctcatctgtccgtgttcaaatgtccgattacaaaagtgattgagaaagaaaagtaacagtgatatttctatgattactcgcattagttcttaccataacaattataatctgattagcttcccataacaactaatttatgatgcaagtgtttttaagcatgctatttttaagatttcttagctctctaatataaaattttattagcgtttttaacgtacaaaaaataaaatacgatgtcgaatataattatcctaaaacaaattaataagccacagaatgtttcttttttcctaaattaggtcttaatattaaatttactctaacatgcactaagttgaatacaattaacctaaaacaaattaataagccacaaagtgttttttttttctttctaaaatttggttttagtttttactgttgaagtaacactaagttgtgatagagtaggagtaccagccggtgattcaactaattcaattcggaaaagagaaaattatataacaacgtaaacaacattcttactttgtgttttgagggtaaacaaattagtttttgttctagttcataatctaaagaacgatttttgtttaacaaatgcttaattcaatattatttttctttatatttttactgaataatatctatattaaataaatcagccataatttaaggtgccaaagtgctcgacaccttttttgtttctttctattttaaaatttaaactttggtaatattcccctttttgtagcccatcctagcactttttatcccttttccatctagtacaaagaatagtgcacactgcctttcttatgaaactctctaagattttatacatgaaggaaaaaaaaattaaaagtctaatttgaaaaaaaaaaaaaaaagacaaagaagactattataatctttctaatcaaaggtcatcattgatccccctttaatttttttctttcttctgttttacagctaaggttcaaagcaaatcacagtccttaagagcaacacattcaacacaagagcatatatatacatatcaaataacctcatgtaataatagagcaaagccaaagaaacaaaagcaaacatg

SEQ ID NO: 26285 - DNA, 3003 bp, Unknown; identical to SEQ ID NO: 26284
  misc_feature (1)..( 3003): 2750-1469P.txt file - cDNA_ID_2712136; gDNA_ID_2214553; Annot_ID_185624

SEQ ID NO: 26286 - DNA, 3000 bp, Unknown; identical to SEQ ID NO: 12465
  misc_feature (1)..( 3000): 2750-1469P.txt file - cDNA_ID_2712145; gDNA_ID_2214553; Annot_ID_134714

SEQ ID NO: 26287 - DNA, 3000 bp, Unknown
  misc_feature (1)..( 3000): 2750-1469P.txt file - cDNA_ID_2712149; gDNA_ID_2214553; Annot_ID_134713
atggtgataatgatgaggacaaaattgtaaataatatatattacacacaaaatataatgaaagttttttttttaggttagtttcttaatttataaatttttgttggttatacacccatatttccctaactaaatactcttttaaaccggcgatttaccattctattgatgaatcgattcacgtcaaattttgaataaattctacccaaatcttcttcaatattgaacctggttttgaaaatttaacatttctcctttacaagataatgaaagaaagccaagatatatcatttctctttttaaccgaccaacattcacatcgggcttttggaaagccttaagaaagaaaaacattccaacaagaaacttgtttacaagcccccttcaagtcacacagagttggtccattaacaattttaagtattgtagatttgattaatctatgttaatcatgtccaatgtccatattgttagataaaagaaagaaaaaaaatcattaaaaacccatagattgtgtgaagaaaccaaaaaaaaaacatcccataaataagaagatcccttaacagaaggttaaaaaaaaaagatcagagtcctttggattcttcaattgcttagtctcataaatccccaaaatctctccacccagttggatttgcagctctctcagattcatcagtttcttgatctctttgttatattcaatttcacgaagattgtatccagagcagatgggtctggaagcttctttctttctcagtgatttcgatcgttccatggaccagacgtacgatgcctgagctgcgtagcaacgcacgcagagatcgggataagaagaacccgaagcagaacccaattgctttgaaacaatcacctgttaggagaaatccgaggcggcagctgaagaagaaagtggtggtgaaggaagcgatcgttgcagctgaaaagacgacgcctttggtgaaagaggaagaagaacagattagggtttcgagtgaagataagaagatggatgagaacgacagtggtggtcaagcagctccagtgcctgatgatgaaggaaacgctcctccacttcctgaaaaggtgtcaactttattgttggttttgttgtttttatgaggttttagttcatcggaattgtctcttgcattgtgtgttgtgttttttgattaggagaaagctctcaaacttaggcatgccacttaaagttaaaactttctcttgtaggatgatttgattattgactccttggtttttacaggttcaggttggtaattcacccatgtacaagttagatagaaagctaggcaaaggtggttttggacaagtttatgttggtcgaaagatgggcacgagtacttctaatgctagatttggcccgggagctttggaggtatgctgtttgtgtttgcaagtttacttgctttcttttggttttctgtgatctgtaatgtgattttgatgtgtccacttttgtaggtggctttgaagtttgagcatagaaccagcaaaggatgtaactatgggccaccgtatgagtggcaagtttacaagtgagcgttatggtctcttgtctttggctctaggattcatcttctgcttgttcaaatagtttgtttataaaaggatgagataactaatgatgctttatcatctgttcgtccagtgcacttggtggcagtcatggtgtgccacgagttcattttaagggtcggcagggcgatttttacgtgatggtatgtggaatttagtcaggtctgaacaagagcacttgcagtatgagtaattactgtttttaatctttcatacaggttatggatatccttgggcctagcttatgggatgtttggaatagtaccacccaggcgtaaacattcactctgagaaacatttactttattttgtagcatctgaagattttgttatatgaaccattgataaacataatttttcctgagatgagcccttcaatattggtggcactcaccatatgatttgtgtgttttatacattccaggatgtcaacagagatggttgcatgcattgcaattgaggcaatatccatattagaaaagatgcattctagagggtaattttctaatatttctgctactgtaactctctttcttcaagtggtttttatttgctaagaagcagtgctcctgtttctacagatatgtgcatggcgatgtaaaaccagagaattttctgcttgggcctcctggaactcctgaagagaaaaaacttttccttgtagacctcggcttaggtacactttatttttgttataagagtgagcgtactttattgtctttctgctgcttatccaatctgttgatcttgcagcatccaaatggcgagatactgcaactggactacatgttgaatatgaccagcgtcctgatgtttttaggtaagttgattcagctaggcataaagcctgtgagattgattcttatcagggacttcaactttagggtacttattaacgtgttggctttttcattttcagaggaacagtacgttatgctagtgtacatgctcatcttggcagaacttgcagtcggagggatgacctggaatctcttgcttacactcttgttttccttcttcgaggccggcttccatggcaagggtaccaggttggggacactaaagttatttgttttatttcctggcaactttccttgtcaatcattaacttggtctatttgttagggagagaacaaaggtttccttgtttgcaagaagaagatggccacttccccagaaactctttgctgcttctgtccccaaccttttcgtcagtttgtcgagtatgtggtcaatttgaagtttgatgaggagcctgattatgctaaatatgtctccctttttgatggaatagtcggcccaaacccagacattaggccaataaatactgagggtgcacagaaggtgatttggtgatcttctttatgaaacatatattgaggtttactatttagctccggtctgaatg

SEQ ID NO: 26288 - DNA, 1208 bp, Unknown; identical to SEQ ID NO: 12487
  misc_feature (1)..( 1208): 2750-1469P.txt file - cDNA_ID_2712157; gDNA_ID_2214554; Annot_ID_134741

SEQ ID NO: 26289 - DNA, 1208 bp, Unknown; identical to SEQ ID NO: 12487
  misc_feature (1)..( 1208): 2750-1469P.txt file - cDNA_ID_2712157; gDNA_ID_2214554; Annot_ID_185663

SEQ ID NO: 26290 - DNA, 3003 bp, Unknown
  misc_feature (1)..( 3003): 2750-1469P.txt file - cDNA_ID_2712165; gDNA_ID_2214554; Annot_ID_134738
aaagaaagtaaagaatggtcaaatctttttaacaatatactattagaagacactgaatgcgatcataccagcactaatgcaccggatctcatcagaactccgcagttaagcgtatcaagtgtcgttaaagactctaggcgaagcttagaggtcgccggttcgagtgacgcttgagacgaaactaatattacatgctgtagtttcgggcctggagggattacgggattcggcccaaaacctcctagtattcagaaaaaaaaaactattagaagacactatctcaacattaagactccatgtgatcgtagtcgtaggtgaggaagtgttgatgtttacaatatactagatccgtacgtgcgggattttatatttttaattcaatgtagattattttcttattttgtgatatatattatagtacaatgtattagatatctgaactcgcatatacgtacaaaatataattttttaatagattattaaaatatataatattttgttataagtaaactttgtaatagtatagatattataaagttaagagtaataatcaaaattcaattgtgttcctgtatagttatattttaagatccggactcacacagagaaataacccaaactaaaatcaaatttatatcctattttacactagtaattaaactgttataatgttttgattagtttagaaaataaaaacgtatacttgacttatatttcttggaatggaaaacctgtgatgtatctatcataaattcttcgtcacataacccgtctgtatatgtgaaataaaaatactaccaacctgtaaccatcacaaatagaatttgtgtcacaaaatacgtacatgcagggttatgtgtgtaaacaaatttattttatatagtgctcataacccaaactcataccagttagatatttaatttgatgtccagttggatttcaaattattttatatagtacttccgtttcttttcatgtcgtttgtgtctcataattcctattttcatttcgttccattaaaaatacgttccagaattcttatttgcttcctttaaataccaatgtatatatgactgagttttgcggattaacatataggatgttaaagtttacaaatatatcataaataaaaacacacaaatatattttcttgattttttttccttcttcaaactcaaaaatatgaatagcattataacatataattttgtaaaaaaaatatattttaacaaatgtaataatgtttatttccttagctacattttagatattcttctttcccttgtttaatcataattaattggagttttggaatataattaaaattttgaaatacacctataaaagcaatttattttgctggataattttttttgaatgaaaaatgtataattagtttacattatttctcaagtttgtttaataatatattatggatttatttaaaaaaagatctggttgaaaaaaataaaaaataaaacccaaaatatttggaaattagtatgtacaatttattgcttagatatttctaaatgtaaggcataatgataattacttgaaattaattatttttgttttatttatagtaaatataaatctttgtaacatataatctcgtttttagaaattttgaaataaattttcgttttatatttcaaaatacttaacccaaaattctaaaattaaatttatttatctatcacaaattatgattttttattcatggtatcaagcaagtgttatgatttaaaaaaattttaaaataaaaattaacttccaaaatgttagtttaataatatagtataatttgatatgaaatcttagtttttcaatttttattggttaagaaattttaagaaataaattttaatttttcgtccataattaataggaaatagaaagtgagtttaattttggaaaactaataattgcttaaaagaatattaccattttttatatttaaatctattaattttgtgattactattgtatctttaatgaatttatttaaaaacacttaaagtcaatagcattctatgtaatattttacccttcataaggttgtttattttcaatgattccgaattaatagtatagatacaatggactagatatatgtatacttgtctatacaatatttattcgtgacatgattggttgatatttgttagaaagttcaaatatcatgttataaaatacagtacgaaagccttcaaatattaagtctttgtttttcattttgggctaaaatccaataattgcaattttttaattttttttctgctggtgtacagtataaataaagactttgcggttgcaatatatcaaaatatatgaagcaaagcaaaacaaaacaacaacaaaaaaatgatagatgagaaagatattccaaagaacttgagggaagaagaagttagagacgataatgtagaatctttgaaaatagtggggcatgtagaaaatcaattatcgagtctaaaatttttcaaaaaatttggatgcatatcgagaagacgccactagaaatttttgatgcaataagaaaaattagagatgaatttcaacgagattcgagctttaagaaaagacaaacaatactatagttatattatattatattagcgtagaatgtatgcttaaaaattataattattaatttatgatattattgagatcatatttttatataagaatttcaaaaaaattataatcttattattttaacaatttcggttaatttttacattgaccccagcttgaaaccgataagatttattaatttatcatgtttattaatttatcgactattaatttatagagttgctacggtagtacgaaagcttcatatcttaagtctttgtttttcattttgggctaaaattaataattccaattttttttttttttttttgctggtgtgcagtatatataaagacattgcggttgcaatatatcaaaacatatgaagcaaagcaaaagaaaacaacaacaacaaaaataatg

SEQ ID NO: 26291 - DNA, 3003 bp, Unknown
  misc_feature (1)..( 3003): 2750-1469P.txt file - cDNA_ID_2712184; gDNA_ID_2214555; Annot_ID_134768
atctggagtgttccatctcttaggtacgagaaacagggagtcggggaagtatcaaacatagcatttcttcttagacaactcttgccaagagattgatgatatacattgaaactcatgcaggtgatgatgaaaacatagcaaacaagaagcctttggctggttctcaggtctcaggtgttcctgctgcatccactgcccataaggtaaaaaaatttagaacacatgaaactaatctttcatgaatcgggcagttcatgtagaaaaatgcaactggattagtaagctgtgtatttgtaatcatggttttgatgagacaagtttgtgattcaacaggatttggaggttccgaaacttctaactgcacacaggtcacttgataacaacccgcgacgagagatcattcaagctcctgtccggacaaagagtgttctttctgcgttctttgttaaacagaaaactccaaagctcaaagctggctatgtctcgtgaaaacaccaactctttgtactgagaaggaaatttcaatctcataccacgtttcttttaccttatataataacatgttgattttcatgtaattatcttaatcaccacatcaacgtacgaagtccagtaagacatgattttggtctatcattaacaaaactgtgtaatagattaagaatgtgtttttagaatgtaaaagcttaataaagatttctgttgagttattaattaacattgtatcaaattaacaacagagaaaccaacatagagaacaaaatggctcacaacatagccattccaactcagttgattcagcgcgtaaaccgataccaactcaggcttgaggcttcagggcttcatggaattcataaggtctctaataaattatcagtaccttggagctgcaccaaaaaaaaacagccaaaggttacaaaagcgaattcacatagtctaataccatagtagcagtagattcagatgtctcagccggaagatacatacctccaccaagtgtagcttcaggcaacttctctattgagtacttgcgattagtcacatacatgatgggcacaccaggaatctgcaaacaaacatagaaaaaagttgataatatccaaagacttcagccatggatataaacaagagcactgatacaacaaactatctttacctttcgaatccttcgctttaagtctctatcacatgtagccactatgaagcatttatgctgtatattatgagaaatgaatattacagaaacatacaaaagataaaatgtatacaccaagaaccatgggaccagagcatcggtatatcatttcagagtcttgaatacaaagttcaacaagccgggaacgatgtattacctgagtaactctgtcaacgagacagtcatcagcatatgtccctttgtgtatacaaggtagtctttcgaagtgaggatctttcgcaatcctaccaaatattatagtaaaccaattacgaatccacgaaacaaaaccataaacagaaaagccttgttcaaaaagtctaaaagatttaccttagagctacacgatacttctgacctaacttctctaactcagccatgacacaatccgtgatacaaggagtgccttcaaaccagaaacaattacaggtggttaacaagagagagaacctatatagacctatcaaaatctttaagtaactcacaatttgcgtacagacagtctctcattcccttctcaagatcgatctattagatacaccagagcaaaataagtcaaaaaggatttcaaacaatgagagattccaatcaggttcaccaagactataaactctacaaagatcgatacacattctgattatagctctgtgatagagaaatgcaattgaagatgaaccgaccttattctggatagagaagttgatgaagttagtatccaccaaaacacggtaaggaggaaccaatgtagagttgtaagaaaagaaaagccctgcaggaacactcggtctgatccaaaaacaaatcaaacgaaacccaaataattacaacttggcaacgaaagctaacagtggtaggaagcttacacgtttctcggaagttccgtgaggtccttcttgtttggattcagaacctcttccttgtaactatataaataaaaacaaaactaagaatctctttaaaaaaggatcaaatttgaaggaagacgaatcgtttactcactgcttcaaagctttgtggctaatcatcttcttcacgacagcaaacttttgaggtttctttgcctttcccatcttcgaagcaaagagtaacaaaaaccctagaacgacgcagagagaaagactgggaagctgaatatgcgaggtctgaatcggcggaggctgagaagtggttttcgaattgggtatcagagacggagactaacgctcaatatacagcctaattataagcccaataataaaataaatgggcctaatttatatggcccataagcgaagcgagtttcttaaatcacgtgttagtaaaggttaagaaacgaagagaaaattccagatttttcaaagtgatgcgagaatgatctggagagcagaagaaatatcttttccctctgaacgttgttgttcgtctttctataaatcaagaaatgtctttggattgttcactacccatagaaaaagctgcaatcatctgaatcagaaagtaattcgaagaagaaatctgctttttttaattggtggagagagtgagagagcttcgcaggaactgagtcatcggaatttacggatcgtttctgtttcgtgtaagctccgtcattttcccttcttagtttaatgaatagctttgagaatcttgagttcattgctcttagtttaatgaagatgcgattgatttagtttggcagattttggtgattgtggtaacgaaataattctgaatgaaccaaattcacattgtatttttctaatgatatatggatttgggtatttgctgcagttttactggaattggttaagtgatcttgattaaagatg

SEQ ID NO: 26292 - DNA, 3003 bp, Unknown; identical to SEQ ID NO: 26291
  misc_feature (1)..( 3003): 2750-1469P.txt file - cDNA_ID_2712184; gDNA_ID_2214555; Annot_ID_185698

SEQ ID NO: 26293 - DNA, 3003 bp, Unknown
  misc_feature (1)..( 3003): 2750-1469P.txt file - cDNA_ID_2712188; gDNA_ID_2214555; Annot_ID_134766
ccctcttaccagaaaaccccaaaatccagcgatttcagttccacaacctaatgtgagactcagcaacgaaaacaaaaaatatggatatatggaagttagcttatagattaaaaaatcactaccaacatggaagttgataatcgtgagactaactgagacttacagatagataatttctacggaggagactttgccgagatccgacgccggcaaaagcaaaacagagcgcgcgaggttgagaagatgcttatgaaataattgggctttaaatttatacactttggcccattaggaaaaatataagcccatttaaaaggttttgtatccgccactaaagttcattgaatcacaaaaataggatgctaatttttaaagtttagaactaacagtacttttccactttttcctgcttttgtgattttattctgttattgacaactttaaagttgctcttgaggatactctagtttttctgagtcaaccactaaaagaaattgatagacccacccaaactaatgacaaattgacatattaacatgtaagacaaccttgtcaaatgtcactggagttttcctctaatcaacaattccatttatagagttaaaaggtaattaaaaccagtggattttttattgcttaaccatttaaaacggttctaaaaataaaacacaagtgtcaaagattcgaacatcgattccaaaacagtaaacaaacaaaaaacacacacacaaatataaggaagagaaggcgtagaatcgattcagaatctgtgaattacgaatccatagagagaaaggttttgcatttgcaacctttctcaaattgggttctgtgcatttccttgcactttggataataggaactaaatctctttctctggttcatcaatggcggatcaaacgaagaagagatacgttacaagcgaggatttgaaaaaacacaacaaacctggagatttatggatttcgattcaaggtaaagtttacgacgtttccgattgggttaaatctcatcccggaggcgaagcagcgattctcaatctcgccggccaagacgtcaccgacgcgttcatcgcttaccatcccggaaccgcatggcaccacttagaaaagcttcacaatggctatcacgtgagagaccaccacgtgtcagacgtctcacgtgactaccgtcgtttagccgccgagttctccaaacgcggcctcttcgacaaaaaaggtcacgtgactctttacacactcacgtgcgtcggcgtcatgctcgcggcggttctctacggcgttttggcgtgtaccagcatctgggctcacctcatctccgccgttttactcggtctcctctggatccaaagcgcttacgtcggccacgattccggtcactacacggtgacgtcaaccaaaccgtgtaacaaactaatccagcttctctccggtaactgtctcaccggcatctcaatcgcgtggtggaaatggacgcacaacgctcaccacatcgcttgtaacagccttgaccacgatccggatctacaacacatcccgatcttcgccgtctctacaaaattcttcaattcgatgacgtcacgtttctatggcaggaaattaacattcgatcctctagctcgattcttaatcagctaccaacactggacattttacccagtaatgtgcgtcggaagaatcaacctcttcatccaaacattcctattgctattctcgaaacgccacgtcccagatcgggccttgaacatcgccggaattttagttttctggacatggttccctctcttagtctcgttccttccgaattggcaagagagattcatcttcgtcttcgtgagcttcgccgtcacggcgattcaacatgttcagttctgtttaaaccatttcgcagcagatgtgtataccggtccaccaaacggaaacgattggtttgagaaacaaaccgccggtacgcttgatatatcgtgtagatcgtttatggattggttctttggtggattgcagtttcagttagagcatcatttgtttcctcggcttcctcgttgtcatctccggacagtatcgccggtggttaaggagctttgtaagaagcataatctaccgtataggagtctttcgtggtgggaagctaatgtgtggacgattaggactttgaagaacgcggcgattcaagctagagatgcgactaatcctgtgttgaagaacttgctttgggaagctgtgaacacgcatggctaaaaaggtgtttcgtttgtcgagtactttttaattagattgaactgttttaggtgtaactctaccgtgataaaaaactacatatttattttgattttctgctgagtttataattttctaatcgctaagcctaagaatctatttttgataaacaaatttgtcagacatgcgtgcttgttctacgtttaagacggatcgtgcgggtctaatatacatgacaaagtactccaccgaaaaacccgagcttttgaaccaaattgtttgagttcacgtcaatgtaaagttttatctggaagggttcatgcttattatacaacaaatgaaagaacattttgccaaatgaatttggagtttaggaagaaaacaaaaaactagttgggcctctttgaaaccgtttcatacacacagatataagtgaggcttcctataattatttttgtaatcaaattataataatgaatgggctttacttaaaggtacgtgaagccctaaccataaatggaccgtcatataatttcaattttgggataatcatcagaaccttcaacgagtcattgtcgttgaagaattgaagatgacaagtccgagaatcgttatccatgcggacttgaaaaattatccttaggagatttttcctgacctatcctcgcgtcgcgccttcttgtcttctctctcaatccagcatattcctacgcaaatcccttatcgttttcatgtttgtcctggtttaaatcttcaatctcctacccggtcttttcatcctccgatg

SEQ ID NO: 26294 - DNA, 3003 bp, Unknown
  misc_feature (1)..( 3003): 2750-1469P.txt file - cDNA_ID_2712213; gDNA_ID_2214555; Annot_ID_134755
gagaagatttaatcgaaaattaattttgacgattcattattatttttggtagtactttgctttttaaaaaattgtaaaatcctcatcaaaaaaatttcagcaactgtgaatattttttaaaaggcataacaactttatttgttttacgtaacgaattccttggatttgcgtaaaacatgggcctcaaagcccaaatgacagctgtcaaggaacaaatcggtcgacaaaagtatggaccccacttttaatttacatccggacaaagactaaagagctgtctttatctcaatcgtttttcttgtttctttaagcccattaggtatagctacctcaatttatgggccatcaggtccaaagggcatttttcccaaaagattcctaatcgaattacgtcgatattgaataccttattgactttgagacaactccaccattgtgctagataaaataggcctttttaaaactttgaagataaaaaacggcccataaacgttgtgaaaaagcctctcgctgaaacagaaggtctctgtaagtgtctaatcgcgcgatgaacttgataacggcgatgaccggagctaaattgcggccatacaatgctacgatccacttgctgcactccactttgccctttcacggcgaaacaaccttctttccttaggaaacagcaacgtattacctctgatcgcttcacctttcgcggtggtggtggtggcgatgccgccgccgtcgtctcctcctccggcctccgtgatctcgttttcgtcgtaaaccctcaaggtgtgtttgcccttttactcactggatgaaaaaaaactgagattcgaaattcattggatttaaaaatgatgtttttaatatgagaatcaatctcgatgtggaattgaggtttagtattatcgtctcttgattcttttcaatgtcttttatatgagtctaggtgctaatggtagaacagctaaagaatggaagaagttgcttcctcaccttcgatctcgtcttggtaaagactgtaatgtgagtttttgattcacttgcctttttgtgcccctgtgttagtgatgccatctcctttcgctttcttcagttccttcaactgagtttacgtgtcttcttgtttgtttctccaggtaagtgaattattaacatcgggtccttctcatgccattgacattacaagagaggtaaggagtagtgaaagtaatatactactttgctgggtacagtattctctgtcttgtcgatttggttttatgatgatcctctgttgcttctaattatcctctcaggctataagggatggtgcagatgctgtcattgcggttggaggtgatggaacacttcatgaggtaggaattgccatttttggttgctagaactgcgctctggagattcttagctccactcattctgtcctttttttttttatctacaggttgttaatggtttcttttgggaggggaaacctgtcggttatctcagtggggaagctagtcgatcgactgcacttggtgtgagtagcttgagttgactttttgacttgtttttgtgtatatctcttgtggagttacaacatacaatcttagtccatcctttttattttgcagctgattcccttaggtactggctcagattttgctagaacatttggttggttagtttttgcaacttctgtttgttgtgtttttttgaaacttatgttgagccatatgttaagtgtatcctgcattctttaggaacaatgatccttgtgaagcagtggagcgcattgctagaggtatgtcactgaattcatttgaggagttaggacttagttactactgaactgtctatctatgtctcatatatcacataaccagcattttctcagggatgcgatcacggattgatgttggtgttatcgacaaggaaggaaaggatttgcattacttcatcaatgtagctgatgttcatttgtaagcatatcgtggaaattttcatctgtgattgatccctaatgatgcaaggttgtaaatctgtccttttgttgctcattacttgcaggagcgcaaaggcaggattttacgcttcaaaatacaagaaatttggaaacttgtgctacgtaattggtgccctacaagcgttcatgggccatcataaccaagatatgagaatcagagtaagcaaatttttttctgcgaaatcccttctgcaccgtagcaagtaacttaaaagcattctgttattttctcaggtcaatggaggcgaatgggaaatatatccccaggtcactgctctctgcgttggaaacgcaaaatactttggtggtggaatgaaaatcacacccaacgccatccctggaaatggaaatcttgaggtgcaactattcgttttcttcaatctcaaatcctatgttgggaatatggtagctcttgagtcttgacttcttccctgtaggttgtggttcttcaaaacttcaaatggtatgatttcgtacttaaacttcataagctgtacaacgggactcatctttcggttaacaatgtgacttcaagaaggtaatatttttctttggcttcttctcattttgtcctttaaacgaccttagcactagaaaagtcaccacctttatgctacctctcttgtagtgtacaaagcatcgaagttgaagagattacagacagtggaagtatctatgtgcagtcagatggagaacatcttggattcctacctagaaagtttcaggtgttacccggtgccatagacataatcagctgatcaaaaccgcagatttcttaggataaacttgtcaagtaaagtgtagaatacttcaactttatattcttcctgtaatatgattcattgtttagcgaatcagatttatgctcgtgttacttgtgtaactcgttactatcactatttattgtgtggtctctgttaaccacaaatagatactttaaaacattttaaagcaaaaagtcgcatctcctaaatcaatcaatcacacaaaattgaatcctaaaaatg

SEQ ID NO: 26295 - DNA, 3003 bp, Unknown
  misc_feature (1)..( 3003): 2750-1469P.txt file - cDNA_ID_2712215; gDNA_ID_2214555; Annot_ID_134754
ccgtgaatctaaagatcatgaaagattacatacgtgtatggtaacaagaagcagagtcactcgatattagctcaatattgcatttttcatttgttactactaattgcacttaactatagatcaaagcctctgatttgttcctttgattgaaacaggtttagaaagattggatcactacaaagagagcagtgattttttcaagccaaacagatgtattctatatttatattttattgcagaattgatttcatacagtcacacatacaagaccaacacacctaaacggaagagacaagctcgacagatggactcaaaacaaagaaaaaagagaaaacactatttatagaacctaaagctgccttttgtaagggttaaacttgtttgtttacctcactattttagtctacatcttctccaactgcattgccagagattgagtcacttgacctaagattacagagcaacacatcgcgccctctcaaagtcagtttaaagaaactatcaacttcctccagtaactgatccaacccttgagacaatttctcagcttgtgtccccaattccataacattatctttgaagaattcaacttcgacaggatcaacgccatcttggatcatcgggtatagcttctcgacactagcatcaacgctctccagctctttgagaatcgtggttctaccggaagacaacatgtctctgatctcagcatttacaacactctgcatatcagtaaagacctttgcccataatggtttttcagagacaggtaaatcgaaaagatccttggtggaatcagaccaggctgcggtaaatacactgcagatataaactgtttgaaccttcacaccataaaaagctcgcatcagaacctttcctttaggcgagttcttgactttaggcagactcagagatttaacaagactgtctagaaccgcacggcagttttcaattctagggttgtttgtattaacatgttgcctccagctatcaagcgaagatcgagcctggagatacttctccccagaatccgattgtaaattgtgcagaacacacttgaggaagagatctccctggttgagacgtgtgagctcagagctaaaggcattacagagatctagtaacctaacgcttatgttgaggtaaacatcaacccatttctcttcccaatcagagacaggaagctggagatcagtaatgagagtgttaatgttcttatgagtctcgcagagtgactccatagctagcttcatccaggataaagtgaggatgtcatctttgttcttaggcataagtttcttcagtctctcttccaaacgtagctcaaagccgttcaatagagaaagtagccatggcgataaatctgatccctttgatgataacatccgaaagggatttccaaatgggaagaaacctcggggtggatcttgtggtcggctcattttgctagacacctgaaaatgaaaagagaaatattgttagaataatgataatgattaatcatacaaaccgatttgctgtgaactcaatgtatcttctgtgttgttgccacacatagaaggactaatcgaggaacaatacaatcccaagtcccaaccttaagagtcccaaaaagctgacaacttttgagatcttgaaaaaaaagaagttaccacctttattgaaatgatgtaaaatcaaaatttgaagatgaaaacaaacacataatcaattgttctaagccataatctacacttgaagatgtccagaaccaaggaattaggataaaagtttcaatctttccaaaattagaagaaccctaggagttaattatctacacggaagttttgaacacagaagttcggtacaaactcttcatcgaacagtaaaatctatcttagaactaaacacacaaacttcgatttacagaagaacacacacaataaaaggagaattatagataacaaaaaaaaactcaatttccacgaaacttaccgttttaagtcgccggaaatgaagaaatcacagggaaaatcgtgtggaaatgattcttctaatgcttcattgaattttctgagtcgatcggctgagaaaaatgtctggcggaggtcgagtttgataaagctacggcccgtcacataaaaactagttacaaccttacaagtataccattagtgaatggctgttacgttttaattggtcacagccttgtgtgtagttaaattcttagcggaaagtggacggctataaaataattaaaagttttatcgaagggccaaaaatgagacgatttcgtgggattataaaataagtcattggtcgattggcgtagtctttgtttattttaattattataaccaaatctaacggctaactaatacataccacgtcctacagactcctgttattacttttaaaaataaaaactgagaagatttaatcgaaaattaattttgacgattcattattatttttggtagtactttgctttttaaaaaattgtaaaatcctcatcaaaaaaatttcagcaactgtgaatattttttaaaaggcataacaactttatttgttttacgtaacgaattccttggatttgcgtaaaacatgggcctcaaagcccaaatgacagctgtcaaggaacaaatcggtcgacaaaagtatggaccccacttttaatttacatccggacaaagactaaagagctgtctttatctcaatcgtttttcttgtttctttaagcccattaggtatagctacctcaatttatgggccatcaggtccaaagggcatttttcccaaaagattcctaatcgaattacgtcgatattgaataccttattgactttgagacaactccaccattgtgctagataaaataggcctttttaaaactttgaagataaaaaacggcccataaacgttgtgaaaaagcctctcgctgaaacagaaggtctctgtaagtgtctaatcgcgcgatgaacttgataacggcgatgaccggagctaaattgcggccatacaatg

SEQ ID NO: 26296 - DNA, 3003 bp, Unknown; identical to SEQ ID NO: 26295
  misc_feature (1)..( 3003): 2750-1469P.txt file - cDNA_ID_2712215; gDNA_ID_2214555; Annot_ID_185681

SEQ ID NO: 26297 - DNA, 3003 bp, Unknown
  misc_feature (1)..( 3003): 2750-1469P.txt file - cDNA_ID_2712230; gDNA_ID_2214555; Annot_ID_134747
agggttcttctacccaagagggccagcaaaattttaatccaatgcagcaagcgtatattcagtttgctatgcaggctcagcatcaaaaagcacagcagcaagctaggatgggaatggtgggttcatcaagtgtgggaaaggatcaagatgcacgaatgggaatgttgaatatgcaagacttgaatccgtctagtcagccccaggcctcatcatcgaagccatcgggcgatcagtttgctcgcggtgaaaggcagactgaatcaagttctcagcaaaggaacgaaacaaaatctcatcctcagcagcaggtgggtaccggacaactaatgcctggaaatatgataaggccaatgcaagcaccacaggctcagcagcttgtcaataacatgggaaacaaccaactcgcatttgcacaacagtggcaggcaatgcaggcatgggcgcgtgagcgtaatatcgatctctcacatcctgccaacgccagccaaatggcacacatccttcaggcaagaatggctgctcaacagaaagctggtgaaggcaatgtggcctcacagtcaccatctattccaatctctagccagccggcttcatcttcggttgttccaggtgagaattcaccacatgccaactctgctagtgatatctctgggcagtcaggatcagcgaaggccagacatgcattatctactggctcatttgcctcgacttccagtcccagaatggtcaatcctgctatgaatcccttctccggccaagggagagagaatccaatgtatcctcgacatttagttcagcctacaaatgggatgccctcaggaaatcccctgcagacttctgcaaatgagactcctgttttggatcagaatgcatctacaaaaaaaagtttaggtcctgctgaacatttgcaaatgcagcagcctaggcaactgaatacaccgactccaaatttagtagcgccatctgatactggtccactcagtaactcgtcccttcagagtggacaggggacccaacaagcacagcagcgatcaggatttaccaaacagcaactccatgttctcaaagcccagatactggcatttaggcgtttgaaggttttcagctctgactttttccttatgtcttcatttttattgtatgttttgctggagatgtatgcctataaataacgtgtctgcaagccaggttgaatgtttttaattgcttttttttgacagaaaggggaaggttctttgcctccggagcttcttcaagctatttctccaccaccgcttgaactacagacgcagaggcaaatatctcctgccatagggaaagttcaggatagatcttcagacaaaactggagaagaccaagcaaggtcgctagagtgtggcaaggagtctcaggctgctgcttcttcaaatggaccaattttttctaaagaggaagataatgttggagatacagaagtagctttgacgacaggccacagccaattatttcaaaacctgggaaaagaagctacttctactgacgtggctacgaaagaggagcaacagactgatgtattccctgttaagtcagaccaaggagcagattctagtactcaaaagaatcctagaagtgattctacagctgataagggaaaggctgttgcatctgatggaagccaatctaaggttcctccacaagcaaactctccccagccgcccaaggatacagcctctgccaggaaatattatggaccgttgtttgattttccctttttcactcgaaaacttgactcttatgggtctgcaacagccaatgccaataacaatctcacattagcatatgatattaaagatctgatttgtgaagaaggtgcagagttccttagtaagaaaagaacagacagtttgaagaagataaatggtctgctagcaaaaaatttagaaaggaaaaggattaggcctgatcttgttttacggcttcaaattgaagagaaaaagcttaggctatctgatcttcagtctcgtgttagagaggaagtagatcgacaacaacaggagataatgtccatgccggataggccgtaccgcaaatttgtgaggttatgcgaacggcaacgcctagaaatgaatagacaagtactggccaatcagaaagctgtcagagagaagcagctgaaaaccatttttcagtggcgtaagaaactccttgaggctcattgggctatacgtgatgcacgcactgctcgtaacaggggagtggccaaataccatgaaaagatgttgagagagttttcaaagagaaaagatgatggccgcaacaaaaggatggaggccttgaagaataatgatgtagaaagatacagggagatgttgctggaacagcaaactaatatgcctggtgatgctgctgaaagatatgctgttctctcttcatttttgacccaaaccgaagattatcttcataaacttggaggtaagattactgccacaaaaaatcaacaggaagtggaggaggcagcaaatgctgcagcagtagcagcgagattgcaggtatacatactgctttctctactccacagcgaatatccattacactctgtagataattcttcaaactttaacttaaatgttgacttttgcgtgtttcagaaaatagaactttttcttttcaaaggtatagtggatatatagtaccttacctgtttccgtttttgacgcaggggttgtcagaagaagaggtcagggcagcagctacttgtgctcgagaagaagttgtgatcagaaatagatttacggaaatgaatgcgccaaaagaaaattcatctgtcaacaagtaagggcattagtcacacaaaaaatgattaaaatagggaattagcaaagtactagttgtaactcataattaccaatgcagctgaatacttaaaaagtatgtgcttatctgtaaaatgctgataatcctgcacatccatatgtgagagaattctacagatcacaagattaggaataggcgccgtgggtgatg

SEQ ID NO: 26298 - DNA, 3003 bp, Unknown
  misc_feature (1)..( 3003): 2750-1469P.txt file - cDNA_ID_2712246; gDNA_ID_2214556; Annot_ID_134787
tattttcttgctaataccttcaataccaagtgagacgattccaagaacgatagagttaagcatcaatcccaacgcaccaacgtgaatcccttggttgtatagtttcttcattttgtcatctccttttgagtctccaccgtacacttcacgacccatccaatcggtatcgtataaaagaaaagggaaccatgcgatccagttcaaggccgtgacgattaatagcatccacattggacgtttcatcaccttgaaagctccaaagatctcaccaaagaacggagttttctcgttgtccgagtctgctttaggcgaccattgcttgtcttccacgtaccaaagagctatgattgtgacgactaggaggagagtgatggaaaggaagaaacaactcttgagatttgcgcaatatatgtcacatgctttagtcattgtgaaagggaagatcttgtagaggttagtgtatgatcctgccgcgtatcccaaaacgttcccaacagccatgaagaaagagaaaaacgcgtttgctgttcgcgttttcttagcgtctccagcggctaaatcaccgaggaaagcgcgacaaggtccttggagagtgttgttagccacgtcaaggatccagaaaccgagagcgaagataacaacggctcgcatcttgacaggtttgtcgattttgtctcccatgctgtggccaaaatcagctgcgtatccgattagtacaacagcaacagctacaagcaaggcgcctgtggcgatgaaaggacgacgacgtccgaatcttgacgtgcatcggtcgctgaagtaaccgacggatggctggacaagaagaccagagacaggaccacatagccatatgaaagatgaccatttgtgtgggactccaagaagctgcacgtatggagttagcagagacagctgaagagcccaaccgaactgaataccggcggcaatagaagccactgatatcatctttctcagcggagatggtccatcaagatccgccaacgacgaggaagactgtctatctacagctaccacatcgttttttgcttggaggtcactcatcttcttcactttgtcttagaggttgtgtttggtgttggtgatggatgagatgaaagaaacaaggcttgtctcttagagacaaggtgaagaagaggaatgagacttatatatctaaatgttttgattctgtgtttcaatagttttgaaggtaaatcttttatagtaaggctataacgcatatatccttataggattgttgtaataatgacaagactaacgttaatataacagaaatcggtttattatcttatctttatataatttattttgagatcgtgacagatttttcaatttcttgtttctgtaatgtatgacttttataaatgacaacaagttgtaaatgattttgacttattttaggtaaattccatgttcaataacagattatttggaaaaatattttgaaatcaagagatttcaaataaaaaccaaaatcttctaaaattcttaattcaatacacccccctaaaaggctaaaacataaaacaaaatctaaagaaatcagatgttaatcgacaaacaaaatataataacaagatttagagttttctcttcgcgaaagaattcaagagaagggtttaaggtttaaggttaagagtttatggtttatgctttgattttaggttttattatagtattctcattatttaagggttgcaaaaaagtattggtctaagtaaacataatattttttttgttaaatgtaaacttaacattttatgagttgtatgaaaagcttagagaaacatttcgaatttgtaagatttaatcgtttaaaagtcattttaacaatcattatcattccacacatcttccatcagctcaaatggtaccatattttgatcacgttcatgattgcccctctcttagcctttttaaactcttacggttacagactcactgactggtccgtagtccgacaatatttgccaatgacaaaaccgaagcaaagatagaaccaattgccaaaacactaacacctttcaccggtctcttaaatccttatcatacacaagcttatctcaaaagttctaatctcaagcttttatattaagttcttatttcttaatcatattctaacattttttttctttaatcttattctaacattaatatatgatcgtttgattttaacgtcattactagatagagaactattcttctatatatcttcctaagattagagttagtcaaaacaaatacatatttgacaatcgtttacaaccaaaatatcagattattaatgcaaaatctctcttaaataagaaaagaaatccaaacaaatccacaaagctctgtcacttgaataagaaatttgcataagtctatagctacactgaatttttttgtacaattttttttttaaaaaattagggaattaactgaaaatgacataatggttaacatagaactaattataggttacgtaataaatagtctaatcaaaagttttgtgtataaatctcactttttttaatagataaggtaggaaaaagaataagatagaaaacacttactaaaccggattgatcctcggttaaggagaaattcggttttgaaaaaattacgaggaatatcccaacgaacataataatctgacgaaaggagtcatttttggtcaaaacgaagaagaacaaaaaggtacaaacactttctctctgatcctttttttttaatttctttttctcaatttcaatcttctcgattagggtttggaattgcccttggaatgttgaattttaagacttcgctttgatctgtaaactaatttcagggtctcatctgaattctttgttgatttgagatgagttctgggtttttgctaaggatttgtttttatgtcttctaagcaccaaaatctgctcaaaaagtctgtaaatttccaagcaagttgtttactttttcatagtgttgatttgatcttctgcagatcaaattatg

SEQ ID NO: 26299 - DNA, 3000 bp, Unknown; identical to SEQ ID NO: 12524
  misc_feature (1)..( 3000): 2750-1469P.txt file - cDNA_ID_2712250; gDNA_ID_2214556; Annot_ID_134786

SEQ ID NO: 26300 - DNA, 3003 bp, Unknown
  misc_feature (1)..( 3003): 2750-1469P.txt file - cDNA_ID_2712266; gDNA_ID_2214556; Annot_ID_134781
atacatatacacgtcctttatgtacgtgtgtatgcatgatcacatcattacttcattagtatggcttctcgttcacataattcccacgaggatcatagttgcaactgattatggttccaccattgttacacctcactttggcacatccgagtctcactgactttctccaaacaacttgagtgtagtgaccacaaactccattgcacgtgttcgcagcgtagttgtagttagccttctcgctaacccacatgttcacggcggagacgccagacaagtcaccgctaccccaggctaagttttccccgtaaggcccaccagagtgtatgagtctgcagttgcctcttagttgttctgcgtagctccgagcataggctgcaaccctctcgtcccactgcatgggacctacgcctaccgctcctcgtgcctggttgtgaacccttagataatcttgtgggctatcttgagctttcgagggaagaacaagagcacctacaagagctacaaagacgattaaaaatcgagaatagccagtaaaattcatttttctaagttgataatggttattgttgtgttatgattttggggttcgtaaacatcgcttatatagagatttgaaaactatttttttctttttttttttgttaactatagatctcacgtttttgtaaatacatggtccatgtgtgagtattttagtaatattcattgcaattgtccaaatgaatagaagttgttttcgtaactatttttttgtcaatcttgtccttacacacatttttcctaatattgtttcgtatcggtagctttgccattgttgatatatttttttagtatatatgtaagtataccctaaatgaagtttattaagaaacattgtatatagttgtttcatgtcattcagttgttttgtgttttttttttcttcatgattctaatttaagtcttctatttcaaatttgaatttcatatattacttcattcaaaatgttttgaagatatcttcctgtaaataatacagaaaaatcgtatcggacagtttggcaattaagattatatttacagtcagaaaaaataaaagtttatatctacagtcaattttcaaataaaagaaaaaaagtcaagaattatttgtttcttagtgtttcatgcatatgagtatctctatcactcttgcctatggctgaaaagtcctgaagaatatatgccgccacatctatgacgtaagtaaaatagtgacgtagagaaacagtcaatagatcacccattgagatttatccaaaaagaaaaaaaaaaaaaaaaaaaaaaaaaaagatcaccgattgacattgtatacactttgttttttttttccaaacactaatacgcagtttaaattgaaaaactctaggtgaccgatctacttttgtgttcttctatcttcagtatacctaattttgtaccgccttcgtatatcatttaccaattttgactactgatatgcactggctttaaaattttccaatcctgatatgaatctgtgattctaagcaataacatatactccctccgaatcagaaaaattgattttttaaagtttttttgtattaaaaagattgagtttatgtatatttttatcaatcaatattaaaaggttatgaatttcaagaatcaattaattgagaattttaaaatttgatgaattactattggttaatagttacgagaaatagtttagcatgaataaatagtaatttataactaagcattattatttttttaatcggtataaacattctataaaatcaaacttttttatatggagggagaatcattttataagttaaaacaagcttgtgctaacttataaaatgacaccataggatattattacgtaataatatcctatgatatcctattcaatattatatgttattaaaatataaagtaatttaagtagaataacatgttacattaggtaaacaacgtttcaatattttcaaaaaaaaactgttatcagtccaaaaattaacaaaatagtttaaatttaaactctaagttccgatcataaaccttaaactctcaaaactagaaaagactattgtacttttcttttgcaactaacaattacattttttttttgtcatcacactatagaaaagcttttaaaaagatagttgtctcctttcgaaaaaacacgaaaccaatgtaaattagaagatagttcgcatattgatttggaaaagtcagtcctaagattgatgaagcaaattagagtgagtgtttcatgaagcaaagtcagtttttggaagcttttctttggattgaataaatccccacgcgatgatatgttatctctctgcatgaaagtaatgaataaaccttttcaacaatctattaacaatgcaaagacttctaagcaagaaaagtcgtataagttttttctttttggtaaaatttagtttaaaatcgtgtccgttgtttatttgccagatggcattttctattagatttaaaatatgtcagcaatctatttaactttaatgcgaacggataaaatgagattttagcggttaacttgatcaaaatctaataaaaagttacaaactaaaatgaatgataaatgaaggttacatgcatggagaaattttttactttgtaaatgacttgctgcctaataaaaattagttatttttaatatttaaaagaaaacataatatgtaagttaataagtatgaattgtaaggaagcaaacattcttacgttttgaaaaaagaaaacaaaaagattcctacgtaagtatgtattctctttgcttctccacaaagatattctttgtataggacacaatttactttaaacacacaatacaatatgtatatatactaatcaatgatcgttatatatattctttgtataggacacaatttactttaaacacttttcatgcaatacaatatgtatatatactaatcaatgatcgttatatatgtccatcgtactcaacctcaaacatcttaaataatg

SEQ ID NO: 26301 - DNA, 3003 bp, Unknown; identical to SEQ ID NO: 26300
  misc_feature (1)..( 3003): 2750-1469P.txt file - cDNA_ID_2712266; gDNA_ID_2214556; Annot_ID_185731

SEQ ID NO: 26302 - DNA, 3003 bp, Unknown
  misc_feature (1)..( 3003): 2750-1469P.txt file - cDNA_ID_2712293; gDNA_ID_2214557; Annot_ID_134792
ctgattggtctgagacattgaaatccttctctctttctcgtggagaaagcgatgcgttcgagtcactatcatcgtttctgatggaatctgtctctatccgtacctctcctgcctccatatcatttcctttctctctctctttcattagaggttcctgattattgctacctaaatcaacaagaaaaatcactaagaattatagaaagcctaatcatgatcctgattaggtcactaacaaaactgtaaaatgtcataccttgtagtggcctaggcctaccatcaactacatttctccacaaagacgtaaatttagaatcattttgagattctgatggaaaagctctgtgatggaagctctcatggcggcaaaagaagatatctttagggttagtctcagcaaactcttgttgaaaactatctcctgttaggtttggtttctcttccaacggatcgtaaggaaggtcaaatgggtttcttcttggtaataaaacggaaggtgcagagcctggcatgacaagtccatcgatttcgtagtttcctttatcgaaaccataaaagtttcgaccaatacaaatccgaggaacttccatatcatccatcaagcttccttcagctgcaagtaagaaaaatctccttgaccttcttctagaaatcaaattctctaacctcttgtttcgttcgatctcagatgtcccaagatccatcaaattcttctgatcatcctctgtccacgccactacaaccttgcttacatcttcacgcctttcttcttcttccttttctccttccgatgatgatgatgatgaacattcaacttcactttcatcatcaccatcaacacttattagcctctctaattcaacaagatctctgtgattgtcaagaacagagtcaaatacgttttcttctgcaacaagcaacgtcctttctctcttgaatttctccatatctggtgtaatcgtctccggtaatacttctccatagagagtagtcagaataaccttacctctctcatcctcactagcttgagacgaatcccaatctttcccaacctcttcaactttccttcttgcatttcgtctaacactttgttgatgctttaacttagccttctctgttcttccctcttgagaaatcgtagataacccacgatcctttctcttgtcttcatcacaaatcttcgaactcagatcatgattccgtatataaaacgaagcaaaagctatcaaaggagaagaacagagcaaaaaatagaaaacccaaggaagaaaagtgtacaagatgatcaaaaacgtagaaacaccagaaacaattgggtatctcttcacgtatctgaaaattgttttcgttgagaatctaagaattttccaaacgataaagcaaacatctttagcatcaaattttcccattttcttctccttctagtgaatcaaacaaacctgaaacataaaaatcattataagacctaaaacacacacgaaatgatcaaaggtattgaaggaaaacttcaaaattgatgaagaagagaggtcaagcttacctttgaaatgattaccagtcaaaatagttttggaggggttttaattgcagatttagaaaaaaatttctctgttttcttaaaaacatgatgtcggtgtggtagagaggggatggttttatgtacggatcggatcgtgcggggaagacaaaatagaaaaacaacgagggagttagttgcttacatgttgtttttcaaagatattattttcttcttattacatacacttttgaatttgttgatcgtgttacttacataaaattgcaggttaggtccctttgttttcgcagtttttgcaattatttctcatatttcttaatattgggcttttcacatgtaataagcccaacgataagaccatgacaatttctatacgaaacatgatataaattctttggatatacattatgaatttacgatatacaattagtttgtttaaatatcaaaatataaatgcgtcaatggttgttgttacttgtgagattatctttctatttaagaagaataattctcttcgtagataaatttttaaaataattttccgagttttctaatgtttctagatatgatttgatttgaacaattaattcgtggttctttgaatgaatatatcgactgtatttgatttcagttaaactgataataattgtcatttacgtctcaaaagaattgaaatatcatgtctctcaagatatggacttacatattgttatgcattatttatcaaaatatgtggacaaaacataatatcaatgtcgctttcagaataattgaacaacagatattgagaaatcaatttttatggttatatcaattgtcattgccaacatctattacatagtaacagtccaatttacattacaatggtaattcaatgaaggtaatttactttttattggtttactcgtgaaacgacgttctcctcctcacgtaccttatcttaatatcctgatcaacggacaccaattttcgacaaaatatctgagaaagaggacacgtcagcaagcctttcgctttaggctgcattgggccgtgacaatattcagacgattcaggaggttcgttccttttttaaaggaccctaatcactctgagtaccactgactcactcagtgtgcgcgattcatttcaaaaacgagccagcctcttcttccttcgtctactagatcagatccaaagcttcctcttccaggttcgaatccttgatttctccatgaatgtgcatggtagtccaacaattgtcgatgtttttgatagagagttttgtagattttctccggcgaaattccgatttgttcttcaatattatgtgcatgaaactttttttttaagattgtgcgtttagatgcaatattcgactctttgttgttctcatgctcgtcgatttcgatgtgtttctgttaatccattgatcgtatcggaaactgtgattgattgattcatattttcgtttgtctccagctatg

SEQ ID NO: 26303 - DNA, 3003 bp, Unknown; identical to SEQ ID NO: 26302
  misc_feature (1)..( 3003): 2750-1469P.txt file - cDNA_ID_2712293; gDNA_ID_2214557; Annot_ID_185752

SEQ ID NO: 26304 - DNA, 3003 bp, Unknown
  misc_feature (1)..( 3003): 2750-1469P.txt file - cDNA_ID_2712303; gDNA_ID_2214558; Annot_ID_134836
cccactggataggtgaagagagaatgttatgataaatattttctataccataaaccatctgaaagcaagtaaaccactagaaaacaggatgtccagacaaactgaaggcaaactaggagagattcatgtgactagaatccaacaaaatcttttccagtaaggaactaactttcagtacaaaaatgattaaacccaaactggtagagaacttactgtggtggaaggtcagcatcttgagaactttcactaagaatacgctcaaactcttggatattctgtttcatatcccgagtcaacttgctttgagaaggcattttagcaatactgggatagtatgctctagccacaaacagctggtccttcatttgcttcaccttggcatctttcattggttccttattttcctccctccagaggcagtagctcccatatttcacttcacaagttctccaagtttcatcaccacttactattttcctctgaacacctgtatatgaggcttccgattttgttttctgttcacagaagaaagcagagtaaggttaacgttaaatgattggtgagagatataaagatgtctactaaggaaaccacttaatatatttgtacatttgcagggcttggattggcaacaacagttggggacactggtaatcctgcagattaatggagagaccagacgtaaagtatcagaccagaatcaatataaaataatggaagaggaatttcaagaaagtgaagcttgtaaagcagacctctttttttagaatcagtgccgcttgttgcattcacatctctggaacccacgtttatgtcgcttttctagcatgtgatacaataaaacaaaacataagtatagaaattgttacaaacagtttaaccatctcacccaaggaactaattcttgaccttgcccaagacaatttgagatacattaagcaacataattcatgaaagtatttcaactttctagtctcatgagatagtcaaatataaaaaaaataaagagatcattcatctaatttctctaccctttaagcaacatcacacaaaatatacggcaactgattaactacaaccttttgacctatagtttgtttgtagtgccagtaaagtttccagattcactggctaatattagcattggcatcttgcatagctttccatgaaacgaaaaggcatctaagttttttctaatgttagcattgacatcttgcaagaatactgtggcaaacctgatacaaagcctatacatttacaaatagccctattatctgtaatcaaactacaaagcctatatattttacaccacttgaaagacaagatgtgaaacattaatgccaataattatgacagaaacatacttcaatagttgaaaattaaacatatatagaccagatctgaaatgtgtgtgtcaattagagagcagtgtgtaagataatgaagtgcttccaaccaccataaatgctttgactctatgggtacatgaaaagatctaaaatttctgtcaaaaactactaatctataacataaatggaacaggtcaaggcctttaatccacactgaaacaagtggaaccaaccttgggaagaactggattgattttttgaagaacctcatcgacccgttcggatacatctctctgcaaaaccaaagaaagaatatcaaaagcagcaaaaagattttggtataaaaaatgagaatcgaatcaatcaaaggagagtgacattacctgtgtatgcttagtagcattgattctggtaaagctctcaaactgattccaaaagaaagaagattcagaacaaaatcaaaacacaccaaaacaaacacacaaagaaacgagaaattgcttactgaagaagccggttgaacagtgacaaatcctgaaaaagtgaaaaagatgagattagatctgaaacagagatcggcagaaaaaaagcaaagagagtgttagagagagaatgataagagataccaggagagtgaaagccattgtgaagaccgagtaagaaagcaagaggaacaagcatagaaagaataacaagaaccaaaactccaatcaccagaactttccaccggcgttttcctccgccaccacctcctccaccaccgcctccgcctttcatattcccgatttagaattgaatgaaatgtctttcccaattacgaacgcattggatccccaaaacgttgccaacgatctctctatcaatgtctctctctgttctcgatacactcaaatcatactctcgtcgaattctctgtgtgtgtgttgtgttgcagaatgcacaagtataagtgtttctgcacttagcccgatcgcatcgtctctttcccctttgctttttgctacttggaggaagagagagagagatacacacacatacacacatacacacacacacacacacctctttttttttcacacgtgtggctatgtctccgccgtttattatttaacccacttgcaagatctatctccagatcataacacgtgtcttttctcacacggtggtgaattctttttactttttttgttaatcatcatcgttttatattgtcactcgttgaatcctaaactccggtatgcctagcgatatttttcaacgccattgacgacgctttatataccactggtaaatctctcctctgttttttcctattttccgatttcttctttgttaagaattctatgtatgatgaatttagctgagtgaagaagatgaattttagctgagtgaaagcttatgatagtctggtgaaatctttaatccatttaggttcaatctggtgcaagtttgtttttactgtattatgcgcctctttatttgtttgtgtggatgtaatgaagagtatggagctaaaaggatcaaattatggttttattctagcttaggctgacctgtctaaggttctcttgtctggtctgtacttttacattgacttttttcttgtgcttgatttgaatcagtgactgttcttttagttttgagtatgttaatg

SEQ ID NO: 26305 - DNA, 3003 bp, Unknown
  misc_feature (1)..( 3003): 2750-1469P.txt file - cDNA_ID_2712339; gDNA_ID_2214562; Annot_ID_134895
taagtctgtgaaaggtttcctctgggtaccatattctcaggagcagtatcatctcggtgaagtgacactggtgccatacgcggcagattcagatcagaaacagattgagctctggccccaccatcgttaaggttaaatctgcgtatcatttcatcctggcgcggccacagcaaaggggttgtgtcagcagctgatagagaggtcttgtcaccactaccaattccaccaccatgtgagctaggaggcgcagctctacctatccttttcctgacaactgaaaccttctttccaccttctctgagttgccctaaagcaatattataagcttcagctgtaattgccccttcctcagcatacttgatggcttcgcgacataaatgattatagcggtgtatcgagctatcatgcccattttcactgacatgctcatctaactctaccatgctcttggcatttcttgtccaccgtctcaaaatataatgtggtggcaaagtgagtatattagtgacagtaaacaccgtcaaaacatgtcggcagagtatgccggagtgctcaaacatttgacagctgcagtttgctctcatttcagggtagcaaaacgttactatataagctttgttgtcattttcaaaatttgcaaccctaaatgtgctggtagtaccatcatcttcaattctgtttgccgtgtgagcgaatgtctctaccaactcttcctggaactttccaaatattttccttgtaaagagatttgcagcctgattctccatgggtgatggcgtcttcaagactggaggtgtgttgacagtgtcaagatctgcttcaatctccatctcgaaccagctctccatagccctttcgtacagcctaaagaacatcggaagggttgtctgctgattcacatatccatcgaaaaaggaacccgaataaccttggctaggaaacactgcagcaaaaaacgaatcccggaaataaacaggtacccactgagctcgagcattatataaagaattaagccattcatgtcttcctaagtcatatttgtcaatgacagaactccaggacgattcaaactcctcaatcgtttcagtaaagttgatacaattatatagctccacctgaaaactaggatacgcaagacacacatgagccagcttttcctgaccttctcttagcacatcccacttattaatacagtgacgagcacctggaaatacctgaccagcagcaatctgtatggctctatcttgatcagtcaccaaagaaaccggcggttgatctctcattgctgttagaaaagtcttgaacagccagataaatgaagtgtctgactcgtccaaaataagtgcacagccaaataagatagcctgaccatgatgattcacaccagtaaatggcgcaaaaggaacacgaaactgattgcacctgtacctcgtatctaaggtaaccgtgtcaccaaaatgagtataagcaaccctagatctcgaatcagcccaaaacacatttgacatctgattatcttcatcaagctgaaccgcatagaaaaagccaggattctctgcctgcatcctcttaaaatactccaacagattatgtgcatcccgtccaatcgttctcttcgtgtttgtagccatagacgcatttctagctcctctgctattagcatccatagaaacatacatcataccactaggcacattaaccccttcttgataactagatttctccgagttagcaaaatgcctacgaggacgaagacaatgaagcatattagaacttgctaatccatgagtatgctctttaacaaactttgtaacaacccatttctcatgaccttgcaactctatcctaaccattgcatcacaactctcagaaagccttctctttgaccttttactactactactacacacaaattctcgaacactaacagacccatcagttctaggaagaagcttagaagtaaaaccaagctgcctcgagtactcatcatagaaagatttagcttctttttctgaattaaactccataccaacacatggctctgcaattccaatctcatcttgcacccctaacgagttatccatgttgttctgtccactgcaatcactaggttcaacatctccttcatctcctatctcatgattccccattgacacattctcttccaccaaatgaacatccataaccttcacttagtagagaagttctaatttcacacaaatgtttctcatcttcatagtctacaaaaaagtactattagtgtttggagatcttcttccgaacatataaatatgaggactttttgcatctctcactctccgattgtttgttgagagagagagaaacccagaaagaggagaaagcaaaagagagaaagaggagcttacgtcagtcagtgatgcgaagaactcagaactcagaagaatcgaaagtcgtgaaattagggagaagggcaacaacaattggggaaaattgagaagaagctatggcagctatttcgttttcagattcgaccggaggaaattaaactcctgcttcttctcagtcgttcgcgaggaagaagagattcaagcacgaaaccgacgtcgtttcgtgcttttgttggtttttttttttcaatttaaatagcgagacctcgttttaatctaaacccaacaacagaaagccctcataaaaagtgaggcctcatttgaaccgaacccaacaaccaggaaagcccttgatacaagagacaacgcgcgcgaaagcatttcatcttcttcatctgtcttttttagttgagccctaattcattttcggatgacaacttcatttccttgtattgtcgtcataagaatctcaggttctagatgattctctcttctcttatttgatctggttccatctcttcaccgtaccagtgtcaatcacgaatccctttgttttgaaccctaatttatttaatacgcaacacaagcaatcaatacaagagtctcttagcatcatcggcgtgggccaaatatg

SEQ ID NO: 26306 - DNA, 3000 bp, Unknown; identical to SEQ ID NO: 12619
  misc_feature (1)..( 3000): 2750-1469P.txt file - cDNA_ID_2712343; gDNA_ID_2214562; Annot_ID_134894

SEQ ID NO: 26307 - DNA, 3003 bp, Unknown
  misc_feature (1)..( 3003): 2750-1469P.txt file - cDNA_ID_2712347; gDNA_ID_2214562; Annot_ID_134893
atcacggcgcactctattgaagttttcaaagcttctaacaagagtatcacttgtgggttcatcaaactcatcatcatccgaatctctggactcttccctttcttgaaaagaaaagtcctcaccatcatcttcctcctctggagttccatcttcctccttaacagatctcgacacatgaccattcccaacatgagaagaagaaaactggttgtcaattggatgagaaagaccaaaataatcccaaggtgcttcaggtggcatggaagaagattcctcaaatggggttgattccatcttttctatagacctgcttggtgggatactggatgaggtaacagtggcaataatagatactggtggtttctcttccactttttttgaagaaaaccctttgaatttcatatgattgacctggaacggactggtactaggaggcgacggaggaggagaatacgtgtcatggtgggaatgtgaagcaggtggaggagagtatgacaaatgagaaacagatttctcgattaaagcaagaggttgttctggtgttgcactagtggacgtgtacaaggaagattcaactggaacttcagtctcagaaaatttcctgagggcagttccggtactcttaagagactgaacgtatgaaacgtgagcagcagctaacaaacatcttccatcgagtgcttgttggacgaatttttttctttctcgacataactgtaaggctttatcttcatctattctggatgttgatgcacccattgtccaagcttacatgcaaaaaaaagagtaacatgagttagatttacaacctgcagaactactagaatagcttcaaattcagaaaaagaaactttaattagtggggagtgatcatatgttaattaggactcactaactattccgactaggaaattttctgttaagtggttttggagattctaataaataggaagcaggacgatggatagatccatcctgcgacataggcttggtttagaccgagggaactgtgttctgtattttggggttctatttcagttattgatttcagtaaaatagtggttctgattatattctagtgatccttaactctaacaaaaacaaacacaacaatcacaaaaccacttcaaaaaaaaaaaaagtattaaagcctctcaagacactgtattctagggatcaatgcactgacccctggcaagacccgatcagaaataaccaaaacataactagaagagagaattaagtaatagcgagtcatctgttccactaagttatctaatgcaaaggtgtgagtgagagtatcattgtattcatgttgaatatgagagaagaacagtgccctttattaccaaattgcatcatgatatataaaacaaatgaaaattacgcattgcaggatatttgctatttagcgagacatgatcattctctcaaatctcaaactcaaatctcatgcctccgtatatagaaaaaaacaaagaaatcccaagcaaacacaacgaagatacataaattaaatccaaggcaacaaatacaaatcaagcttatgttgctcccaacacaacacaaatcaatcatacataccaaataaaaaaaaccctcaaagcaactatctatcaacaattaaagaacaaatttccactttgaaatcctaacacaatctaacctattctcttaacttagtaacctgttccgccgtttaaagttcctcaagcaaaatccttatggaaagagtaaaactttcacagaaccatcggatagatgacaaacaatcagaatcacataagaaggcaactttttcgtaatcggaatcccaaaatagggcgagagagaatataaggagagcataaccaaagtcataccgcagacaaaacacaaaactgattgaacaaattaagaagttttcttagagtaatcgaaaatcaaaacctgaaaagtgcacgaatttgacaaaaaagagagatttttatagaaaggtaaagaaacccaaatgaaattggaccattagagtagaagaaaacctagaaaaggtgagatttttcacacaagtagaagaaacaacagtaagatggagaaacggtgatacctaaagagatgtcctttgagagctttggagttacgcgagaggatcaaacccaaaagaaaacaaaacgtcttcttctacaggagacgaagaagaaggagagaggtggtctgtgtcgtgtgtgagtcagcagcgaatcagatgggtagagagaagagagagagagagaagaggaatcttatgcgagaggagaaaaaggagattgtgtgtgtatgtgtgtgactaccaacatgcaataaagcatttgcttgcttgtaaagacgattttgacggatgactccaaaaacggtaactttctcttgccgttgttatttctactccggttacttttcttacaccttttttttgtttgtctttttatttttttaaggattcattagtttatgataaacatccttaatctatggtcttagtcaattgctttacaaaacaattttgttacatgtcaactcacattttagtattttactaataatcaaatccatagacagattatgaaaaaataatccatagtgatcccataaaaaatagaaactaatcttatcaaattgacagagatactaagacttattattggcttaatttacagaattgtttgaagaatttttctggaaatgatgggaaagaatctgactgaaatattaaaatagttttgcttcgatgaaatggaggaatagtcaaaggtgtggacaaataattaacatagaaatccaaatactgtattttcataaagacgaagatgggcctctgagagtaaggcctatttatgaagacgaagatgggtctctgagagtaaggccctattggaaataaagctcactgtaacagtaacagcagcaaaacccgtaaaggtagagggagagacacagaggcttcgagtgaaatcgtacattctccgatttagggttccgaacgaaatg

SEQ ID NO: 26308 - DNA, 3000 bp, Unknown; identical to SEQ ID NO: 12606
  misc_feature (1)..( 3000): 2750-1469P.txt file - cDNA_ID_2712355; gDNA_ID_2214562; Annot_ID_134887

SEQ ID NO: 26309 - DNA, 3003 bp, Unknown
  misc_feature (1)..( 3003): 2750-1469P.txt file - cDNA_ID_2712373; gDNA_ID_2214563; Annot_ID_134906
ataaataatcggaaaacgtttttatcgtcgtcaaattagtgagctcagaatacgactcattaagtcatgacaatctgataaagacacaaaaagattccaccaaccggttgatttctggttaaataagaaaaaaaaatgtttttctttttactgttgaaaatattgagacacaagagaaatacacacaaaaattgagagctgctaccatgagtccatgaaggccaaaaaagcccgaagacaggggaaggtgctggtcaccgtcagttatattatctaaccatttctaaagattattaaaaatattttatccaccacaatgtgtgatccgatttacatcgactcacttaatgccttcatttaccgcacttgttaatagacgtcttgttcttcaaatttgtccattttgtaaaattgtagggtcaaaagttgtgatgatgaagttatgaatgtgttgaagaggaggaggggtcctctatcatcaaagagtcatggacggttgtgctgaagtttcatgagacaagatctcgatggaagatctatttgactctttttttagggtttttttgaaattgaaagcatgtcttcccgacacatcgtgcattacaatttcatgatcactccattaattcatcaaatcgcttttatagtcaacgccatgatcctttgactcttgcttcttgagctctacgattgctggactcaattcttttttccgatagtttttcagtatggtggtacatatatgttttggtggtacactagctagttttgtacacataattttgtggcggtaaaaaggtgaaacgtgcaatattagtttaagaaattgagattactaggatccttgtatcatagccaatggtatgtcaacaaacaaaaataaaagccatagtcttatacaatggcggatccaggaaataattttatatggagcacaattataaaaaatcaataaaaagacatagcaaggcttgaacttgggttaatgtggggcaccattaagtaaaataccactacactacatacatttttaattacataatgcaaacttatataagatttatataattgagtatcgggcacatgccccacccaagaccaacgtgtgtccgcccctggtcttatacattgtcatattgctgcggataacaaataaaacaacaaaaattgactgtatagaaagaaaaagaaaagagataggaaatgtggaaagtgagagagcaatatggaacccactagacccataagagagtattggttattggacggacttttcatgtgtctaccatactttggatacgtgtcgtccatataaagatgatgattgatgatgatagtggtgatgatgggcatgaccatgggaggcaaatctttggcagagaatcaagtgaacattgccatgtctttgccactaccacactacctaactatttagtaaattttcttattcttttgccaacgaatctgatcgccaagtataatacgatgagcgcaaaacactatttcacatttaggttacattttttttatttaatactgttcgtagatgtaaaagcatttaaaaatagtatctataatacttagaatataaaacatcatttatactatatattttatattgtggatttttaacaaatcccattaacaagagatacttgtagcatgggaacttacaactaaattaccgttatactactattttcctctctaaataatacattcatctcttcttatttatctccaaccactaaaaactttgactggtcatataatttttatgttaccaatcatcataattaagatttaccaatttaacttcacaaaaaaaaagatttatcaatctaatttactgattgagtattacaccagagaccaaccacatttgtactaaaagtgagaaaaagaaaacataaaaattatatccaataagtaaatgatacgcagcaaaacacgtcacatcgactcgcatatgaatacacaaaccccacaacataaactgctaaatagaaatagggacgatgttgtggtccgacgaaaatcttttccactagtcactctttcaatcaggaccattacaaattatttcgaatgtttgtgcagagtataaataaaaacaaattgaatattgtaaatacatcaacgatccaccgtaaaaacattcaaaattctattccttttttttttttttgggatttaaaccactcttaacattcaaaattataagcaaattcttaattaggttcaacgattatttgatcggtgacatcccagcagctcaataaacatatattaaaatcgaaaataaaaaatactgtcatcacaaaaactcgttattatttaatctcttttaaaacatcttgttttcgaacatcttgctaactaatgtataagtttttttgtttttttaaacgttaaactacaattctttttgacaatgaacggttttttctatatatatatattttcaaatggctgttaaaacccaccaatagcaatgcatgtggttgtggtagtatacacattattaaatccctcatcctcttatcttaaaaaaaaaaaaagtctttggtgggctaaacaaatcctttaaaatcttcatatagatttctttccattatttattttatccattatcaaagtcttttttttttttaaatttctttctctcgttgtctccttggaaattactttcatcatttaaaaaacttgcttactccgtaaaccaaagctagatccaattagtcttatttcctttttattcgtctctctctcactatccgagatttgggttgaaaaatacaaacccccttttatttctcctcttctctcctacaagctcattcagaactctcaacatttccggtagagaaaaaaaaaccgttttttttttaatctctttctaaagaaggatatcaaaacaaaacacaaagttgaaaactttgcatctgggtttgtctattttagattcagatcttagtttttttcgattgaatatctacaatg

SEQ ID NO: 26310 - DNA, 3003 bp, Unknown
  misc_feature (1)..( 3003): 2750-1469P.txt file - cDNA_ID_2712377; gDNA_ID_2214565; Annot_ID_134931
acattattttcatggaatttgtttagctggactgtctggacctgaaagatctggcagtatcgcctctcatttcgacaagtatatgaactcggaggctacattcaaggacttctttgagctctacatgaagtttctgcaatatcgatgtgatgtggaagctaaggatgatcttgaatatcagagcaaacagcctacactgaggtcttctttggctttcgagaaacagctttccttgatctacacggacgctgcttttaagaagttccaagctgaggtacccggagttgtttcttgtcaacttcaaaaagaaagagaagatgggacaacagcaatattccgcattgaagatttcgaggaacgacaaaatttcttcgttgctttgaacaacgagttgttggatgcgtgttgctcttgtcatttatttgagtaccagggattcctatgcaaacatgcgatacttgtacttcaaagcgctgatgtttcccgcgttccgtctcagtatatattgaagcgctggtcaaagaaaggtaacaacaaagaagacaaaaacgataaatgtgccactatagataaccgaatggcacgttttgatgatctatgtaggcgctttgtcaagctgggagtagttgcatctttatcagatgaagcctgcaaaactgctttaaagttattggaggaaaccgtgaagcattgtgttagtatggataattcttccaagtttccttcagagccagacaagttaatgacaggtggatctattggcttagaaaacgaaggtgtgttggactgtgcatcaaaagtgtccaagaaaaagaaaattcagaagaaaagaaaggtgatttttagattcttcaatcttatgagattatttgtagtttgctagccctggcggaaagatctgattgattatcttgtgtttaaaggtatactgtgggccagaggatgcaacaaacaggtcagaagaacttcgccaagaaaccgttagtaatctgattttgccatgctattatatctgaaatctcccattttcttagcagtgttattattcatggcaaattattttcatccaaatacttgaaattagtccatgcaccctgatactattaggcttatttttcatgtgcaggaacaagttagctccagagctcctacgtttgagaattgttacattcctcaagcaaatatggaagagcccgaactaggctcccgtgcaacaactcttggggtctattattcaacacaacaaactaatcaaggagtgggtgcacattattactctgtcattttgttgtctaacaatttttatattactgtttcattgaaattgatacactgttcttgttattctggcagttcccatcgatttcttccatccagaatggttactatggacatccgccaaccatacaagctatggtgaaatgctttatctatctcatttttagtttcaaagcttttgttataacacatgcaaatccatatccgtaaccaatatccaatcgcttgacatagtctgatgaagtttttggtagttaagataaagctcgagactgatatttcatatactggatgatttagggaaacttgcattctattcatgaacgaatgagtcaatacgagacacaaccaagcatgcaaggagctgtgagttgatgttctatgctatttaagtatttttcgggagatatatatatcttattgttctcctcctcccgagtcaagttgttctaagaaagaaggatctatttcattttgtggattgtctagtttcagggacagacggggtttaggggaagcgctatccgtggctgctatgacatcgaagaaactctgcacgacatggtatgtaatcttgtgacgttagtaaaaacgctctaatgttacaaaagaaagaaagagaaaacgaacccaattcctcaaaatgttttcttttgacaatgtcaacttcttccttctcgggtttttatcagtttgattgaagcgagactgcgaaattcctctgtttacagtagaaaatgtgatcagccctatttataaccgttgtatgttttccggtttttgtttgtgcagacaatggggtcctcacagtttcagggatctgattcgagccatcctagtgatcaccgcttatccaattaacagaacagaacaagctcaagagttgctactttcatatctttaaaatagtggaatgttttgtatgtacagaaataggaaaggtctaaagtgtggaactggctttgaggtaaactcttactctgattggatttgcttgtatttataccggaatcataatataaatatatgattaatgtattcacattctctaatcttcttttagacttgtagttaccattcaaaagtcatggacaaccttcgttaaccttgagggccactgagagacaaccttggacttggtcactggctcacttagcaatattcagttattcactctgttgtatataactcaccaattaaattcaaacaactaattcaaaacattatactatagcttttcattaaaaaaattccaaaacattcatttaattatataaaccaaagaacagcttttaagacttaaaatatttcctaagtatccaacaagtcaatacagattttttaagaaaactaaaccattttttcaactttacaacaaaaacaccaactgttacaaaaaaactctcgaatttcctatttctccagccttatgacaaagatatcagattaataaaatttagaattcattactttttcttcatttttaaaattatctacatactatttatttctctccattttattcagtgagaaaataaaattacaaatgcctgaacacaaaaataaataaaattagaataatcagtttcctctagaggatattcttcgtcacaaaattaaaaaaaaaaagagtaggagaagagggaagcgactagcaccttttgtagttttccgtttattttctgtataaggcgggtgatttcggctccttcatcggaaattatg

SEQ ID NO: 26311 - DNA, 3000 bp, Unknown; identical to SEQ ID NO: 12685
  misc_feature (1)..( 3000): 2750-1469P.txt file - cDNA_ID_2712388; gDNA_ID_2214566; Annot_ID_134958

SEQ ID NO: 26312 - DNA, 3000 bp, Unknown; identical to SEQ ID NO: 12685
  misc_feature (1)..( 3000): 2750-1469P.txt file - cDNA_ID_2712388; gDNA_ID_2214566; Annot_ID_186010

SEQ ID NO: 26313 - DNA, 3000 bp, Unknown; identical to SEQ ID NO: 12683
  misc_feature (1)..( 3000): 2750-1469P.txt file - cDNA_ID_2712394; gDNA_ID_2214566; Annot_ID_134953

SEQ ID NO: 26314 - DNA, 3000 bp, Unknown; identical to SEQ ID NO: 12707
  misc_feature (1)..( 3000): 2750-1469P.txt file - cDNA_ID_2712397; gDNA_ID_2214567; Annot_ID_134988

SEQ ID NO: 26315 - DNA, 3000 bp, Unknown; identical to SEQ ID NO: 12707
  misc_feature (1)..( 3000): 2750-1469P.txt file - cDNA_ID_2712397; gDNA_ID_2214567; Annot_ID_186060

SEQ ID NO: 26316 - DNA, 3003 bp, Unknown
  misc_feature (1)..( 3003): 2750-1469P.txt file - cDNA_ID_2712409; gDNA_ID_2214568; Annot_ID_135017
ctggatttagttgcatatatagagagaatttcattagctcttgatgaaaactagggatttagaaaaaaagagatagacaatcaaaatgagctaaaagctagagaagttacgagcatttcagcagaatcgtaaagcccatgctctattaaagtcgcgatctgctcctttggaacctccatttcagagacaagagagttcgtcgttagtggcaatggtgaagttttttcttcggagcagcgatgaagtaaaagatccttcacgctcgctcttcattttgaaacaagaaatctcgaaccgagtcaacccaaaccgacattaaccggttatctatctgaaatccatctcggttcattaaaacccgacttttccaagagcccgacttcaccgaacaatctctatctccggtcatgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggttatctctctctctaagatcctctctatgaagttaaaaatcacttctttattatattcacttggttattatttcattaggataattcaaaggtcgagggatgttttggaaaactctagctcaagatcaaggccattgccatggcggagatcatttggacgaccaggttcagttcctgattctgttatcttccagcgaaagcttcagtggcgagctaggttggtttactattgattctaactctatagcttcatttgcaatctcctttttcgaagtgttagattagttcgccgttgtttctaactagtgttggctctaaatacagcatatacactaagcaattacgagctgttcgattacattcaaggcgcttggaactagtaagtttcattatacaatgtgttcttctctgtttgatgtttgtagtattggggtttacactcttacattattggatatatgttcacattggaagccttatatatacctgcttcgttgtgtcatcttggattattgtagagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaaggtaagatttttatacgctagggttttttcagagtttcaagtagttacaggtttagtatagtagtacagaaaacacataggcaacctaaacctagtgacttgtaagtctgaacagatgatagagctgatatctgtttggtttaggttttttggtcatatactatttctgatgagaaagaaaacatttttcagatgttttgcggagagtatactcacgatggagacttatgatgcagtggttgaatacaatgaggtggagtaatagcagtaaaaaaaacaggtaaagaaattaggatatgtattatgtgggtttggtttcactaagtaggaacctgttttgcttcgatggttttttttctgaagtcattatgttgtattcgcttgcagataaccgagcactatgctctcgtcaaatgaagtaaatagacagacttacaacgcgactgttggtgtcttggaagttcaatagtggaaagactggaccaagtaagagaaaccaagagttaaagagtaggtaggaggaagatgttgagatgatgcaagtttaggtgtggagttagttttgagatagctataggtggattctcaaatagctgacacttagtctctctacttccataatgtacgtctcttctataccaaaaattctcacccccaaagtttctttccaacgcttttcctcacctcatcattttttcttacgtttcgagtaccacctatttcaacaacattaaatattttctataatttgactatcaatttttaataaattaaaactatacatagttttagataaattacacgaagcttccatagaagaggaaagttcatttgaatttctcttctaaaccgtaccttaaagattaaatggtgaatatacacggggaaatttttttaataaacaacgcgttctctattaaggtattgattgatataagtaagcaagcgggtgtaacacaaaataaaatattataaaaggcttcttctataggttggtaagcggcaatccagctgccattgcctatttgacttcccccattcgatcatggtgagctcgtcttctctcttctcctcttatctctttctctaccattttcttttgctttaaagctctctcaatcatgatcatgaagacccccatcacagcattccattcatcctcatgaataattctacatcaggtttcttctctttccctttctgattctcaacactcttaccacatttctacttttgtgttgtatatcgatttttgttctacattcttccaaatgtcagggaatctagttgaaatgtgatgatttttgtgttgataacttgatatctggtatggattgaatgattggtgattatctctgttaattcatctctgatcgtgtttctgtttgtgttgacttggaatgtggacctggtttggatagtgaagaggctggtttcatctaaggcaatg

SEQ ID NO: 26317 - DNA, 3000 bp, Unknown; identical to SEQ ID NO: 12741
  misc_feature (1)..( 3000): 2750-1469P.txt file - cDNA_ID_2712413; gDNA_ID_2214568; Annot_ID_135013

SEQ ID NO: 26318 - DNA, 3000 bp, Unknown; identical to SEQ ID NO: 12725
  misc_feature (1)..( 3000): 2750-1469P.txt file - cDNA_ID_2712416; gDNA_ID_2214568; Annot_ID_135012

SEQ ID NO: 26319 - DNA, 3003 bp, Unknown
  misc_feature (1)..( 3003): 2750-1469P.txt file - cDNA_ID_2712419; gDNA_ID_2214568; Annot_ID_135004
gttacagtaaaccggaacattagcgtcaattaatcacctaatctgatacctaaaagtaaatatatagctgcttctgtatatatgacaagaattatgacaagaattatataattctgtaaaacatttcagtcatatagagagcttattattaaacttggaaagtaatgaaaagtagtagtaataacttttttgacatgagaaaataagaatattgaaatagatgaggtatatatagcgttgatgactacactaattactcataattattcattgcacacactatattttttgtgttgacaattttactttttgaatgatcacactcgtgacaattaatgggcatgatattaaacaacacatcaaaaccgtgtacgcatcataagtcgttttcatttgttttataagagcaacccagggtccaacttatgttatcatggcacttataaccaaaaagtcttattaatattagcatttttgttagagccaacgaaaaaactagatttttttgtacggtgtgatttttattagatgagactgatttagagtatatgttttacgattgtttggtgtttaaatagtatatctagtcgacagagaagcgatatacaatcttccaagcaaaagctgattgtcgatgtagtggaaatcattgtgtgtcgtcatgagttaatgtgggctagctcatgattattgtcgtctcattttgccaatgatctttaataccatggtcaaacggcaatacctattttggttaactagtgttttacaaacgggtaccatccacaatatcgacttaagttgtatttagctactttggtcgcgataaagtagcaactttgttttccctatcacgtttttacttgcaagttgcaaacatttttattaatagttgatttcgaataatcactaaaataaacatcaaatgaaacaaaacacatctctataactttacaaggaaattaatatagtaaatatgtaaatatatttagttacttttaaatatatattaaaaattaattactaaaaatattgtgactaagatattaattttgaaaatatatatatggttactaagatattagtcaatcaatcttttcctaaaaaaaaaaatattcagaagataatcttttaacatgatcacctctacatattcaattttttttgaatttgtctttttacggacaaatgaagtggcagagagcatcaattgtactcaccattttttccactataaaaataaaaatattagaaaattaagagattttttcttagaaaaaagaaaataagatttaaataatgataaatatatatagacttcaaataggattgttggtgaaaattttgccttgctatttatacctttatagtttattagtaccgtgggagatttttgttcaaatatcatgggcgttatgataacatttatatgaattcatatgccataaattgtaattattatttttgtaaaagtaaaatgatgtcaattcaatgtccagtcgctaccaactcaatggaaattaatacatttgagtgtactaatgtgtttttcttgtgcgtgttaataaaaaatattcgatgtatgaatgattcttaactgatgtaggagttgtaggacactagctatatcttgaatcacatcagaaaagtttattaattctaagtaaatacgcataaggattgaccaattaattcacaacataaataacataaaatcagaaaaatcagttttaatatttagctctatcattaaaagtgacggattgcccattgctttccacaagataataactatcgtgacttagctaactcgttaaataagcaaaatttctctgacgctcaaaactataaaatctaatgatgtttgaatctttatcaaaaaaactagaatttgtagcgacttcgaatacataacaacaaatcaatacaacacactatacaaacaacaataaaaaaaaggatagaaagagaaactattacatgcaggtaatgtggttgcagccttcaccccgatcaactatactcatacagttttgacatttcatccatcctagactctttgttgcagcatcaaatagtccaatctctgaattcttataagccttggacttaataaactcatctcaagtctttatcttacatttttaggcataatttgaaactacattcaaggcatttggaaggttcagtctgagaataaccaaagttgcgctttgacatgagaagtgaacaagatgggttaggacattacattttgtccaaaacgtggatcttgtccattttttctttctggattataagagtcatttgatgatatcagcaatatcgtgaaaatattttaagagaataactaattctaaatcccaaaaactttgggttcgaaaacgtaggttaaagacgaatgtgttaaacattttgatcaaagttaaagagttaaaaatttatgtaacttgcaataatcaaagaaaaatagaaacttggatgaaggcataaatttagggttatgacttaaggtagaaaagagatgtagcagtgcacgtgtgctcccaaaacctcatcatcatagtgtagtgtcatgtgcataattaaataaaaaaactcactggcttgtaccattattaatcgcacaaggagtattacaaatcagttgttttcatcattctactctcatcatttcatttcctctcatcattagcttcttttttcttcccaaacttattctattgcatgatctagtcatttcttttgctaacaatttgttagtaaaattttttagatatttttgatccaaggagttttttttccaataatttttcattggtaagaacgccttcttacacctattctttttttcgtcaatttcttgcacctattttaaaaatgcaatttgatatcttttcaaataattaaataatattttctttgacaaactaaaatgatttatatatggcaaaaagcagaagcattaattaactttatagattcactttttctttttatattatg

SEQ ID NO: 26320 - DNA, 3003 bp, Unknown
  misc_feature (1)..( 3003): 2750-1469P.txt file - cDNA_ID_2712423; gDNA_ID_2214568; Annot_ID_135003
aagtccttgaggaagctcctgtgttcaacccaaccgaagaggtcagttttgttttctttttatgaaagaaaaattagggtattaaactaaattatctttggtaaagaatcatgtactcttacagaggaatatattccttttcctcttacccagtgttactgaattatcaggaattcagggacacactctcatatatatcaagcttgcgtgacagagctgagccgtatggaatctgttgtgttgttcctccaccttcatggaaacctccatgtcttctcaaggagaaacaaatatgggaggcttctacatttttccctcaagttcagctctttggaattcagaccgagaaccgaaagattaaaaaggaggttgatgcagatagtaatgatgctgcatctgaaggggttcagttatgtagagtagaacgtggtcctgggtatactttgaagtcctttaaaaactttgcagatacatacaagaagagtcattttggcatgaaggatgaggttttgggttcagagaactcatctccatcacttaaaccaaatgagctaattgtggcagacattgaaaaagagtacagacaaattgttgagagtccacttattgaaattggggtaatgttaaaaacagttgttctgcttttatatatgaaacggaatatatcactaacttgtcgtgtaaatttaggtgctttatggcaatgatttagacactgcaacgtttggaagtggatttcccttatctgcaccatctgaatctagcaaatattcatcaggttggaatctgaacagtacggctaagcttcctggttctcttctatcattagaagactgcgaatcagtttgtgttcctcgtctaagtgtaggaatgtgcttgtcttcccagttctgggtaagttttaaggttgatgtcaagctatggtcgtcaatttctgaaagcataagtataactggtcaacgcagaaatagcatttgttttgcaaactaccactagaataaattttgcagcattgtaagtttattaatctaatttgcttgtgtagtctcatatttgtctcttggaatatctgttactgaacagaaatctgagaaggagagactctactctctctgctatttgcatgtgggcgctcctagagtgtggtattccgtagcaggatgtcatcgatcaaagtttaaggctgccatgaaaagcttcatccttgagatgtcaggagaacagccaaagaagagtcataatcctgtaagtatttgaacacattaagcatcaatacaagttactcttttcaaaattccgaaagaaaatagacagaagagtgaccaacaacgattccacttgcgatttagttcttgttcagcatacacgaccatgacatgacatagagagatcacacagtatttggatttatctgttcaaagcaaatcctatcattactttgttaaatttttgtgagctattatatactagtattggttcatttacaagggaagcaattcatttggcaggtgatgatgatgtctccatatcaattgagcgtggagggtataccagtgacccgctgtgtccagcaccctggccagtatgttattatatttccagggtcgtattactctgcctttgactgtggcttcaactgtttggagaaagcaaactttgctccccttgattggttgccccatggggatattgctgttcaggtgaatcaagagatgagtaaaacgtcgctgatatcgtatgataagctattatttagtgctgcaagggaagctgtaaaatgtcttaaggaatatgggttgtcgaagaaaaacacagcatgttacacgagatggaatgattcttgtgggacggatgggttgttctccaacataatcaaggtaatactcactgctcctcctctttgcttgtcttattcctcagattatgcactaaaacctgcgtagaataacttcctcagtaccttttgctaattttgtttctctcttttatgtagtcacggatcaaactggagaaaaatagacgtgaatttcttatcagttcactagaatcgcaaaggatggacaagagttatgatgctgtgaacaaaagggaatgctgtgtatgtcttggggatttgtatctttccgcggttaactgttcatgctctgctaatcgttactcgtgtctgaaccacatgaggaagctctgtgcatgtccgtgtgacagaaagagttttctctataggtacactatggatgagttgaatcttctcgttgaagccctggaaggtaaaaagctcagctctatgttcagatgggcaggcatagatcaaaaattctgtgcttctccagccaccacaagttcaaaacccgaagaagacaaaggcaaggaaacagatgaggttacaccctgtaatatcacgaggaaagatgtcgcagctggaactaaggaccagacaagagtgaaggcgagatctttggctgatatactgaatgttaaagatggaaacaatgatgcaaaggagactttagaatcttgttctaagaaatcaaacaggccatgcgataacgattcctctgaggccaacgcgccaaagaaacagaagcagtgatgaataatgaaggagattgtagtttagtcacaaaatgcaagacgataaaaacacttttgtcttcttcttaaatcgatatatgaagcaacttttttttttggtaggcgatacatgaagcaacttgatatgtgttttgtttgttttggctaatagacaaaaacatttttttggtttcactaatatttatttacgttgactctaactaaagtagaaggaaaatatttgacgaaaatacagagccgttggatttgatgactttatgagattgagattagttttgactttctttttttgagagctgcggttttgtaaaaatggcccacaatttctctgaaaattcaaaattcagtgccggagattactcgtcgtagtcgtctgtgtcagatttagttctatttgcgatagtgcgaatg

SEQ ID NO: 26321 - DNA, 3003 bp, Unknown
  misc_feature (1)..( 3003): 2750-1469P.txt file - cDNA_ID_2712427; gDNA_ID_2214568; Annot_ID_135002
actgatgcttacgatctcttttgcatctctctcgtaacgaagctcctcggtcgtatttattaccacgtggaaggcgcacaaaagcctgggactctccctcccaacgtcgcagccgccgtcaatggcgttgccttctgtgggactctcgccggtcagctctttttcgggtggcttggtgataagctcgggaggaagaaagtttacggtatgacgttgatggtcatggtcctttgttcaatagcctctggtctctctttcggacatgagccaaaagctgtgatggccacgctctgtttttttcggttttggcttggatttggcatcggtggtgactaccctttatccgcaaccatcatgtctgaatatgcgaacaagaagactcgcggagcctttgtctctgcggtttttgctatgcaagggttcggaatcatggctggtggtattttcgctattataatttcctctgcttttgaagctaagtttccatccccggcctatgcggatgatgccttgggatccacgattcctcaagctgatttggtatggcggataatcctgatggctggtgctatccctgcggctatgacgtattactcaaggtcgaagatgcctgagaccgcaaggtacacggctttggttgctaaggacgcaaagcaggcagcttcggacatgtctaaggttctgcaagtggagatagagccagaacaacagaaattggaagagatctcaaaggagaagtccaaggcctttggattgttctcaaaggaattcatgagtcgccatgggcttcatttgctaggcactacatcgacatggttccttctcgacattgctttctacagtcaaaaccttttccaaaaggatattttcagcgcgatcggatggattcctcccgcgcaaagcatgaacgcaattcaagaggttttcaagattgcccgtgcgcaaacgctaatcgccttgtgtagcacggtacctggttactggttcacagttgcgttcatcgacgtcattggaagatttgcgattcagatgatgggtttctttttcatgacggtctttatgtttgctctggctattccttacaaccactggactcacaaggagaaccgaatcggatttgttatcatgtactcgttaacattctttttcgccaactttggacccaatgctacaaccttcgttgtgccggccgaaatcttcccagccaggttcagatcaacctgccacggtatctctgcagcatcaggaaaattaggagcaatggttggtgcgttcgggttcttgtacttggctcagaacccagacaaggacaagaccgacgcaggataccctccagggattggggtcaggaactcgcttattgtgttgggtgtagttaacttcttaggtatcctcttcactttcttggtacctgaatctaaaggtaagtcactcgaggaaatgtccggtgaaaatgaagacaatgagaatagcaacaatgatagtagaacggtcccaatagtttaggtgatataatacgccttttgtaataattttcgttttttctttctccttgtctctagcaactcaagttgttctttgtgtaatccattgatacctaattaatgctagagaaatcaaaattttcatgagtcgattttaaatcagttcctaaattgaagatttattagacttgaagaagccgtgcaagttgtgcagtatatatgttaaatcacaatttatgcgttgcggggaagttgagaccacagataaaggcttcacttaaagatacattatggcttattaatctctagggtgaaaataacgaagtgctgaagaaaaactctgttcttttaacaaactcccttgcaccgaacaacattctcattgttcatcgacctatggaagaccaaaaacgattgctactttggtaaattttgtaaactttagggcatatgaaagcggtgggtatatattatagtttcacaatggtaagaaaaatatttgggatgttacagtatttttaggcatggtaaaaaggcccatattggacataaaaatatgtaatccctcaaatgaagtggaaattagataatttatttatttataaaactctgaatttagataatttcttatcttttgtttttgtaaaaaagaatttcatgttggataaaatatatattgcatttattgtgtgtgactatcttattggtggacaaaatatacatttttttaaaaaaagtattatcatcggaaattaggtttttcgacgggaaaaaaaaccaatcaccataacaaaatccagaggctctgttgttcttggggttgaatgtgtaatgtctcataagtcttcggatctcacttcgtccgggtatgtgttctactcgcttttcgtctgttaaaaactggaccttccgatcgctaatcaatatcaatcttagctttttttcgtcttccggttttagattttgtatcctaagctccgatactctttacgagaagcgtttttatttcaagctcagagtcaatcttagtatagggctgctaatggttttcatgtcttggatcacatcctgtggttgaaaaaggagtattctttactgattcttttgagaaagcaataaccaataaagtagaaggctctccttcgtaattgacctggaatctgtgatataagtattgaaagtaccataatttacagtttgtctctcagttcttgaaagtttagatgctgtctaatgatatatggtgtatgagtttaagttcctagactaatcaagaagaccgtttctgtgatctttgtgatgatgactgaatcttctaagtagcagtctttttcttcacacctatcattttttagttgaataacgtatcgtagttactgtgtttaatcacttggtttatacttgacattagatttctttccatcttctgcaggaagttgcatctttattgacctcatctgaagttcaatttatttcgtcttccggaaatcaatccttttggtggctgtaaggtttaatg

SEQ ID NO: 26322 - DNA, 3000 bp, Unknown; identical to SEQ ID NO: 12776
  misc_feature (1)..( 3000): 2750-1469P.txt file - cDNA_ID_2712456; gDNA_ID_2214570; Annot_ID_135056

SEQ ID NO: 26323 - DNA, 3003 bp, Unknown
  misc_feature (1)..( 3003): 2750-1469P.txt file - cDNA_ID_2712475; gDNA_ID_2214570; Annot_ID_135050
attatccgaataaagatatacctaattctgatcaaaagagagcgaaaataagtctctggagtttagattgagaaactaaatgtcaacaaaccggaaacaaaaaaaaactgtgtcaagtaacaaaaacaaaagaaaagactcaaagagagtagcagcaacgtaagatttgattccaaagtgtctcacaagggaggaatgagtaatgctactccctgttttattcactcatcacaagtccatcaatcaatctatctctttactcttggacctctggctgcttctttccacctgctttcaagtaccaaccaatcgaaccgacaatagcaaccacacctgccacaaccgcatagtttctgttcttgtcttctgacacctttgggcccgactcagctgatgcagatgctgttgcaccagcaacctttgcttcgcttgctgaccctgctgcttgttctccaggaccctagtaagttcataagaagtttcagccacacaagactgtaaattttctctttatctaaacaagctattcgtagtttcaacaactggagttaaaggaattatttacctgtcgagctaacttctgaagcttctcctgctccattttctgcaatgtagaaaaccataaacaaggtaaaatataaggacagaagatgacttactcaaaaatataaattgttttgaaaagagtaagtattatgtaacaggtttctagttcaagctagatgctacaaggtttagataacaaatagatttaacttctacgattaagacacaagataagtttcttataagtaaaaccaaatattatctaatagtttacaacagagacagatagaatcaaacaagagcttgataataagtgttcatcatcaacatcacaaaaggaaagtaaatatacttatagttttttcgaggattcttagtctactattattgttcacatcaataaggaaagcttctgatctttaccttaatgaaaacattctcagcggctctctcctcttcgctaagaactttgccactagagaacctacgagacacaattctcaaagcatttcttgttgccatggtaatgaagaagtatcctgtgcataaaacattaaactcattttaactaaagcagacagtgaatgagagagattctaggaactaacaaaatcgttcactttgaaaaccctgaaattgtttgaaaactccataaaaactattacagaaaacctataaggagtaacattggactcttacaatccttttcgtcatcatcaatcataacatggtaaatttgtttttgctaaataaacatggtgaattaagatactaatgtatcaagtgtcaactattactgtatcccacgtatcagcgacaatggtgaattactttaacagaaacataatctacagcacaatagcgatgctagaggtaatctcaagattccacacagacagttacagaaaatctataatgaggaaacacttattggtacttgtctctcaaaatcctttttgtcatcatcatttcatacaatggggaagtcaccaaaaaatctattactgtatcccaagtatcagctactacattcaaatcaaaatacatatactcatggatccttgtggaggctgtagaatgttaagtgtttgttaccacaaaaaacagtgtaacaaacacagcttctcatataccaaatcgatccaaatctaggtttagaaaacgtatagaggaagcacaaaagatcatccagcgaaaatccgaggatcgcgaataaacaacaaatcactgattataacaaatgtaatcataaaatcaaaacctaatccggatatgataacacagatacgaaaacggtagctctgacctcgaaaatggtggtatcggtaacgaaaaatcgaggtcaggtgttagatcgacagagaagaaaaggttagaaaaatttctgagctaatctaaaaacgagaaggaaagaatcgtaatcggagaagatgatcggaagatatgagagacctggttcgatggtagatcgttaaaagtttcgtctggctgctgaatgctgatgaaatccgcttacagaagaaatggctcggtgaagaagaaatgaagaggaaggtgtgagatatggaaggagctaaaatgggcttaaactaaactattgggcctaaaatcattttagcccattgaatgcgcgttgaacatttgtggtcacgaacactttagctattgaacattaaaaagttttctaggatttgaatcttgcctttgctcaaaatagtttctattttattatgatatacaatattgcttttcccgtaagtttcagccagagtacaactccatatttcactgtctcctccacattacaagaagccttcaattacaagcactctaacatctttattagcctttttcttttgtaaagaaaaagaattatatatctatctgttattctcagttttgttcttcatgaaaactcaattgcatattgtaatatctttcttttttttgttttctgttttgccttcaacttcacacctaacatattttttctaaatctaatccatacatttccctactttatctatacgtatctttgtcttatttatagattgagaaccaaacaatgagaataacattttagctacctatttataatacaccaactcaagaaaattgttgtattaccaattcaatataaacatgttaacctacaagaccttttagccccacttggtattctttttttactatatgtttttcctttctatgaaccaacttaatatatttcatacaaaattagtttctgattcaaattttgccctactaagtctctaaataagtttagaatatgtttaatcagggatagtgtggttgactgagagggcatttttgtcattatacatcggtaacaagtcttgataggctcttaaggccagtcttgggttatataacaaggcatctcccttttggtgctcatgtaaattgaggaagagaaaaaggatctgaggaacaatg

SEQ ID NO: 26324 - DNA, 3003 bp, Unknown; identical to SEQ ID NO: 26323
  misc_feature (1)..( 3003): 2750-1469P.txt file - cDNA_ID_2712475; gDNA_ID_2214570; Annot_ID_186144

SEQ ID NO: 26325 - DNA, 3000 bp, Unknown
  misc_feature (1)..( 3000): 2750-1469P.txt file - cDNA_ID_2712479; gDNA_ID_2214570; Annot_ID_135046
tgccacactccatcaattcttcctccaccacaattacagcaatcacctataacaacacagtccaataccaacaccataatgcctcttattgcatcacactgttcatttccagcaaacatatacaattcctagttccaataacatttcaagttaaacaaattctcactactagaataatcatgtatacattccaatgctcaaatcaaagtcacgaacctgatccaagaatatccttgatatcgccagtggttggggaagctttcccgctcaagacggcaagcaaaaacgcagcaacaaccttcattttctgaagaaaaacaaaaacagatcaaaaatcaaacatagtacgattacgtaggagaagaaggagagagaaatggaaatggaggcgcttactgcggaagtgttgatggatctcgcaggaggcggagtgagattagggtttttagacggcgatggagaagaagtacgaaaaaatgaaaactatatgatttatatacgcttagggtttttaatcttatcaatgtatctccgaatttaaaattttatttaggcccagttctttcaagcccatatttatatgggctcaatatttcgattgacgggtaatattgatgttgagaagagaacgaccagattatacaattctctagttttattttgtttgatggatgggatttcacctctaacctcgtcttctatagcaccttcttggtcgatgacatcaaaagtagcttcaactctacacctgttgtttccgaaacatcgcctgcgtatggcatttctcggtatatgtagttgacaagtgatatgttttgcaagttactaataaatttgtggtgtcaaagttttagcatagtctagttattttctcatacgaattatgatgtatttacatattggacggcattgaagggggaacaattcaagactagaattttttttttatccttttcttacaataatactattcttgaagtcatacgtaagccgaatctgaatctaggttccaaatgaacgacaacgtatcattagcaaagtcaaggctagaggtatctcatcaccattcgagtcaagatttaagaccatgactaggaccaatgcttttgttggctactaaaaactccagagtgacaaaggcgattgagatagaagcagaaatgctaacaacaaagtgcaaatgacattcgggtcaaaaactcttgagaatttcagcaatgtctaaaaaagatgatcgaatacaaactaaacaacaacaacatatagatttcaaaaggttacaatattaaaagaggacaacaaaaccggacttttcatgctactaccagcttactcgaatagactgaaacccatgtcctgcaaattaaaaacaaaaacacacacaagtgagccatcatttttaggttaaatttcaagctactattaagatcaagacttttgttagaaggaaagtaaacttacatcatcggattcttccttttcttccttcttctcttctttcttggactcagcagcagaagcaccaccacctcctccacctccagatgtagcagaagcaaccgcaacaccacctccgccaccagacggcactgaagctaacttctcccttccagcagcaatcaactcagccaaatcttttcctttcacttccttcaacaaaagctcaatctgagaatcctctgtctcagcaccaactgcaacaccaaacaaaaacaacaatgccacattccatcaatcatcccaaactcattattgtatcccattgttcactaaatcattactcttaacaatacttacgcatctcgactatcataaacaccgtttaagtcgataggaaccataaaaatccctaatatacatatcatttcagcttaagcaagttctcaactatctaataaagatttcaaatcgaattctccagcgactcaaacaacgaatctaatcatattgtaatgaaatcgattgcgattcatcaaaacgaacctgatccaaggatagtcttgatatcggcactggttggtgaagcttttccgctcaaaacagcgagcaagtatgcggcaacaaccttcatcttctggaaaaatagtgaacagataagtaaatggagaatttgatcggagaagacgatggagaaattgaaatggattagtgtcgtttaccgtggagactgatagatctcgtaggagattgtgagattagggttttgtgcagacggcgatgaagaagtgaagaattaaggaagtatttttagtttatatacaattagggttttctctactttgagtctctccgggtttaaactattatcggatatgtttaatgggcgttggcccggttcatcgctaggcccaatattaattttaaaggtgatgagaaaatttctcaattcttcagtcaataaaaacctatttcttttgcaaactttataactcttgataataatgttcatataagtgaaatcataaaacaatattgtttgtgtaaacaaaacaattaatcttgttatcactaataaaagtgaaacaaattaaatttataattagtaaataaagtagatttatgctttttaaaaaaatcttttttgcagtagctagattgtgtctatatgtgtaatcttttttattttttatccttttaagtaagttagaaaaatctttaaaatgtattatataaaaacattaatggcattggatatgaataataattaaagatttacaaaaatttaccttttaatatatagtagatttcattccatttaaaatcatttatgtaaatgaatcttaatccgagaaaaaacaattatatcttgcatggtctagaaattatttaagcagcatcgttacatacttagaatcggtatatatctacacaacgtgtttgctccaccgtataggaagtttcacaaagaaaaaatcatagctaattctcgttttctgtctcaaccttgtcgatcaagtcatctcccatataaggtaaagcttattcgattgtttagcaatg

SEQ ID NO: 26326 - DNA, 3003 bp, Unknown
  misc_feature (1)..( 3003): 2750-1469P.txt file - cDNA_ID_2712511; gDNA_ID_2214570; Annot_ID_135033
gtaaaaataattgtaatgtactaatgtttcatttagcaaagtatctaacgtaataatataacaaaaagagtctaatccctttttcttgtgctgaatatacataaataaaaaatacagatttataattttaaatcgataaatattttttaacaaagaatttgtaaacttatcgcgatatcatagtttttagcacgttaaacaaatagttatatacttatcatcaatatattacaattatttttatttaatggcatttttgtaattattttttttttaaaagatatttttggtttatatattatttcttcttcatacttacctaaataactaatatttatgcatagattcttaatttcttcatcttctatgcatagatattaatataaccctaaaacaaaagaagaaaatgtgatctactatagaaactttcactaattttcaaccgagtaaatcaacatttaagtaaacataatcttatcgtcaattggctgtattcaaagtccattgaattccatgaattaactatttccaaaattgcatttaattatacttttgtacgtggaaaaactaaatgataatctctgttttttatggacggtctctagaccaatcaagtcggtgcgaaaacatgtcagaaatgcctaaatgcgttatgtctatatgtatgtgtaaatgcatttagtttcaaaacatttttctggtatacactgaaatttctaagttcaacaaagtttgcaataaactatagctgtcttaatatataagtcacgaataacggctctaattaaacgatgtaactgacgagctttaatttcgattgtttttttacttttcagtttcaaggaacaaatgaaaggttggtttcctctacctgagaagaaaagttctatcacaggacttgcgaataagaccgtatatatgattgacatgttgtgcttttaatattaatgttagtgtcacagattgttgtgggagcatatgctaaagtataaaaaaataataattaaaaatattatcacgatcacatgcaaagtacacttgaaacgtgtaatctgaagacagttaggttggaatcagggtttctataagaggaaacccagatcttgtttttctacctcatagtttttttttatggaaaaggaaagaaattacatataaataattcaaaagtggcagaggaaatgaatctctttgtcaagttgatgtgacctttcacaatttgtcaaactgtcagcttttgaatgtgttggaaacgcattggggttgtgggtcgccaacattaacatttccaaaaatggtaagtccaagaataatattagttgttttgggatatattctttgcaatacatccacacacctaacagagaatatatttcttttcctcatactccaatattattactttttaagaaaataattaagtttcatattacccttattgcaaaagcgacgtttagaattttaaacagaataatgacacttgaaatttgtatctttctttctttaacattaaaaaacaagggggcgataaaagcaaccaaagctgtgattcatggtcgacactaacacatggaataaaaaaaggttatctcttttttccaacatttctctggtgactaagttaattgaataaattgtatgcatatatttatatgttctatatatatactgtccaaaaaggaattgaggaatttttaacttttaaggaccatattggaaaatctgccacttctcatccactcataggttcgaaattggtttattataattttaacgcacaaattcccttgttagtgctaaagaaggatacctacaaaaattcatatcgaattctagacgaagagacctatattgtagagctgaaaactgatgttttacaaaaactgatattttttcgggaatgatttggtttaagcaagaaatatcttagtttgcattattcctaagctggtactagaaaacaactatcgataaaacgaggttgtcttccctttggccacctattgacataagaaaacaagacacctatcttttttctctagcaaagatactcctagagtcctagtcctacgacgaatggcgatgctttcttaaataaatataaaatattagttctctacttctcctaacgtactagaagtagaaattctgctgaaaaaagaaaaagaaaaagctaaattcccgacgccaccatttataatgcgttcattctgtttaaataatggctagagaagaacatggccgtaaatccgtaataacacttccaggttctttcattctaacataaatttatgtataaaataaagtttttaatctatccacctgactaattaaatttttattttcataaaggaaagagttttcctataaaacaactataaaaaaaataatagtatcagatttgaaatgacgacttcagtgacgataattttactgaattaccatcacgcccattattatgttttattttataaagcaatcttttattgtgtcctaacaaaaaagctaacttctaaattcttactagggttcaaagacatatttttttatcgaatcatgtcgtatgtatacaaaaataatttattttggccaatacaacagatagttgattagtgttcagaaatacccaactctccaaaaaaaactactctcatttttttgtgtaaggtatgatcctagattaaagaaacgtctttttttttattctctctgaagcatcttattgacaagaaaataaataaattccttggatctaaacgtcaaatcaaatgcattacagccatttcttctcttaaaccctataaatatacatgttcttctcactttatgcttcatcaaatcaacacaaacatatcccccaaagcagaactaaagcaagcccaagcttgtctctccccattccaacacacacattttcatatcaaactcaaaacactatttccttaatttctttcacttattcttcatttcttcgtctaaattcttaaccaagcaatcgagatg

SEQ ID NO: 26327 - DNA, 3003 bp, Unknown; identical to SEQ ID NO: 26326
  misc_feature (1)..( 3003): 2750-1469P.txt file - cDNA_ID_2712511; gDNA_ID_2214570; Annot_ID_186129

SEQ ID NO: 26328 - DNA, 3000 bp, Unknown; identical to SEQ ID NO: 12755
  misc_feature (1)..( 3000): 2750-1469P.txt file - cDNA_ID_2712517; gDNA_ID_2214570; Annot_ID_135031

SEQ ID NO: 26329 - DNA, 3003 bp, Unknown
  misc_feature (1)..( 3003): 2750-1469P.txt file - cDNA_ID_2712526; gDNA_ID_2214571; Annot_ID_135081
aaggactccaagacaatccatacccttccttgtcatgtcccactagcctcagatcaggatcacactcactcgtttgagactttgcagcatgtttggcgtaatcaaacagaaacacctcacacccactcgtctttgcacccacaagcgtcggcttttgaggcatacaccgcgctctgttcacttctccatcaacacgtatcctctgcctaatctccacctgaaacaaatcagaaaattgaagaaacatggtttagtagtatacaaaaactcttctttatcctaaacctataaaagagtccaaatttaatatctcaaatcctataactaactaatccttaacactatcagtttcagctagtcatttgatcgaacacttggtgcgcgtaaaacatgagctataaatattgtccaacaaaacgaagaatctccagggatcaaataccttaggaataaagggatcctgattagcgccgcctatcccaggttctgcgtttggtgtcggggtaacgacgtcggcgaccatgagaaaatcttgagcactaccggaagtatgagtaccgagtataagcttgtggacaccgaagtaagagtctgctacgtaaggatttggcgtcgatggaacccaatggacggtgagagatggccattcgagtgggtgagagatcaaaagatcgtagagaaatggtgtgttcttcttccacacagaaaaatcttcctcgacctgacccattcctgtctcctccttaccttcatctgccattatctctctcgcctctcaatctacttctctctctctcgctgatcttcgagggtttttctggttgattttcccgccaaaaatacacagagctgatcaagggctgtgatgctgttttactttttcacaattgaacgctttgccgttttactgtttcgaaacagcatgcatgtgctgtggatgctggttttgagtttatgggcctgtaaagcccattcttaaattacttgctcaaactacatttttttgttcagaaaattaattacctatagtcctcctatacaccaactaggcaactatgttataactatgttataactaaaagttttgattgctgtgagatataacttgctatatgatgtgacatagtacacataaacaataccatttttattatgagagttcaataaaacttgaatactcaggaagtaagattttgcttatttatatatgtagaatacaaagatgaatagtaacaatactatgtgctgagaatttcacaagtctttacctcaagggttcaaagaatttgctaccatttcaagaattgtattgactataacttcagggcttagaaccacactgattttgaatatcttttcacattcatcagcttgaagcagatcaaactgagactgaagaagagtaagaggcatgaaatgttcttcctcggaagctctcttctgtaaccgagcagcaatcacctctgcattaccttccaataaaacaaacgtaaccttgcaactcgtatagcttcccggtttgtaatcaggatcagaacctctcaagatttctctatactgttttctcaaagaagaacatgcgagaacaacggtttctccatcgagtaaacgttttcgcaaactctcttgtattttttcaagccatggcattcggtcttcatctgaaagagcaatgccttgacgcatcttatctagttgaacaattagtgttaacacatgaaattttcccaacagattcgtcaaaagtaatatcgattctgttacctctgtttgataaagaatgaaaatcatcagcatcaagaaaatcgcaagatagagctttccccaacattttacctatggtactaacaaagtgaaacaaaacaataaacatcaatgatctttcttcaaagtagaagagaatagtacaaatgagaagaaggaataaaaacagcttacgatttccctgcgccacttacgcccataatcgcaatgactttacctgtcactatgacaatgagcaacaaaactgatgagatcatttacattaatggaccataataacaatattggagcttaccgtcatttttagccgacatgcttgatgaaacaggttttggtgattcttgaagaaaacaatctgtgatcaagaaaagtaaacatatctattaactctcaatcttagcttataattcttcaatatttcctaatttcatctgagaggagtatatgactcaaattcaataagtaacggtggaaacgaaagaaaaaaatccctaattttgaaatcaagaacaaaactgtacggatcaatgtttattatacgtttcaaaacttactaagcaaaatttagttttctgtgagagacgacttactgagattctttttgtgtttcttgactctccacaacaccaccaatggtgaagcaattggatacgttttcttgatcaaagacgaaattcacaaaattcgctagattaggtgaattggattagaattgataaaaatctaataaaataataataaactgattaggtggtgagacgtgactttgcaagagaggtaggaccaaagatggaaaatgattataaaaatacacaattattgacaattttttttttttttttgaatgtaaattgataaatctttttttcataaaaaaaatttcaattaaaaaatacaatttctcttatacatgcatgtttctacactattctctaccttctttcaataaataaaaaagtaaaaactatacaacaaaaatattcttcaccaaaactgaacatgaataatagtattatattttaatacttttttttatataagatcaacatttactttagttaatttccattcctataattaactaatattttattgattgataaggaagcaacaaaatatatttttagaaaaaaaaagttttatcctcaccgattgagagcaaagtctcactctcttccttaagctctgagaaacctccgataagcttatcggacaaaaagagaagtagacgccgccatg

SEQ ID NO: 26330 - DNA, 3003 bp, Unknown; identical to SEQ ID NO: 26329
  misc_feature (1)..( 3003): 2750-1469P.txt file - cDNA_ID_2712526; gDNA_ID_2214571; Annot_ID_186195

SEQ ID NO: 26331 - DNA, 3003 bp, Unknown
  misc_feature (1)..( 3003): 2750-1469P.txt file - cDNA_ID_2712529; gDNA_ID_2214571; Annot_ID_135078
cagacaccaggttggccattactaagaacatccactttagctactccaatggttcaacatcagactaggaaaatatcagttgtcaattgggtcatgagcttgcctgaaagatttccacatcatccgaatcagacttgtcaacagagcttttgtgataaacaacttaaagacatactcaaggacataaacagatggtttagctatgatgttctcaagacagcaacatcagatttctctttaggtattaactaacgtaactactctgttttatcgtattcatagccactttatcggattctttttttttggtttacagagaatctgatcggaaaaggaggatgtaatgaagtttacaaagggtttcttgaagatggtaaaggcgtggcagtgaagatcttgaaaccatctgtaaaagaagcagtgaaggagtttgttcatgaagtgagcatagtctcttctttgagtcactcaaacatctctcctttgattggtgtatgcgttcattacaacgacctaatctctgtttacaatctctcttccaaagggagtttggaggagactcttcagggttaagaaaatactactttgttctcttaaacatgatcttgacacacaatttcataaagagttcattaatagttcagtttctgtaggtaagcatgtcttgagatgggaagagagactcaagatagcaatagggttaggggaagctcttgattatctacataaccaatgttctaatcctgtgatccacagagatgtcaaatcttccaatgttcttctctcagatgagttcgaacctcaggtattaaaaaactactgagaacttgtaaatatatgtaagaaatcataaagatgtgtggacctttaacggattttgttttgcgagaatagctttcggatttcggtctttcgatgtggggatcgaagtcttgtcgatacacgatacaaagagatgtggtgggtacatttggatatctagctcctgagtactttatgtatggaaaagttagcgataaagtcgatgtatatgcctttggagtagttttgcttgaactcatttcaggaagaacttctatttcatctgatagcccaagagggcaagagagtttggtcatgtgggtaagtgttggttttgtttacttgtagcagaagcaattatcattgaaaaccttaaaaaaaacagattacttgcgttgcaggcaaaaccaatgatcgaaaaaggcaatgcaaaagagctcttggatccgaatattgctggtactttcgacgaggatcagtttcataagatggttcttgctgctacacattgtctcacaagagcagccacttatcgtcccaatatcaaggaggttagttactctaattttggcagacttataaccgaattttaaatgttggatcctctgttctacctatgaattatgccaagatctctaaccttttagtcacatatccaatatcatttctgtagatattgaagctgctaagaggcgaagatgatgtctcgaaatgggtgaagatagaagaagatgacgaagatggtttcgacgacgaggtttacccaaattcgaacacagaattacacttgagcctcgcgatggttgacgtggaggataatgactctgtgtcaaacagtagcttggagagaagtaacaacagccttttttcttcttcttcttcttcctctcaggagcttcagtcttaattagggtttgtgcttagcttgtctccagttcacttgaggactacgtcatctcttacggtgtctgcactcaatatgtcacactatatatcacttctctgccttggcttttgcaaccattgttggagaagtctttttcctctttctctttttgtatatatgagaggaggaaaatagaaaataattattataagtttttaacgtgattgaatgtaatgactaattttaaaaatcagataagtttcatgaattagtattgctaaaacacgggtttttccaaaaccgtatttaatcattttatagcaagtttctcttgtcaaatataacataaacctttgtcactatcaaaactaaaatttaaatgtttttgcttggtctaagttggtagaggatggtttaattaaaagactcagtagactcaatatctcttgttttggtggcaatgttttgtcaaacaccaaatactaagacataaaaatttatgagtgatactaaaggacttgcaaaaaccatgtataggcgaattactgttcactagttttttggttaagaatgacttggaacttgcagtttggtgaagctcttggaagagtcaaaagacgttgtatatcgatgggcactttgaggttatgtgaagcacatattttgaccagctcaagacacggtaatgtagccaaaaaatgcttcatttggttcagatctttgtcactatctttgtaacctgatatctccaacactttcactcgagatgctgataggcaagacgatctatccgctctcgcgttacgggccttacggaaaacacatacatcaccacaatttcttgtaatcaaacaaatttttatttggttaagcataagtcattccattcaaatttcttcaaaggctactactcataaatttcttgatttattcgaaatttgctatatatatttttatatatttcaatttaatgaaattattccttccagtttttttttttttttaaatggaacccttaagcattttatagaaattcaaacctaaaaaatcggaacaattgaacaaaaacatgcaaacaaacaaaaacgtttgaattggaatttaaagctcccactactatatgttaaagtggtttaaagtacacttcctgggcccaataatacatttaacgggccaccaaatactagttttcactacgtgcgcatcaccaaatctttaacgttcgctcaccaacttttttccccataagttttggtcttcgtcgtacccaatttatttctctctacccgttttttctcttatttcaaaaaaaaatg

SEQ ID NO: 26332 - DNA, 3003 bp, Unknown; identical to SEQ ID NO: 26331
  misc_feature (1)..( 3003): 2750-1469P.txt file - cDNA_ID_2712529; gDNA_ID_2214571; Annot_ID_186190

SEQ ID NO: 26333 - DNA, 3003 bp, Unknown
  misc_feature (1)..( 3003): 2750-1469P.txt file - cDNA_ID_2712532; gDNA_ID_2214571; Annot_ID_135076
tatgacttaccataggatcaggagcatcattttgcttacacataacccatgggatccccaaatccatcgagtgtaccagtttagatgcccacttaatgtagtttaatccatcttctttatatgctcgttgaaccgcactatactcattctcaatctgaatccaaacgccaattttaaaaaaatctttcaaaacttttatgattcatatcttaaaaatgtgtttgttgtttttattaatctttatctttttgtcaatgttacctgtcctaatataatggggcctccttgtgaagcaaaaagcttctcctccttcatcatgtcaagtaccaccttaacatatctctctgtatgttcctacaatcaatagttttctccaaattatttaattgttccaacatatcacacacatatcttacatatgcatagccatatgtgaaaactaataatcataccttgaaaggttcattatcggtacggaagaagatcccgggaacttccctcagccagtaaggaagtcctctgatgtttcattataaccataagcattaaacatgtcacatatgtaaaagaattttatctcaatttggaggaatcagacaatgtaacaaataaacatacccatgagtccattcagcttgaataaaaggtccaagcctcaaggttacatacaaaccattcttctcaattaattttatgaacttcaccaagtcggctctacccgaaaaattgaactgtcccaacaacaaaataaaaaactcttcaaaacagtgatttaatcttttctaaaggtttttgtttgttaatatttcaaattacctttccctgctcaggctcatgaacgttccaaaaaacgtatgtctgaatcgtgttcaaaccgccttgtttcgctctcttgatgatgtttggccacatctgagcaaaacccacatcacatattctcaaaaatgtaagtaaaacaaaatttaaagataaaacaactttaactaacgagtgtatgaatcatttacttcaggagtgctacgagggtaatgtatggagccagagtaaaggagttctctatttccattgatgatcaaagacgttccatcataagttacttctttctttttatcgaccgatttcgtcttcttctctttgtcatcgcttgagagagctccagagaaggagaggagaatcacgagaacggctagtaaaagccatgaatgatcagaagaatgtattttcatttgactatcttcttcttcttcttcttcttcttgaggatttttaaatttaaacaagaatccacctaaagggatatcttccttgtcagagaaataaaaactttagagaaagaaaatgaaataagagaatgtttcgcagagaacataaggtttcagagaaattcacgtattctcaatttgagattccacattttgtttgtaaataaaacttccaataactctcccttttatttccttatttcctcctttcattttgttttcgttgaattttctaattttaaggtttttggttgaagagcctaatttggcgggtatacacacaatgacttctctcaatcaccaccaaaaagaaatgtgagccaatgcttatgttgagaaggtgcgtattacaccaaaaaaaaatggttcatacgaaaccaatgattttattttattttattatgttcattataaacaccacttttggttcttctttaattgtggaaatgtggattaaatccatgagagatctaacaaaaatttgtgtaacctgttatctagttattattctttgtctacaagttgagtaaatttttttgctgtaatttggattatcatcgtttaaacctttagcttatttctaactttaaatatcataacggcaaaaattgtaaaagctttggtatgcttcttttacgtaaaatacataaatgtgttgaccgtgtggttgaagattgaaagcaaagcaaacaacatttgttacaaaaaaaatggctatttttttaagtaatcaattaatcgtcttttaaaaaatcgagaccaactattgttgagaattattttcctcccgtaatcaccatcataaaatatcggttgggcaaatcacgtagcatgcatgtacattaactttggactaacagctgtggagtttcttcttatagcaatattcaaaagacctaataagtctgaaataaacagaggcttgaaggttatacttagattgaaaggcaatgatttacatttacatatataggttgatcaatgacgatctctacgatatgttgtgatataaatctttaaaataaggaaataatatatgcatcactgatttgtggagtgttcctcactcgacgccactctgatttgtaaattttttattgtaaaattttaaagtatgtaaatagggcctataattttttttcctaatgatacatgggcctataatcttaagaaacttttgaaatgggtcctataagttttcaataactattttacctcatcaaatgtatgttatgatttatgattatatttgttgaacatgatgctcatcacccatcactttgctggtccagtgaacgtggacaataagattaagaacaaaggatattgtaataaccattctttatgttaagttattctgattctcagactttatcaaatcccattatagaccgttcaatagatatggtatattacagtaagcatgtacgtaagaccatccacttcaaggcacgtctctctttcagaatcagaacaaaagaatggatctttctccattacctttatgggcaaagcgggcggctaaaaagagactttacaatggtaaatctttacttaaacaatgataaatgcaatagtgcaagcattcctgtttgcaagagaatcacaaatctttgcttacggttcacgctttaaaaacacaactctcattctccttctcttcacaaaccactcatattttttttcacatacttctttgtagtgctactttccattatatcaaacactcagcaacctgatg

SEQ ID NO: 26334 - DNA, 3003 bp, Unknown; identical to SEQ ID NO: 26333
  misc_feature (1)..( 3003): 2750-1469P.txt file - cDNA_ID_2712532; gDNA_ID_2214571; Annot_ID_186188

SEQ ID NO: 26335 - DNA, 3000 bp, Unknown; identical to SEQ ID NO: 12786
  misc_feature (1)..( 3000): 2750-1469P.txt file - cDNA_ID_2712546; gDNA_ID_2214571; Annot_ID_135068

SEQ ID NO: 26336 - DNA, 440 bp, Unknown; identical to SEQ ID NO: 12801
  misc_feature (1)..( 440): 2750-1469P.txt file - cDNA_ID_2712550; gDNA_ID_2214572; Annot_ID_135101

SEQ ID NO: 26337 - DNA, 3003 bp, Unknown
  misc_feature (1)..( 3003): 2750-1469P.txt file - cDNA_ID_2712562; gDNA_ID_2214572; Annot_ID_135098
ttaaatgaacggaatagtactctaagaattttttgttaaatcttttacttgaaaagttttgctgttaataatttagttgaaggttttcaataaatcacaagatacttagggttttatttatcattaagatattaatagaataaaaaagtggaattatttttcttctacaattacaccaatcaagaaaaagagttttcctctcaattactctggccctttacatggaaaagcaaaaaagttgagaaaacttccctctacaaaactgaaaaaataaaaataataattttcttaaaagtgcatatgttttttttcctaattgttcttgttaattccgctgaaattgtcactgtcacaccctaaatacactaaaattatgtgcctttttaaaggacggacgtttcaaatatatatttagtaaggcccactaataaaattgggtttcaaaggacaggaatgggcttctgcaaaatttgcaagacacaaaggcaaggcaaggaatatgtgtgaaagaaacaatgtcaataacaaacttaaaaggaacagaagcgccaaagtcacattggtcaagtgtatggtttcaattggttatgtaagttaaagtgatagtccaaaagaatggttctaattatgttgagaaggtaatccaagattgttgctggatgtgataaaaataaatggaagaaaaagttgttggcttggctcaaatagatctatgtttatgactatacatcaagagttggcttaaatgactgcttcctgcatatttgtaaatctttatatacttttgggatacacatgtttgtatagtttacatgatgcattatcattctaaaatatcagtttccgattaaacgttgaagactggtatggctttctaacttaaacctctttcatctatcaagacatatgcactgctcaacttgagcagctcaagcatatatataattttattttttctaaaagtaacttaattataaactcttacacatcagtttttgtaaggcgaaagatgttatagtcaacaatttttttttgcagagaatgttggtagaaatttggtagacatagtagaaagtcgaaaaaaaataaaatcggaaaataagtatgctgatgggaaaaacattaacagaagttaattggcataaaataaaaagaagaagtttattgctacatcgccacgaattccaagtcaattattacatatttacatgcataaatggttttgatatggttgtattatactattacgggctatgataaagaaataaaagcatgcacgtaaatctaacaagagacatcttcatgcacgagtttttattccatttcagctttccaacaaagaaagaaaaagcaaataatcgctttaagcttttcttaaattgcaagttaatgctctcatttaatcaaattgtttatccgttcctcaaagaagatgcaaaattgaaatttctcttaaacatctatccatatattcggaagggagattattacctcagagtggtcttaattggcatattgattactgtatttgttacttgaacgtggtcataatgggcatatatattggttgaagataaatgccttcttcttccgggtttaaagttcatcttcttctttagcacaaaaaataaaataaaattatcttcttaagactactgattaaatttcatattaataggtatgattggtaattttttacagcttaggttacctccataaatgtggtcgtagacaccacttgaaatgggaatcatcctttttgctatgcctttgcggttattctctgagaatcctattgttagatttatatatggctatattttatgatttcatatttctaaaggtatacggtctagtgtttctgagtccaaatcatggtgttgtgacagtggttaccaaaatttctttcaaagtatttctcacataagcgacaaccatatctaccgacttcaaacacctctaaatcaacaatagattttgggtttggatcactcttccacaagaaggtatgattctcatatgagagatcccaatccaatgattagtgtctcaaaacaaaatatatccaactatgcgagtcttccaaatttaattgaatatttagaaaccatgatttgaatcttcctcttttgtggaaaatttatttatttcctcatttctcctatatggagagaaccttgcttgctattttgctatttagtcacaagttaccaacttaccatccttgctattttgttacttcgtgtagaacttctcgtttttggaatcgtcttcaacgttaccatattttttttatcgagattatcatttcaatttttttatggacgaattctcgattaaccatgaactcatttgtaccaagatactatctaacttttatctccaaatttttatggatctaatgtcgacctatcctagtattttatagcattcgagaatgctttattacctttttttttttttttttgagaatgctttattacctttcattgttatgtataaacattgaaatatttttgatttgtgaatgaacaaaatccaatattttcatggcgaaaaaaatcctttaattatttatccagtaaacctgtaaaaacgtatttgtggaattttctttaatttgattaaattaaaaatagacaaaaaagaaaaagacacgagcgaataaaatcacagtgattttcagtgtttttttccctcgttacaaaacaaaatagctctgtctgaaaaataaagctttaactctctctctcttaacactgttactgtcgtctctctgtctctccattaatctccactgctctaaaaaaattcattaattgctgaaactctctctctctctagtctctatctctcttcttcatccttgagctctgttagattctctctaactctaccatcgtttcatttcttaattctctgttttcttgttcctccagagtgatagatctggcagagaacaatgtcggaattagccaattaggtcgccgagataaaaacatg

SEQ ID NO: 26338 - DNA, 3003 bp, Unknown
  misc_feature (1)..( 3003): 2750-1469P.txt file - cDNA_ID_2712570; gDNA_ID_2214572; Annot_ID_135096
atcagccaagtttctccatttctcaatcaagaaaatcttgaaatactcaaatcttttcaagattcactttcaaagatatcttgataatagcctcaaactctggtttcaaagatgggaaacgacgagaccgtacgattcttgattcacttcttcaatggaagatggttcatggtgtttgcttcgtttctcatcatggcttgcgctggagccacctacctttttggtacttactctaaagatatcaaatctacacttggttacgatcagaccacgttgaacctcttaggtttctttaaagatcttggagcaaacgttggtgtcttgtccggtctaatagctgaggtcacaccgacttggttcgtcctcaccattggctcggcgatgaacttcgtcggttactttatgatctggcttaccgtaaccggcaaagtcgctaagccaaaggtttggcaaatgtgtctttatatttgtataggagccaactcgcagaactttgcaaacacaggagctttggttacttgtgttaagaatttccctgagagcagaggagttatgcttggtttgcttaagggttatgttggactaagtggtgcaatcttcacgcagctttattttgcgatctatggacacgattccaagtctttgatcttgttgatagcatggttgcctgctgcggtttctcttgtgtttgtgtatttgataagagagaagaaggttgtgaggcagaggaatgagcttagtgtgttttaccaattcctttatatttctatattcttggctttgttccttatggcaatgaacattgctgagaagcaagttcatttctcaaaagccgcttatgcggctagcgctacgatatgttgtgctttgctttttgtgcctcttacggtttccgttaagcaagagcttgaagtttggaacatgatgaagttacctatcgaagagccaagcgaggtcaaggttgagaaaccaaagaaagaacttgatcttgatcaggacaaagccgccaaggtgaatggagaagagaaggagacaaaatcttgtttctcgacggtgttttctccaccgccaagaggggaagattacacaatattacaagcattgttaagcaccgacatgataatcctatttgtcgcgacattctgtggtttaggatcgagcttgactgccgtagacaacctcgggcagataggagaatccctcggctacccgaaccacacggttagttcctttgtgtctctagtcagcatatggaactacttcggtcgagtgttctctggctttgtctcggaatacttacttgcaaagtataaattaccccggccgcttatgatgacattagtcctcttattgagttgtgctggccaccttctcatcgcgttcccggtaccaggctcggtatatatagcgtcaattctaatgggattctctttcggtgcacaacttcctctgctctttgccatcatctcagaactttttggactcaagtactactctacattgttcaattgtggacaacttgctagcccgctcgggtcttacatcctgaacgttcgtgtcacgggaatgctttacgataaagaggccttgaagcaactaacggctcgagggctaacccgaaaagacgtaaaggacttgacttgcttaggaagtcaatgttataagctgccgtttctgattttggcagcagtaacgttttttggagcacttgtatctttggggctagcgataaggacgagagagttttacaaaggtgatatttacaagaagtttagggagagtcctgagtccgagtctgaattagttcctgattcaagaaaagctgttgaatttgttggtaaataattatcacacaaattgtttttgttacttgaatcatagttgaataaattaatagaaaagagccgtttaatttctttagtctttctcaacttggtttacttttctttaattcaggacaagttgttgaagcatttcttttgtcggtcaatctaaaatactaaaaaagggtaatagtaatcatgtgataaactgataatctcataacattccaaaacatcacgttcacgagttgtaatgttacatcgtagagctgtcatatagcactcgtgtccgtctcattcttaccaactgtggataacgcacgccgattagttgtgatttacctatttgcccttttcagcacgagctctttggacgttcaagtcatagagttaaaattagttacgacacattcctcttacgagaaaaattgtcacaattgtgtcttaggctgtgaaaaggagactccggttcaagtgtatgtttgttaaccgttttgggatttatattcacattggacaaattttgcaggtagagtttagaaaaataaattcacttgcaaaagaaagttttgtttatttttctttctcatgatcgcacatgcatgggctgataggcagatacaacatctaaatttggggtgattcaaatacgtgtttatattttcttctttagagcagttttaaaactttttttttataagcttaacttacccccaacatctctggttttgtagtcaacacattactagtttcataaagttggcttccataaactaaataatagattatagaacttctacatctccaaaagattcattgtttcaaacaaatagaattaagtttttttctaaagttttttttttgtttgaaattgtgtgtataaatctgccaatattttatagttcgaattttatttgtcactaataaatgaatctaaatttttttaacaacccaaaaaatttaaatagttgagttttttttgttgagaattttcttttaaaactagtgttttgactcaaaactcaaaagtacgggttctctagaaactgaagtgttggctcttttaaacacttgcccttattcgcgcttcccaaagctgcaaaagtttcaactttttaagggtttcgtctgaaggagaaggagcttgaatcagccccaagttagagagaactcaacgatg

SEQ ID NO: 26339 - DNA, 3000 bp, Unknown; identical to SEQ ID NO: 12794
  misc_feature (1)..( 3000): 2750-1469P.txt file - cDNA_ID_2712578; gDNA_ID_2214572; Annot_ID_135094

SEQ ID NO: 26340 - DNA, 3000 bp, Unknown; identical to SEQ ID NO: 12794
  misc_feature (1)..( 3000): 2750-1469P.txt file - cDNA_ID_2712578; gDNA_ID_2214572; Annot_ID_186224

SEQ ID NO: 26341 - DNA, 3003 bp, Unknown
  misc_feature (1)..( 3003): 2750-1469P.txt file - cDNA_ID_2712607; gDNA_ID_2214573; Annot_ID_135113
tcatctcatcaaacaatgctcttgcataatccaagctaccacatttagcataaaaaccaatcacagcattacacaaggataaatccatctgaatatgattttcaatcatcttcttgtgaacttccaacccgaaaataagatcgcttgactgtccgcacgcctggaagacgcttatcacagtgactccattaggcttaaaatcagagcaagctaacatcgctttatacatcttcttacagtcctcaaaagacccactttgagaataccctgaaatcatagaattccacgaaacaacatctctctcagacatttcatcaaacactttcctcgcagactcgatgttatcacactttgtatagtacgttatcatcccattgcccacgaagacatctgaatcaaatccacctcgtataacaaacccatgaacttgtcgagccaatgaacccaaccagaaatcatcacagcctgacagtgccttcaacacacaagagatgctaatagaatccggtctggcagcatcggaagagtaacaagaggatccaatccaggacaagaacaacgagaaagcatcgaaatacatctcacgcgaagtataagcgatgagaagtgcgttgtaagagaaggcatttctaacggtaatttcgtcgaacacatggagtgcttggcggaaacgatcctgcctagtgtaaaaactgatgagctttgacgcgaggaagttgtccggcttgatggagaagacgacaatacgcgcgtgaagctgaagcacgtggagaggaagtcggtgacgggtgaagtgctggatgaggtgaccgtacgcaccgccgtcgaccgccgccttgtttagcaagccttgcaaggctcgttgaatttcgaatcccaacttcattcatatctaaccaaaagctaaaccggagaaataaaacaatatgaatatatagaggcaatttaacgggcttattaatgggccttaaagcccatagtgtcgctgtattacagaacggagttttgaaatcgatttgacttttttagtttcatgtcttgtctgagaaattattattgtcgagctttcggttataaacagtctcgatcttgctacagtcgatcactgaatcgtgaaatagctaacgagtcatctgaagttgagagacgagctcgttctctgagagttttggatatcatatcttcgaaatctggtggagtttcgaatcgtcaggaccattttggtttcgttcaggaatttcgacaaacagattcgtggcgattcagaggtcaggcaatttccgaggattttgatctctcaagaaccaaaaatggagtttcaagcgtgctcgaagaagttatgctggaggattcttcaagctctgtcaagcgagatggatggagtttcgatgcttatggtttatcatccgccgtgagatcttgtgggttgaatcgagactttagaaccggttctgggtttcattgtttagcgttgaaaggtgggtttatctcagatgtctacttaggaagttctctggtcgttttgtacagagattctggtgaagtagagaatgcatataaagtgtttgaagaaatgcctgagaggaatgtggtttcatggacggctatgatttcagggtttgcgcaagaatggcgagttgatatctgcttgaagctttattcaaagatgagaaagtcaacctctgatccgaatgattacacattcacggctctcttgagcgcttgcacgggaagcggagccctagggcaaggaagaagtgttcattgtcagacactccacatgggattgaagtcgtatctacatatctcaaactctctcatctcgatgtactgcaaatgcggtgatttgaaggatgcttttcgtatctttgaccagttttcaaacaaagacgttgtttcttggaactctatgattgctggttacgcgcagcacggccttgcaatgcaagcaatcgagctctttgaattaatgatgcctaaaagcggaacaaagccagatgcaatcacatatctaggagttttgtcatcgtgtagacacgcaggtcttgtaaaagaaggaagaaagttcttcaatttgatggcggaacacggcctgaaaccagaactcaaccattactcttgtctagtcgatcttctcgggagatttggtctgttgcaagaagccctggaactgatcgagaacatgccaatgaaaccaaactcagtcatatggggatctctgctattctcttgccgtgttcacggcgatgtctggaccggaatcagagctgcagaggaacgactaatgcttgaacctgattgcgcagccacgcatgtccagctggcaaatctttacgccagtgtagggtactggaaagaagcggcgacagtgaggaagctgatgaaagataaaggactgaagacgaatccgggttgcagttggatcgagatcaataactatgttttcatgtttaaagctgaagatggtagcaactgtagaatgctagagattgttcatgttcttcattgtctcattgatcacatggagttcctctaatattcagggttctctctcattagttttatagtgcataccagatccagatcttttctataatggatcaagttttgctttgaacgttttcaacataacctctattactaatgaaaagactttaatttgtatagttgagtaatataaacacactaatttaataattaaccaggtaatgaaatgaatgtagctgtataatgcggtaaaatgcaccaagagtttctctatgacgtaatgtgaagttgagaaacacacgccatcaaaattttctttggttaataattaaaattttaaggtacaagtttgcacgattaattcaaaatttactacacaagattcataattaaggaatcgaatataggaaagtgtccaactggtcctctcttatatacccttctccactaataccgcactcagaagacgacgacaaaacaaaaaagttgcgagagacagagagaaacagagacatg

SEQ ID NO: 26342 - DNA, 3003 bp, Unknown
  misc_feature (1)..( 3003): 2750-1469P.txt file - cDNA_ID_2712649; gDNA_ID_2214574; Annot_ID_135141
agatcgtgtttttgcagaggcaaaaaaatactttgtgttacggtctccacctgacagccatgttttccggctcttaagtctctagaattcttcttcagcagcataagccttcgacagctgcaatctgagctctcggatgtgttgagttgttgtgccatcagagtgagctctatcaattctgtttttgagaagggctatatcttcttgggcatttgatcgatatcgcctcttccattgagatatttctcttctgcaggcagtgagtcgtgatcgtagattgtcgtcctggtgaaagattctccggttccacccacgtctgacagcatcactgaacccatcacgctcaaccattcttccatcaaaacagaactggttatgcttctgctcaaaatcgctcgtgattgttgtgatcactggtcgatgatctgattctattaactcaaggaattccatgtgggatgcgggaaattgagttaaccattcgttattcaccaaggatcgatccaagcagcaggcaacatcatgagtgtgtcgttttccgacccaagagaaagggtctcctgtaaacttgagatcatggaagtcacaggtttgtatcattttcctgaaatcaaagaaagagctttctggcctcaagttgcctccttttttctcatggttgcctcgtatttcattgaagttccctatagccatccaaggacctgttctttgtgttgctgttcgttctaatctttcccaaaccaagtgtctatggataggatttgggtgaccatatacacaagataaatagaacccaaatccattaatattaacaaaagtatctacaaggtttggggattgataaagaacagaatacagaaatactacttttccacattaaagcaattccaccacttagaccatttggaggaaccattacaaccctatcataacctacatcgctgcaaatatctctgacgatgtcattcctttacttcgtttccatgagaacaatgatgtctggagagaatttcttctttatctcctttagacgtcgaactgcgaggtcattgcccagtcctctgcagttccaagcggctgtcctcatggaggaagagggggttctgggcccaccgcgcctctccccacgtcattcggctgaaccgtctctccggagcaaccactgctttccccagcctcacggatcaccatcttagaaggctcgtgttcttcatcttcttcgatggtgtcctctctcttgcgtttgcccctatccgctgccacatcctcacgaacatagtctctgttcactccattatttgtttccatctctccatggtacgtggagtaacgacatggctcccaatcctggaaatcttccacggcttcatgatgggcattcatcactaatgagagttattttatttattattgtccacgtatttattttgtttttaatgtatttttttttttttttgccttttacagttcctaatccagatttaaatctggatataaccctataaattataagatatactcgtccacataatattatcaagttttttagttttttagaaaataaaaatctattctaaaatttgagaaaatcaagtgagataattttgtgcctcacaagtcacgagattacttagctcggaagggttttgggctctacgtgtgaaaggcataagatattttagttacttttatgctttacaatttacattactagagtacaaacaaaacaacagctatcatggatttttatgacatcatcaatttacgtgtgtcatttgagatttataatctttattttattatcacttctattttgttttaatgagttcaagatcttttcttgaaagacatatgaagactttaacccaaaaagctaagtattgtctttgatgaaactttgaaatcgagaagttttcaaaattttaaacgatgtcaaccagtattttttatttataaaacagtatttttctctaaatatttgacaagatttttttacccccgcattagctaaaacccattttcgtacatatgtttacaaacagtgtccgctcaacaatttcatgggtgtaggataatttttttttatattttgttataaaattttttgtatgataatttagttaacaaaaaaaaaaaaaatgcattaaaaaaattataggtccattctaaattttatttttgtgttatatctaatttttaaaaatattttttaaaaaatatatgtcccttaattgttaaaacatgggtttggattcttggctgtcgcaccgcttgcccctctatttaaaccggcactgtttacaaattaaacattatagaaaataattcttaaaaaccggactaagtaatgaaaattttaaattacaaaaacgaagaatactaggaagctagaactagggaagaaaacttgaagcaccacattagtcaaagagatcgaagaaagaagccattctctaagaaaatttaccattaagattgactatgcactttatttaaaacacttgccaatatatctttttcaaaagtttttttttcataactcatattaagactttcatcttcaaattaaagggggatgagctttccggatgatacttagacctgagttgagtcaaaatcgcatctccctacaaacaagttcatcataaaccagtcgtagggtccaaagactttcacgatccattaaactgacatcttagtgttcaaagatatttttcttggtgttctaaaacatatatcttctgaacatggctcaattgtgactcctctcaagaaaatttaaaggacttgggggaggactatattattatttttagttccccttaaatatccacataataattactgtttgttgttttctttttaattcaaacatacaccattccaaagagacctttgatagttttctttactaaaatattattgaaaattacttataagatttattattaacatgttttagattgaaaattgctcatacaggcacataaacagattgagatg

SEQ ID NO: 26343 - DNA, 3003 bp, Unknown; identical to SEQ ID NO: 26342
  misc_feature (1)..( 3003): 2750-1469P.txt file - cDNA_ID_2712649; gDNA_ID_2214574; Annot_ID_186294

SEQ ID NO: 26344 - DNA, 3000 bp, Unknown; identical to SEQ ID NO: 12836
  misc_feature (1)..( 3000): 2750-1469P.txt file - cDNA_ID_2712676; gDNA_ID_2214575; Annot_ID_135157

SEQ ID NO: 26345 - DNA, 3000 bp, Unknown; identical to SEQ ID NO: 12836
  misc_feature (1)..( 3000): 2750-1469P.txt file - cDNA_ID_2712676; gDNA_ID_2214575; Annot_ID_186315

SEQ ID NO: 26346 - DNA, 3003 bp, Unknown
  misc_feature (1)..( 3003): 2750-1469P.txt file - cDNA_ID_2712696; gDNA_ID_2214576; Annot_ID_135180
tctattagcttttacagaggcctgaaaaaacttagagttcttatccccacgagacatccatttatccctgcttttcaacctccaaaaagattcctcctctctaaaagcaatacccagctgattttgaataacagaaatcttattccaacaaggaaactggtaactcttttcttcatccaaatcaaatcttaactttttaattcgactctttgcgttataatcctttccttttttccagtgactaatagatgacctacagtcaaccagacggcgcatagaagaaggattatgagaagaaaaattacctatccatgctttgtgaatagcagcttggtataaagggtcttcagcataccttttatcaaacctgaaagttcctcggaaaagctcatgatcattaacaaacttcaccaaaaccggtctgtgatctgatccaagtttctccaaaaaccattgatgagaattaggaaacaaagaaaaccactgtgaatttccaaaacagcgatctaatttacattggatccattcttcatttcttttgcctccccaagtaaaactatttccagtgccccccaattcatgcatatcactggttgatatcatattcttgaagtcctgaaaggaagattccactctagatgggccacctattttctccttattagacaaaatatcattaaaatcccctatcaagcaccaaggagctgttctgttcactccaatgttactgattttatccaggagcaagtgtcttagcctctgtcttggattatcataaacacaagagataaaccatctcttacaaccttgagatatctccaaatccagcaagtttttgtcttcaacaaggaaatctgtatgaaggtgatgtttccaaaatattgctaaaccaccactctttccatccggttcaatagtatgaaagtaatcataacccaaccacctaaagactttcaatatgaacatgtcagaattcatggtctccatgaggaacaaaatgtcagggaaatatttctttttcatttccctcaagtgtcgaattgtccaagaattcctcagtccttggcaattccaactaaggatgccttattgatactgcggtggttcttgaggaaccaccgtaatgacagccttttccatacaatccactctttccaagtctgcaatttccttttttcgtttgatagcattagcaaactcaacattaagactaacctctttttcttttgaaccatcacgagctgcttgcttattgtgaactatagaagcctttctttttcttggattcttctgcttaatacttaatcctgatgcccccgattcattaaatccaaaagggaacccttccgaatctattgaagatgcttgatcagcggataaagaaggtaacttggtaggaacaatcttctctcctggattcactaaacaactctttccatcaagaaatcctgaatcagaaaaactaagatctttctttgattctttagagtttccgaggctaacaaaggggcaaacacttttctcatgtgtgagtcgttgacagaggaaacatctttttcgaatcctttcataatcaaaggaaactgaaatcaattcacccgatggaatcaggacttccttaaagttacgcaagggattccgaacatcaaagagcacttgaaccctgatataattttgtgcctgagatttttctaaatctaattccacagtcaatactttcccaacacatcctgcaatttctttgatagtatcttctgtgtagtagttgatcggaatatttcggagtcttatccagactggaagaaacaaaagagaatcatctgaaggtttttccacccaacgctccatcaaaacacaccactcatcctgagtccaaactccagattttaagatttcaattaaatcttcttctgatttgaaaaagaattgaaatctctcttgggataaagcaacacctcttacccttgaatacaacctccaaattctaggcatgtctaatatccaattagacatcctttggagtgacagattcaaaaacctatccactaaactgcaattatttctgtcaatcgagcaaaactgcgcttgattagacaaaataagaggctatcttcgttaattgacatttcctttatcgcttgatccaagtccatgttcatctccactgatagaagaagaaagcactttcctgatacctaaacttggtgaatatatctttgccgacagaaaacggggatatcttcggtacttacctcctctcaaatatcaaaaaactgatgtagagggagaagttcttatggtcaaatcgattgggacggctttattaacggcgaaggagaaattttccagaaaagctactatgaaagagaacagagagtttttttttttttttttaagtactattggagactaattattcatagtagttaccatttaaacacgtaatgttttcatttagatacgataaaaaaagttaacaaaactctagtgtccttgactacacttttcttacttttgacgtggtcactattattgtggactccccaatatctgactaactcaaattttacctttcttcatacgttttttttatctgtttgttaattaattccagaatgagttgtcaaaccagtaggatttctctgcatgtcgtgtcacttgcattttaaggacagattaacggttatgactagggtcggtaaagcaaataaatcgacaaaattagaaaacaaagaaaatgtggaaaaagcagtcaaaagaagaaaaatgttgacaaatgttacgaatttggtttaaatcaaaagtgaattatccgagaaagatgatatttacccccaaaatatctaaacaaatacttaaaaatgcaattctctaatagactatcaaatatcccgatacctctttatatagtgccatcttcatccttagtaatgtacacacacacacataacacttatttccaactctgtctctctcaattttctttctctttctccaaacatg

SEQ ID NO: 26347 - DNA, 3003 bp, Unknown; identical to SEQ ID NO: 26346
  misc_feature (1)..( 3003): 2750-1469P.txt file - cDNA_ID_2712696; gDNA_ID_2214576; Annot_ID_186348

SEQ ID NO: 26348 - DNA, 3003 bp, Unknown
  misc_feature (1)..( 3003): 2750-1469P.txt file - cDNA_ID_2712716; gDNA_ID_2214577; Annot_ID_135195
gacgaaacaatggccacggtcaaaagactaagtgacgttgaaaacgattccatagtcgaggttctcgccggcacgagagcgagctgggtttgctcatcgacaaggagagaggttaaagtgttgttgggcgggtttgaaggtaaggagttaaggaagctttggtaagcaccgctccatggagcaggactcataattccatagttcctcaaacctttgatttcatgaatatcaaccttaaaatcgttgggtaacacatgctcagattcagtattcagcggaaatggagaaaaatgattgaagaaatttcggtaatcatctccacgtagagagaaaatcataatgcctctatgatccaaaatggagaatacttgtactaagcataagcatttgtttattctctacttgcattttttaaatgacctctaaaaaaagcaccaacgattgacattgagtttggcttttggttgtctcttcccttttcacaacctcttacaaaactgacaaaaaaacatatagtggagctagcacaaactttaggcttctctacttgcttctttttaaatgatcctctaatatgttaccaacgattgatcttgataaaagcgacgattgttccctgaataacaaaaccaaaagtaaagattggcagttatttatatatacaaacacagaacacataatgatgatacacgaagaaccatttttcactaaatttgaatcaaagtataccaaacaacattaggaaaccaaacacggttaagatataaagtaagaaaacagcagacctggtcaattgcacaaggaatcaagcaacgaagcttgtccattccagagaacaaattaaatgtgaaaatgagctaggaaaagatggagcttcctgcaaatatatggaatccaatttagaattcaggtacctgctccgcatggagaatgatttttccaatatgatcttcactggaaaagccaaatattgccttagcctagcaagataaaagatataaaaatgaaaacacatgcattagcgacattgtgcaattgaaggagatatatatagagagagcaaagtcaccttattatatcgaatattgtttgaaacctcgctcatattttcttatagaaaccactacacacaaagttaacgttggttgtatatcttccctcttcaaaactttttacataaataatacactcaaaattttataaattatgtggaacttgatgaaatatgatgtttagcgaagagtatattttactattttctagaaaattatattatttactaagagattatatattaattatgttgttgttaagtaataatagaatatttacgttttactggtcttaatgccatttatgaatttgaatgtaagctaatatgatcataattatcggttacattgtaaagaattcattgttataatgacatgcaatttaatgtggttttttttggctaaaaagttcttattggtcttgattctggtcaaacaatatgaactttgtaaatgtaccaattttcttttagagatagttatgtatacttatatttagaaccaataaattaaagaaatttttttgatatgtagataacacatgtcgaatcaatagagcgccacttgtcagtttttttagagcataagtttgaggaaatcttattttattatataataaaatatttttattataactaaaatatattatcctccttgatgacttaacccatctggttttttttttgtagtggcgattgccagatggcttaccggtttccgtcctcgtggacatactgaagctgttattgctattgcatttagtcctagacctggatccccgtaccagcttctctcgtaagaattgttctttttggcatcttatacgctgttttgtgtcagttctattcattggttgatatcatgctatttatgtgtttggaaaagatggtttatttcaactggtaagctccatgagccctttataaaatctttgcagatcgtcagatgatgacacatgtctgatatgggatgctcggggtgtccagcttgctccgcggatataagtccctaagcctcatagtcctattggtgattggctgattgctttatattcctggttgatttatatatcgatttgatctattggaagctataggactgacttcggaatcatattccaggagaaaaccgtggcggttcttctagtaatggtaattttttttgttgtgcattcaatgctaatggatctatctttgtcaatagcagctctgataatcgtgctagagtttactcggtcttgataaatgtttcttgactagattatatatataatgatgattcagttaattagagtagatacttccttggttacaggtttggggtgctagtaagaccaataagaatgatttagaccagctaaatcatgagatggatgttctggctggacatgagaatgttgttaaattacatttcttatcatatatgttatatttggtacctgctcatatttttaaattacatttcttatgagatcctaattttcttaacttagtcattttctgtggttctttctagtgcttgtgctggaagatctggacgaaaatgttccaaattttaagaattcttggtgtgctttctgctgcaattattcgtaaaagtttccttataatgtttttgacactcaataacatatgtatttgtctaggttctcttatgataacatagttacatgctctagtgatggtagtgcaatcatttggatcccaagatcacggagttcgcctgtaacatccgatttcgataagataaccatgacattcaatatgttttcataggagtagaaaccatatctttatttatgtctttcaggtaaaatgctgccaagccttagaagaagatccgagaggttgaaagataaaacaaaagtgagtattttgtaatattgctttgatcttgtggctaaatatgctacttatctgtttttttacgtctttagcaggctaggatcatg

SEQ ID NO: 26349 - DNA, 3000 bp, Unknown; identical to SEQ ID NO: 12875
  misc_feature (1)..( 3000): 2750-1469P.txt file - cDNA_ID_2712728; gDNA_ID_2214578; Annot_ID_135220

SEQ ID NO: 26350 - DNA, 3000 bp, Unknown; identical to SEQ ID NO: 12875
  misc_feature (1)..( 3000): 2750-1469P.txt file - cDNA_ID_2712728; gDNA_ID_2214578; Annot_ID_186403

SEQ ID NO: 26351 - DNA, 3000 bp, Unknown; identical to SEQ ID NO: 12883
  misc_feature (1)..( 3000): 2750-1469P.txt file - cDNA_ID_2712740; gDNA_ID_2214578; Annot_ID_135209

SEQ ID NO: 26352 - DNA, 3000 bp, Unknown; identical to SEQ ID NO: 12874
  misc_feature (1)..( 3000): 2750-1469P.txt file - cDNA_ID_2712752; gDNA_ID_2214578; Annot_ID_135206

SEQ ID NO: 26353 - DNA, 3003 bp, Unknown
  misc_feature (1)..( 3003): 2750-1469P.txt file - cDNA_ID_2712760; gDNA_ID_2214579; Annot_ID_135240
agaaacgaagggtgtactgtacaaaacttttttttcattttttttcgaagagtgccacttgttattgagatgctgacacttgctatattttcttggagatttttatttcatcttatctttttacaatcaattattacatacaaaagtttttttttaaaaatatatacttatataaaaatttatgacttctatatatacatttttgcagccattttaacaaataaatcctataactggacttatttacaacccaatgccattagcattaattttttttccaaaataattaattttactttaaattcttaatttaaattgtcaattacattatcaatcaaatttaatccaaacaaacttcacattaatcccttaaaattagcataaacgtatttgttagcaatattttaaaacaaagttttttgtttaaataaatattattcttactaaacgtttttttgtctaaataaataaaccctgtatttgaacttatttacaatgtcatgctattggcattaattatttagaaattaaaatatttaattaacgatttaaatcttctaaatctttgcttttagagttattatgtcattacctaaaaggcaaaaaatatatatatttttaaatattattatttatatatttaaactttataaaacattattaatatttaaacaaaaagtttaatatatcaaaaaatttaacatcattatataatatatagtttaaaaaatctcaaaaaaaaatccgtcatattttgtgattcaaaattttaaaaatgaacatatattaaccaattagcgaaaaatgtgtgggttcaacatcccgcatcgactaaaatatttagacaatgattcataaataagatcaacattaataaaataaatgttttttttgcaggatgggttttgcgggacgggtttggcaggacgttacttaataacagttgtaaactataaaataaaaatattttatagatagatacaatttacaaatttttatatatatactatctttaaaaaataaattgtccccgcggtgtaccgcgggttaaaatctagtttaaactctataaatggaggcttggttcaatttatttggacacataaaaaaatgtcatttctaccataattttcttattcttctgccataaattctatatattattctaccataatgtcatttttaattaatttaatttagttttaatagatattttaacttaatttgtttaacaactattattatgcatcacgaaatataagatataagaaaataagaataaaagaaatagtggggttgggtgttgaattttattaataaaaaacattggagtgataaaaaattaaagtaaggaagaaagaggaaatgatgtgaaatgttcaaaattgaggtggaggtgctgaatatgtttttgcattgtacatagttttaagcatttaactattgaattaatattttcaataagtcattgtagatagtcatagagaaaacaattaatcaatactatttttgaatgcccaccagcactctaaacttgcacattatcacaaataccaacggtcccaggaattttccaatcttcatcggtctatgtaaacatagatcatttattttggagaacacatttatattattttatttttagcttttcttggattatgtgatacatatggaaagcacaaaatgaaaaacttcacgaaaatatggatcgagatccaagggatattctcaaactagcgaaaaacaaagacaatgcttggacgttagcctgattggaggttgcaaatgaaattcaagcctcagtggcagttaagtcggttaatataaatctttcaggatatcattgtttcattgatgactcttggaaagatagtgacaagtttttgggcatgggatggttctgtattttaccaaatgaaggacatccaaccatgtgtgctggaagcactcgtctgggcaatgaaatgtatgattggccaagaaaagcgaaaagtaacgctttttataaactgtagatctgatgaagatgatgtattttccaacaaaatggccaacattcgctacatacttaaagacgattcaggaagatagtgatgagtttgatttttttgatttatctctaatgcttcgaaatgtaaatgttaaaacagaccactagatacggaatgttcggatataaccacatatgattatctttgtaaacaatactttttagcattgatttattatttgagttaatctaataaagttgtcggaaaaaacggaaaagtgagaagagaaaaagtcgaaaattcagaaacggtttaaagttaaccaggattccggtttttataacagaaccgatcggttttgtaattgagacgaaaacttctgatatcacttaaaaacttcacagaaacaacacctcgatctcatcgaagctcctctctcttacatatcatcacttcacatcaaccaaacctacttctgtctctctctctcgctctctatctctcacgctctcacaggtttttttctctctctgtctctctcttgttctccatttgcgtctctgtttgtttgatgagtttctgaatgttaaatgcagatgtgttttggttttctgtggaagtttttatatctctgttgattgagtttttctctgatgttgttgggctccaaaaaattcgaaacttgtattatctctcgtttaggtttcgtgttctctgcattgatctgcttctttaatttgttaactatactcacgtatgtgaaaaatctgaactttgtttgttaactctaatccaaatcattagaaaaatgcagattgagatttctctaatgcagtgcttgaaattttggaaactagggttcttgttataatgtttcaagtagtgaacttatgtcaacttgtgctttaggtttgatctgattcttaaattttgtttcatatgtggtctttcttacaatgtttctggatttgttgttttagtagaagaaaaaattagaaaggttgtgagaatg

SEQ ID NO: 26354 - DNA, 3003 bp, Unknown; identical to SEQ ID NO: 26353
  misc_feature (1)..( 3003): 2750-1469P.txt file - cDNA_ID_2712760; gDNA_ID_2214579; Annot_ID_186437

SEQ ID NO: 26355 - DNA, 3000 bp, Unknown; identical to SEQ ID NO: 12894
  misc_feature (1)..( 3000): 2750-1469P.txt file - cDNA_ID_2712782; gDNA_ID_2214579; Annot_ID_135226

SEQ ID NO: 26356 - DNA, 3000 bp, Unknown; identical to SEQ ID NO: 12894
  misc_feature (1)..( 3000): 2750-1469P.txt file - cDNA_ID_2712782; gDNA_ID_2214579; Annot_ID_186420

SEQ ID NO: 26357 - DNA, 3003 bp, Unknown
  misc_feature (1)..( 3003): 2750-1469P.txt file - cDNA_ID_2712786; gDNA_ID_2214579; Annot_ID_135224
atttgcatctgaagcacggtggacggaacatgagtatgtaagtacactaaatatttttattcaccaacctatgtttaaatttttttattataaaaaaatctaattaattttaaaattatactgatgcaaattaacaaaattaaatttatattttgatcaatttttgtattagtggtttataaatatctgttattgtttatttattaacacaaaaatttaattaactattaatatatatatatatatatatatatataatctgtaatccgccacaagaagtttttttaccaatcaaaccttattctgtaccgcttattttgtactaaccgcacttgtcccacaaatatgtattctccctgcatatacctcagttgaaccgtacatcattgtaataacgctttccccgcacaataaaaaccgcgattaccattcagacctttaatgaaaatatttaaagttgtcacattaccaaattatgcacatgcaattagctagaagattaaaagataattctattaacatattttaatcattaacagtaaaattgataaaaattccggaatagagcggaatgatgctgaaataccgtgacacaggatatacacaccaagaagatcaagggttttgctggatattcacaccaacaagatgatctaatcttaaagagttttagaacagaagatagatgagttctcaaagagaatacaaaagggtttataaagagaaaagagaagagaagagaccaaaacatgatcaaaacacaagcccttctcgaaactaacagaaaattaattataagtttgaattagaaaatccgttttaaatacaattgactgccatttaaaataagatggcatagcaaaaaaaaatctccaacaatttcgataattttaccttgtgttctgtttttttttactttttgacagaggagtttcatcatacattcttcttcatctacaatagaaaaagagattattgttaattaacttgatttgatgtttgttttgtgtctcgagaagagttaatggaacaatgagtcaaaaaaggcagaagagagagagatggctatgcgaaatgaaagaggcctagcgaagaaacaaagccctaataaaagcagagaaatgaagcgaaaatgcgatcacatccatgattcatttatttttaaatttatttatgttattaaaaataaattataattaaaaacatatacaaaatatttttagttattgtacctaaacccgcaccagtcccgcttaagtttttcaggtaacagaataaatttaggtgtgtttggttactggttaaatagaataatgaatttctattatgtttggcaattgaaataatgtaattcagaagaaaaaaaggaaaatttgacaacattgtgagtttgtttgttcagaaaaaacctttttctactatagatgattactttctgagctaaaagaaatgcttatttttagtttgacatctaacttctcacttgtcaaattactcttttcattactcataaaaatgcattaaactttttttattggttaccgtgaattaaaaatatataatcacaaggatatgtagttgaaaagacttcgttggcccttttcgaatgattttaaaaccatctcatacgtgtgctaaaagttttgtctaccaactgtttgtcgaaatgcttccgaaacgttttttgtttgttgataaactaataataattctgattttctggtattttttatttgttgtgccgactattttgcagacacgagagattaaaggtatcccaaaaatttctgggaatatagttcttattcaccaatcatttgtagcaaacaagatagaaaaaacatgcctaattctccaaagtttgttttcataagtaattttgaataattttcatttctctttatttacttccattattttgatatatagttcatatccatatctcttatgattaattttttaatcataacatgagaaacgataggaatgaaacctatttgtaggcgtttacgatatttcttatgatacattttttttgtaaattagaatttagaagtagtcactttcgttttcattactggttcaattagaatgagatatgataaaactaataatttttttcaattgtctgctctacaatctacacaggattccaaggaaaaaaatactttaggacttcacatcaccacatcagatattgtcaaagacaattttgttttgtgaaatcgaatactctgaatccggctttgatatcgaggaaaaaacgcttgacaaagcattgaaagaaaaaaaaaatattagttaaaggaaccttatacattttatgaagtttttttttttgtaagcacccgaaataaaattgatgaagtttgagtatatcactatgccttatggtttttgccgaccaaaatatgtcgaaattatgaatacatatattttatttatttatttatattctattaaaattattttgggtgtaataataaaattaaacttctatcaattttaaagggaggattattaatttaaataacattaaatcatatatgatatataatcaaataatattttagtaatcttaaaattaaattaaaatttaaaaactgatatttagataatcataaagtattaacccacaacaataagtgattacaatttaaagaactactattagtttcttaaaatattttaaaagcacatgtgttctaaaaaggttacaggtagataagcagtctgctcctaaagaactataaacaataatcacttttaatttgtttaaaaccagcttgtttcacgccctaaattaactaaaatatatctaccattattccagacaaaacgacgtcggttggtgtgtttcacgccggcttggtgctctaggcatctatctgattctcactatcactactgacacaaatccttttccttttgttcctctttctctaaaccaatctttaaaacaacttattcgtcttcaagatttctccaacaagtcctaccatg

SEQ ID NO: 26358 - DNA, 3003 bp, Unknown
  misc_feature (1)..( 3003): 2750-1469P.txt file - cDNA_ID_2712793; gDNA_ID_2214580; Annot_ID_135257
gttaatctaatccttttaataataggaaaacaataaaagggaaacaaatattggaattttaagtaacaaaatctttattatttttttcttttaaagagaaatatttttacttttccaaaagctcaaccttagtaataatatttactttccagatttacccgtatctgatttcagaaaatacagttaatcatctactacgtgtgaaaaaatcattgactagggtcttatgttttaataaaagtaaacctccacgttcacatagattatgaattaattattatttgtgtattttgtagtgaatatcaatgaaaatgtaaaaattggtaaccaacaccacaatttttttaataaattattatttactgggtaaaactacgttacactaaacaaactgaaattaacgaacattcatgggttttggtttttaaaattgttggagaaaaatatgattatagttttagttaatttttatgttcattttgtgtgtgaattagatactgttcttttctccattcagatgatcttttaaattattataaacgaacgtcaatatttatcttcatttagatgaatcatcgaatggaaaaacgaacagtactttaaaagattagcgagaaggatcagttggatggtttttaataaactcatttaaaaaaggaacagaacagcagttaacggaagctgatttaatccaaaatacgaaatgtcataaaatacacctacctaaaaagaattccagcaaaacctaaacctatttctccttcattcctcgacattcacttcgccggacctcttcactggatctctcactagaattcactcctatctcttgccgtaatccactattctttgccggatttctcgtgcgttctctctctctcactcactctctccttctatctctctgtttcatggatttgatttcactatttctcactctccccttctacctctctatctcttgcagtaagactcacgggtttgatttgtccttgagtcattagatggattcgattatttattttagctcgttttggacaaagtaagattcatgggttttgtattgagtttatgatgcttataagctataattttcatgggtttttgtatttgtcgagattcatgggtatgagctgattcatgagttttgtatctattgtgtatttagaaactgatatgctttagaattgtgtgtcagtttagggtataatttaggtcagtttatcactgtcaataaccatctttcagttatatcaatgctgtattttcatctagttcagtattagattgtttgatgaaaagtaacaaagtatcaatatgtcattactaaatcaggatttatatgctaacagagttaagcttagatttgggaattaacaataagctgcatcggtagacataagtcagagaattttgttatacttttaatgtcaacaattttgcttatggaatcagtcggataattttttgcttgtatacatgagtaggataaagctgatgatgttctgtatcttgattgtgcctttatttttttcggtattgttgctttacccatagaccaatccctggtttcaacttttgtggaagcagcacctgttatggtattgacagaatcttagaacaaaaattataataataggtcttgttataatgcattggcaaaaatcatatcttatgtttaattcatcaaaatcataaatgaaaatagcagtatttcatagcatagaatcaaaacatgatagttcagtgccaaagaaaacaaaaagttacaaatgaccttgagaagtttcacgacatcattttattacctgcataacattcaacagtggagaagaggtaatatgttttcatgtgtccactagttttcaatctaattatttcacttagaatacgaaattggtttttcttgagtttgatttctttctttatatgtttgtagagtagatatcataaaaatggaaatttaagggggatgtattcaatcaaacatttcaagtgatttgttttaaaataacaaatcctatgttattcaatcatgaatttttaaaagtttcatgaaatctaatgttattgaattagtgattttaaaatctacttaaaaatcctatgttattgaaaacatttgaaggattggatttttgatgactttaagagacttaattgaatacacttttagcggatttccttagttaaaaatacagaattttaaatcccatagttttaagtggaatttgagaggattttataataaatcataataacttccttaaattcaccaaattcttcaaaatcatataaaaactcaaaataactcaaaatatacgattgaatacacccccccccctaaatgtcaaatataataatttgaatttttttgattgtaaatatgtatttgattagtaaaataaaaaattaatatggttagaataagaattaaaatatagttagatgaaaacatggacattttaatcgtttttcatattagaagtaactagatggatcattcagctgaacaaacaaacaaagttttaatgaaaaacagttagatgaatcatccagctgaactaccaaaaatggaaccgaacatcattcagataaattagtcaaatgtacgatttggatagattatctagatgtacatccgagagcaaacgaacaggacctaaaattgggctagtgtaataaacaatgtggggtggccggccagattaatgcagagaaattataagccttaaaagtttttctttctcgtcattttttttttattggagtccaaaactcagtataaatgggcttgtattgggcttaactaaatcttgaggaatcagcccagagcttggccacagctctcctctgcatctgagcattgctctcgtttcagattaacaacaacaggtttgctggttttaagacaagatctttgtcttctgatttaaaaattgcaactttaactttatacgaatagcagcaagatgattgatttggctactttatagtttaatg

SEQ ID NO: 26359 - DNA, 3000 bp, Unknown
  misc_feature (1)..( 3000): 2750-1469P.txt file - cDNA_ID_2712801; gDNA_ID_2214581; Annot_ID_135268
atcgtagtcggcagccatttcatccaaccgaggggaaggtaagcaaagagtgaatcacgagagattattcgttttcattagttcctacacttgattgcataggaatatcgctatgctaattcttctctacgcctggtcattctttctttgtgtcgcagagtgcaaaccataaaagtatcaaagtttaagacgagctcactcatcaggccagagcaatcaatacatgagcaacatagaattacgaattgtaaagactcaaagaaagagggtttggtagtagcagtccggttttgtttgttagagttagaaagctcaaaccttgaatctatggctatagaggtttcagttgtagcagtcgtttgagttagttatgacttagaaagctgaaaccttttttgaagtgctttatatcttaagacgttagattttattcatagacgctataatgaattgtttgattgcttacataaagtgttgtaaacttcttcctttaatgttaattcttggctttatgactttgcttgcttggtgaaatagttgcattagcactgttgataaagaagaaaaacaaaatgaaggaattggggaatttctttaatcgacatcatgcttggtcctctcctctgggaagtttggaattcttcttatgaagttggactttatgaagttggacttaagtgataccattagaaggagtagtagtaatcattacatgatcctcatctcaatcacataatacatgtgaataaatttatatttcttctctaggaagactatcattagtgttttgatcaataaataacgagctttaagatgatagcctcaatacctgaactcaaatgggaaactttagcctaaggactaaatgagcacatcagcctttattcaagcgtatgatctcttttgcttgtatctgtggttttatgaaaagtagacaaagtttgtggcctttctttattgcttggaaacagggtaggtttgaaataattatcagattataattttcaacttatatataatctgtgaacgactcggtcatgacgagtaaaatatatggagtttggttcgataccatgcatagtgatacccaagtcaagaagcataacctcttcattacctagagaatctacctcaacaagcaagttgtcgtgtttatttgggtctggattaggatccttcttgaagatgcggaagctcttctcgctttcaatatttttctcgtaaagattgtttagaaccatcaaaacctctcctgatgttgtaaccacaaggttaaaaatacttcgaaaaccccatggtccattatgcacgttgaatagataatttcgagtaacatccttgaaaccttggtctttagacaaatcgatgatttgaatgtaatcaccaacaccgatgtaaagaaagcaaccatggagtacaatatcagatacgctttgaaacacatcggtgatgacatattctagttgaatgtgactgtaatgatcatcagctttcttgtaaaaggctaaaaagttgcaagagtcttccaagaaccaaactgcaacaaactctttcattttctcgtctacccacaaaatacctcttaactcttcagctcttggtaatctaaaaactagaatctgatcattagatgcttgccatttcaattccttatcccctttttgctcgaaagtaaagttatctgacaggagagactctagaggcggaagatcgatcctattctcgctaaacacatctattatatagagattggatttagaatccattacaagaaaccaattacccgagtttgcaaggaatatagtcccagagaagtctctcaccgatttgtaaatcctatcttcgtctggattgtacagcacgcaaccatgaactccttcatctggaaacagaattagccatggagattttgtttttgggggagccgtttgtttcgaaatcgaattccaagtagcacgatggaaatctgcaaagctcaatcggttgaaaatatttctcagcaaatcatgagggagttccgacaaggtgagaggattaggagtttccatagggttctgtctgacgttaatgtttgcgtaatttatttggtctttaataatagggttttgacgttagtataaatagggtttggatgcttgtgtgaaaagtaagaattaatatataacagattgaatgtaattatggaaaattagaaagttaataaatatttcaaaaccaagtgaataaaatttttttttatcaaaaaaataaaataattatttttgtcctttttgtgagatctatatatgctaatatagtgttaatcaatataatctaaaggctaatgttcttgtatttgagatcttcattaataaaagagttttatatctagtgatattaatttttatatttttttatgaaccgtgtaatattagtttttttatttgtaatatatactattaagagagaacgagggacaaaaatattccaaaccatttaagccattttctaaaaacacttcacagaaaaaaagcaaacaaaaaaatttcaggataaaaacgtcgttatatgcgctttacgcagtcgatccgggccgcctaacaaactgaccgtttaaacacacgcggatccctttcttttaccctaatatttatagattttcactcggcctctgtctctatctctctcgccttttttatttttcccaacagaaatcaattcaatttttgttgttgttcttattcttttccattgttgtttttcttttctaggatgattttttttttgtttcattcatgggtttcagttcagttttcagagattcttctcgtgattgccccttttattttgttttgaaagtcacaacaatggtcacgttttgatcgcaaacttaatttgatttccatgataaaaattggaactttcttatgttgtgatcatttacaacaatttgtgcgtgatgggttgttctaaatgtagaattttgtttgatcatcgttgggttttgaaagaagagcaatg

SEQ ID NO: 26360 - DNA, 3003 bp, Unknown
  misc_feature (1)..( 3003): 2750-1469P.txt file - cDNA_ID_2712852; gDNA_ID_2214582; Annot_ID_135278
ttatgcaccaactatatagaagcaaataaagaaaaacactagtaattgttaggaaataatataaaatttggaaaaacaaaacgagaattcgatcagcaatgaagtgtaatcacactaatcagcataagtatttgggaaagcccttacattccctctaatgccgtgcaatttcccaatgaggcaggtattgattgatataacgcattgttgtgaagcattctgcaatgacatgggaatacacatacaatgagtagtagagcatatgctagacatcaataatattaattaaaaggttaggagcacatacaaaagccttaactgatccagctttccaagctcagggggtaaaggtccccttaatttgtgataagtaagactcctgcacacaagaaacttcaggaaccgacaaaagatgcaccacatactgaagaaaaaaaaagaatttaaactaaagaaattttaaacttacaaggctataactctttttgtttttgcatcacaggtcactcctttccagttacatggatcaggatcctctggtctccacagaccaataacaccatcagaagccaaaactccatttctaaaactcaaaagcgcctcacctggagaaaaaaaggatttaatcccttcagcaatctgggcggagtaaatggtgatcatgacttgtcaaagacaaaatatagaagagattaaagacacatatcgctgtataccatcaggactaattgcttcattttcattcgttagtgcagagagaaacgagatcaaaagaaaccatgagcagcagcgcttcattagacagatgcccattatggcaccgttcaagcataatatagctactgccaatcatctgaaagaacagcctccggaatgcaacactcgtagcatatactcagctgctccgtgacgcccagtctatcttcaagaaacaaaaagagactcctgaagttaaataaaataatgtcattagaccgtacaacaataacagctgaccctcatttgaaactctatcaagcctcgatcttccaataatcagacaaccaaatcctcaattacaaatcaagcgttccacaacatcgatgcacaacatttgcatggtctcattaacaattacagcacccagaacagtgagattatctaatcggatcaaatccacctcccaaatttgcaaaatcagaaatcgaaccttcagaataaaaccccaactcattatttaaagaggagctcggatagctaaaatcgaacttaaatcacgaaattcggaggacatcattgcaatcacagcacaagaagaactgaagagtcaacaaaaccattcaataatctaaaaaaacgaaatcgattcgccgataactcagaccaaaatctcacttcccccaaaaaaatggcgaaagagaatgggaatttacacgaacctcaaaatggatccgcgaggaggaagatgaagatgaagaataagacagaggaagaagacgcaattgagctgtaaagcaatgtcttaactaacaacttttttttttttgttgttgttgtgatttatgagagagtgaagagagagaaagtagagtgtgcagtggaaatgtgagatactttggagaaggaatcggctagttacgagtttacgaccaatgagagaggagaagtggagaccacacgtgccgatcatgacttattacacgtgtcgaccgacgcattgtataatgccagaactggacaagggcttgttgggtcagttaaaacatcgttattgcgtgggcctactaaagcccattgttatttatttggaagcgtactgtactttactatctttagggacaattcttgtattttcagctttagcggatcttattcacctaaatcaaacaaacaagtgtacttaaaaatggaacaaacaatggactgataatcattatttcatttgcttttataatagaaatcaaaatattaatattggattcaatctttccacgtaacttcttgttttggtaatttcatctatgattcttataaatttggtaccattgtaaaaatatggcttaaatttgagttgttgtttcatgtgttagcagtagacaagaaaagatatctggagatagagagttacatcacctaagacatgaggatggagatggaaaaggtgtaaggtgtggtgtggcttaaatattcttgtactaattatcaatcaaagtttgtttgaaatttgagtatttgtattctgaatttgaattagatatttcaaatatattaaaatccaaagcgaaatcagatcctagcataaatatttaggatattaaaataataaattttaactagtttttaaatcataaaatacacaatgtttttgaacttccataatcaaactaataaatccattttggtttacgtgtctagttttatagaaaatgactatttatttgtattttatagaagaaaagataatccaataagtaagtaataataactcatgattttgttgattttttaaaataaatatttttataactaaaaatgagttattcatttcaaaatattactttattttcttagaaattaatagattgttaatgtaaatatattttgaaaatatttacagaaccaacaataggaaaattcagtactgttaatcatttcctaaaatagtttgaaaatgccgatctctccacgtggagaaagcaaaagaaaaacgctcgttttaagatttgaaataatcgcgcgtgtaaacatttccaatcaaaacgcgcgtgaagggtttttaacaaaaaaattacaccaccgatttaaacgtagaaaccaaaattcccccactctctctctctcattacgctccaccctactcttcttttttgtccttctctctctctctcttgccggcactaacaacacgaagaaatttttttgaaaagagagagaaagtttccaagagaccgtacgaagaaaaaaaaaacttggtatagatcgataagatcgataccgtcggagagataatttcgtggagtaatg

SEQ ID NO: 26361 - DNA, 3000 bp, Unknown; identical to SEQ ID NO: 12933
  misc_feature (1)..( 3000): 2750-1469P.txt file - cDNA_ID_2712856; gDNA_ID_2214582; Annot_ID_135277

SEQ ID NO: 26362 - DNA, 3000 bp, Unknown; identical to SEQ ID NO: 12947
  misc_feature (1)..( 3000): 2750-1469P.txt file - cDNA_ID_2712882; gDNA_ID_2214583; Annot_ID_135297

SEQ ID NO: 26363 - DNA, 3000 bp, Unknown; identical to SEQ ID NO: 12962
  misc_feature (1)..( 3000): 2750-1469P.txt file - cDNA_ID_2712886; gDNA_ID_2214583; Annot_ID_135295

SEQ ID NO: 26364 - DNA, 3000 bp, Unknown
  misc_feature (1)..( 3000): 2750-1469P.txt file - cDNA_ID_2712890; gDNA_ID_2214584; Annot_ID_135318
aacaagatcactaaggtcaatacattagttgatagttgagtaacatgtagtcaccacaagcatgacgattgaaactacgataagcgccactctcctgcgagtacagaaatgactattatacatttgtttattaaaatccaaagattctacaatcaatctaaagatagttttgaataagaatgtatgggttacgcaaattacatgggttacgcaaattacatgggttacatgattcatcatcatcatcttcgtcttcatcactaatctcaaaaacttttttcggtttttaaggtgctttagcttcagacttttttcttctctctgttttagaggcagaagcttcatcacccttgcttcttctttgggtttttgatgcttctggttcacacacttttttcctctgcgtcataggtgttcctgtttcatctctcagttttcttttcagctttttagatcctcctgcttaatcattagcttgttgttgttcatatctaacttgttccaactcaatgactctccgagattccacgtctaatgatctcaaatactcagcatcaacagaatccaacggatcctatcattaacaaaatacaaaaactagtcaagactagcaaatcaatcaaacaaaagtaaaacatctaattgtttatgtgtagtcacaaataacataccattacaagtgttagatgctctgttttgatctgaaatctgaatctaagaagcttcaatgatcgtaaaaaagaaacttgaagagatagagaatgacttttcagtttccttgttaagcaattgagcgtgaactactacttttagggtttgaactgcacaagaaactctaatagagagaaaaagtttgaaagcctctatgagaaatgaagggttttaaaagagttggtttttctttcgtgggctacccgcatacccgcagtccgcaacgggcttgtccgcaacgggcttgtccgctataatccgcagtccgtaatgggcctgcccgcgagacccgctaatttgtggacaaaaaaatcaacgtccaagcccgttccgccatgggctacttggacaaagcccgcgggctagcggccccgcttgacaactctagtcacgttagtaaggtgttaatgtggaatcattttgcaaaacctatttcttctactaaactcttaaaccctaaagagtaaagacatttgcactaccccgcgtggtcgacgattcgacgcttccaatgacgtcatctcgcctctatctccgtttcctccgccgcttctccaccgccaccggtatagattctcaaaccactgcttaccccggcgcaatcactatgtccaaagctaaatccaaactccgcaaagtacaagatccagacaaagccttagcgatttacaaatccgtctccaacaattccacatctccactctcctctcgttacgcaatggagcttacagtccaacgtctcgctaaatctcaacgcttctccgacatagaagctctaattgagtctcacaaaaacaacccaaagatcaaaacagagacttttctctctacacttatcagatcttatggacgagcttcaatgtttgatcatgctatgaagatgttcgaggagatggataagcttggcacacccagaaccgttgtttccttcaatgccttactcgctgcttgtcttcattctgatttgtttgaaagagtcccccaactgttcgacgaatttcctcagaggtataataatatcactcctgataaaatctcttacggtatgttgattaagtcgtattgtgactctggtaagcctgaaaaagctatggagattatgagagatatggaggttaaaggtgtggaagttactatcattgctttcactaccattttaggatctttgtataagaatggtttagtcgatgaagcggagagcttgtggattgagatggtgaacaaaggttgtgacttggataacacagtttataatgttagacttatgaatgctgcgaaggaaagtcccgagagagttaaggaattgatggaagaaatgagtagtgtaggattgaaacctgatactgttagctataactatcttatgactgcgtactgcgtgaaaggaatgatgagtgaagccaagaaagtgtatgaagggcttgagcaaccaaacgcagcgacgttcaggacattgatatttcatctgtgtataaacgggttgtatgatcaaggtttaacggtgtttaagaagagcgcgatagtgcacaagattccggatttcaaaacttgtaagcatttgactgaaggattggtgaagaataacagaatggaagatgcaagaggagtggccaggatcgtgaagaagaaattccctccgcgtttggtgaccgagtggaagaaactagaggagaagctgggattgtattcaaagggtaatgcagctgctgtttcatcttcttctcaaactagagaagtgttagatcaagaaagagaggatgatgtataaagctcaagaagttgcttagaagatcttatttttgtttgtgcttgcttgcttcagctaatattatggcttgtggaaactgtgatctagcgtgtagaagacaaacgattcccaatttacttgtctatgctttgagccaattactacgcttgcgttgaaagttaaccgtatttttttgttcttttcccccagatcatctgaactatagtctgaattgtgaaaatttcatatcgtttaacaatttaggtttacagttatttgtaaaaccaattcccaaaatgattagtaaaaaaaactcaaaatctctagactctaaataggctaaatatcttaatggatataaaagagcttaatgggcttataggcccattagagacggcaccactctaaataaacccctctttcttcaccgtccgttctaacttctagaaaaatcgccagaagtgacgaaattgaaaatctcagatttctcttaatcggcgacggagtaacgaaacaaggagaagaagaagaagaagaaaatg

SEQ ID NO: 26365 - DNA, 3000 bp, Unknown; identical to SEQ ID NO: 26364
  misc_feature (1)..( 3000): 2750-1469P.txt file - cDNA_ID_2712890; gDNA_ID_2214584; Annot_ID_186594

SEQ ID NO: 26366 - DNA, 2637 bp, Unknown; identical to SEQ ID NO: 12982
  misc_feature (1)..( 2637): 2750-1469P.txt file - cDNA_ID_2712894; gDNA_ID_2214585; Annot_ID_135343

SEQ ID NO: 26367 - DNA, 3003 bp, Unknown
  misc_feature (1)..( 3003): 2750-1469P.txt file - cDNA_ID_2712929; gDNA_ID_2214588; Annot_ID_135375
tctgcaaatgagtcccatatatcaccaagcacaaaataaggcacaagtttattataatcatcatctgctcttctttctcgtagcaatgtctacacagagattatcaccatcaccatcagagaacaacacagacttagattaaaaaaaaaaaaacataaaatagagattgtaataaaccttggataaaaactgagccggtacggatggtgtgaccgactctaaaaaccgatctagattactggaagataaatcggacggctcgagttgttgtttatgcggagaaggagctgatgatggaacgttagagacgtcgctctgagctctacggagctgatcgatgcgctgattggccctgcgagtttttgcggaagtgtagaaaggatcgtcgccgtgtctgcctctcgtcaactgaaatccagcacccaacatctccgagtagtcgtagttgagtttttacctatatatctatatatctatctaagcttaatttagttgatttagcgtgaatatgtgtttgtctccgatgagacggcgaagaagcttggtcgaatcggagattccaaagaaaggggtaaaaatggatcgaatgaaggagaattgatagaacaaaaaccttctgatgatatctaagctccgattaaacaggcaaaagattagtggaagaggaaaatctgaagaagagattcgctgaaatggagagagatttggtaatttcaaaaaaaggggtcaatgaagagagaaagacgattggttagtaattggagggggagagacaaaaaccattgaataacacatgaatccctcataagttagtgtttttacattttggtccttttcattttgatgattgattacagttttacccgaaacttctttgtaattcagttatacgcttacttataaacaagttaatcatacggtaatgcaaggtattttagactgctcagatgcataatgtagatggtgcataggaatgatttggggttatgaatgtaacattttaaaatctgatgagaaatatgtgactatgggaaatataaaggggttaaacattggcaaaagccaaaggccatatgtatattaggaggctctttaatttaatggttgatactcgatgcttgcttgctagatgctgacaagattataaagaaataaaaaagaaaggctgtaaaacatttggtctttctttttttgttcatagataagcttcacaatgttcaagagtaatcaaaaactatactaccattgaagattcgactaatgcatgtacaccaactacattcatcattcattgacaatgacataaacgtatcagaacatatatattcatgtatttagtaacacttatatgagattataaggagttttttgataagtgaaatgaatgaattttcacatattattgagcacctgactctgcattctgcaataggcggctagtttttatcagccacataagtagtcttttattatttgaagatatgcacatgaccaacacattatagtgttctttttgcctggcttcgataggtccacaaataatgggtttgatagaaaacaattcttgcataatgtgggggattcgcctagctagacatgaagcatttttttggagtatataaatggggattttagcaatactatgattagtatttggattatgtaatctgtgatacttaaacacattgcctgcatataaatccatatattatttaaaatatatcatttttgatttttgacagaaatcatagagattacggaaacagataaaagcacactccagaaaattagagacaaatattactattcaaaaagattcagatcgctactaagtgagggtcgccaaatcgcgagtcgaaacaccgattttgagtccgcgaaattcggaaatttgcgtggttgccacaataccgaagtactggaatcctcatcgtgaatggaatctctatatgtaatgtttcagtgtagtaaaattcaggtcttagcatttgctttctagatttgtatgtctaaaataagtgttaagcttgaatgtttgataacagtatcgaccataaatctcccatctaagccgataatgtgttttgatcatcattgtgaattttaaatcagtgaaccataagatagcccaattgggcccaaataatgttgtctgaataaagcccattatcaacagtaacggagttcaaagagtgggtaagagatgtgcgacgtcgttcaggagcttctatatcacaaatcttccttcattttctcagtggaagaggagggaagctttcttctgtagatcttcgcttcctctctctatctatctctgttgagaagaagaatcgaaactttgaaatctgtgagaggaggggttcatagttcgattggatttgatgtctttggtgcatctgcttttgttcgccggccttgtaatcgccgcttcctcttcttccccgggctcgcgcttgattctccgggaaatctccgatcagaaagacaaagctgttgaattgaacactaccaacttcgattcagtccttaaagacacccccgccaagtatgccgtcgtcgaattcttcgctcactggtcagttcttcgattgcttttcacttttcacttaaatctccacttttggttggtgggttttgcagtttatctactacctacagagtttggtgctggatctagcgttgggttctcttgcaagtgtgttcttataggaaaagatttgaactttatgatcctattagtgtgcttcttctctaatcattgctactagaaggctttatattttcttcagttactagtttgggcgtttactgatgcgtgtatcgttttcaattgattctaggtgtcctgcctgtagaaactacaaggtaacataaactattcaaagcctcaactttggagatttccgttgcctaaaaagtgttactcttatgcagcctcattacgaaaaggttgcaaggctcttcaatggtccagatgcaatacatccaggaatcgttttgatg

SEQ ID NO: 26368 - DNA, 3000 bp, Unknown
  misc_feature (1)..( 3000): 2750-1469P.txt file - cDNA_ID_2712933; gDNA_ID_2214588; Annot_ID_135374
ttggcaaactcggtaaggaaaattatagatacacttcaaagatgaaacatagtttgaatctgctagatatatttcgagtcaatgctgaagataaacgtccggtggatttgtggcacaaacctgccaatctgcttgttaatccagttgagcaaacgctcagcagtgcggccgtcatcaataacaagtatctcacttttatcctttttaggttcccaactgccagagacaaacttagtaggaggaccccaaaagagcattggatagtgagaaacagagaacttgtcacagagcttggtattcgtctgcgctgccagggaaatggaccgacttagctcagaaacagtgaaccaagagaatttaacatgattcataaaaacattcggagcatggagtaaataccttcattgcacaatcaactctagtcatcaaaacgattcctggatgtattgcatctggaccattgaagagccttgcaaccttttcgtaatgaggctgcataagagtaacactttttaggcaacggaaatctccaaagttgaggctttgaatagtttatgttaccttgtagtttctacaggcaggacacctagaatcaattgaaaacgatacacgcatcagtaaacgcccaaactagtaactgaagaaaatataaagccttctagtagcaatgattagagaagaagcacactaataggatcataaagttcaaatcttttcctataagaacacacttgcaagagaacccaacgctagatccagcaccaaactctgtaggtagtagataaactgcaaaacccaccaaccaaaagtggagatttaagtgaaaagtgaaaagcaatcgaagaactgaccagtgagcgaagaattcgacgacggcatacttggcgggggtgtctttaaggactgaatcgaagttggtagtgttcaattcaacagctttgtctttctgatcggagatttcccggagaatcaagcgcgagcccggggaagaagaggaagcggcgattacaaggccggcgaacaaaagcagatgcaccaaagacatcaaatccaatcgaactatgaacccctcctctcacagatttcaaagtttcgattcttcttctcaacagagatagatagagagaggaagcgaagatctacagaagaaagcttccctcctcttccactgagaaaatgaaggaagatttgtgatatagaagctcctgaacgacgtcgcacatctcttacccactctttgaactccgttactgttgataatgggctttattcagacaacattatttgggcccaattgggctatcttatggttcactgatttaaaattcacaatgatgatcaaaacacattatcggcttagatgggagatttatggtcgatactgttatcaaacattcaagcttaacacttattttagacatacaaatctagaaagcaaatgctaagacctgaattttactacactgaaacattacatatagagattccattcacgatgaggattccagtacttcggtattgtggcaaccacgcaaatttccgaatttcgcggactcaaaatcggtgtttcgactcgcgatttggcgaccctcacttagtagcgatctgaatctttttgaatagtaatatttgtctctaattttctggagtgtgcttttatctgtttccgtaatctctatgatttctgtcaaaaatcaaaaatgatatattttaaataatatatggatttatatgcaggcaatgtgtttaagtatcacagattacataatccaaatactaatcatagtattgctaaaatccccatttatatactccaaaaaaatgcttcatgtctagctaggcgaatcccccacattatgcaagaattgttttctatcaaacccattatttgtggacctatcgaagccaggcaaaaagaacactataatgtgttggtcatgtgcatatcttcaaataataaaagactacttatgtggctgataaaaactagccgcctattgcagaatgcagagtcaggtgctcaataatatgtgaaaattcattcatttcacttatcaaaaaactccttataatctcatataagtgttactaaatacatgaatatatatgttctgatacgtttatgtcattgtcaatgaatgatgaatgtagttggtgtacatgcattagtcgaatcttcaatggtagtatagtttttgattactcttgaacattgtgaagcttatctatgaacaaaaaaagaaagaccaaatgttttacagcctttcttttttatttctttataatcttgtcagcatctagcaagcaagcatcgagtatcaaccattaaattaaagagcctcctaatatacatatggcctttggcttttgccaatgtttaacccctttatatttcccatagtcacatatttctcatcagattttaaaatgttacattcataaccccaaatcattcctatgcaccatctacattatgcatctgagcagtctaaaataccttgcattaccgtatgattaacttgtttataagtaagcgtataactgaattacaaagaagtttcgggtaaaactgtaatcaatcatcaaaatgaaaaggaccaaaatgtaaaaacactaacttatgagggattcatgtgttattcaatggtttttgtctctccccctccaattactaaccaatcgtctttctctcttcattgacccctttttttgaaattaccaaatctctctccatttcagcgaatctcttcttcagattttcctcttccactaatcttttgcctgtttaatcggagcttagatatcatcagaaggtttttgttctatcaattctccttcattcgatccatttttacccctttctttggaatctccgattcgaccaagcttcttcgccgtctcatcggagacaaacacatattcacgctaaatcaactaaattaagcttagatagatatatagatatataggtaaaaactcaactacgactactcggagatg

SEQ ID NO: 26369 - DNA, 3003 bp, Unknown
  misc_feature (1)..( 3003): 2750-1469P.txt file - cDNA_ID_2712951; gDNA_ID_2214589; Annot_ID_135397
cactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggtttgtttctcttatccaaaaatcttctgaggcttataaacattttcagatctgttgattgtttgttgtagattatgatgatcttaatcagattaattagaaaatgcttatgtatcattggttatttagtgtagtttatgatgatgttaatggaatcatttcgttaattagaaatgcttgtggtatagttgttgtagtcttgtgaatgatgatttgagtatatgtttgcgcaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcctggacagaaggttggtcttattgctgcaaggaggactggtcgtctcagaggtcaagctgctgcttcagctgccaaggcagactagagttaaaagagataaactttgtttctcttgttttctatgtttcaagttttgttgtctgtgtttccttttgaacctcattctgaaatcctaaaagatttttatgataaacctttctctcttctcgaaaagcttatgttattcacattgcatactctcaatacgcaaagttttcattttgtacatatgaaaattatgtaagaacaacgtaaccaattctcgtgatcgttaaagtggtagttgaattgcagattttcatcgaaacagcagcccgccgcattgctatcacaaagaatcaagtctttggtgttagtcgaattgaagcaatctgaagtacctaaaaaaaaattacaaggaatcttaaaaacgaatcttgcagcaaaccttcaaaatgacacagaggactcaaagacatttatgtgcgtaatacaagtctgattctatagttgattagctgagttttggtaatgtgtaatatttgtgtttatgtgattgagatttacctaaattgtctttgtccatcaatttttagcgtttgagactttgaggaattggttttagtatctgatccaatagctagatttgtgttgctcttgctctataattgtcttccaggttgaatatggtccaaggataattggttatcgtcggctcttagatgtattctgctctagtcatgattctagacaagtgtttggacaaggtcctgatgtgggtaaccaatacaggtaaaagagctgtttggttatctttgagtttgtttgtttggcccaaatctataacatttgaatatatgttgaacagatcctgtattttcactaactgtacagaagagttgagactggcttctaccagcaaagaaagggagcaacttaatacaagaagcagtatcgtgacttctctcttgtcgttgactcctctcttcacgagtctcatctccgacgcttcttctcttttcttctgttgctttggttctcatcttcatcacacttattgcaagtttgatcaaaggctcaaaatccaacaaaattcaccattttagacaccttgggaagcacgttagccggaaaaccttgaaaaacccacaagggttttcaatgcgcctcctttggataattggatcatacatacaccattattggataatactctcttgagtcatgaagattaacagaaaacaacatatcatcaataacacaagacggctcttgcctcagatcactcaacttatctatttctctccttgacttcaaattagtttccctgggttggtaagcataagaacagaaccgtgcttatccctcatgtcaaattttctcttccatcaccacatatgtcacaaactctcagtcgcagaggtgcgtaggttcggacagaaggtcttattgctgctaggaggagaggtcaagctgctgcttcagccgccactagggttgttaaacaataaataaattaaaaaaaaacatttgcttctcttttatatgtatatatatccgtttggaccttgttctcaaattgtaaacatttttatgataatctttgtcttctctctcgaaaagtttaaagtattattgcaaattgtaaaaagttatcatcgcaagttttgattattgttctcgaccgaataattttaatatttaaacgaaccgtatcaaaccgagtatttggttatatgtttaaaacgtctttaagtatcaactaagtagaaatatggtcaccaattgctaactggtaaaagcggttgagactcagcatgatgagagagtctcaccacggttcgagtcgcgatattggtacctcgctcctaccaaaaggaatcatgccttaattgttagccgaaataaagtaatctaaatcacttctttttcaataatcatgcagcgaaccctctaaatgaatcagagggtctcaactctcaaagacagagtttaatggaggtggagccatggcgtgactttttgagcgactcgactcaatcgactacaggttgttcgttcatatggagtttcgttccctggttcgaaacagcagctagacgaaaactgtgtaatg

SEQ ID NO: 26370 - DNA, 3003 bp, Unknown; identical to SEQ ID NO: 26369
  misc_feature (1)..( 3003): 2750-1469P.txt file - cDNA_ID_2712951; gDNA_ID_2214589; Annot_ID_186731

SEQ ID NO: 26371 - DNA, 3000 bp, Unknown; identical to SEQ ID NO: 13034
  misc_feature (1)..( 3000): 2750-1469P.txt file - cDNA_ID_2712964; gDNA_ID_2214591; Annot_ID_135428

SEQ ID NO: 26372 - DNA, 3000 bp, Unknown; identical to SEQ ID NO: 13036
  misc_feature (1)..( 3000): 2750-1469P.txt file - cDNA_ID_2712968; gDNA_ID_2214591; Annot_ID_135427

SEQ ID NO: 26373 - DNA, 3000 bp, Unknown; identical to SEQ ID NO: 13041
  misc_feature (1)..( 3000): 2750-1469P.txt file - cDNA_ID_2713015; gDNA_ID_2214592; Annot_ID_135438

SEQ ID NO: 26374 - DNA, 3003 bp, Unknown
  misc_feature (1)..( 3003): 2750-1469P.txt file - cDNA_ID_2713019; gDNA_ID_2214592; Annot_ID_135436
ataataacatttaattgtttgcgtataaaattgcacagttttattacttcatgtctttttcttctaagcaaaaacaattgggtattaaatgtccaaataaaaattaattgaggttttttttggtttttttcgttcttctttagttgatgttttataaaaatgcacacctattaagaaataatataattatataattaattttgcattgaaaattaaaaatatcatgtatttaaaaacaaaaataaaagcttaaaacatcatttataagagaacggaaggagtattaagtgtaatcttttgcattttgttttaaaataagtgtcattttgtcatttcaatgtatatgtttgataataagattttcagttttattcatattatattaatgtataaaccaatagaaaatatataatatattaataaaaagtaacatagataattgaatttttttaaatatatgtgtaacaatcttaaaacacatttctaatgaaacaacatttgcagataaattgttttttatcaaccacatgttgttcaaatcgagtaagataaaagtaaagttacatcaatcttcattatcttggttgactttaaaatattttccaaaaaagatataaacttgtctggcgtatttttacttttggattattttatttctctcagttgtttcatatatggacggagtatataggatttcgcacgtcggtttgtaacttttcacaatgataattattcgcatttagttatcatcatactccatgaaaatgccttgttactccatttacgtatttaaattttattgttccttgtcttgtccaactcctaaataatttctgtcaagaagaatttttttatatatttttgtcataaaaaagagaagagttgtctaatattatatagtaacaagtttagagttttcgtgttcgttgaggacttttcgtttccacattgtcaaatactataataagttagaattgttcttttttatttcttcttctttttattgattttcttgacaaatgggtggatgacaataaggagtgttgagtttttctatttggtagtcgtaagccaataaaaactatataacagtctatatcacttgaattctgactgattaaattcttttaaaacgaattattctctttggaaatatttctccaaaacttattttaatattataccttgactatttgattattcttcccttttattattgacttttctcctgagaagaacaaaaccttgtctgattcggtttgtcaaggtgtaatatatatttttttttttttatcaattctcatatatataatgatgttgagatgtattagtcaagaattttctatactttttaagcaaaatcatgaaggtttctatgaggcttctgagtcatttcttgagcatgttcatatgtgacgtccctgtagccctcatagattaagaccacaaaacttggtctacacaagttttaacaaaagaaatagcatcaaaaactttgtctggtaaacttagatactttgaattctgtcataactatggtctatggtataagttatgagtggtgaataaggttcctcataacttggttaaagaacatttcttaattaggacttgtcgaaaaagttgtaatacttcatacttgtagtaatatacgtactagtgatgacatgctataaaagtcatattggtttaagaatgataacataaccatttgtatcattagttgtctaattttacaagagccatttgtcacataaatatataaggttacgtgtggaatcaaaaactaggtagctaacaagtctttaatacctatatgtatcgttaattcaactgctgtgtgtaggtttgattctgatcatgcgctcgtgtgcatgaaagtaccacacatgcatggaagtcaacgtacaagttgataatatccactaggtccgatctaaaaattatgtcacttcaactctgtggcacggcattgaagtcatcagccaccatgcatcatctattacgaaaccgatttctttggaatctgaatctgaatgttagtcctagtcccactaaaggttgcttcgtcgtaaaagttaaagttttttttttcaagttttttctttctttctattctataatttccaaaagatcagattacatcaaattcagaaatagaaggatagtttaagttcatttcaatgaaagttgttgtagcgtcactatttttttaaaatatccgtttttaacaaatttagctaaatgacatttactataatgtttgttttgtctattatacataattaagaatcttttaaatggaacgcaaggagtattaaatattgggtttctgaccaaaagaaaggatggcattgattactagagatttcaaattctttcaaatgatatctaagtacgtacaaataatatctaagtacgtacaaataataatgtatttttaaaaataatatgctcatatattggtccaacatttaatggacaataagaagacatggtgtgaatatatctgactcactagccgtgcatggattggctgcttcagaaatttctgcactctatccacttgaaggtgacatatatatacacattttaatagtggttattggtacttacttggagtataaatatacgcacatatcagatcagattgtatcattattgtctacatatctttttgaagccgtcataacttgcaagtaaagaatggtcagtctaatgttctttagttcggcctcacctttatgctcttctccatcaaaaattcccaaggctaggtacttgtttacaattataatgcaagacatggattcaaatattttacgctattaagaagtctttctcttataatcggcttcttgatacacttaacttcactctttcttctacagtttggacttcgagatgaagaaacttggtaaatttttctcatcttgactctcaaaactatgaacagaatatagttttatagttggttatcataagtctcttgtcctaattatg

SEQ ID NO: 26375 - DNA, 3003 bp, Unknown
  misc_feature (1)..( 3003): 2750-1469P.txt file - cDNA_ID_2713041; gDNA_ID_2214594; Annot_ID_135444
gatgagtctcacaataataggaaaggaaataaaaccctaaccaagtaaatagtttccaaaatcaataatataaaaaaagaaatgatcctaatagaagaatatatccttctgccttcatgtcaaaatattcgtgatgtgtatttgatgtgtactccgtgatctaaattagttgcttggagatatggttctactcatatcatagtctctagccatatttaacaagcactatccttgattgtctgaatgctttatcaggtttacctttgtatgcgttttcttttcttttttctttttttttgttagcaccgtttaatttgtgttaattgtaaaaatctatatgttaaatagaccatgcaacctgtatcgtagatcataatactttagcatcgtttggacgatattttacgtgcatccaatatctagagtttggctgaattgtcagccatatactagttgcaatctcaacatttcaccataattttttttgtttcttaaataactacaaaaaaaagaaaaatctcgataaaattatatatatttttagatttgtttttaaaattacatctccatgaaccgattagttaaccgataatatgaaaaacattcatttgacgttttatagtgaattagttaaaaaatatatatggttttatatattacgagtgtgatcgatacgtaagaaacaattcctagtaatatatatcttttttttgtcggttcctaataatatatatcagagactaatactggagaatttcctagaaaccttacaactttttttcttgtagataattgcgaaatgatgataatttagctttttgacatggacaggtacgtgtcatatctctctcaaatcacatcaaaataaaagttcgttccatatttcgttaattcgttccatttaatttttaaggaaacatgattttttaatggaacatgttattctaacgtggttatgtgaacttctaaattctaggttatgacatccatttatgtaaaaaattagtatattatatttttaaaagaataaatatgttacaaaaaataagattgcaattttcataacatttaaatgtatgccaaaattatcctaaaactaggtcacaacatttcttttttacttttactccaaaattttgtcatcccacctaattatttattatttagatggtagtacaaccttctagataatctttactctttacaatcaacgtgaaaggaaacgacaaaaaaaatgactcttgtgtcaaagagaaaaggaagtaaccttccttggccacgtctgaaaatgcggaaaaaggactttgggtcgtgacagtgaaacttagagatcttgtcgacaaccagatcgcttcacttgattagtgatactttatcatcactattttagtatttttcgtgtaattttaaatttcatgctctctcttggacttggtccgctaatgattccgatttttatacagcttatcaatcactgtaggagtatcattaaaatttatgtatttttgataattacgaagttatcatatacccatttggactctagcctctctatatcataaaatcagttatgtgaattgtagtggctagtagaatatgagttagtataagtgtatttgtttgttttattagtcacaagtcgtttgtcttattctcaaatagtaatttgtatagatatatagatagatacaataaagtatcaaactagtagaaaatcggtacccaatctaattcattagtaatcaattcatatctaacaatattttatgtgttaatatattggcaacaacttcatcaaatatgtggcaacgattacatcaacgtcgtaaaaaacgtggcatccacgtcagtagccatgagaaaagatatatggtttcacacgattcaataaatttagatataaagtttaaattattgaaatattggatatatattagcatagaaatgtttgtagttagaattaaatacagatactttactttactatgaaatgaccgaactttgttcaaatttgccaaaggcaaacgctaagaaattcacttttgagtaaaatgcaagtagaaagatggtacctacaagactacactcagtgacttggatactgattaaataaattgcatggatagatatttcgatcgcggtcggcatgaattaagtatctatagccaagcaatttgtcagtcaaaagctccattagaaatttaattagaatatttgtattcacgatagccaagcaaaagttttgcacgctctaaaatgaaagtcctatagtagtttctacgcataacgcattgctctttttatgctatacttactattgttcagtgcatatagatttgtctctatatatccctctgtcggcagagatttcaaaaaagatccttaacaagtatcattagtgcacgccttaactatccaaatagtaacaaacttaaacaatagaaaaacttgaaaaaatgtatcaattttcaaatttgatacgaaaaaacttgaacttttaaaatattatttaaatcataaagttttctttgatattttttgtaaaatagtcaaattttgttgaattcaccatttcgaacatatcgctaaattttcataaataaaattaactttcgattaagagaataaaacaacgtcgttttatcaactacaaaacatagtcgttttgttaaaaaagcgtagtggactggagttgccattcacgtttattcatatctagttacaatgaatccaacaacggaccataaggggcccgacgcaacacgtataatactctgatacttatcttcttaattactacttaatttgtttctactgtgataaatttcctttaactttacttttgataaaatattgtcttctttttattctactacggagtagttttttgacttttctcatttcctattctgttcgtttctataaatagagggcatgcaacgtaacatattactcatcacttacttaacatactaagagagttattagaacttgcaaaaaatg

SEQ ID NO: 26376 - DNA, 3003 bp, Unknown; identical to SEQ ID NO: 26375
  misc_feature (1)..( 3003): 2750-1469P.txt file - cDNA_ID_2713041; gDNA_ID_2214594; Annot_ID_186829

SEQ ID NO: 26377 - DNA, 3003 bp, Unknown
  misc_feature (1)..( 3003): 2750-1469P.txt file - cDNA_ID_2713048; gDNA_ID_2214595; Annot_ID_135487
cgtgacaagaatcatacatgaaaatgccatgaagattcgtgacgatggtgtgcctgtgaatttggtggacctcggatgaataagcatgcgcttgagttgaggaagtggaagatgaggggaaactggaattatgtctttgttaaaggttggaacgatgtgcttgatgctaacaagtcgaattcgtttaaggaaaaagacgtctttcctctctggtctttccgatctggaacaggtaaactctgttttgctctcacccctaaaaattccagcaacggctctacttcaggagaatctggcagtggcggcgatggtgcttctacttgaggtgaatctggtcaggtaccgttacccattcctccggcaatagattctagccactctggccaaggctgttcaggagagagcagctctagttcttcctaatcataactctgcttattgcttaagccacaagtaaaacggatttagttttcaggcaaatctggcttggttttctttcttttttttgttcagttgatgaaatagtggggttttgtccaaattgtgagacccatgatatgatgttttgatttgagtttctttctttatgtttgatttttttttatctctctctgatgctgcctatgtttacttatgattagcattgaaaatgcagaacaaaggagagagaacttgttttcttatattatcacaaaaagatccatcaggctacaacaacacacaacaagtgtaaagtttcttggctctactaaaaactcaaaagtcaaagttggatcaatcatcaccataggccttgaaacaataccgctcaatataaggagcgttaaagaaaagatcagcttccaaccatttcggataccgaacaagatctccagctaaaaactgcatatacctcttgcttccttcgggaacaactcgaacctctccttgttcaatgtaaaccaactgatccacctgccaatcccatggcaatttgcatttccctgtcttccaaactgaccatctcgaaaccccaagttcctccaaccgtttctgtgaaactttccgttccactttaacattgtatagctcctctaatggtttctctgtctgcatacaagtcaccctaaaggctctttgaactgacaggttatttgtcttcttacatgtagtgacagaacctgggaatggtgtagtcattatcagacttgccatggctgcttttatccaatcttgtcaaacctgagatccacaatgaactttaaataacacatatcgaaaacattgtgatgtgttaaagtcttgtaactcctgaaacagagaaagaaggtgaatttcttaactctagtgagtaaaagtgaattatattgtaaagctgaaggctttatcatttaccctctttgcaatagcttatatgaatcaatgacacagcgtaacacaaaaactcacaattcaggaaattagctaatgcccatttgctatttcgattggaaaagtgaaaactcatcgcaaaattgatgatatacgaatttaacccaacaagcaaaaaaaaggttgtcgatttcaaaaccaaaaaaaaaagcggaagacagattatacgcatcgaaatcgaatttcttaccagcggaagtgtgagtgagagtaacccttaaaccctgaagcagtcaggcttatccgatccccgatataataaatgttacagaaacgaccctaatatttatatttgttttaactttagactagaagtttgttttgagttaatgtgacccaaatattttttctatagacgtaacgttttcagatttgacgtaatccattggtcaaacttttgcattgagaatgttgacgtagatgatcttttgcatagcgcgttatatcttcttttttctttttctaggtgtggttatacgtgacgaaaataaattacgtttagtaaatggagaactacattggtcggttaaccaaacaaacaaccaaacttctctaacgttgatattctatattattaggtatacactaattaaatcacaacttgcgttcacattctcacctgatatgaaaccaatactcaatttccttaactggaaaaattccatgtggcctctagaagataaagttttcggatttaatattttttcgtgaattcttacagaaaggaaaatggttagttgaatctctaaatgaaactattctcaaaataacatatattttgttttacgttgttaagttgtttactattttgtcagcattgtgaggtttagttgtaatattctctctttttcttaattaacatgtagatattcccgtagagaaagcactaaacttttgctttgagaaagaaaagaaactctttattaacaaagaaaggaataacatataactcaaataaagacatgctgaatttatcatttcattcatggtgcatattctaatgttgttaaaagtaaaatatttcgcattagaaaggttaacaaaaacaataaaaaaggcatatcttcatatcattgttatattatattttttggtttaaaatatttaaatcctctgtcagaaaccagagagaggcgtattaaggtttctgcgttttgttaaattgatcttgagctctaaaggctgtctaatgcagtgttttatttaattagcctttataagatttaggcaaatatacataaacaactaagtaaatatatacttcctctgtttgaaaatatattagcatatctcaataaatattgaaataaatattattccttgcatgtgtgagtcatttacttattcttaaaatttgagttacataacaaaaaaaaggaagcttcgtagcagttttcgttcgtcgttggaataaatatatggagacttagcaattaatggtgccctcacgcggttctactaaaccgacctcctttttgcttcccttacctatatatacatatatctctatcttcacttcatattaatctacacctctacatacgattttcattaaacacttttcaaaaacaaatcataatctgttcgaagatg

SEQ ID NO: 26378 - DNA, 3003 bp, Unknown; identical to SEQ ID NO: 26377
  misc_feature (1)..( 3003): 2750-1469P.txt file - cDNA_ID_2713048; gDNA_ID_2214595; Annot_ID_186901

SEQ ID NO: 26379 - DNA, 3003 bp, Unknown
  misc_feature (1)..( 3003): 2750-1469P.txt file - cDNA_ID_2713056; gDNA_ID_2214595; Annot_ID_135483
cctcatcgtcgacgtcgaaactctattacatgtaaaacatatgttatacggacgatcatttgattattttgttacccttatattattcatatcatatacgagtgaatgaaactgtagtatgagaaatggtctaattaatgttttaactatatgaaaaaaagctcttactctggtgtatcgtacatatcggtagtgagtttcctttcagaaaccacgaaacagtcgtcaatttcttctctatctccatttctttctctggagatatttgacagggctttcttaacttccttgatgattgaccttatgaaatccttctcagatttatcactttgatgtgtaaaagaaaagaagattaatgggtttagtagctttcctttacacttacttggtatcttgtgctacaagaaacagacaatttttatgattgaaaaatcgtaacctgtgttctggtaagcacaatgcaaacgttcgggaaacagaagtcaaagcttccgtccatttctggtatctttctggttcatgatgatatctctcaatcagatccctgaatttatcgccgaattttcctttaagacccttcaccactgcgggatcaagcttgtagaagatgggaatcgctatgattttcttttgatcaacgcatttcttgatctgtaccagctcgtccaaacaccattttgactcggtgtatccctcagagaagattaccaacgcgatttttgactcacctatcctcctaaacaggctgattaggtcttttcccctcacctcgtgctcatctataaagacgttgatgttttttttcttcaaggcaggcacaagaaaactgatgaagcctttgcgtagctcttttcccctaaaactgatgaacacttgaggtcccgttgggatcactgatacattagaagaagaagaaggagaagaagaagctattgccatccgatctcgagttctttcttagaaacaaaaggagtttgatcgattcttgtttgaaagaaaagaagaatctggaagacgcaatgaaggaacttgttctgggacagcaaaatctgtatgtcttttttttttttttggttggaattgaaattacctacatcctatcgtcgttaataattaatattcagacaaaagaaactttttggtatatttcctggaaacttcggtgcctaaacacggaagttgcaaaggaagaacacgacataagccccaataattgaatggagaaaagaattttctaagaatctctggaaaacaagtgactacttctctgaccacgcatagggggaaaggaatttcgtcctgaatttcagaaaaatttcgacgtaatttctttgcaattcaaggaaaatttgcctcaaatatgttgtctcaggttttgtactacactactcaaatatgtttaagacaagttactaatactcaaagttacatgaaataaatagttagattgtattgcagaatccaatttgtaaaattagaattggttttaaaatatttagataaaaaaaatataaattattattagaacttaaaatattctattaaaaattttatatattttttacaacttatttaggtgagtcttatctagttacatacgatgatgaaagttgttgttgctagactccagatgaagagaacaaatgtgatgatttggactagaaatattaattgtcattcttctctggctccaatggttattcaaataagtatatgataattgaaattttaataaatgaataatgaaagcagaaaataataagagtatcatgttggaatctttcacgatagaagatgaagaagttgtagaaaatgtccaaccaataacgcaacatattggtgacatcttttgatggggaagtgctgatgtttgggagaggtccacagacaactcaacaactatcaattaataagtatactattttatttaaaaaaatcagaacattatcactagcaatatcgtatttcttatgtgtgaaaagaacacgattcctaatttctgctggttagatagattcatggcatttttttcttctttttttcgtggtttttaggaatttgtaatgctaatcagtagtacatgagatttttgctaatcattctccaataatctggtgtagcatgtgaaacacgtacaactgaacgaagcatattctgtcaacgcgtagtagcctactaggaattgatattattttttgtgtgaaacacacgtgttttgtgtgcacaaacttaattaggctagtgagtcgatcgtgacatcatatttgaatttcacataaaggcgatgttgttaagaaaacatctaaaagctaaaagttaaaacctaatgatggacatttcatatgatacttcatcgatgtttagtacaaactatagcgacgcgttgcctaatttttctgtaacttttcttgtgatggcattgaaaaactaaattctattaagttaaaatattggaacgttatagtaacatttactatcaaccatggacgaagtttaagtttaacattaaaaaaaaaaaaaaaaaaaacatggacgaagttccatgctcgctgaagacatcgaataagtaatatttcatagcgttttaatacaagttaattagaacatttttagagacttaacacgttaggttaattaaaaagtggtttaacattgtttaattaagatagaaagcggccattgcaagtttgaaacacaaatgaggatagaatatgatccgagtaaatatcaaatcatattttataatgtaatggatgttcaaagaaaatgtataaccagataaaatagacgaaagggatttgaaccatgagtcagcagtcagtatccattattaaaaaatagagaaaaacaaacactaaaaagaaaagactcgtcttcctataaataccttcaaacatctccctttcttcacgcctcttattgttgtttgctatataaatcctccaatttctcaatattctaaacaaattatatattttcttacttacttgttctcttgtaatg

SEQ ID NO: 26380 - DNA, 3000 bp, Unknown
  misc_feature (1)..( 3000): 2750-1469P.txt file - cDNA_ID_2713075; gDNA_ID_2214595; Annot_ID_135464
tctacatcaccatcaagaacaaactttgacaactatatgcactgcaatcagataagcattccgacaaaacaaaaacatgatttgtttcactccgaagcaagatgagagattcactcctataaaatcgatatcatcggaaagagatactaaaagttactttttttagttaggccatacccaaaaagtagcagaagatgtgtaaagcacaaacctttatcaccaaaagctaattacccagaaccacaactatcttcgataatctacagcgaggcacaagacaatcctgagttcagaagtaacaaaggcttcaactttggaagcatcgacaatcttcgatagagaatcaaccaaagaaaaataatcgaaaattgatactattattaattaattccctccggaaacagacctagaagacgaatctatgtctcactcataagagttcagtgagaaaaacccctagttaaagttgtaaactttgaatcagattcggattagtaagacagagaaaaaaacgaaaagcaaaacccataagtttgcaaaataaaaaaaccagagatcaatgaccaatcacctgaaaagagaagcggaggaccacaagtagaatcaagaacaagtgatggagggagaagaagaagaagctatcatcttccccaaagtagtagaacaagagagacagagagagagagaattggagataaagatggggaaaagcaacgggaacaagacaggcgccaatgtctttgttactaattaattatgtatgtaatggtgagtcttcccactcaggaatgtccacgacaatacttcaccttccttattccaatgttcttatgctttaatcttctttagaagatgctcggtcgttctcctccttaatatgtttttttatttaacgatccatgttttttcaccaacatactgtacatactttagcttcataatataaaatcgaaaatgttaaatatatactccagaaagtttctttattaatctcatcgattgaaaatgggaacttatatataatcggaacatgaaatattagttcaatattctttgtacatttataaaaccataaatttgtgtaggaaatgaatccaaactttcttttttagtatttcatgtattgaaaaatgatattttagaacaaacttagagaaaatcattgcttaaaactgagttttttttttatatcagcttacatataaattaaaaaaccataatctttttaatcaatcaataatgaattgtgttattattttaaaattttaatatcaaaataatgagaaacaagaacttaattaggaaggacaaaacaaggtttgctacaaatgcatttgcgggtgaatcctttgcaacgaccgtcagtgaaaccttcgctaatgcatacttggcgacaattcctccatttcagacacatacccttccagtccaagctctttgcttcacacatttgttgtccttcaaccatctctatatctataatataatacattatcattattcaataaataattgaataataatataattataatcatataaacaatcaataattgacttattcttcaatatcatcaaatattaaattattcaagtagatgcgtaaaaccccatgcattaaatattaaaatataagcgtatattatatgttttagtaactttttaatattgtgagtttgtgagaaactagatttgcatacctggtgaagcaagaagaatggttaagaagaaaagtgttggaattaactgcatagaggtagtagagctcttcattttatttcctactaactagttaagcgatatgaatacgtggggagaattgttgatattgaaaattagcgtgagaatgtcgcatttatagtaaacatgtgcacaaagcttttttggtatatcaacgtatgcatacgataatgaagaacaataggaatatgtggaaaagaatctgatcttgacgaaaaatatctgcaaatacacatacgagaatattttgttgtttatatatatctctagtactgtactgtactggttaaagatatatgctaatgattttttctttctttaaccactatgaatagacaatctaccataagagaagagattgaatcaacatagttaaagtgggccgaggggactgatacaatgaacgtatagactatagagtgttaagaaaattacaaagtggtagtaatatcatagatgaatttagactaatgtgaagctagacagatatgcaaaaaaccattcctccataagttcttccaaaaaaaattcctttataatgatatatttgtagtttagattttggtgtgttttgacttttgagtttatatctttatccaataaaacaaagttacgtacaaaattgatcaaagccagtcacacagcctaaaattaactttagattacattatcactaacttgcttagataggaaaccatcgttttaatcaatcaatcataaatttggttatctataaagttttaacataatatcaatatacagagaaataaaaaatttagtacaaatgtttggagtttggttgttacataattcgcagattgtaaaatttaatagtttattacattaaacaatgatgtaagcacagttaataaattattattctaatgacatatccgatccagatgcaatctgaatttcactcggaccagtaaatttaccaattgaggtcggtttgattgcctataaccggtaaccggcgagaccgacagatatcatcagaaaagacgaaagagtttcatgttttttttttttttgtttaggcttttagccaaactctctctagtctctctctctctctctacttgagagtgccgtctccattttctcaacgtagtcgtttattttgaacaaagactctctccgtttaccaaaggtcatctcttttcttcctccttctctcacttttgattatattttctgacttcctcctcctttctcagaaattctctttcgatcttctctacagtgttgttaacgatg

SEQ ID NO: 26381 - DNA, 3000 bp, Unknown; identical to SEQ ID NO: 26380
  misc_feature (1)..( 3000): 2750-1469P.txt file - cDNA_ID_2713075; gDNA_ID_2214595; Annot_ID_186875

SEQ ID NO: 26382 - DNA, 3003 bp, Unknown
  misc_feature (1)..( 3003): 2750-1469P.txt file - cDNA_ID_2713083; gDNA_ID_2214596; Annot_ID_135493
cgttattttctgtatatgtgagtttatgtatgtcaaaatgacatgatgagattttttgtaaacaacatcttaaaaacaggacatgtgatttttgtaatcgtaaaaactttgggatgcagtttattttctaatcaaaacaaggatatatctaagtaatcgaaatttttttcgaaaatagaactagatgacacttatagattatagatcacacctaattttgaagatgtatctaaaagtccattcaatttttctctgttcccctaataagaaatcatatgttcatattcaaaaaataagaaacacaaaaaaaaactttaagaaaaacacagatgatcaaccgtctggctagagtttggtaaaatattaatatcttatgatttcatattgttccataaataaataaaaaatcataacataagcttttcttgctgattgtctaaaattatgtatagatggaaaaagccaaatcacatgtgatggagccagatttgagtgagagtcatgtgtcaattgtcaaaaacatcgacattataagtctttaagccatgtgcatactggtcagaatctatttagcaataattgagttaaatatcttagatatttttgcatactgttttcatatataaatttattccaaagtttgaaatagtcgatcgaaaacacttaacaatagtaaaagttgaaccgatcaaaggttggatacatacattcagacagagacacccatatcatcaatcatgtttcaatcttcgtggaacatccacataacattattttagtggcaaaataaaaaatgtgttaaatatcactagaaatacaaaaaaataaaaataatatataatatatgcttcatcaataggtgtctggtcttcaaatcatgtaaatcatatactattaaattaaaatgctaagatgagtttcttccatttcattcaagatttggtttggagcaggagtagttcacggatatgattttagtggattgtttataatcgtgacttttgttttgtgtttgatcgacttgatcgacccggccaacttatgatcttccgtaaactaaagtcaaaagcaataatatttctttctttttttgtatgaaaaaagcaatgatatttcactgatctctacggagtaaaatctctttcttggacttcatttggcatagattcttttagttcgtttcacattctctttcagtaccagagatttcttctgtatgttttaaatcttggtcataccgtctttacagcactagcctctagtatcacaatagataatgattttctaataccaaaaccatatagtcactcatctggactagatagattttgaagtcctctagtttctatgtagtgagatcctccattcatttctcttgactttcgtgaggtttgagaatccagtcatgtaacccatagcaaatgattcgacaactgtattacccaatgtcaccatctcaaataaagaagagaaataggattataggaatactgatcttccatgtgatctaattttgtatatatcgcacacttatcaaaatccattgtaaattgtagttttttgcttgaaaagaaacgcaaatagtatcagcagaaaaaagctacacaaatagtaccaccacttttttgtttatctttagaaaaacatttttattactatccacacaaaaaactactaagaaagttataacatcatgtcaataattcaaaatcattatcaatgtcaaaaaaatattagctttaacaataactaaactcagccatcaagcccagataattgtatttaagtatttgagtttttaaattgcatttgagtaatttactcgtaaatcatagctcatggaattaaactaaaaatttcttaaaaaaaggataaaaatccagtaaacgttggaattttatggtaaaagttcgtcttcaattcttacgaaactcatcatagctatcaatatcatacctattaaaatcattagaatcgtctagaaaccttttttaaaagaatttacatcgtcaggtcttaagaaacaaaatatttattatttaccagatacagacataaaagctgacgtgttgacattttaatttgatggaaaacgtataaatgcacgacacgtgctcctactggaccacttgataagttacgtaacttatcaagcttaccgaaacgaacacgtgataacagagaactaaattcacaatttttgttattgataaaagaaaatatttaaattttgaaaaagtaatattaacatatactagaagctatataattagcaaataatatagaaatgaactacttatctaattttagttctaaattatttaccaataatttgttcatatcttgaaattgttaattgtatatcttaaatctttgactgaatttaactcttttaatattaaaataattaaataattaatcttaaggtatttaataaataaaaattactaaaaaaactacaataaaagatctatatccaataagaaaattaataattatattgataattagggagcatatgcgttattataaattacaacctaacctactttaccgacccaaagcctaaaaaatccgacctttttttgttttctctctctagaagtctctctgttttcatctttctctctctctctctagctcttcttcctcgtttctggcttttctgggaattttgatcctttggcccccattgctcgcttgaattacgaatcagatatcgccgatcgtcgtagatctgcgttgatactgtccggctgagtaaacagggtgaacaaaaaccaaaaacagagagggggtttaaaaatcctgaagaaaatcgcatgaatttgtttggaagcctgattttttcatcttcgatttcgagccacttcacgacttgtcttctcatctttattcttcatttctctccccagcttaatagtaataataataataataatagtaatcgtaattccaataatctcgagagtaatcgtttgatcaattgaaaaaaaaatcatg

SEQ ID NO: 26383 - DNA, 3003 bp, Unknown; identical to SEQ ID NO: 26382
  misc_feature (1)..( 3003): 2750-1469P.txt file - cDNA_ID_2713083; gDNA_ID_2214596; Annot_ID_186923

SEQ ID NO: 26384 - DNA, 3003 bp, Unknown
  misc_feature (1)..( 3003): 2750-1469P.txt file - cDNA_ID_2713087; gDNA_ID_2214599; Annot_ID_135530
actttttcttctaacacgaaccttttcccttgtctttgttttctttttgttttgttttgttttggagtttgtttatctttatctgccgaaagtttaagacttcagcctcccaccttggcacctccttgcgtccacgtcatcttaatatgtaccaaggtttctaagttcttcatgtcaatagacattataacatatttggaatccatattatgcaaggagacatcggttttactaatgcgaattgaggggcttgtataaaatcggtctgcttcagaaaacattccatttttcaacccttgaaagtccattcagtttaccatccaagagtttttccttgttgtgaatgataagaaaatccataacatttatctaattttatcgtattggaaaaataatttaatatttctgaatacatttattaaaaatatagttaaaaacgatgtatttttagcgttttataattatttagcattatttagatgttttcgttattttgttattacatcattttaattattattcatgtgacttgaaattaattactttttaaggtcgaatctttttttacgcctgcctttacacttcttattagaaggttatgtatcgaaacagccatccaaaatttaaataaattctaaaagaagttatatatattatgaatgtatggtgatactgacatgggtagggtacattctttttctattgagttagttgatacgttaagttggatgagatataacttatactatcatataagctttttttaatttgtgtgtttcaagtttggtcggttttgtttatgtcttttgtaggtggggtatacagaaaaataagagaaaaaaaaacaaagtcaaagctgactttgacgacaaatcgctaaccttcgagagatgatgataacaagcctaattaaaatacacgttacgtcgcaatcaattgcttcaatctcattctcattgcatgtcatccttagccgcggttagccgaccatactatcaacgatgtgcatactatcaacaatgtatttgtaataattaagtagaaaaataaagaatgttccaccgtccaaaagaaacacaagtacggtcctgagagggcttgagatattttgcttagtgatatatgtcaacatcttagttaagccccaccggttctgatataaaagtggggaaaatatttcataaccacacaacaaatctctctgtttctcccgctcttgctctgttttctcaaagacaaaagaggacatcgtcgttgactcctcttctctatggctactgctaagaacaagggaaaatcaatcagggtccttggtaccagtgaagcagagaaaaaggatgagatggagttggaggaggagttccagtttagtagcggcaagtataaagattcgggtcctggctcggacatgtggttaggagatgcttcctctacgtctccaagaagtcttaggaagactagaacctttgaccgacataatccctatctcgtatcttcttatgctactcctcagccgccaacaacaactacatgctctgtctcttttcccttttacctccctccagcgattcaaaatcaacaacgatttttacacccgaatgacccttcaggacaaagacagcaacaaatgatctcgtttgatcctcaacaacaggtgcaaccatatgttgcacaacagcagcaacaacaacaacatctattgcagtactggagagacattctgaagctgagtccgagcggaagaatgatgatgatgaacatgttaagacaagaaagcgatctgccactgacgaggccaccggttcaacccttcagcgccaccaagctatatagaggtgtcaggcaacgccactggggaaaatgggttgccgagatccgtaagccacgaaacaggacacgtctctggctagggacattcgatacagcagaagaagccgccatggcctacgaccgcgaggccttcaagttgaggggagagaccgctaggctcaatttccctgaactttttctcaataaacaagagccaactcccgtgcatcagaaacaatgtgagacggggactactagtgaagactcaagcagaagaggagaggatgattcgagcacggcattggcagtaggaggggtgagtgaggagacgggttgggctgaggcatggttcaatgcaattccagaggaatggggacctggaagccctctatgggatgattaccactttcccatttctaaccataaggacgatcttgacgccacacaaaactcttcttctgatacaatttaggacctttgttagaatatagatatgcttagttgtatgactgatctagcttgtgttttttttttgggtggagacagtttttgtcatcttccacattttagattctattttcgaccatcatttttttcttgatcggtgactatgaatctaatggggtcaatcattttcacatataaaacttaagtatttggtgtttgtacttcatcagttcatcttattccatagaaagagagtgagaagtgatcaataacccttttaactgaaaaaaagaagaagatcaaaacctaaataagatttaagtacatatgtctaattcgacgtaagacatttttggaaacgatcaatgtactaacgagttgaattctgatgaatcttgagcatgaataaacggactttgtagtttgtacaattgataatgaaacagagagcaacattatgtacatgtgatatatgctgcatttatttatgggcttttattagatggaccgagctctagcaaaatccaaagtaaatgggcctaatcctaacgtggacagacaagggacacgtgtcacactaccgacatctcgtggagttggataagccactcgaaagtcgaaactcagaagatccaaccagagccatcatcatccttccaatggctattacttgagaactcttctgattaaacatagcaacaacaacaactcttcttctcctctctttctcacttcaatttagcgatg

SEQ ID NO: 26385 - DNA, 3003 bp, Unknown; identical to SEQ ID NO: 26384
  misc_feature (1)..( 3003): 2750-1469P.txt file - cDNA_ID_2713087; gDNA_ID_2214599; Annot_ID_186993

SEQ ID NO: 26386 - DNA, 3000 bp, Unknown
  misc_feature (1)..( 3000): 2750-1469P.txt file - cDNA_ID_2713093; gDNA_ID_2214599; Annot_ID_135525
tgtctcagaaaaagagaagacagtgaacaactatccaaaccgcacctaactagtgaatacgggagggcaagggagggttctcgctcaaatgcttctatgcttcctccatccaatacattcaataaaggtgaaatctcatatcttgatttcttcacttttagatttcaagaaagtcacatgtttgttttctcttcttcaatgaaattcaaacaaaagacaaggaggctagaccaaaagagagagtaggaggtgcttcgaagctgcatggtggggcagaaagaagcgtaggaagtgaatcaaagcaggagagtcatgagatagacatgaatggcaatgctatggatttgatgcatccctcatcaattccacctatcaaaagggtcatcgcaaaggcgactgaacctgctgaagcatctctaaaaaggacaaccagtaaatcccatggtcccttgacagctgtgaagcatttcacggtcgcatctctacaacaacacacaaatagcttttcccacgaaaaccttattggaacaggcatgcttgggagtgtctacagggcagagcttccaggtggaaaggtatatatgcattacattcattctttctttatgtgtattcaatttccgcaactgataagttagtttactttcttggatagctcttcgctgtgaggaagttggataagaagtctcccaatcatgaagaagaaggcaaatttttggagctagtgaataatatagatagaatacggcatgccaatattgtccaactcgtgggtttctgttctgagcacagtcaaaggcttctgatccatgagtattgtaggaacggtacactgcacgatttgctgcatattgatgacaggttgaagattgaactatcatggaatgtccgtgttaggattgcactagaagctgcaaaagctctggagtatctgcatgagatctgtgatccacctagtatccaccgaaatttcaagtctgcaaatattctccttgatgacgatataagggtgcatgtctcagactgcggcttggctcctctaatctcctcaggtgccgtaagtcaggtaagcaagactcctgagaaatctgatttgcttgtctcatagcatttgtatatgttccactccaagctagtttgtgcttgttttagttatcgggtcaactcttagcggcctacggatatggagctccagagtttgaatatgggatctatacaatgaaatgtgatgtctacagttttggagtagttatgttagaactcttgacaggtcgcaagtcatatgacaagtgagtggaaatgaggtcttattcatatgtatttgtggtttgaacttttgttcttaaaaagaaatggaaacgttatgcaggaaacgggatagaggagagcaatttctggtgagatgggcaatcccacagcttcacgacattgatgcattagcgaagatggtcgacccatccctcaagggtgactatccagccaagtcgctgtcacactttgctgatgtgatatcacgttgtgttcaggtaagcatcactagaaaagaatacaaattttcttacaccaatgtgaactacagtgtgtattaacatctatgtgttgggacagtcggaaccagagtacaggccactaatgtcagaagtggttcaagacctctcagacatgatccagagagaacatcggagaaatgactcaaatggggataatcagtatacgggaagaagatagtttaaggagattgtctcttatacaaaacaagtggtattattagtattctttagaaagtcgaaaccattgttctttaacgagccttgcttgtattattatatatgtagagtgtgtgagtgtgacacaggcacacagcttactctgctttggccttttagtctatccacaacacccccaatgtatttccaccggattaggattagcaatctctgagtttttccaaaaatccatagtactgctacttcaaattttgaatcttttttctttctaaatagtattttatcatattcttcataatatgattcatctctttagttttgtcaaccaataatgttttgtttctcgtttcagtgtgatgatgattgtgaattagataaagcaactacggtaaaaccactataaattaaaactatgcagaaaataataaattataccggtctcgagtcggattagtgtaaaattaacaaaattctagataaaagtatggtatcaataacatcataaattaataatcacataattagatctatatttaagttaatatataatctatggttttaattttttttaagtattgaattttcgttagagtatttctcaaacttttattgaatcaaccaattgttttgtctctaaatttaattgaattatgttgtgtttttaaactatcctatgatagtatatcgtttataacttcgtaatacaattagccattatttttttgcaaattttcaactttttggtatgcatcatgttcattccaatagtctactatagttgaagttattaatcataaacttaaatttatgtatatcatttgtataaatgatacaattattgtgatttactgccaaatgatttttttgaaatattaaatttacaattctgatattacaaaaattataacatccaaattgaattatttcaactcatatttttctaaaattttaaaaaattaaaacaaacatctttataaagtaatggtgctttttttatagaaaatttatcatcactataaattaataaaatattatggtcccatcattattattaatttttgtagattttcattttactaatgttaaaatgttggtttgttggttatctccggattagaaaaccgggtataacccagacgcgccaaacacttccttattactctaaaacgcgcacccaattgcttcatctccaatcgctctctctctctctctctctctctcgctcggtgtgatccgtgtagagagattggatttgctgagtaacggtgcaatg

SEQ ID NO: 26387 - DNA, 3003 bp, Unknown
  misc_feature (1)..( 3003): 2750-1469P.txt file - cDNA_ID_2713101; gDNA_ID_2214600; Annot_ID_135561
ctttgggtggtagtgaatataaccagagtcatagcgagaataaagcagcttggagaacacttccatggctaacacgaagaggtagggagacaagggatcaccttgccttagacctttagtactgttgaaaaaacctcccgagaccccattaatagagattgagaaggaaggcattgagatgcactgataaatccagttgatgaaccgatcagggattgcaagcgccctcaaagctgcaatgacaaactcctatttgacggagtcaaaagcctttctcaaatccaccttgagcattccccaaggtgagatatgcaacctgttataaccatgaaccatctccgtggtaaagagaacattctcagctaaagatcttccaagcaagaaagccgactgagattgaccaatcacttctgaaaataagccctgcaacctgccagtcaaaaacttagatataattttgtacagcgtattaaggtaggagatgggcctaaaatctgatatgaaagaggcgttagaggttttagggattaagacaagggtggtagcattccactgcttaaggagctgcctagagataaagaactcgtgaatggcagcagtaacctccgacccaataacgctccaggaatctctaaaaaattcaaccggatacccgtcaggcccactaaatttgttccgcgggagagatttgaaagctgctttgatctcatcatcactaaacagcctttacatctcagtagactgcgcctgagagcacctataggtaagcagcaggttcatgtcatcttgctccaacgagaagggagtctcaacctcacccaacagcctctcataataggccatacaatgatcaataataccttgttgggagtcaatcaccaccccattgcagtcaacaagggactttatggggttaaaacactttctggaatccgccattctatggaaataggaagtattgctatcaccctcagcaaaccaagaaaccctggatctttgatggaagaaactctcctcagcagaggaaagcaaaagccacttacgctgagcctccagttccaaggctgcattgagatcggaggcattggcaagagtcaggtcttggcgccttaaaaaccactcatgagcctcttttgtacgcagctctataccagaataattgagcctactgaagtctttaataggcttcttgagggctttcagctttttagaaaccctgaacatgtgagacccaaccacgttagttgaataccaattttctataacaacattcaaaaactcctcattattcaacagaaaattatagaacttgaagggacgcttaacactaataccatcagcctccaacacaaccccacaagacacatgatctgagaagtccaaattaccaaagacaccaaagacggaggcgacaccggaagacccatcccgaacaccagaagagacagaggatgcagcacgagcacagactgctgcgaacttagaagagcttgtgaccaccccacgaagaagcttctttttctttttctttggcattagaacagaaatttccgaccaccgacgtgaggccgacgttggggaaaaagaagcgaaacgaagaaaagaaaggtttttaaaagatactttgaatatagagatcgaatttaatgttgtttctgtcaccaaacgctcagcctaaatcgaagctctacctatctttaagatatctattatctaccatgcatcaactactaggactactctttttttgcgttttattaattatctttttacttatttaattttctataatgtaatcttgtttttcttaacctagctagtatattttattttggtgtggtgaacatccaaattaatatataagaatgtttgaaaaaataatatattaatatcaacgctcattgtgttcttataacaaaaaagtaaataaaaaagtagttgctttcgtttattaacattgcttttctatatagagtttatattatgttgcataatatgaaaggtctgttatccaaataattaaaaaagatgcactgctcggagccttctaattaaaatactttatacactagacgtatgctaaaaacaccgtattgtcttttacatagagatcatataacaaaaaaatgtatatataattttttcagtatatatgaatatataattataatgatacaataacaaaaaaagccataaaattgatatgggtcaactttccaattttcagtttgtaaaaatatgattatctaacaattttcagttttttgtttttgtttttttcagttgttttgtaacacctccgaaatccgaactatacaaaactaagagtatgccaattgttcggttgtcgaataacgtttcacaattacgcaacttgagaaaaactaaacgtaggtgaaaaacaagaaagctaactacagtatgtggattcagtcaaaacttaaacccaaaaaaatccgaagaatccaaaaactaaaagagcaaaacataagtcaaacctaaaaaaatggaatgggtcacacgttattaactaatatactacctgatgcttaatgcttctgaaatgaacacataaaaaaaattgaataaaataaataaattagataaataaaaataaaaagatgtcggaatcatcaaaacgtcaccgtttcatagctcaagagctccgtcctcgaactttgcgcttcaattcccaaaaagtttcttaattttttattttttctcctgtgtaagtgcaaacatctaaattcccaagaaccaaaactaaagatccgtaaattcgaagcaacatcaacgttctcgagcctctctaattattgttttatagaccaaaaattcttcgtttttcttttttccaggaatttttaatttgtatgggctgatcagaaaaaagccactttgtgttttcttttttagctggacggtgtctgaatcattcaatgcctttctcttctctacctttctaaatctctctctctctatctctccatcgaagcagccatg

SEQ ID NO: 26388 - DNA, 3003 bp, Unknown
  misc_feature (1)..( 3003): 2750-1469P.txt file - cDNA_ID_2713128; gDNA_ID_2214600; Annot_ID_135553
tggatgcaaaaaaatctgatagttgaaaaattgttggtttcttgaaaagcttctgttatgaatctgttgttaatcatgtcacgagttagtgttatcctttagatcagacttatactttgacttgagctctgtgaattgggaacttacgtcagaatagccaaccgcaatataatgctatgttcaatgaatttaaggatatgaacatgttcttgttacaaggttcttttgataatgacacaaaagttacgagttgagaatgaatgtgcttcttcaatagagcataaacgcataaataagagtgacaattaaaaaacaaaaacgcatagaaaagagcacaaaatgaagttgcccattgctttcagcctttcacttaactccaatgatcgtctatgtccttcttctcgttgcccctcctagtctgattctgaatctggctcatccaccaatgggggatggactgacttgagttgtttaaagtcgtgaacattaagatcctctacgtggtttacaaaggtgcaaactctacaagttttctttaacacttcaccaaaaccttggatttcaacacgttggagagtgttcctttcgggattgaagtagaaaacataaaacggttgcttaggtgtatatttgagcatcgaaaacactatttcacccgaagcagtccctccagcgatggaaacacgacgacggaagaatctatcatcggtccaagtgtaggcatatttcgaccattgctgtttcttaacatcctctagaacccacacacgcaactcattaatgtcatcatcgttaatattatactccacatattcgtcgacatccgaataataaagcttataaatgtcgacatcatcctcccaataaatcacagctaattttcccttatagttgatcaatcgacaaaacctttctacgtcaataaacgtgaatttctcagacctaatatcaaagcaaactatcacataatcagatactatgccatgaccatccttaacacaatccgacgtgctacctaagtaatacaaaactccattgatgcatatcccttcactcttaatatcatgtctatcatatcgtaagggacaatttatctttctccacttcatatgtccagccccaaatgtaagaattttactatgaccaggaccagatggataaaatatggacaatgccttgtattgcttgtcaatcgggtcaaatccgaaaaagctatacgcctttctgtaagtataccgattaggtaagatggcataccgtcctgtagtggggttacatattagaggtgtagcctcgcctcgatcaccatataaatagatcaaccccgaggcgtagccaattgaaaaatattttaggtcataacaatgacagatatatagcttgtctggagagaacttaacatgaaattcagcggctgctacaagagtcgatgaggatttctcatatggattctcaagctgtggcgtcgagaagaacctccacacacagtttttctcttcgttgactttctctgccatggcgaataagaggcgcggcttagtggaggacctggtcaggaacaactccttgaaatatggactaccaaaaattgatccccattgcttcgacacgcaatgaaacctcgcgactgactttgcaggcaatctcgacaaaatctccacggtgagatcattcgttattgtacttggattcatgattgccgatcaaacgaagaaagagagatgtgataacttgtatataaagtaagacctagagaaaccaattaacaaaagacctaaagagtaaagagtaaagaccatatttatatatcgttaacgtccaagtgggccaccagctattggattttcttcagtaatcgctgctttataaggagacgaacaagatgagaatcaatcctgatgatgtgtgacatacaattgcttgatgaagaagattgggttggttcctaccagatttgcttgcatggagaacaatgttatggagtctatgttttgtatattaatatatactttgattcattaattcatctgatatggttatcatgacagctttgaatgaactctgtttctggtgaatactataactcgttttgagacacagatttgcaaaagaaactcgattgttgcgagttataatgcaacttgtgaatctggtttgcttcttagtcattttctcagggaaactataaaacacactacatactaaaattggtccaaagcctcaaacacattgagctagatagaatgatagacccatcagatagacaataagaaaagttcagataccaacttaaacataaacgaaagtgatagattgttgttactcttaactcgattccacacttagaaagcacaaattcaacttagagaactacaatcgaaagagaagatcaaattcaattatcaaagcaataatcaaacagatctgagaatcaaatcgttcgctaagtgttagctcacgatacaatgatcaacaatgatcaacattgtaacatctccagacaaattctctctctctctcaacaatctcagaaaatacataaagaaatgaaatgagctgcaacggctcctttaaagctgagttctctttatttccatcagcgtcttccatatcctttgactccagcttgttgaagaataatcaaatctcgtataagtcaaagtcacattcgtataagttagttattaagttacgagtcgtgtctgttaacacagttgtgtctttatcaagagtcatgtcttttacacaagacaatgtttcatttcatataaatagatcgagtctctgtttcctgtaacacaattgagttttgtaatacaatcaagtcaataagattgattacattcatactctgttttttcgttcttactctgttcttctttcataacaaaacattaacatggtatcagagcttatcgattgagaggacaagagaaaacactaaaaagagagagaggcaacaaaagtgagatcgtatacgtctcagcaaaaagcgagacgatg

SEQ ID NO: 26389 - DNA, 3003 bp, Unknown
  misc_feature (1)..( 3003): 2750-1469P.txt file - cDNA_ID_2713146; gDNA_ID_2214600; Annot_ID_135547
ttcaagctatggttgttttcgatatatttgaccagaattgtcatttcttcattttaaatatatgattacaaattgcagaatatgctagtatttttttttccaccataagtgaattatcttgggttgagcaaatagaaaatgtgtgttagatactttagatgtaggctggatcttgtaccagataacgaaaactggtttgcatggtattgcgacacgtatgtggaataacaaaacctttgtgtgtcggatcattctatcaaaatcaaaaagaagttgaaatatacgatacggtaaaacaaggtgcactagactaaagaactaaattttcgaaaagcagatgagaaatgagcccaataacttcaacaagaggtaacgtcctgccaccaccatctccttagtccaaacgtccacatgtacaacatttatttgcatatgggccaatgttttaaaaatatattaattttgaaaagcctaaagctgaaccgattgtaccgaatccgaaccgaagcaaaaaaaaccaaccgaattaaaaatttgaaaattgaaaataattgaatggatactaaacactataatccgaagagccgaaatcgaatcagtaccgaaccgaaatattttggataaccgaaaatatccgaaatacaattatatattcagaaattattagttatttgtagaccaaataataaaaaatacttgaatatatataaaaaataataaaaatactcagagataactgaatatctaaaaatatctaaaaatactcgtagcaaaataccaaattgatattaaattttaaaatcaaaagaactaaactttaaaaccgaaagtattgaaaccgaatagaatcgaaccgataaccgaagaggtaaccgaatgccaatgactacctaaaggtcttaaaataggcccagtcatctcaaaatcacgagaaagaacaaaatgataacatgtaggaacggtttatgtttcttctttagtatctgcgtaatttataaagtacttcttcttgcgtaagatacaactactaggtaggggggacgaaatatattcgtgatagataaatacatttaataattggatagggagatgatagaatagagttaatcacgatttctccgttagcgatcaaattctattactcgagttcagtttttcacttgtaaattttttttttacatctgagcttggaaaatcttgtttacatggatgaatcaatatagattgaaggttacatgtttaactgtgtgtttgtttttgttggaagaggaatgctaatctcgttgaataaaaagtgaaaattcataaactgaaaacttttcgctaaactcgaagtttggtatgaaactttttgggaatgcactgaagaattttctggatgaaaattagaagaaacagaaccaaaggtgtacagcttgtgttagatatcacataaatcatatctataaccaaacttatagacatgtttagaaataaatcatgttgaggtagatagtacgcacacggcacacttccttaagtgttcatttcaagctagtagataaacgatagggaaccaatgattcaggcatattaattagatgaggtaagtatacagttccaatgcaatattaattttaattaattaatttaacttcattgtgggtggtaacacaataatatgatttaatgaaataagtcatggttacaaaagttgttgctctatatccaccagtgaaccataatagtatattcatggctcttatccaattaaccaaataaaattttctaatcaaacggtttgaggacataaacaagtttaaaacaagagatagtggatgtgttttgtcacagccagatttctatagctttttctaataacagaggacaaacaaatagacgttagacttcccttcatcagatacatggtttcacaatgagatgtgacttgtgagtgttgcatgtgaagattcacaatgaaagtaatatgataaaaattggcaaaataacatggtccatggtttgagggaaacattgttggaatatcaatcatgccagaaattgcccaaaattagaaaataattgtttcatatataaatcatgccagaaattgcccaaaattagaaaataactgtttcatatgtatatcatgccagaaagtgcccaaaattaagcttaaaataattgtttgagagacattacagaaaagagagggtcttgtaaaaacaaaagacaatataatctcacgtagtttggtcgtttgcagagagattaagatccaatatttaaagacaaatcagcacaagcccgacaattacgagtttttggtcgcaatgaccaatttttcctcatttccaacaattagaactctcattaattagtcataacccacttctcaaaagaatagaaatcatattcataacttattttaagatagataatttttttgaaatatgttcttatagatttgttttctggtcaacaaaacattttcttatttattaagaatgcattcatcttttacaatcctaaaaaggtctgaaaaaaaaacttttgtcctaaagttaattataagttataacttaactttaaaagctgttaatttctacaatatccttctatttaaataattgctaacacgtcatcctgttattcaaacaaaatctattgaaatttaatattttccttatatactaacattttagagattttatcccaaaaaaaaacattttggagatagaggttttccattaaaggtaattaaaactggagatagagtttatacagtggaatatgctggccaatataatccttattaatactaaaacaaccccaaaatatggatcaatatatggctttacctcccaaaagagaagtaaaaactaatataaaattttaggagccttctcattccgaaaacattcacttttttctactacattaacacttttgtgtagatattattattcgtgttacatagcagaaatggttcttacacaatcaaaagaaacctagtcactaatg

SEQ ID NO: 26390 - DNA, 3003 bp, Unknown; identical to SEQ ID NO: 26389
  misc_feature (1)..( 3003): 2750-1469P.txt file - cDNA_ID_2713146; gDNA_ID_2214600; Annot_ID_187030

SEQ ID NO: 26391 - DNA, 3003 bp, Unknown
  misc_feature (1)..( 3003): 2750-1469P.txt file - cDNA_ID_2713150; gDNA_ID_2214600; Annot_ID_135546
agcaagatattttcctttaattttggtatattcgaatttagacttcttattttggagattaccagttaatgaatgagaaagaaaaatctcattgttttccatagattttatggttcttatggaaaaaataggaagaaaaagtctttaaatgtttacattccgaatctttagatataataaattacgcttaagtgaacaattagtgttgggagaagctctatcaaatctagaagaaacaagaaattagcaaaacagtgagtaagatgttggattgacggctcgtggaaacaatcggattcaaccataagttttagatggtggtgccttcggagagacaaccaaactgtactacttggagcaaaatgtcattggacgagtctctctcttcttcacacggaaatggagactcttttatgggcaatgaaaagtatcatcttaaaaggattgattgtgatcaggcgttcaaaactgatagtaacgagctagtgttgataatgcaggcgtctgatgtttcaagatttctctaatctacttgatgagattggccaacttcgtgattctttctttctttctcgttttataatattgttcgctcttgtagtttttatgcagattgtctagttcgttactctaaattttatactttataaatcttatttgtaaactattttcctccaaaatgggctatcaatcgtagagtgattttctaaattaatatgttcttgacatattagatgatattttaaaattttaatgcagattaattagttctgtattagttttgatgatttatgtgatgtttaatataagaaaatatttttaaaaaataatttaatttacatgcaaaaatatgtaacatcaaatatagaaattggaggagtattaaatacataaattatagtgatatggcatactaaaaaaactatagctttttaatttgttaaaaacttttgtttgtagttaataaatatgttggactgtaacgtaaactgacacgattctaaccttttataccaaacgtgaaacaaagcgaataagttttctttactagtctatgccaccctcacactatttacgtgtattaaaaatattgtagtatgactttttattattattattgtagtatgacttttaaaagcatttttactgtgtttttatattttcaaaatatcctttttactcaaaacatttgtcgatttatttctttgcattttatgatattttttttctttgttttaatttctgcatagtttcgcaattgagttttagaattttcaaagaggtttcagagtttgatcgatttggatatttaactagtatgacatgatcgattacattttaaaaataataatatcagcatatcatcatcaattatatagttgatgatgatatgctattattgttttttattagtgataataactgttgaaaaaaaccactgatcgtcagtcgaattcctgatcataaaagtcatggtccatatcagctatatgagcttacacggcattcctagctcttattataaatctccccacattataatgaaagcaaaaacttaaccaattgcaacatgcaaataaactaacctctatgaacggagttaagtaactattgatcgaggaaaactagcaagtcagagcaataactgttacttaccatttaattttaacttatgaaatgatgggaaacgtatagtaaaataaaataaccaaaacgtaagaagtaaacaaggtgcattttgaaacccaaaatgttaaaatactggcgatttaatctcttaaagcttaaatgattaagtaactacctattgataatactcacaatttaattttatttgaaaatatatatttttaggatttttaaccaacagcataaaggaagaaattcacattcctataatgtgatttttaggctaaaaaggaagatggaattctaatattatctttgtcaatttttcaatcattgatcaacttttgtatagataggaaaacaactatgtgtaatttttttaagctacttagagtttatgtgtttgagtttcttttgggagatgtaagaattttttagatatccgagtttttttttggtacaaggttaacttacaagatttaaagagtacaagatttacgagttgatcgagcgtcttcaatattttgagttgtgaattcaaatttataattcattgtttctgtttcggttaaaaatatggttttaagcacttgatttattatactcccttcgttattttataaatgatgttttaagcttaaatttttgttcttaaatagattattaaatttgattatttatattatgcagattatttttttattggttgattagaaaatagatgatgtttttgtttataaattataaaataataaattcttaatatgtgtgtaatcttctaaaacatcatttataaaagaatggaaggagtataagacttaatttattacgtatcggatcacaacaaacatgcacttgaatcacatccacctaacttccatctaggtgtttgtttttgcaattattcatatagaattgatttggtgatataagtttacgagttattaaaggaaaaaaaacaacaacaaaaaaaaacaaattcccaacattagttatccaagagtattttttttttttttagttatccaagagttaacaataccttctaatactgttctctacaagtctactatacctacgttgcaatgataatttcctgcgtgttttttttttccttttaaacgtcacatgtttaaacaattttcactaacccgttatttacacatgtaagagaaaaaaagatagccaaaaggacttatagtgttatctatttaaaaactaaacttgtggtgtctacctaattaacccatctttgtacgtaccaatatcgctttcttcaattattagtaatatataaatataaatgtttgtagtagctgccggtcattttttctttctctctctcctccctaagcaaaactaaaacaagctatg

SEQ ID NO: 26392 - DNA, 3000 bp, Unknown; identical to SEQ ID NO: 13134
  misc_feature (1)..( 3000): 2750-1469P.txt file - cDNA_ID_2713153; gDNA_ID_2214600; Annot_ID_135545

SEQ ID NO: 26393 - DNA, 3000 bp, Unknown; identical to SEQ ID NO: 13134
  misc_feature (1)..( 3000): 2750-1469P.txt file - cDNA_ID_2713153; gDNA_ID_2214600; Annot_ID_187028

SEQ ID NO: 26394 - DNA, 3000 bp, Unknown; identical to SEQ ID NO: 13133
  misc_feature (1)..( 3000): 2750-1469P.txt file - cDNA_ID_2713155; gDNA_ID_2214600; Annot_ID_135544

SEQ ID NO: 26395 - DNA, 3003 bp, Unknown
  misc_feature (1)..( 3003): 2750-1469P.txt file - cDNA_ID_2713179; gDNA_ID_2214602; Annot_ID_135585
cgtctttggccatttctataactttttttgttatatatgaaagttgtgttttgtattgtggatatgttgtgtttgtgaagactgaagagacgaatgaaagttgtttatatagagagactatagctatagtgagtgctctcattaattttgcttgtcaatatacgttaataattgtatacgtgttattgattgattatattacgataatgttttccttttggtaggcttatggttgtttttattattcgtttcaatgaaatgaatatagaattgtgtgtatgacgattatgattatttttgtggaaactttctttcactaattaattacctagctagctgtcatgatgatatataatctaaaccaatctaatcattgctacataatcaatagaaactgattttgcttaatatattcatgttccactgttttttttttgtttaagcagaatttccatatacattagtataattaactgatgatagtaagaattagctactgctaagagtttttcatctcaattagtgtttgtcataatatgatagttaaggtattgttttgttgacaaaattaactataactaaattattattattttggtttcaacttcaactattgatacaaatctgtaactaaagatgaacttatttgagattctgattatttaaaagaatgattgtggagctatcaataggaacagagaccttttaattctaaaattatggttgataatggagttttgtggttaatttaacttagcctcgccgccccatacctaaacgttgttttcatttggaccgaccctaatatactatatgcttctatatttttctttctcttgtcctatgtcatgagccttgtcctccccctagaataatatagactgtcactcttttacacataaaataaataaaaaatatgaagttatgaaccttatctatttgggcaatacttgaaagttgttacttgttaacgataaagctttttgaactacgagatagctagattgatcaatagtaaaatttctgattatctagattctatcatccttcatttaatttctagaaggagctccttatatagttatactagttcttatgcatgtaattagtaacgattaaattgacttcctatgctcttaacgttacaaatcaaatctattaggtggataaaaaagagtcttttgatagctctcagctaaccctaccatataacaaaaacataatttatcacatggacatgataaaagaaacggcgtcgcttcacgggttatgtttccactaaagtagaaaatatgatgaaagttgggtccactggaccggagaaaccgccccatatagaattgattagctccgtcaattgcatcggcaccgtccatacagattaagtccaactccagttcagccgtcccaaccactcctcttatgccacgttgtttagtccccatattcaacaatcatttgctctcactcctcaattccaaatttccaattgcaattttcttacgtatattattcagtattcactaatcactagtctgtctacaaaaataaattggaaaaataaaaagtgtacatagacaaaaggaatgtggtgtaatgtggtgttcatggccaatgttttgccacgtcacaatatccttatcgttgtagcgacatttctctgctcttattggattatatttccacgtcagaaaggtgctctctctctctcggtctctcccctggttttatttttgttttctttcatctttgtcgctttctgttttgttaaagaattgtctactcgatattggttacgaatggtattgttctctgtggaaaaatgggttaatttgttatgataaacattttttgttccaaacaaataaatgttctttcatttcatagtaaattttttagtcttctgaacacacgtatatatatgcttgctaacaatgaatccacaataacagatcataaaattacatctgactcatatgtaattctatcatgatatgttgagtcaatatatagtcgatggagtatatatagagttataatttgattgtagtgtcctatgacagatttaacactcagcttacaccgaaaaagttaagtctcaaataaattacgtatttatgcgttatttaacttattatacaaaatgacctaaaataccatttcattttcctatacaaatattcgcttactatatatactatatgtttaccaactatcatgaaaaagatgcacgaatgatccagaatgtgcttgaaacggcagaaaaacaaaagaatcgtgtgacacgatcgagacaaatactttactaatcatataaaatcattatttatcaaaaacttaaaaagcacctacagtatatgcaatgtggatacagctaaaagataaggtatgtatgttaacacacaagtatatatgatcatcattgtcaaatatgttcacttatataattgctcacgttttatcggtttttggttttttgtcaacggtcaaattttttgggtgatgcctaacaaaatttaatgacgtgactcttgggacggtgatctatcagtagcatttaacaatctagttatttggaaatgaattacagtatgagatttatactatttgtataaacttttcaggaaatgttaaattatatctttaggagattttttgtattggttctcactgatttagattatcaagttactgagataaaaaaaaaattaatacttgttttagatttcctttagttaccactgaccaacttctttagcaaaaaaaaaaaattaccactaaaccaacttatgcattcgttacaaaaaaaaataccataaaacaaaacatcaatgttgtaagttgtgacattaaatcaaaagtgtcaaaatcaacagtagcacaaaccaagagctcactctatataaagaacctttattcttcatctcacaaccacaagccctacaacaaccacaaagcaaaacacttacttagaaagtccagaaacatccattaacacatatg

SEQ ID NO: 26396 - DNA, 3003 bp, Unknown; identical to SEQ ID NO: 26395
  misc_feature (1)..( 3003): 2750-1469P.txt file - cDNA_ID_2713179; gDNA_ID_2214602; Annot_ID_187098

SEQ ID NO: 26397 - DNA, 3000 bp, Unknown; identical to SEQ ID NO: 13163
  misc_feature (1)..( 3000): 2750-1469P.txt file - cDNA_ID_2713183; gDNA_ID_2214602; Annot_ID_135584

SEQ ID NO: 26398 - DNA, 3000 bp, Unknown; identical to SEQ ID NO: 13163
  misc_feature (1)..( 3000): 2750-1469P.txt file - cDNA_ID_2713183; gDNA_ID_2214602; Annot_ID_187097

SEQ ID NO: 26399 - DNA, 3000 bp, Unknown; identical to SEQ ID NO: 13153
  misc_feature (1)..( 3000): 2750-1469P.txt file - cDNA_ID_2713189; gDNA_ID_2214602; Annot_ID_135575

SEQ ID NO: 26400 - DNA, 3000 bp, Unknown; identical to SEQ ID NO: 13153
  misc_feature (1)..( 3000): 2750-1469P.txt file - cDNA_ID_2713189; gDNA_ID_2214602; Annot_ID_187087

SEQ ID NO: 26401 - DNA, 3003 bp, Unknown
  misc_feature (1)..( 3003): 2750-1469P.txt file - cDNA_ID_2713196; gDNA_ID_2214602; Annot_ID_135572
ggccaggaaggatcactacatctccactggggtcaatcttttgagatgcattacattagattagaacgacctaaaaaaagtcgtcataaaggaaaaaagatagtaacgagaatattatctttctgagtacaaaaagttggagtctgctaaagtccatacattaggaggcgataaaggaattcgtcatttgtccatacataataagacccattattgatttgcccataatacagatcatcattcagatatatattatttaatcaatttctatatgacttgtatttcaacttttataaagtatttatccaagatgataatatcaaagttaaccttaataattatacgggaatgagatcatacctaataatcttgtcatgctgtttttgttacgtgacaaaatataaccttttttagtttgctaagtacaaaatataaagtttataaagattacagtttaagggaaaataaaataaacatttaaacatattgatactataactaggatacgaaagtaaacaaaaaaaaaacaagaaaatgccattggaaaaggcaaacgaagcattatatatccattataataaagcaatagaagaggaggagattgatttaaaagctcattagccgatgcaatgatgttttaggaagaagataaaacagttaaacactcagatctcaagtttgtctactactctcccaaaacccgataatattgttctcttctttacgtttgaccggtgtctcctatcttcggtcttcgcatgagttcaattttttaaataaagatattttggatattattagtttgatcattatttacattaagttattttaattaaagctatatatatctacaagatctttttaccactttgatcctccaccttctttcataacgtttatcagcaattttgaattatcaatttcccactatgagtatgataaatatacacttttttcttcttttttttttcacttcaacattgctaataagaaaaatgattacaagtatttattttctctaatctaaatatactaaatcagcagtcacttttccaataactaatgcattcagtgattgacacatcagcttagtactattttttattttttcatttttacgcatagtatgtgtcgtttttatttaactttgtttctttctcaaatgattttctctttcatccccacgatctccacatctccactttctctcttccaaaaactccatgactactgtgtaaaatctcaaaaatgggtttctcaacatcattaatcgattactcagaaatcaggtactttgttcatctcaatgaaccaatttaccatcttctatttctgtttgtaattttgttttatatatatagaaattttccatagatccgaaaatcatatatccttcttctagatttctatggtttttttttttttttgctttgtttctgctttatttgactgaattcgatttctctcatacatctccatttttccataggattattctttaatacaatcaatgcctatgattctcccgtctcacaaacactcaaggaacaacgacaaattttggcttctcatctgaacagttgccttaaaacaagggtgagtttaatatcttaatcgaagctcaagtgtttttttgatggtaaattaattctcatactttttactattcttctttcatctcttattttacttctttatatctgcaatttcttttttgtattaaactgcaattgtattttcacgcaagatttttgtattaatacaaatacttcaattttaaagtcatctcttattttacttctttatatctgcaatatctttgatattgtttcaaaggcagcgtctgcgtcatgtagttacttatttgtgcacattttacatttttttttagacttccaagctttgggtgtcaacgaatgtttgtaaactgaattactgatgatgagaagaagaacacattacaattggttggagctaatgatgaaataagcggacatgtatatacccagcataattttcgtacttatactctcttatatttctaaactcttgatttgttagttattgcctatcgcaattgattcattgggtagaaaagttgtaccttctttatatctttttcttaatctttgtatattcttcgatcaatgataataaatttgttgtatattaatactgtctgctttattttaaaatttttagttaaaagttgtaacagatataatctaaaacaatgttatccctaaataggggccaaatgctagttatattctaaatcagtaaataatagttactacatgcacactaaaacagacatagcgtacgtgggggacttattttgggaattgtcacatgtgtgtgagtcactcaccactaggttcgatttatatctaacgatttttcccggaaatatttatggacgaaaaagcaaacattataagattcatttgtttgttttatatagtacacaaataatagagaattaaatcactaattttaatgaaaattaaaaataaataatatatatatatatatatatatatatctgttgacgaaaataaaagcaagtatatccgaataaaattacgaatataatttagggatgaaaatagaatctcctatacagttaagatattataagaatattcatggttagactatcttagaattagataattaaggaaaattatcgtgatcatcaatttacaaatttcatacctgaattcattgtttaataaggtaacctgtttattttagttttaaaagtatatcaacaagagaactttgatcactaaaaaacaaaattcatacaaactttaatcacttccctatattgaaatgatctaatctggatgaaaaaaatattatttattaatttcccataaaacaataaacatgtggatgtagctcttaaatattcttagaggcagagaatgtcatttattcaaatccggaaatatattaaaaatgttgaacaaaaagaaaaagaaatatattaaaatg

SEQ ID NO: 26402 - DNA, 3003 bp, Unknown
  misc_feature (1)..( 3003): 2750-1469P.txt file - cDNA_ID_2713206; gDNA_ID_2214603; Annot_ID_135614
atttttatgataaacatagaaaattctaaaaaaaggaaaaaacccgaaaaatacctcatttattttttatttggacgtttaatatctaattttttttggttggaagaaaaatacttcagttaattatattcggtcaaaaaataccttatttttaaattattggtagattcaaacctctgttttaacggtcgttaacggacgttacggtatctataaacaacgttaaattataacaagaaaaatagacgaaaaatactcaatctatttacttttggacttttaatacctcatttttttgttggaagaaaaatactccatttaaatatttttatctcgtgagttagtaacttttaaaatcgtactttatataataagatgtaaaatttctaacacgttatttcgaccaaatggttttatatcgactattatcaagccaaattctactattcaaaatatgtatatccaacgacatatttatatcggattaactattaataccatagtaaattcataggttttttactttgagttttttgcttagaaaataaaaaaataatgacataaatacataatgtatattagatatagtatagaaaccataaaaatgaactcagtttcttatgtataaagatcactatttcgtgtttattcttttatttgatccagttcttccatagaatatccaaattccaaaggattacaatatttcatttttcttagagatgtttttggaaatttgaaatgtaaaagatgagtgtattatacagataataaagctaacgtggatacagagaattggtcatttctaattaaatatgaagtgttatacgattgaaggtggaacgtcattatcaaatttccttattttcctttgcttcaactgtatcattaatcacatcttccataaaattcaacgatatggcgtaaaaggatttgaccttttaccctaagaaccttaactctaatctgcctaatctcaaaatgacataatttactctcttaattcacagcttctttcctaattacataattataaaaaatcgcagtaaactttactaattggttccgtagattttaattttcattattttggattccattattatgtatagtaaaatggaaatttaacttgttggaatacaagagaaagttttgccgtatgattgaagatagagcaagatcgatcatacaaatataacaaatcaaggttaaggttaaaattgaatattgtaaccaatcacgttcgtcagatccaccaaaatcggtgcttcacgtcacacatatttgcttcacgtaaacatcaagaatacctaaaaatatacgaaatcatttatttacataaacgcaaacccaacaacactaaccacgagatcagaactagtagtagcaaacgcatctccagcgaccgcagggacagtagtacgtatatctctttacctgaggagacagcaacttcgaattgaacgacggaggaaagggctaaaaggacgagagccaccgtgatcatgactattaccggcaacggagacgtcgatactctacaccgtgcgcagaagcaaccgtggtaatgcatcgctgatcgccttctcactgttttctttggtttgtttaatggtttctattactcggaagataatgaaacaaagaaagataaagagagtgataatggtttgttaggactataaatgatattattatgatcgatgatgataccactatttcgagaaaaatcataagtactagctagtggggtaacgaaggaaaatatgtggtaatttacttatgtatttcgtcaattagtgggtccataatttgtctaattttgactgaaatatttgtattaacactcaactaattaaacattggtttcttcatgtttattttgcgtttatgggtttgaatggtaacttttaatcaaaacgatagttctgtacaactttgatagctactgatcacaaaactttatcaaaagcgttattataagttttactttcagttttttttttacaactttctcgtacaactctatcttacagttttacattattccgaaaaaacttataactaaatttattgtactgttttgtattaccaatgagacctatatcatattcgctcatacaatttgtttttaggtgttgatttctttgctaagcactcgccactttcctatagtacacatttcaatcccacaaaaacaagtaaaatttgtagaaatgatactttaacaaatgaatgtaactattaaagatcgatttcttttctattcaccttattattgttgttaaagattagtatgaacaggacatgtctttaaaattctgttctgatcgggtttgtgagagatatgagtgattggtggttaggacatgagaacaaggaagcttatctcagtagcctaccataaaaaagacactcacttcaccttgttccactcattgtatatataataattacatgttgtgcctaatgtatgtcgatttcagggattcataccattgttcttttttttttggtgagtataccattgttctttttgtacaaagacaacaatatatgtaaatccttttttaaaatttgatttgattcattttaattaagactcaaaatataatgtgcaattgattaaagagaatataatacattatgtttttaaaatatagacaagatgtttttgacccaaaaaatagaagaaaaatcttaacaaatatagcatattttggtatttttatttttatccttaccaaaaaaaaattagtttggtatttttatgatatataaaaagaaatcctaattaaaaaatggtaattcaagaaatatttattccaacaaaaaaaaaacagataaatactttcttatagggcctaaaacggtttttgtgacccggcccatttaatgtgagtcacaaatggagttatcttatagtttacctgtaaaaaaaaaacttttgtcgtcacttaaccgagaaagcaaaagagaagaagaagaaggaatcgaaaaatg

SEQ ID NO: 26403 - DNA, 3000 bp, Unknown; identical to SEQ ID NO: 13183
  misc_feature (1)..( 3000): 2750-1469P.txt file - cDNA_ID_2713210; gDNA_ID_2214603; Annot_ID_135612

SEQ ID NO: 26404 - DNA, 3000 bp, Unknown; identical to SEQ ID NO: 13175
  misc_feature (1)..( 3000): 2750-1469P.txt file - cDNA_ID_2713221; gDNA_ID_2214603; Annot_ID_135597

SEQ ID NO: 26405 - DNA, 3003 bp, Unknown
  misc_feature (1)..( 3003): 2750-1469P.txt file - cDNA_ID_2713225; gDNA_ID_2214603; Annot_ID_135594
ttatacatcagtacaactaaaaaaagtaacaactcaggaagatggtacctcttctctgtcgacttattcacagcttcagatttcttgtttacgttctttgatgccttttgtcctgtaatttcaagatcagtcacacatttcaccttataagctttatttgtattgtgtcaaatgagaaagaagaagcatactggccatctcgttcaagaaacgtattccttgtgagtgtacattaggggtcactttatccgcgccactgcataatcacaattggctttagaatctgagaagcgggttctgttcgttatgttaaaagtaaaaaacttgttgagagtttccaaccttagagcctttcggagaccttccactgatagcactcgaacaggctgagtggtctttttgtttccgcttctatctgctggtggctcaactgtgtaaatcccttgcgattttagatctctgaacgctgttctcaagttcctgaaatagaaaaacatcccaagaatcatgaaaatttccaactcgtggtatgaccaacctatgaacacgactaggtaggattagcataccctcctttgagttcagttctcattgtagcaaatttgtctgatgcattctgtgaaaaattcatagttagtgaaaaacatggttcattgcattgacgccagaaaacaagaccaaagtattaccaaaatgtaccagtttatgaatcttgcagaatgctccttggcgcctgaaaccaaattcaaagttgtaactcaacattcaggaaacaatacaaagagagatgcatcgctaaggtaaacttacttgtttacaacagatgtacaagttgttccatctttccgctttgctgtgcagactccataatcagctgaaacccccagtttaaccatttgtttagcagagttgacactcaatgagaactcacgtccctgccacaaacataaattttttaaaaagaagatttagttaagccatccggctactggaaaagctgatgctatatacttaccccattgtccttgcgaagtgagcaattaaacagaccgaaaaccgttcctgccttttctgtctcattctttttgtaagcatcaccaaacaagaacaaggagacattgttttcatttaagctaccgatcttccatataccataagcctgcccaatggagcttgttttgggttgtcctttctctgttatcactcccattgtcgcccagcagccagagagtttgtcacccattagcaagttcctacacagaaacttgttttaaatctcttctgcttcccaagagtagtaagtaatgtttatctatctaagaagtgaacaacttactttattgttggcaatcgaacgaaacggatatctgaaaacagatcacttatctctgcagggctaagtaattgattcctacaaatacatcaaaagattggctatttcagctatagattggaactgaaaaaacaatctacgactatagtagctgtgactcacattgctagagtgaaaagggtttagctttacctaatgcgcaagccagaaaacttctcaatgtcattggtattggagttgttggagcctttgggtttagtgtttttggcgattggtttaggattatagtcaatgcaatcttgaacaacacttctgaagtcagacaagtcagagtgacccctacgcttgggggattcatcatccgtgagatatcctgcacaaacgttacctcgcattaaggacaagaacaatccaactgagagaaaagcatcaaactttacagattcttgagcgaattagatggaaacaagacgcccccagatcaatattcgaatcataagatctattacgcaagtgattgatcgaatcagagatgcaaatcggaatcgcacactggatttaagaaagcaaaaaacaaaaccctacaaaagtgagagagaaactcaccgggtgcagcagaaggagaaccaggaggagtttcgagaaccctatcgtcaagagacagaagcaattcaagatcctcttggtcgttttccatttttcaatttcacgatccaatagcgatgcacaagaacacaaaacaacatctcgtgggcgggagactgaatttcgttgcccgccgaaacgcataagcgacgccgtttcgttgttaataaataatgtttcataccacccggttttaccggttcgtgagaaagatcaggatggtgaaataaaccggaaatttgagtgacgatagtgtcggcatggcatttttttttgtctcttaacgagagagagtaaataaaatagtcagatgtcttacgtggtccatcaacaaccacagggccctaattgccaccaacatccacttaaagtgtgccacctgtcttaatcatgggcttcttatcaacatgcgatggcccaatataagatacttacccttctctttcaataattatccaaatgtgcccaaatatagtttttagaacaaatgaacaattatatatgttttcgtaaacaaaatactaattttctttgaaaacatatacgtaaatttcaatattgatgtatgtagaaagttatgaaaaaggaataagattttcattaattaatttattatagtatcatcagaaagcaatgttattattcgaagagagaataaaaattaaaaaaattaaattaaattgctgatattttttatttttaaaagtaaaagacaaaaaaagaacaataaaataaattggtccgtgtctttagcagcgaagcgcacacaaagtttgcttgccttctgggcttcacgattctcacgacatctgtttatcttctccgatttccacgtccatggatctcagtcaatgttccttaatctctcttttcgattagtccaatctccactaatctctgacctcagatcgcttccgacgccgctgaactgtgtccgtcttgatctgtgtttaggagaaagcttctagggtttttgttttggttgctgagtagaatttgttggatctgaaacggaaatcaaaatg

SEQ ID NO: 26406 - DNA, 3000 bp, Unknown; identical to SEQ ID NO: 13203
  misc_feature (1)..( 3000): 2750-1469P.txt file - cDNA_ID_2713232; gDNA_ID_2214604; Annot_ID_135637

SEQ ID NO: 26407 - DNA, 3003 bp, Unknown
  misc_feature (1)..( 3003): 2750-1469P.txt file - cDNA_ID_2713236; gDNA_ID_2214604; Annot_ID_135621
aaacattgtcatttttctagtattctcacagctttcccttatctttccgagcatcatcatccatccgtccaacgtcgttgaatgtttgaccggtcatttgatccgacgccttcagtgaagtcgccaccttacccggctttgaatcctcgaccttgacttcaaccacagtcctacccgtccctccatgctcacgtgccgcgcgtgtttcctccacaatgtctgatggcattgtcagtttgctctttattgcttccgttacattccctaatgcaccaaaaatagtccctttcgcttcatttcccctgcatgatttaatcacatcaaaaaacaaaacaaagagtttcacagtcacctttaaacttgaagaacatgacaagatataactggcatttcatcatttacctcacggcagcagaatctttggtctcttcggctttttgagctcccgactcagtactctccctagtcttttgagatgcctcttgggcttttgctccagcttcttctttgagctctttaccttccaatctcatttcctccatcttttgtcttgttacttctccagctttctccatgttttcctatgttatcaaaacatcacattatatcaaaccatttgacatatgtaatcttcatttacatggaaacaaagttccaagaaattataccttggcagtatctttggtctccacagcttttcctttggcctcctctgtcttccccgacaagaaacccatagctctcttcgctgtctcaacggcactatccttcagctctcctagcttactcaccgtaacatctttcccctccgtcgccttctccaccgtatagtccttatactctccagtcttctcagctgtcttatcctttgcttcaatagccttctccgctgtgtaatccctagcttccacggccttgtccaccgtgtaatccttatactcaccaaccttctcagccgtcttgtccttagcctctttagccttatccgccgtataattcgcagtctccttcgccttctccgctgtcttatctttagcttctactgccttatccaccgcatagtctttgtactcaccaatcttctccgccgtcttatcctttgcttccaccgccttatccgcagtataattagcagtctccttcgccttctctgcagttgtgtccttagcctctttagctttatcaaccgtatagtctttatactcacccaccttctccgcagtataatcagcggtttccttagctttctcgacggttgcgtcctttgctccaaccgctttctctgaagctatctgagctccttctttggtagactcagccgcttcgtgggtttttccaactacagcgtctctcgcatgctcatacgttccttggacagccctgaacactgatcctatcacaccgggcctatcttgctccggtggatgttcagttgttctctccgtcaccttatacattgtgacatcagcaccaccggatttgttaatgtcatgcaagtcctcagccgctagcctcgccgcaacctcggctctctccgccttttgtttgtctgacgccattgcttttttctcgattgcttgaaaattgatgaaaaaccgctttagaactttacgattttagaattctttaacttgtgctatcagttgagctgcttttgttacttcttatagtaatgctctgtttctgttgagacgctacgtggtagatagagggacgcaacagctgccacgtacaatttacttagctttatcttctacggacgtggtatgacacgtggacttttcatgcatggatcatgattcttgagtgttcatggcatgacttaagagctaagacataagcaagcaagcatcgatggtcggtcgtatcaaatcttttgatatcataatttgtgttggtcgaggaaaatgttaggtgaagatcacattcgccatttcaaacttactgaggcacataacttggaaacaagcaatttagagatatgaaagattacttagttattgccacacagtttattggaagttattgcctcaacatcaaaaacttggaaacaagcattttagaaaaataaggacgcaagttaatcattggatagagccgtttattgatcaagtcggttatcaatataattttgagtttttgacggttcttgggagggtatacaaaaaagttcattgcaatagtttggatttatttccaaattttctctaatttgccagctaattcaggttagcacatgagtctattgtcttaaccgaatagacaactctcttttttgttaaacatctctattagtcaccttaactttttttttttatcaaaaataaataaatcacgttaatcatgttctcacatagattacttttatacttaattaggtacgtcctttttttattatttctccgacaactttgttgacgcgcatttgatgccgaatcatccaaatcggtcacgttttctacatgatttgtcgtaaatatgatatacactaacgtgagtaccttaagatctcaagtatatagttaagatcagatcaaatcagaaacacttagtttgagtttcgatttgatcaaccatataacaatatatggaacttctagctagcatcatggctttcataatgtgtaggtacgtgtgagtatgagtacacacgtacgtatgtcgtgtaagtggagaatccgatgcccaaacgagtaagcaagcaaaagcaatggtcaaaaagcaaccgatctcaattaattatcttattgtaaaaactcaataaaaagttaagggaaaagaataatcttacaagacatgtatcctccacaacaaaaagaggactgtataaaactatttttttcatgagaccaatgattcgtataaaccatttaaatttgatcaaaccctcacaagattgatcaatcaattctcgagtctctgtttcggtcacataaccgaaaggaaacttttttagtcagaaagaaagatttttggagttgaaagcaacataagagattaatg

SEQ ID NO: 26408 - DNA, 3000 bp, Unknown
  misc_feature (1)..( 3000): 2750-1469P.txt file - cDNA_ID_2713244; gDNA_ID_2214604; Annot_ID_135618
tgggagcatcagcatcatcagtttggtacaatgtacgagttcgtcatccgacaaaagaagtaccaatcttagattatgatcttgctcttctctttcaaccaatgcttcttctcggtatcactgttggtgtttctctcagtgttgtgttcccttattggctcattactgtcctcatcatcattcttttcgtcggtacttcttcgagatctttttttaaaggcattgagatgtggaaggaagagacattgttaaaggttagttttatcttccatcataagttgtggcttttatgttgtgtgagtgtgatactgaatgttttatgtggcttttcttaaacagaacgaaatggcgcagcaacgagctaatatggttaattcccggggagaacgtgtgtaaagcttcatacttttgattcctttagtcatgtttcttgatcttaaactgaccacattgttgattctcttgttcagttttaatcgatacagagtatgagccgctttacccgagagaagaaaaatcagagctggtaagagtgtatgcaagatgattttcttaacttattggctcttcagacttgcataaagatttaaaaacttacaggaaataatacgctccaacctcaaatggaaagggcttctaattctagtaactgtgtggttgactttcttgctcattcaaattgtcaaggcaagtaatcttcttcttcgtctaagcattctcaataatctttatgttgagctctcatcaatggaactcgtgggtttatacagaacgaaataaaggtctgcagcacaatatattggatactattcatcgtacaggtaacatatatatgtcgcagataacctttgattatgttttgtgctctcgctaaatcaagtcattcggaacaattttccctttgtagttcccagttgctttagcggtgtttgggtttgaagcaagcaaattgtatacagcgaacaaaaagaggttaaacagtggcaacactgaatgtatctgtgaagctacgattgagtggactcctctgagtctaatcttctgtggtctctgtggtctcattggaggtatcgtaggtggtctccttggatccggtggtggatttgttctcgggcctttgcttcttgagattggagtcatcccacaggtaaacacaccatcttatcagtatatatgattgtaaaacccataatcattcatcttgtgtctttcatttttatctaacggttaaaacacaggttgctagcgcaacagctacctttgtgatgatgttttcttcgtccttatccgtagtcgagttctatctcctcaagagattcccaataccatacggtaagatctctaacacacaacatgagatacatttagaagtcgtagcagaataaaaaggaaactgatgattgacctttgtttcattgacagcaatgtacttgatttcggtatcgattcttgccggtttttggggacaatcctttataagaaagctcgtggcgatcctgagaagagcttccataatcgttttcgttctctcaggagtcatttgtgcaagtgctctcacaatgggagtgattgggatagagaagagcataaagatgatacataaccatgaattcatgggattcttaggattctgcagcagtcaatgaatcaaccatctatctgaacaaaaatttcaagtgttttgttttcatttactggacaatttcggttgtccaacaccattattgtgagaagttataaaattagattgttttacttgcagtccaagtcatttgtgctctgttcttggtcaatacatagttgaccatcttcagaaatagagtttgtctaaattgttgtcattgtgttttgcttgtattcaaacgttgtattattatttgcgagacgatagataaaataaaaatggaagtctttttctattcacatcttcaatgtaactacaacaagaaaacagaacatgttttggtaatctttctaattggaggaaggagggcaattgatttggacttggctaagattgttgaacaacaaaggcaactttgagacagttgactaaagaaaaagacatcttcagacaaatctaaccacaacatcgtcttcccacttgagtgattaaattttataagcatttaagtattgtggttccaaaagttttgtcaaccaatgataagagagattgcaatggaatgattcgcggatcatcttggtccatataccattttagccgtgagtttttttcttggaatttatgtatagttttgtgatatattgttcgtggttaaacgtcaaattcgaaacaaacaaaaaatgatgcatgtgagatatggaagtccaagccaaacaacatttggtcctattaagactgtactaactatcattttttatttattagaggccatcaaatctttgtgtaatgggtttttaactaaaacatttctttcatgggccaagacatttaatttcggctaaaaggcccattaaactcctccaaaactagggctcaggcgaattcatctgccttaaatagattcgtaattctagaaaacagattttttagggtttcaagtgaaaagagtaatagcgcggcggagccatggttctcaagtaatcaatctcttctctatatctctcttctccatgcttctctgttcataggtttacattgttgctaatgatccatgtgaatattgctactgttgaaaatgccaatttgctaaaatgagcttcttttggttcaaatctgtttatttcccgatcagaaatgtctgcaaattgtgattttctggtacgagatatggcttgtgttcggcaataactagatcttattgtttcccttcactttgcaacatttttgtttgtaattctgtacattgaattaattgtgtttggtctctgtttcaaatcattgtgactcttgtgaatcgtattgtttctctcattgggcagatatctaattagccatttactagttctgcttttaggacattgtaaaatgagatg

SEQ ID NO: 26409 - DNA, 3000 bp, Unknown; identical to SEQ ID NO: 26408
  misc_feature (1)..( 3000): 2750-1469P.txt file - cDNA_ID_2713244; gDNA_ID_2214604; Annot_ID_187163

SEQ ID NO: 26410 - DNA, 614 bp, Unknown; identical to SEQ ID NO: 13209
  misc_feature (1)..( 614): 2750-1469P.txt file - cDNA_ID_2713251; gDNA_ID_2214605; Annot_ID_135653

SEQ ID NO: 26411 - DNA, 3000 bp, Unknown; identical to SEQ ID NO: 13208
  misc_feature (1)..( 3000): 2750-1469P.txt file - cDNA_ID_2713264; gDNA_ID_2214605; Annot_ID_135646

SEQ ID NO: 26412 - DNA, 3000 bp, Unknown; identical to SEQ ID NO: 13208
  misc_feature (1)..( 3000): 2750-1469P.txt file - cDNA_ID_2713264; gDNA_ID_2214605; Annot_ID_187204

SEQ ID NO: 26413 - DNA, 3000 bp, Unknown; identical to SEQ ID NO: 13206
  misc_feature (1)..( 3000): 2750-1469P.txt file - cDNA_ID_2713268; gDNA_ID_2214605; Annot_ID_135644

SEQ ID NO: 26414 - DNA, 3003 bp, Unknown
  misc_feature (1)..( 3003): 2750-1469P.txt file - cDNA_ID_2713280; gDNA_ID_2214605; Annot_ID_135640
agatagatatttgaatattcagatctttgatgacccgtctttagatccaataaaccctataatctagttattaacctgcagtataccgcaggtaggcttatactttagttaaactaaaaacttttattgtaaagatgatttaaatatatatgatattattttatttgattttaaatgtatagtaaactgtgagttgtatatgttttgttgatattatctatattgtttagtgtttaagattatacacttgtagtttggttgttaatttaagagtttcacctgtagtatatcatcttgtattaatatcgatctaaatccgtccattttacgattttccagcttgtattaaaaattgaatcacatctaatatgttattaattactgtagtatataagattataaattttcaatataatatgtgtgaaattgaatagaactatttcaaattatgattcgttactcagtagaaagttttcttaaatctatttttctcccgttataatattttttcatgtattgaacagtttatattcgtttttaaaaatttaaattatggcatatgcgaaaaaaactctaattatttgtttataatgatgatattatttttcggcaaaaatagaatcatataaagatgagaagtgaactataataattaataaaaaattaatatgataatttagatattaaatctaatttgttgattttaattggttacttttttggaaattaataatgtatttcgtttttctaattaaattaaattaattaaaatttagatatcaaatcttatatgttaattttgattggttattatttttggaaattaataatatatttcgttttttaattaaatttaattaattaaattagtatttgactttttaatctttaaagagataaattaatttactctttaaaattttatttctaatggtatacccatgtaattacttacaaaaattaaggttacattttaaaatgtacttcccaaataatatagtaggattttattaatttttatttgtctttaaacaataaagcttaaagcaaaagtgaaaccaattacaaatttacaacagttgcgatgtgtctagaaaagcgaaaaccgattttaaccctataaggccagaccaggccaaggcctatcatatcaaaaagggcaaaaacgagtgaatttggacaaaatcgaaaccaccaatcagaaaatatatgtggttaaaactttgaacacatcaataaacacgaaaagggtaataacgtcatttccataaattcgtaatcattcgtcctcaaatctttattgtcacttttacaaaaaatactcccaatttcagagaaacctgttgaaaaaaaattcagggaaaattggaaaaagtgatgatgatgacgagagatcaattcaaatcttaagtcctccaaattttaaaaatttcgatctccactaccttcgtcatcttcctctacttctgattctcttttctgggtttgtcgtttaatgggttgattttgtatcgtcaaaacggagaaaacaagaagacttcttttggttttcttattgcgaagaagatatttctagggtttcgagattttctgggttttctgggtttttgtgtgttctttgattggatttgattattgggcaatttccttggaattcaagaaacttctaaggttcttaaagtgtaaagctttgtgattttctcttattcatacattctaggactttggttttggagttgtaatggcttttgggtctgaaaatgagagcgagacgaagatggaaggttggttgtatataatacgatctaatcgatttggattgcatttctctagaaaacgttactttgtccttggagatcatcttctcaagagtttcaagtctatctccgattctaaaaccaaggtcaccaccatttgattaatcgcaagttcgtttggttgttcataatctcccattttggattaggattttaacttttagtagaatctgaatttggtttttacagaatgctggacgaagtgcggtgatagattcgtgtatccgtgttactgacaatgggagagaaaatgttcatagaaaagtatgaaagttctcatttttaaatctttagttgtggagtttagttatgcttttgttttaatggtttgtctggaatacttgtaggcattcttcatatttacactatacaatacatcaaatcacaatgatcagctcaaggtaaggtaatttctgttgttttgtttttatgttggtacactatatacatctctttttttcatttgttaagctttcttgttttaattgttatatagttaggagcaagcagtcctgaggatgcagcaaggtggattaatttgattaaagaggcggctttaaaggttatataaatggcaattagtaacaagttaagagctcttcttggaggttggagacttatagttatatgttttatgcagggtgccccttttcctggagatgtttttaattgttccaggagtcgatgggactctttgaggtacctctttttttccacgtaatcaattggatacatctctaagctaactgttaaataaattgctgagccagtagttcctgccaatttttgttagttacgtagtacagataatggtttgtggttacttaagaaagaaaatttctgaaatcagattgagtagctcagtgcgggaccatcactcaaactctattgactggacacttcggtcgtctgcacgagttgatcctgttacaactgatgttgttgcgccttctccctggacaatattcggttgtcagaatggtatagttcatactcaaatttcattgatttttgtttggctggaatgcatagtgttaacatgtgttgcacgcaggtcttcggctttttaaagaggcaaaagagagagattctctcggaagggtcggtatttttttcactcttaatctgttgaaaaggtattttgggtttattgaagggaatcatgttttgatgattttgttgcatg

SEQ ID NO: 26415 - DNA, 3003 bp, Unknown
  misc_feature (1)..( 3003): 2750-1469P.txt file - cDNA_ID_2713290; gDNA_ID_2214608; Annot_ID_135706
tcacaggttgtgtttcaataatgttcctgaagctctctcacaacaaatttagcggccgttttcttccaagagaaacaaacttcccttcacttgacgtgttgagaatggataacaacttgtttacggggaacatcggaggtggtttgagtaactccactatgttgcggattctagacatgtccaacaatgggctctctggtgctattccaagatggttatttgagtttccttatttggattacgtattgatatccaacaatttcttagaaggtacgatacctccttctttgttgggaatgccttttctttcgtttctagacctttctggaaaccaattttctggagccttaccgtcacatgttgatagcgagctcgggatatatatgttcctacacaacaacaacttcacagggccaattccagacacattgttgaaaagtgtccagatacttgatctgcggaacaataaactctctgggagtatcccgcagtttgacgatacacagagcataaacattcttttgttgaagggaaacaatttaacagggtctattccacgggagctttgtgatttgagcaacgtcagacttctagatctttcagacaacaagctcaatggtgtcataccttcatgcctctctaatttgtcatttggacgcttacaagaggacgcaatggctctcaatattccgccctctttcttgcaaacaagccttgagatggaattatacaaatcaacttttttggtagataagattgaagtggaccgctctacttatcaagaaactgaaatcaaatttgccgcaaagcaaaggtatgattcttatagtggaagatctgagttcagcgaaggaattcttcgtcttatgtatgggatggatttgtcaaacaatgaattaagtggtgttatcccgacagagcttggagatctcttgaaactacgaaccttgaatctatctcacaattccttgttgggatctataccatccagcttctccaaactgatagatgttgagagccttgatctttctcataacatgttgcagggaagcattcctcagctactcagcagccttacctctcttgctgtgttcgacgtgtcttccaacaatttatcaggaatcattccccaaggaaggcagtttaacacctttgaagaggagagctacttaggaaatcctctgctttgtggaccaccgaccagtagaagttgtgagactaataagagtccagaggaagcagataatggacaagaagaagaagacgataaagctgctattgatatgatggttttctattttagtactgcttcaatttatgtgaccgcattgataggcgttcttgtacttatgtgctttgattgtccttggcgtcgagcatggctccgcattgtggatgctttcatcgcctcagctaaacatgtgttgccttagatctgttgagcttagttcttggatatttcagtgaaattttgtttatgtatggtttgagtgtttttgtagtgtaatttacgatgccttttcacttatgaatagttgtgtctctttatctcaattttttgttaaaatatttaaggttttttttgtctttttattgaatcttttttttattgaaatatttacggattttttaaaaggttttgtcctcttattacatgtcttttgcacttttgaacggttgtgtctttttaatgcaattttttgttgatatatttataaattctttcgaatgtatctttctatcgtatctttttgttgaaatgtttacgattattttttacaatcgtatattttcagtttacgtttgtgtctttatagttgtatctaatcatttaaagttatgtctcttcattatattttattgcatttactcgtcacaatttctcgtatgagtagttgtctatctaaatgtttgtgacttttgaactttatatatttgtcactttctaagtgaatcccaaatttttgttcttttacacaaatttgttttattataaatccaaactaattaatctgtaaagtagctccaagttctttactctctaaactatttttaaacatacattatttcaatattaaagaaattcctctaatttttgatctaaaaaaaataaaaaattggcatcttcgttagaatttttatacttttttaaagttgattaaaaattcttcatttctatgatcattccaaaatttgatttagaatatataatttttaatgaactttaaattttagattgcaatgtattttgatttattgttaaaaaaaactttttaaaaaaaaattatcttagtttatgacttttcgtttcatatttgtttattacaaacttttttgaaataattttctccgcgatgtcgccggggtctgcgtcctagttattagtacaatggaatcaaactaatgtaaaactgtgaacttgacggaaaaaaaaaaaaaatactgtgaacagcaaagggaaaaaaaaaaaagaaaaaaaatgtcagaacaaatccttctcctccattgagacagtgtacttctgcttcaatggacatttgatatcatcaaatcctgcgtcaggtgagaaagacgcttcgccgttgtcagagttccttttctttattctctgtagaaactagaggcaaaaaatgtcggaagttttcatgaatctgagtaacttgtatctgcttctgtttacatgtttctttggtccgtagatcgaagtagaactgtcacttacagtttaagactagtaagctcattactaaacaactgtattaacaagatttaggcttctttttttattagaatgtttagatttgcttctaattcagatgtaattttagtttattcaatctcaagaaccagacgatgagttatttacatgaaagataggcttaattaggttgtttctattggcctaagtgaaatgtgtgcctcctatgttgggtgttttaactaatgctgattgatatgtcatatgttgactgattatgttactgtgtttgtagtttacgaatg

SEQ ID NO: 26416 - DNA, 3000 bp, Unknown; identical to SEQ ID NO: 13250
  misc_feature (1)..( 3000): 2750-1469P.txt file - cDNA_ID_2713298; gDNA_ID_2214608; Annot_ID_135704

SEQ ID NO: 26417 - DNA, 3003 bp, Unknown
  misc_feature (1)..( 3003): 2750-1469P.txt file - cDNA_ID_2713342; gDNA_ID_2214610; Annot_ID_135741
aatgtcatttaatcccccaactttcaaaaaattggccattttatacatcaacttcgtatgtggctgtttaaaacatgaactaaacgttgactaatttttaaaacatgatctttcattgatcaggccaaaatagacatgccgttatcagtcattaacggaacttctaacgtccgttatcatccgttaactttattagtcaagtttcaaattgtggccattttaaacatcaacttcttatgtggccatttaaaacatgaactaaacgttgactaccatttaagacatgaaaaattcgtttacagggccaaaatagacatgtctttatcagtagaacctagaaacccgttaatgactgttaatctgtccaaaacaacgtcgtttgaaaataatcgaaagaacataaagatttttcccatatgaaattccatattaaaaagttttaagcagaacccaagaacatagtttgataaagcgataatcgcagtgccagtaattggaaacaaataaaggtgttttcgtttatatatttgttttaaattttaaaaggaatcatggaagcaaattgaagactcattataagattgttcgtcttgtttgggcggttgtagaaatagatttggggaactagggtttcatttagaaaacaatcctgattttcttttgattattctcaaaacaaagtcgttttaggaatactaatagactcgttaacaagtgataatgaatgttataagtttttttaatgaatgatgacaacatgtttattttggcttggtcaacgaatttctcatgttttaaatggtagtcaacgcttagttcatgtttaaaatggccacatataaagtcgatgtttaaaatgaccacaatttaaaacttgactaataaagtcgttaacggatgataacggacgttagaagttccgttaatgactgataacggcatgtctattttggtatggtcaacgaataatcatgttttaaaagttagtcaacgtttagttcatgttttaaacgaccacatacgaagttgatgtataaaatgaccattttttgaaagttgggggattaattgacatttttccctattttttaccaccttttgcaacaataaccttttatgttgtacatttttaaaaataccccttccctttaacagaatgaccaaattactctcatctaataggaacatgtaattggaaactgaaattttctagccaaatttatttttcccgcaaaaaaaaaaaattccgccaaatttttttcccgccaaaaaaattcccataacaattttttttttcagccaaaaaaatgcttttaaaaatccttgtgaaatatttttagcggaaaatagatttacaaaggattttaaaagagttttaaaagatttactagggatttaaaagagttttaaaatatctacaagggattttaaaaagattttaaaagatttacaagaaattttaaaaatttttaaaaagatttacaatcgaaccgacccgaacctgattggacccgaaccgagattttctatttattctattgaatcctagaataatatacccgatatacccgtacccgaccgggtattacccaaacccgacctgcatacctgaatgtcctgccctactacaaattttgatatacagtattgctaaaactttatcatcgttttgttattaatatgacgcggttaaaaaaatatgagaagtctacaaatttttagacgtagatgagataataaaaaggaaatataacttttctctattattggtatttagtttttataaacaaaatgtttacaaaaaagaataatattttttttgtaataataaactctgtaaattgtgtacttttgtgatatataagcttcaactttctatatactttttaatctttgtttttttttttaatttaaaatctttatataagcaaatataatttatattccactccgtttaaagcaccatcgatgaaaattcccggtggattctcgccggtaggaggagatgtctcaattttcactcaaatcttttttagtttttaccaaaaatatattaaagtaaaaggcaaaaaatcttcaaatttattcttaccaaccaaacaaacaaaaagaatccttgcaaaataatcataaattttaaatattttcccatttaaagagatatgcaagtgagaacttttgagaggcgcaacaacaagatggcgcataatagcaaaagacctaattttgcttctgggtccttggattttcttcctcttcctctttattcccctcaaaacctaggagcccaacgagagcacccctttcctcttcttctatatccctttttatctcttcgcagctttctctcctctctcagatctatactctcttctccttcacaatcgttcgttttatcctctccatcggattcgtcagatatcttcgatttctcgtcgtttcatcggttccaggtcaaatccaggtatgtcaattgtaaaatttcgatcagattcgtcgatttcgatcagctttttcgattttggatctattttctatgaaatatcagatctggtgattgttttacatatttttgggttgaattcacaagattttctggaaacgagatcgattaattgagttttctgtgtttttatcttaagctagatctcgatttctatgtttttggattgatttgataagattttcgagaattttttgtgtttttgtcaaagttcgatctcgatttctatatttttggttgaattcacaagactttctggaaacgagatcgattttgtgagttttctttgtttttaatctcgatttttggattgatttgagaagattttctgaaagcgagatcgatgtttttggggattttctttgttttgttcaataattcggtctctgttttcttatcaaaaaattcgttttccatctcaaatcgatgttcttattgatttaattgagttttagtttgcagggatttgatcgttggtaagctatctttcagcaaacatg

SEQ ID NO: 26418 - DNA, 3000 bp, Unknown; identical to SEQ ID NO: 13279
  misc_feature (1)..( 3000): 2750-1469P.txt file - cDNA_ID_2713360; gDNA_ID_2214611; Annot_ID_135764

SEQ ID NO: 26419 - DNA, 3000 bp, Unknown
  misc_feature (1)..( 3000): 2750-1469P.txt file - cDNA_ID_2713381; gDNA_ID_2214611; Annot_ID_135749
ctgcaaaagaaaaaaaaaaaaaaaaaaaaaaaacctccacttcatcaatttttgcaactttagctcgtacttccgaaaatacggaataaacattatatgtatactagataaggcccgtctatttaggcgggtgtacccgaaattttcaaatattcgaacgggtctaaacttcaaaatctgaaaaactcgaacccgaacccgaataggtatccaaacatatttcaaatataagtatatattagttatatttatacttatatatagaaaatattaggattttttggatattttagttatttttgtgtatttttagatatattcaagcaaaactactcgtgttgttttggaaatttttgaaattttaagtaatttaatagatttgcacacaaaatttgatatttcaatatataaataaactcgaacccgaacccaaaccgaacccgacccgaaatcttaaattacccgaacgggtcctaaacttctaaacccgaaaacccgaacccaaaatacccgatccggatacccaaacgcctagggctaataattaataaaaaaaagaaatccacaaaaatatttagaaaccaaacattgttgaaaatatattttctatatatgccgtaatctcgtaagttaattttacatcatgcaaattaatattaaatgagttaaaattaataaatgaaaataattgaaaagttaaatcctataaactaagctatttttctcaaaatgttctattttcacttatgattacatgagttaaagacaaatttgttatttttccttttgttgaataaatgttaattgtttataaatatatagacatataaattagtatatgtaaatttgtttactttttaagattttctattttttagagaataaaaaaataaattttgaatgacacatgtaaacatctgatcgtttgacttgacacgtggcacaatcctttgagttagcaactttgaaaaccatactttatataataagattgtaaacgtctgcacgttcacatacattatattttaaaaactctaaaggtggagttgaactcttcgtcgcgagggcttcgtttgacatattatttttcaaacaattacaaacttaacggtagcggaaaaatgttacattgcgtattattattaacttcatattattagtttgcatttttttaatgtagatgattaaattgcaaaaattgataagttgaaagctttttttgcacaaacccctactttaagattataagatatgaatattattatcaaggtgatgaactttgatagcttactttagttattgtcacaatcttatattagtaataagctagcttccaaaatatcttacaagttgcttgttcctctaacttaaatctcacaaaacttaagatatggtaaattgtctagttcttatcatcttttcctagtcaccaatcaagttcataactagtcaccatagtggtcaatattttccttctattgaacagagcaccataatgattattattttggtatcatacttatttttgttgaattatacatatgaaagttagttaattctttctgtatgaaaacacgaacgtgttaataaaaaacagttagctaaaagaatctttcaatgtctgtttccactctttttcccattaatgaatcctgttgaagttcaccctaagtctcccatagaagcacatttctggagatgtagcgattccacaaaggtagattagtccaaagaaagaatgagtccttaacaacatcgactcatacttatgtgtgttgtatacattttcgtgggcaggtttagtacgaatggctgtgtctttgcctacactctcaccaattcacaacactaacggaagttcatgctggatgggcctttaggattcttatagaacacagagaagagaagaagattaggagagtagatagagaagtacttcttgttcatataacataagtgtacagagaaaaatggtgataagccaaaaagaagacaaagatttgtaagtagaagcaaatcaaagcgtgtagagaactttttttgttgatacgatgtatagctttcatgggtacataatacaaaatcttgactgatgaaaacgtgttgttgtgtgaggtttattggaaaagaatatgatttttttcgtccggaattgtggcaagagaatgcgcgtgaaataatgaatgaaacataaaaccatttattagttatggaaggaagttgttggatacaactaaacacgtattgaacataaacatagtaccatcatttcgatttagaatggaagtggatggatacacctaaacacgtattgattgatagttggaaattaaaataaccttttgatttttcacattttttaacctttttgtgttttcaccttgttatgggtaaattaaaggacagaaaaaatatgatgaattcagtagaaagtaaattacgtactctcaaatccgaccaaaaaagaaaaattattgtcttaaagtataagcaactctcaagattttgttcctaagttatagatttttactaaaaattattttgaaaattcattcaaatttcaaacttgtatctcttaaatcgttaattaaataacactaaattttaagttaatattctttctatatttttcaattttcacactcaatttaaatttaatattacataatttattcactaaaccttcaaattattctaaaaaatcaaacatatatacagtctccaataaacccctaatcaaataatcccaaaaagttttgagtaaattctgcgtttcctctttggcttctcgaagaggaagaaaactttggcagagagcgaagcatcacacatattttggcctctccttcacgatattcgaagaagtctcctcctccttctccaacgaatcccagatcaggcggcaagtaggcgaatccttacgaagaattctaacttcatcatcaacgatagatactctagtttgattttcaaagtagtagtgtaaaggaatcagaaatg

SEQ ID NO: 26420 - DNA, 3000 bp, Unknown; identical to SEQ ID NO: 26419
  misc_feature (1)..( 3000): 2750-1469P.txt file - cDNA_ID_2713381; gDNA_ID_2214611; Annot_ID_187367

SEQ ID NO: 26421 - DNA, 3003 bp, Unknown
  misc_feature (1)..( 3003): 2750-1469P.txt file - cDNA_ID_2713393; gDNA_ID_2214612; Annot_ID_135782
tgcaagaagaccgctgatgcatccaacatagccaaactatttttcaaggaggtagtgcgccttcacggggttcctaagtcaatcacttcggatagggatacaaagtttctaagtcatttctggtctactctgtggaggatgtttggaacagctcttaatcgaagttctacacctcatacgcaaatcgacgggcaaaccgaagtaactaatagaaccttgggaaatatggttcgaagtatatgcggggataatccaaagcaatgggatttagctttgcctcaaatagaatttgcttacaacagtgttgtacatgtggttgatttggttaagttaccaaaggctcttgggtaagtgcatcagctgaaactatggctgaagagattttagttgttaaggaagttgtcaaagctaagttagaggctaccgggaaaaagaacaaagtcgctgctgataaacgtcggagattcaaagttttcaaagaaggtgatgatgtgatggtgctccttcgtaaagggagatttgcagttggaacgtacaacaaggtaaagcctcgcaagtatggcccgtttaaggtgttgcggaagatcaatgataatgcttatgttgtggctctcccgaaatcaatgaacatttccaataccttcaacgtagctgacattcatgagtatcatgcagacggggtcctttatccagaagagaacttgaggacaagttcttcagaggtggaggagactgatgtaggagagatttagcagttttacatttcttttcatatttccttatttcaagttttctattttgcttagagttttctattttatgatttggtttcttctctatatatagaaagaccctaagttttttgctcgacacgttttatcattttaattaataaaagcagagagtttttctctaatctggtggatttccaaagtttcaacctttcaaattcgacgcttgcgaacttgattcatgtttaggcatagtgattgctattcctagaggttccgactccgtaagtattttaattctatataaataaatgaagaaaaaagtaatcataattacccaaataaaacagtttgtttatattcctttttaaaattttaagtaacatcgttaatgtgcttagtgttctttatgttttgcttcccgtcaatattaaataatctttacatggaaattaatcggtctcatatataaaagagaaattgaagacgattaagatgctattaactttatttatgagtatgtattatgtgaaacaccttttatttataacttcaacataatcgtttctaatctttcaaaaaaaactgcctaaatatttttaaatcgttacgtctcaaatatagtctttttaaatatagttaatttatcaaccttatatatttttggataaaaaacatgatttatatgatcaatttagatgtatttttagtattagaggttttcctaagaaaataaatcatgtttttatgaagtgtaagtttctgaggttttttcacaaacccccaccatctgttaatgcattgggtctaacttcatttgatgaccgacttcaaatgaattatttacataggcatgaacaaaattttaaattttgataattaaaataatctttaacaaagaaaaaagataattaaaataatcacagttttttttcttttgagaaatataaaataatttagaaaaattcaaaagaaaacaaaaataaaagagggagaaagagatgtggcatgagtgatgggtgtgtatgggagtgagtgagagctgtgaaagggaagagtcgcagagagtgcagaagttttcagagtttgcagactcactcattattttccctctctctctctcaaacttttttacttctattctcataaatattttttattcaaaacaatttattattcatgcatagtgtttttaacacaagtggaccgtgtacacttaattttataaatgtcgaatgtgttggagctacgagtactacgagtcgtctatctaaccaaagatgtcacattacacgatacggtttatttgattgaagaacaaaaataatgatttggtataattcaaaatttataaactcattacaattggacttctttcattttattttctaatactataatgaatgattaagagaatgttctttgtggttagctaaacctttataacgatctttgtaatagttgcaatatgcttacatgtttctttttttatagttaaaacattaagaagaatagaagagggacataaatcctctcacttggctatttacttactatatttaggatcgaatataaatgctaaaaacatcttaaatattgtagggttaaattcaagcttctttcacaaataagtattttttttttcttattttttctttctcacatatactaaagtttgagatataagttatatgactcaaaagatatcataacaacccaacattagagctgaaatttttaatgtcttattattttgtacacaactttacctcttaagtttcatgacttgttagattttttttttgtcaaccaaaaataattagaacttaatagagtcaatcccgaaggatattgtttacgtatacgtatgtaacttggtagattctcttttcggttaccaaattttctcgtttttctaaacgcaaacaaaagttacaaactcctgaatataatacgtaaataaattaaacataagttatctatgccccttgtcacaaaatttagcttttaagaaggaaaagaaaaacctgaaatggtgcttaagataaaaccaaaactaaagctgaaaagaaaattttaagaaataagaaaaaggaataataaacaagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatg

SEQ ID NO: 26422 - DNA, 3000 bp, Unknown; identical to SEQ ID NO: 13300
  misc_feature (1)..( 3000): 2750-1469P.txt file - cDNA_ID_2713397; gDNA_ID_2214613; Annot_ID_135791

SEQ ID NO: 26423 - DNA, 3003 bp, Unknown
  misc_feature (1)..( 3003): 2750-1469P.txt file - cDNA_ID_2713401; gDNA_ID_2214613; Annot_ID_135788
gttagatgattaataaaaatgaaacaggataaaatatattttttaattgtttatgtgaaattttcttctagtgatgtatcatcatttgtttatgtgaaatttgatattccatatgttttagtatatccataagaaactcatatctaaaactgatgtatcattatccattaatattaatttgttgtacaagtgaatgatagttaatatcgcttatatacgtgatttcttgccgcatgtacgtgagatcacacttcatgtgcatccaaaaatttgcattttatttctagaaattaagcgacaaggaagacagagctagagagtactgtctttactctttagacgtgcatatgtctcctcgtactaattactcttttaaaatccttgcatttcattattttctgcgacaacatatttggtcggaacttgccaaatgatgtagctattgtccacgtgatgttttagtttgctataatatgttttaagtggatccttactcaacattaacaccaccctataataataaaaaaaatttaaccattcattattcaagtttgataaccaatatatatccgttgctcaaaaaaaaaaaaaaaaagataaccaatatatatcttattgctgtatttatctttatatagttttattttaatagtttttgaaaactgaaaccataacaagaaagcgtgaatccaaacgcattcctatgaattgtaaattgacaagtagcattttagaatagatggaatctaatctctaaatcgtaaccgaataaatggattggatccgttgcacagatggtttacaaagataatcatattataactaatccgaatttcaatcttgttttgatctatcttttaatagcaaagtccatgagtttagtgtttttgagattcctggaccaaagggtcatttttcgcatattaaaatgaatgagataattacgacaaaaaaatgaatgagataatttgggaaaattaaatatatacaaaaccattattatatgaatgtactaaattatttttaaatttttatatttcacctatacctaatacagaatacagtgtcattgctttgactccctccaccaacaagtgaaaaacctaataaaattttactaatagaaaacgaatagtggaagaaaccatgtaatgtccaatcaaccagtaaatcggtttaaaatatataaaaagtcagtattcttaagtagaaagataataaatttgtgcaatagtaatcaagatagtagatacgccgttggaatcaaatcttcttttcttgaatgtgttgttaacttaagccaaccatttgattctctttactgcagctatattaattattaaacaccaatgcaataaccatacatttcttcgttttatttagtctgtatattcgatcatgacatcattctcccacacttccaaaaaaaaaaaaacaattcgatgacgatatctatattagttgagacatgcatatctacaatacgaatattcgttattctcatttactgatgtggcgattatgatttatgactaaacgagtgattaactatatacaaaaagtaacaattaaaacaaaagtaatagaaaaatattgtgaaatgaaaattccagtgtatcactaatgaagcaattaagaatagaaaactaatactataatgtttatattcccatccgtgcgtttccattcactttaagaaatgatcatattcgcaaccaacaatttgaagcaaacggtcctctactttttattgttcgttttctctttaccgaattttaaaatcacgttaattatctgtataactacctttttgcgttgaagtatttacaacttgagtaaaatgtagattcgtatcaggatacaaacacacaataatactattcagagttcttagtaaattagtttccttttgcagcgatttatttccgtcaagtgtataatatagttaaccaacataacttaagttaaaatttcccaagtatagatataacagaagatcaaatatcgactcgaaactgagttataattaaattaacacgtgaaaataaatagaaaaacaagaaaatatctcgcacgctttccaaagccctagaacaataacgttcgatggattggaaaaatctctgctggtacattcacgagccaacacgtttgcctgccacgttccagacacaagctagaaagtaacggcatcgtcaaatctaacgagactcatcaaggaacaatttataaacatcaatttctttttggtttcacacgccttattatggtaagaaactatttttgcctattgaatgaaaaaaattgataagacatatgaaggatgagacctaactatagtcttaagtacataacatttactactactcaaaaccgttgtctttaattttaacggtccacattcgttctcacaataattgaccatacgtttgtttaaatacttcaaaggaaaggaaaaacagcaagacgtttgtgaggtaatggacaaacgacacgtagtttgaaagatgagaaggaagacaaaaaggcatagagaggaggaagagaaggagcggtttcgtaactgaaactgaaaaagctttaagagaaaacccggaaaaaaaaaaagagaaatattttaatcaattcttctttatcacaaagagtgcctttgtattaatgaattttgatgttgtgtaatgaatacagacataaccgtcgtgtctcgtcgttaaagaaacgagagtttttcagctctttacttaccttttcttcttacccttctttcatgactcttcttctttgatgggttaataatgctttgagcttgatgatttcgattttagtttcctgttagtgtttgttttcttctgtaaagcttggattttttttggtttcttcgatggcgaatgtggaagctgatttcagaacatcaggtgagttcaaattttgacttcaattttctcaagttttgaattttctttttctcttgggaaaaagtcaacatttttaactctaatcatg

SEQ ID NO: 26424 - DNA, 3000 bp, Unknown; identical to SEQ ID NO: 13316
  misc_feature (1)..( 3000): 2750-1469P.txt file - cDNA_ID_2713416; gDNA_ID_2214615; Annot_ID_135807

SEQ ID NO: 26425 - DNA, 3000 bp, Unknown; identical to SEQ ID NO: 13317
  misc_feature (1)..( 3000): 2750-1469P.txt file - cDNA_ID_2713441; gDNA_ID_2214616; Annot_ID_135812

SEQ ID NO: 26426 - DNA, 3000 bp, Unknown; identical to SEQ ID NO: 13322
  misc_feature (1)..( 3000): 2750-1469P.txt file - cDNA_ID_2713445; gDNA_ID_2214616; Annot_ID_135810

SEQ ID NO: 26427 - DNA, 3003 bp, Unknown
  misc_feature (1)..( 3003): 2750-1469P.txt file - cDNA_ID_2713509; gDNA_ID_2214620; Annot_ID_135874
atcaaagaacaaatatattttcgttctaaagtttaatatccatttgattattttgaaaatttggttcggtttcggttcggttccggttctttcagttttaaaatttagttaccatttagttattttgttttgaatatttttggatattttgttattttgggatattattggatattttcggataatttttgcttatttttgagtattttattattttctatttcggttcggtacaaatttggtattttattattttggtttcggttcggtacattcagttcggtttatttgcccaggtgaagacgtagccactaaaccataagaacaaggcccatacttatcgcacatgggcttttaactgtttattatatataaaaagcccatcatgtggttcgttacaattttctgttaaaatgtttggcccattgtcgccgtagattgtcttctccgttcgaaatcgcatccatcgccgtcgtcgtcggtgacgaaaaccaccgcgtaaaaccgtttcctaaatcagatgttcaatcttagaagtatctcttagaagctctcttgtatgaaaaaatgggactgttaagcataatccggaagatcaagaagaaagagaaggagatgcgtattcttatggtgtatgtcatattcttaaatcgttaatcttctccgatctaatcgtacattatcatgttgtgctgattttggaatgtttttttggcagtggacttgataattctgggaagacgacgattgttctgaaaataaacggagaagacacaagtgtgattagtccaactcttggattcaacatcaaaaccattatctaccaaaagtaaagctctatttctctgctcttgtagtttcgtgttcttcagagttggtttaggaatttcatcgaacatgttataggcaatgatgagtttgtggtgaataatgtgtgtgtaggtatacgctaaatatatgggatgttggtgggcaaaagactataagatcgtattggaggaattactttgagcagactgatggtttggtttgggtggttgatagttctgatcttaggaggttagatgattgcaagatggaacttgacaatctcttgaaagaagaggtatattcataaaagtatcaatatctattcaatcaaaagcttttgtaagctgaagcttgggttgctgtttttggtgaagatgattcatattcaaatcttggttttaatggcagaggctagctggttcatctttgctgatactagcaaataagcaggatattcaaggtgcactaacacctgatgaaattggcaaggtaagggttttgaaactcataagtcgatttggacataggggttatcgggttgaatcattttgtctctcggtcgggtttctcaacttcagtgaagattagtgggttaagtaagatatgttttgagttgtatattgtgtgttaaactgagtttcatcttcttgcttatgaaggtgctaaacttagagtccatggataaaagccggcactggaagatagtgggttgcagcgcatacacgggtgaaggtttgttggaaggattcgattggttggttcaagacattgcctccaggatttacatgcttgactaatcgactactgcattgcacaatcaatggcttgttatactcaactatatgcagtgactttgtattggctctaagtttttccttcagttctattgtaacgatgattagacaaaacataaatatttccaagacgaactcttctcattttgtttcattgaaagagacttaacaacaaaatgatgtctcatacaaccaaataaaacttattgataaaaatccaaccataatctaccacagatagatgaaagttgtctctgcagagtaagaaggaagaagaagcatacaaagagagatcatttggacttctttccttgtttcttcttgacgacttcatcagtgtacattatgcctttgcccttataaggttcagggggtttgcaactccttaccgttgcagcaaactgatgcactctttgcttgtcgattccagtgcagcaaaccacattgttcttgaaacaaaagactcgaaccgctggaggaaccgcaagttcgacttcgtgactgtaacccaatttgaggtataagaaacgccctgcttcctcagctctagctttgtatccaactccaacaatcttcaagaaccggaaaaacttggcttccatgtctctctatcctacagagaattaccctgccaaagaggaaaatttctcagcttcttcaaattaagaacttggaaaccaatagagttcaccattatcataaaacgatgctcaatcaaaatctgaaggcagtagattttgtctctctagccactcaaatcacacaagtaaatatgaaaattgaccaaccatgctacgaaaaattgccatttttttcattactttgtatctcagagacgtagaaacgagcgatgagctaacacagtaaatacgtcgaacactttccgtgcactatttcaagaacaatataaacggaaataaaaactccagataacctcatttacaagaacatggtgacttctggactatgaacatcgccaaaatgagaaagaaaacaaaaatgttcgatactatttctaagtgattcatcaaaatagcggaaagggaagaagaagaagatagtgagtgagagatcgattataaggaacagttaatacctttcttgatttccgacgatgaatgtgacggctctgctttttcgccggcggatctagatcagtctccaactccggcgtaaaaccttctccttctcttaatttcgtttctttgagaagcatacaaagtggttgacgttttatccatgttaaaaaaacggcacgatgtttattcctccaacgagtgtttctttgaacaaagcccagtgggctacatcataaagcccaaaagccctttttaacttttcgatgttttgtttcctcgccgctcttttgaccggagagctctagaatctctcaacaatg

SEQ ID NO: 26428 - DNA, 3000 bp, Unknown; identical to SEQ ID NO: 13359
  misc_feature (1)..( 3000): 2750-1469P.txt file - cDNA_ID_2713515; gDNA_ID_2214620; Annot_ID_135869

SEQ ID NO: 26429 - DNA, 3000 bp, Unknown; identical to SEQ ID NO: 13380
  misc_feature (1)..( 3000): 2750-1469P.txt file - cDNA_ID_2713612; gDNA_ID_2214623; Annot_ID_135911

SEQ ID NO: 26430 - DNA, 3003 bp, Unknown
  misc_feature (1)..( 3003): 2750-1469P.txt file - cDNA_ID_2713615; gDNA_ID_2214623; Annot_ID_135910
ttgtccaccttcccaatgaatccccaaataggcaaatcatcataatacatctgaaagtaataatctttttcaacagctcttcgaaagtgttcaacttcttctctactaagcttctttttacagtacacctctgagtctttctcatctctaaagttaagcttgtatggagcactaacaagcctatccccattcaaaacctcaccaagagcttccttcttatctttcacaccctctacacaaaccaaaacaaatgcatattgacaccaaaatacacaaatccgaaaaaagtgaaaaaccacacataacagagacaacattgagcgtgctcgtacctggaatacaaaaggggagatcgaaatagcgatacgtctcactgcaacaatcatcaaacacaagtaaaaatcagtcatataacaatgcaatcgaagatctatcacattttaagaacacgaatcgaattttttcaaggtcagatacaaaaattcaataccaacgcaagcttctacagaaatttgcaacgatcaatttatcactcatcaaagagaatcacagatctaagctaccgacaaaggaactgagattagagaattggatttacctgggattgtgaaaggggccgaccttgttggcgtagagaggaacggagtcaccgtccttgtaacggtggtcggaggcatcggatctgacagtaccggcgccggagaagatgagagctccgataaagaggagcagcgtcgttggtaatctcatgatgatgtgtgttaatgtgagaggaagaagaaaatcgtgagatctgagtttgctttatatttttgagagcaacgcttatggcaaaaggacgattatattacttttatttattttatctctctttttaacgaattttcttctactaaatgcttaagaaaaaatattgcgaataaaaagcattatgtaagaaaataaaatctgcgacattttaatattttttttagaaattgaaatgattatttttatatattttatttttggttgttttcttaaatcttctaaacaaaattcgtattaattcacaaaattttaaattatttaatacgtttcgtaagaaacttgtgaatggcagaggcaagtgatataaactgaagcaaataaaactttctataatcgatattttttgttacaattgtcgttttttttttaataagtagcaattttctattggtagagtgattctctcgttcttgtgctttctactatttataggagttttattgcattccatgtgactataacaatcagtaatgttctttttactctttaacaaaatcatgatgatgaagatacaaataaaaaggtggtcaaaagaaaaaagatcaatagtgcctcgtttttttttttcacaatagtatctcgtttatgaaattgattaaagcaaagcaagtaaaaagtattatcaattggaatataaaccaaattttttgtacataaaatgaatgatgtagtaatttatatacctgattatcttaactaaactcaattttttgcaaccaaaccagataaataagaacactataaaattaagatgttaattacacagacaataattttatttatttataaagtttatttttgtaacagctctgatacttattgattttgcaccttctttgatggtggtggcgaatcatacactcatcagcgaccatgatatgtaatccatcaacgagttctctctgaatcttctcgcctggaaccagttttccagagcataaacataagccttagaacaaaacaaacatctactatcccctgaactactaatgatagagtaatcaatgtaaactcttttcctattgtagaatttaccattagacaaattattatgcatgttgttagcatctctactcttgaaaaatcttcgtaagctgattggaaaatcaaagaataacaaactaactaactaacaatcactactctataagcaaatcttgaataccaatagagattctttatgttggattctatctttgagcatttcattaggatcgacggttggtcgattaatcaatactaacccaaacagtcttttaacatgcacacttgataccttgtaggtgcttctgggtagcatgaaaatgataattggtgttattctgatatgcgaaattgaaaatgttgttgtgcatcagctaagcataattgaaagtttaaaaaatattataaatttaacgtgaagaattgaaaggtatcagattaatgttttggatcagccgaatagagtcaggctaatccaaattctcaaatattttcgaaaccttaaacacatcaaactccacgaagtaaacacactcacacacatatcaaaatccacattataaatgtatttttggtaggctagtcgtctaattctaaaatagccaatttacatttgcaattgtttattcaaaaaagtacaacagtaagaggtcttatcaattaaatcataagaaaaatatgtcccaaaatgtcaaaaaaccaactacgaatatttcttttccttttaaggccaaaccaggttttggaatacttattacaaataaactcaatttcaataaattcttgtacacaaattaagcactaatttcattgtgaagataccatagtcacattcacatctatatgacatcaatctataaaatccaaaacaaactatatattatatttatattatttttttgtcatcattatatttccattaatttatctaattctggttctaatatactcttggtcagaaaaaatataaacattgaagaattggtcggctgaaaattgtgaaaaatatatagcagaaaaatatgataatgttatcataaacaaaattaatagtaaaatttaattttaatttaacactacagtactatacacgtgtgtatgtatagctctataagtatttactctctttcagctatttattttttcagtgaacgagcattcttcttcttcctctgtgttgttgcttcttagatatattcaaataaaatg

SEQ ID NO: 26431 - DNA, 3000 bp, Unknown; identical to SEQ ID NO: 13390
  misc_feature (1)..( 3000): 2750-1469P.txt file - cDNA_ID_2713627; gDNA_ID_2214624; Annot_ID_135921

SEQ ID NO: 26432 - DNA, 3000 bp, Unknown; identical to SEQ ID NO: 13389
  misc_feature (1)..( 3000): 2750-1469P.txt file - cDNA_ID_2713631; gDNA_ID_2214624; Annot_ID_135920

SEQ ID NO: 26433 - DNA, 3003 bp, Unknown
  misc_feature (1)..( 3003): 2750-1469P.txt file - cDNA_ID_2713634; gDNA_ID_2214624; Annot_ID_135941
ggtttgatctaagcatgtcgaaaagaactcgaaaaccatggtctagtctcatcaacgatatgcatcaccatgcaatatgcacccaaagctcacaaccaaaaccagacaaagaacaagagcaaatcgaagacaaagagattgatcgtaagagtttgaacaatctgatgagatgcgatgagaaattgaatggagaagctgatgttaacaacaagagctctctagatcaacatttcgaggatggcgaggggatcaagccgacgatgcaattggtggtgaagaaagagaagcaaggtggtttgaaattcaaaggtatggtgggtcgatatgttaaggtctggagcggtttgataaaggccaaacgtgaccacaaatcgccggtctttcggtttaaaacttgaatcctatatacgtacgtttcatatacgtgatcacatatatatatattatacgattagttattagagataagctgtagactaggcagttttttggaatgttttgcgtacgtacgtattattgatgtgcacgtttgttgttggcatattggttttgacttgagattgtaattagcactatatacatgcaactcttgttttttttgttaagaatctcactacatgagttttgctttgtgttttgagcttttgccaaaaaaacaaatctgttaaagtcttttcgtcgtcagatcttagggtgttacggttgatcttttttggtttaacggtctaaactgtagtcgttctttgccaactagttacgattaggtgaactttaggtttatacataattgtaatatataacttttgatatttttgtagctctaacaatttgaagtgttttttataaagaaaaggcaaaacataaagagaaaccaaagataatgttttaaaacataaaatatgttcttaaatacaaccatttttgtttttggataattgttttacttctgttttccaattaatattcgcgatattataacccaataaaaaaaaaaatcttaaagaaaaataaaacacgaagaatgaaacaaatttaagtgttgtggctcggattgtgagttgtgagtttttgtatttttcatatatatcagatgacacatcgtgacatagatgaacaatttaactgacgatgtctgactaagacctatcctcattttctgccattacaatagttacggggttaactaattgccaaatgtttaaaatagtttataggtaagtaatcttctcagtcaatcaaatattatttttgttatactttttttttttttggttttaatgttaagggtttgttttactttatacgtaatacaatacaatttctttctaatttaatcaacattgcttagtttcaatccaaattacataatataaaatatgcagaagcgtggcgattttatagctatatatataacctccaaattagtgatgctttaaattcatttcctaagaagataacatataataatatcaaaatatcattgtaataaataactttaacactctatgtagttcatccatatgatttatcatatactaaaaaacgagtaaatactcaagaagtcacatgaataattaacataattaaagacagtttttgatcctcgaaaaacatatatagtatcaaatttgaattcttcgttgttagattcagttagtttgtctaaattaaaaatatatggatgttgtttttttttgtttttttataatcatgtagtttacgaaatgtacaaaacttctcaaattcaatagttaacaagtttttttgtttttttttaaacaaaaaaaaaaagacaatacgtaacaagttgacatcatgaaactatatttgacgatattgtttgttgctcttacaatatgtcaataactatagcctaaaatctttgtcgttcaaaattttcctgctctttatttccctagggctttcacaacatattttccggcttatcgagtttttattgtcgtatcgtaccgactactaggcgggtacgcataacaacgtagtttttttttgttcacaaataacaacgtagctaatttatttatttttcttatattatcatagacttttgttggttaaataaaataaaataaaatgagaacgtatcaggtgacctcagatgtaaggaaagggtcggtagtacgtggcatattatcattgggtatcttttttaccaattaaattggagatgcatcatgcatggcctcaccgaccatgttaagtaaccttgtggcaccgtcgaaaagcaagaatctttaactaaagtgtccagtcagctctttttcttttactttatttcggctaccaaacattattatacttcacaaaatatacgccaagtaatttttttttttctgcttaaaagtagatttctgcaattataacttttaagacaaaaaataaatgttttaacaaatgttttaagaaattttaagcttaaattttgtccagttttgatcccaatttttgtccagttttgatcccaattatgtaccaaaattataacttaatatttcattatatcaaactgtatttcaatatatatacaaaaatttgttgctcatatcatcatatcatatcaataaataaacatacgtcagattacatttatagttatatatatatataataaatttagatctcatattctcattgttattttgattaattccgttagttcatttaacactcgcttaatccagtttgattcataaacctatctgtaaatttaaataatatattacgttatccattgtataaaattaaatttctattactgaatacaaaagaacgtatttaattacatttttgtagaatccgaattccgaagcaaattaaacattaattgttaattaatttctctttataaaacccacctcatcctccaacttcttcatcaatctcaattctcaaacatcaagaagtctctacaaaaaaaaaatctcacatctaaagaaaactctcaatagaaaacaattaaacaacaatcaagaatctataatg

SEQ ID NO: 26434 - DNA, 3003 bp, Unknown
  misc_feature (1)..( 3003): 2750-1469P.txt file - cDNA_ID_2713642; gDNA_ID_2214625; Annot_ID_135963
tgaggaattttacattgatgaatttgattttcttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggttggtaatgttgtctccaaagttttctgtttttaacccctccaatatgtatacatagcaaacaccataaaaagacgcatgttttatgaggcgatattgtttcaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatggtgagaatctctgtccccctctctctctgtttcttgattttaagatccttgtctttgaatagagttaacgatgatgaagctcttgctttgtgccttattttaatgtagaagcaactcctaaaggtgtcctgaagcatatgaaagtcgaaggtttgactatttttcatgtcaaaagtcatttgcaggtttagtttttattttttcctaacatatgtttatcctaatcctcatagtctgtttgtaaaagtctacaatttttcttattcatattgcagaaatatagaacagctaaatatataccagtaccatcagaaggtaaaaactgactcttttatgtagagtcttcatgtgcatttatttttcttaagatgagtaaatattgtagtagcttatatacacaaattcgatcagctcttgttgatctatcttattctactcttatcttgatatttaagttaaaggctctcgacattgtttgcttgctagccactattttctgattttctagactaagaaccctcttcccggactcatttagcctttgttataatctgagcagttttttttatgtttaacttcctacagacgatttttactttaagatgactttctttgatgattagcaggttcgccggaggcaaggttgacaccgcttgagcaaattacatctgatgatacgaaacggtggggtttggtgacatcacaattcacaactgctacaccattatcctttctaataaattgacattactgattttgcagtgggatagatatcactgagactctgcgaattcagatggaacatcagaagaaactgcatgagcagcttgaggtacaacgatgaacatataatgagtcttagctttgtggtgttatctgtttatattccttgaagttgcatacagtagggattgaaaagggggcttgttttgatgtgcttgcagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcaggccttttctcttttttttttctttcttaaaactctaattttctgattctcagctctctaggaagaaacaaataaagagcaattccatctttgtgatgtaattctgagtgcagagattttagatttagtgtttaggtggattttaaactagcttttatttcgagtttcttcctgtatactgcgttaatttcataattgcatgtatggaatcaactcatgtaagttagattaatcttcgaaaatatttttgcttttgcatatggaagaaagatatgcacaagattaaaggttttgtcccacatcgctaagctcgtgaagcattagtcagaaccaacctgtatataaagaaagctgggccgatctttcaaatcatacctttctcggccttttggctaagatcaagtgtagtatctgttcttatcagtttaatatctgatatgtgggccatcggcccacacgatattaactctattttttaagggaggaagcccattaaggtagcttgctacctgggtttccgcgagtcgcccatgcgttgcactactgcacgggcttggctcaacccgccaatcgaatagtaaaatgatttactttactttataatttccaaattattgatataagcgtagttaataaaaactttttgacggagctaaacactaattaacctacgtcttctcgacagaggacaaactcaaattcgtaggtgagaaaaattcgattttggaattgttcatattctaggtttgagcttaattggatatatccttggtgattggttgatttggattcgattaggtttaagtataggttttgatatttggattttggaagaaaaagagtgatg

SEQ ID NO: 26435 - DNA, 3003 bp, Unknown
  misc_feature (1)..( 3003): 2750-1469P.txt file - cDNA_ID_2713658; gDNA_ID_2214625; Annot_ID_135954
aatattcaaccgttgggtttggtaaagccacattcaaagtcaattccaaattttcaacgcttacaagtttaggacctgaacttttagtttttcatatattggttaaagacttttaatttcttttaattttatccataacttctacaaagtcaaatctcgtaatcaacattaacgttcgttaatactatgaggtaatcaagtataagattcatttaaattattccggaatccgagtcatccgatattatgctagacctgttcttttcgtaaattaaatatctttgacttatagatcttgtaagtacttgatcctaaacaaattattgattgctaaaagtgtatattgtgcaatcaaaatatttttaaggtacatcgtgatataattgctataattctcttaccactatatttgtttcctggatggtttttccttaagtagtagcatttacaaaactgaataaaagtagctagttaactttaagcaaaatataaatataatgattcgaacaaaatataatttatttgatattttgtagcttggcttaacattttaaaacttgaattggaaagtaatggaaacaagctaaaaagacatttcatggatgattttgtaatatttttttgattaaatgttagtagattcatacctaataaagtattttctttatattgtcattttttaatctaatgttcttcaaagataatgattatagatttagataatagataattgcccgtatatatgtagattttatatatatatatatatgataaaaaaaattgaattgacattaataacagtgaactaaaaaccataattttgaccaagatttatagcttaataaattgtcttactattatcgttgatgtatcacaatccttggtttaaaatccagatatgattgaatgttgtcaataataaaataaaaaaaggtcttagggggtgttattggtttatgattttaaaagagttttagtgacttaaaatgtcatgtacaatcagttgttattcaatcaagattctttatttagatattacgttgtgaaatccacatataacaatgttgtcaaagttttagagtttcttctttaaaatttgattaggtgaataacattacatataagtaatgaaggaaatgtttgttttgtttcaggaccttaagatgtgagcaccgctggtaacgaactagcggatattacaatttgttttcatatagaaaaatggctagaaaagaagaaccacacaccttaaaatgcaatgatgaaaattgtggcagcatggtcatatgtgttaaaatgcaatgatcataatgggacataacactatgttgttgtatcatgaatcaaggagaacaaagtttttagctaaactcagcaaaattgctacttttaaacttgactagagcgaagttgagaattactactaaaaagtttctgaagattaaataggcaaagaaattacagagacaaataaataaagagagtaatagcttggaagtgaaatttataattcttttgagttataagtcaaacgaatatatatgtttatgagttcaaagctactaaaaaagacaatatatatttttaattctttttttgctaattacactatagcgatgaaatctttggtaagggccttagaagttcacgatttaagaattacatcgattaaagtcaaatttcttgcatccctactcaattttgataacatttgtggtaagattttggaaaggattatttgaaagataaaactgaaacttcatttagttaaacttagcgatgaagtcaacgattaagggtttgtaagaacagatagtgcaccaaactcataattatgcatagagctagaacttggaaacaaatctgatgatcgaaaatcagataaatgaagtttctgctccctcttcataattaaagttgctatttaggtattatagtttcaaatatttttgcatatataaaatacgtccattcaaagacatgcaccataacatgcaaaagtaacataatggagaaaatagtaacatatgttgttattataccatttttgaaattgttaataagcttttcatattttctactattttttaaataacgaatcttggcaaaataaatgagagattattttaaatgactacataagaataccagatttgctattcctttttggtaattgtgtgggaatgaaagtaatgaagtttaaattagacaaaacaagtcaaattaatcaacaattttggttgtatttgctcataacatgaagaccacgtttagtagagttaaaggaaaaaaaacgtgagaggttaaaaagacaaataaaaaaagataaaaagctgttcttctcctggtctcaagtataacctcccctttttcgtataattctatttttagtacaaactttatttatctgtctttttcacccctcccagagaagaagattcaattccacttttgttgttgtttgttccaatttgtgttttgtaatcttcttctctccctaatcttcttcaccgcgcattcatttccttccctccataatccaagcttccgttacaagctctctctctcttcttcctctttttcgtgtttgaattttcctgaaattaaaaaacaaaatctctcaggagcattattgattttgctggaggatttgaaaggtatctaattcttaaattctgtgatcatcttcttttgattcgcataggctggtgtttagctggaaccttgaattcgttcttaccaaaaaaaaattgaattttcttatgatttcaaactcttctaaaaaaattagggtttcgttataaataaaggattggtgattcgatgatcgtaggattgtgttgataatattgctttgtttttgattagattgttgatgtgtttttttttgtgtgtgtgttttaggagagattttgttggtgtgttagttgtttgattttggctgatgttgtgtgagggaggaggaggaagtggtgtatgaagccgagctttaatacggatatg

SEQ ID NO: 26436 - DNA, 3000 bp, Unknown; identical to SEQ ID NO: 13413
  misc_feature (1)..( 3000): 2750-1469P.txt file - cDNA_ID_2713662; gDNA_ID_2214625; Annot_ID_135953

SEQ ID NO: 26437 - DNA, 3000 bp, Unknown; identical to SEQ ID NO: 13420
  misc_feature (1)..( 3000): 2750-1469P.txt file - cDNA_ID_2713666; gDNA_ID_2214625; Annot_ID_135947

SEQ ID NO: 26438 - DNA, 3000 bp, Unknown
  misc_feature (1)..( 3000): 2750-1469P.txt file - cDNA_ID_2713686; gDNA_ID_2214627; Annot_ID_135995
gtgagaataagaagattaaagagaagatagcaacgtgaagtgaagaagaagccatagatgccgatagaaacatagtattgagtagtagagaagctagttgcttggagtgtagtgttaggaatgttgttttggaaattgctgagttatgaggaggttcttgtgaggttttatagtggtgaaaattcgaaaactagccgttagattatttactttttgttttgttgtgaaaaaagaagaattttgaaaaggtaaagaaacgttaaatgtttgttactgtagccgttgcgagtgatgtaaccgttagagaaaatttgaaacaatgtaattatggatactgacatttgttgtgtgtgtcaggcaaaactatgagtgtttctcgttgtctcgcttttaattttgacaaaataattgttcgtgaataaacgtagtaaacaaagtaaaatctagtcattctatttggtgatggtgacgtttgggtattgccgtattgggcctattagctattggggtgatacgtatacacacctttacattttcggatatatttgttgagatcactcctggcccaaagaaaatagaaattttcaaaaattttaacaaggaatttacgttgttcttcttttttcaataaggatttcgaatcaacagagcaaggaccaagtgctaaaaccaattatcaattgagttatcttctttataacatttactagaacaagacataagctcatctatgactatgagaggcgtgtttatacaagggatttggtttaactaatagcaagaatggctcatgagtttaccaactaacgaggcatcaactcatttactcagctacatgatccgtttgtgcaacgtttcccactgattgagactattgtactgacatgtctagcatcaccccgtaaactatagtattgtttaggtgaatttggtctccctaaccatatatagggacatgaagaaaatgtcttgtgcagtttgtcagtcatattagtgtattatatcttgttacctccaataatgtcatatattggaaaacttgagaagtgatcagggccgatgaatgaaacattttttttatgtaatttggttaaaaagtgtaacgaaaaaataattaaagtgaaatctacttttcaaaatcgttaaaatgttttttgtgaacttcaaaaaatataaaaaatagcttacttttcatttaaaatgtctaaatttaatgtaaatattaaattagaaaaatgaatttatacatataccaaaaatcccagttttattttgtatgtgaccccaatattcttaaaaccaattaactttttcgacggaccaagtattccgtcgatttggttcaatatatatgtaacgaaccataatctacctttcgcggttgaatcggtagctaaaaaattatttctaacaaatataaaattacaaaaattgtatttttctcattaatgacttaaaaacaaactatgatatctaagtgtgtactcattcaaagattatttaatttttttaaatgaagtcatggcaaaaggaaataaattgcaaattccgagtttaggaaagaaaagaaagcaaatcttaaataactcaaaaaagaatattggaagacatgtatcatagtcctaaacaaagtaacagatctttgggtcctcctttcttttttttcccttctatctgaaatccgacatcatcctcaatctctgtctgaatttctcaatagctatatcatcttcttcttggtcttagaatcaaagaaaaaccctagttcctcttttcccaagataaccaaactctctctcttctctctctgcatcattccctttcttctttctcgcatgtgcagagctatcaaacatctgttttgattgaaagctaagtttccaattccaaaacggaagaaattgaaagtgtgtatgtcaagacaaaccaccaaactacaaaagaaacaaaacccacatcgcattgttccttaaagacccagcaataagattatctcacgcttccttctttcttcctgacatttttctcgtttttgttttctccttatttggggtttttcctgcaatgtgggtcgcatttggtcataagtgattatttctagggattgtgtgacctctctgcttttttgagttaagcatttaaagaaacctctcaatggcgttgtttagaaagttctttcacagaaaacctcctgaagggttgcttgagatctcagagagagtttacggtatgctctttcttcttttaagtgatgggtttagggtttgctttcttatccttgctcttctttgggctttggagtattgatttttagaaagtttgagtttttaggtcttaagatcagattttgataagtgtagtgtcctgttttagtttctagttctttttaggcttgttgattgaactgaatctaacatttgatagactaagattcttgatgggtgagatttagttcatggattctgttaactatccatgagcacaggctcaggctcattggtggaaagtctatctattatagcttaagatgtctcattctcaaagaattgtcaggaaacagtttcttttgtatggtcactgggttgcatgatttctcaaatccttttgcttgtcttatcccttgctcttagagtattaaattttagaaagtttgaatttttaggtcttaaaaatcataattttagcctaagtttatagtgtacttcttgttaggcttgttaattgaactgaatctaacatttgatagcttaagattcttgatcggtgagatttagctcatggatagatttttcaggttttgtatgttcactgtgttgcatgacttctcaaattcgtccttgtcttatccatgcttagctctgagaaatagactattttagtgagaaagatacaaaagattgctctataagctgcttacgaaatataagattgctctataaggttgctgaactttgatgtttttgtattacagtctttgattgctgcttaaccacggatatg

SEQ ID NO: 26439 - DNA, 3000 bp, Unknown; identical to SEQ ID NO: 13435
  misc_feature (1)..( 3000): 2750-1469P.txt file - cDNA_ID_2713730; gDNA_ID_2214627; Annot_ID_135974

SEQ ID NO: 26440 - DNA, 3003 bp, Unknown
  misc_feature (1)..( 3003): 2750-1469P.txt file - cDNA_ID_2713744; gDNA_ID_2214628; Annot_ID_136011
tgtgtgtagctttgtttggggattctgagcagtctaaggagatgtgtcatggctggaggcaatgctactgatagccctagtgatctctgaaccatccataccaaattccatctccaaatcacaaatgttaagagagatctttcctctcttcacatcaatcctagcaccagctgtagttaggaaagctcgcccaaggataagaggatctttaggttcctttccataatccaagaccacaaaatcagcagggattaaggaattaccaaccttaacaggaacatcctcaaggattccttcagggatttgtttggaacaatccgcgaagacgagagtgattctagtcggcgtgtagttagtcatgcctaatctttcagcagtggtctgatcaggagtgatagtgcaacgtccactctctgtgccttctctttcttggcctttggtagcatctttttttattttttcttatttatttttttttaattttaaatttccattaaaaagttacatggcaacagcccaacaaggcacacatgcacaaaagaaaaagaaaaataaaaaaggaaagaaaacttacaagcccaaaggccaacaaagcacacaggcccaaaaacaaagaaaggaggaagcctagaacagaaagcagcggatggcttgagaccgaagaaaaagcacctgaaacagagaacgaagaagaagaaccaaaacagagaagcggtgactaatcaactttggaacacagcaaaccaagtcatcagaagcgagtcacccacaagaccctgacccatcctcctagaaagtggatcaagacgggcccttacaatgagctggatttccttaatgagctgagtatgattcaaaaatgaggatgtgtgaatccgagagttgcgctccctcaacaacagataaatggaagcctaaaagaggagcttgattataagtgataggttctttgacgtcgaagccgtcttcaaccagaggagagaagccatgaaggacgttggaggagatagtccaacacacctagtgaaataagtccagacagcgctgctatacgggtagttgaagaagaggtgttctctagactcatcccctgagttacagagcacacacactgcaggaatagagaaaccccaacttttcagcctatcccttgtatgcaaacggttccaagccacaacccaagagatgaaagcatgcttggggacccgatccttgaaccaaattgatctatgccaattaacctggacacccggagggtgaagagccatccaagtctttgaagcagagaacgagtttgaaggagcatgagcatcgacttttcacagataaacatcatctttagtacactcagccatactccccacaaccggtaagcagggctttaaaagaagaatggaggggttacgactcctactagcagacagccatcaaacaccacctcttaagccatcttttacctccgtattcagaggcaaaccaactaagataggtccagtaggccccgtcagattaatgagaagaccaagactcgttcaattgtcttgccagaaacttgcagtttcacctgaaccaacatcacacatcaagaagggtctcgctaaaggtggtatcttacaaagcttcctccaaatctaactaccagaggaagacggattcaaatcccaaaagcatttgtgtctaatgagattaattctgacccacgaaacccacaaggaccctgcagctgtaaacaataaccaaatgagtttgagagccataaccttgttccaatctatcaaacgtcgaagacccaacccgccacactccttaggggaacaaactgtttcccaagcaatttttgctcctcaaacggagtttggagctgctttccataaaaaagcattacacatctcctctagctttgtgagacattgggtaggcagcaggaagatcgaaacccaaaagttaattgttgaataaattacagacttgagtaactgtaatctgcccgtaaaggaaagatgcctagtagttcaagtagagaacttaaatttgatcctatccaaaagaggctgataatcatgttttttttcatcttttgggccattaggggcactcctaaatatctgactgggagggctccttgtttcatccgaaaggtagccgctaaagaagaagacctggcatagtctcctccatctagcataagagcggttttggacttgttaatgcctagtccagacccaagcttaaacgcctccagaatgttgagaatccctgcaactgggctcatggacccatcaaagaaaaccaaaacgtcgtctacaaaactgagatgagtaataaagggagccacacacctggggtgaagattgaataggccattgatagcacccctatccagtaatttagcaagaatatccattacaagcacgaacaggtgagatgacattgtgatctccctgtctaataacctttttactacaagaaaacagacaaataacgactacaaaaagcgacaacagatgtcgtcgtcatttttggcgactacttgacgacagtgttacgacaactatacgacaacctgaacattagtagtcaaatagtcgttattttacgactaacttcgttagtcggcaactactcgtctattaacgactatttaactattatattattgaagggagacgtttgtcgttacatagtcgccaatgcacgactacaatttccgactacgatagttagtcgcctgattggcgactaaaataatacacatttctgcaatcgtaaaatagtcgcaacttagtcgcagagtagtcgacttaagcagttggaaaacgttttcgcattgccaagtaggtacacctaatttgtttgttgtagtcgtaaattagtcataaaaattcgtatatataatcaaaattcaggacactcttctttcaccaagaaatcaaaacaacaatcaaaaggaaaaaaaaaacgattgaaacgaaaaaaaatagaaatttagtttattctataatg

SEQ ID NO: 26441 - DNA, 3003 bp, Unknown
  misc_feature (1)..( 3003): 2750-1469P.txt file - cDNA_ID_2713761; gDNA_ID_2214629; Annot_ID_136018
ttcatacagttgattcctcttgtgttatgttgcctctattttgatttctagatggatttcaaaactctcatgcaatttatcgaatccctggtgtgcgtagaaagtatgagaatgaaaaatgtacaaatctgaaaacaaataacatatcaaacattcggaacattagcatgaagagatgaaataactgcgcacaaaaagaagggggaaaaaagaacaatattttttgggttaatagtgagattgcaaaatttataatccatagtcgataaaacaaaatgttttttatagtcaaatattcaataatcagatttataagatataacatctcaatcattactaccaaaatgtatagaacatctgaacatataacatctcaattattactaccaaactgagttttcttttttaatgtaattcgaaggccagccggtcaataatcctagagttggtcttgtaatgtgaattgataggtgaatttactgtttttatcgaaaaaatcacatttttaatcctgaaagtgtcagtggatactatgttaaacctcgacattatttcacaaacattataaaccaccaaagtaattttattaataatataaaccttaaaactgaataaaaacatacatagtaatggccatttcttcttcataattatgtagtattatatatgtaaaaacttctgaggccagaaatagttactatgtaatttatgtatagttaacacacataaaaaaaatgctatgtaatctttgtctctctgaggctattactctcattttaacaaacaactgcacacaaaatgaaaaagagaccgtacctatcactacacacaatgacgatagaagatattaatcgagttgacgattctgctgccttcgtatctctccctcacgcacgttctatagagcgcataattttcatcaacaaaactgatttttttcatatttctctttctctctcttttttttttcttttgtgaaaccatgtttctctcttaaccaattagaccaattcatagttttcttcttatacttaatcgtctcgcttttcttttaatatatgttttctggactaaagtttcttacaaattttgtctttggtatctaataatcgtctctctattctgcttcccaaaaatacacttcctttcacgtactaataaaacgtgacatttagttttcttaatagatgtcacatactatataatatataccgaaagtcaaactagcgaaagagtttcttcatactttacattgatgaaaattataaatactctaaatggattttgtattaatgttgatatttcgtgatatttaaattttatatgaatgttgatccaaaaacccattttaccaaaccaccataaaactcattctgccatataacatgttaagtcatgtaacttatcttgccatataatccgtcatgcaatatagtctgtcttatgctttttttttatatatttttaaattttccataatattataaatttttgttaattttaatccaccctatattgaaacagcgagttgataattttttaatttattaatgttgatccaaaataagtctcgctaggccatcataaaatctcgtcccatgttactttttattttaaaatgtttaattgttcataatattataaactttctatgctctcaaatatatcgattataataattcgtgtaaaattaaagaatttaactaaaaaccgaattaatatgtatacaaactttttaatttggatgtttgttaagtgaaggtttccagctcgtttagatttatattcattttgatcttatttataatataactctgaatcattatctaaacattttaaccgatgtgggacattaaacacatattttttcattaattgggtaatatatgtctgttttaaaatttttaaattacaatatatgtagaaaaaaattgagatttttttaactctatgtattataaattattcaaaggagttaaaaaataatcaaacaaagatggaaaaggaatcttaaatctaaatcattaatttgaaatatcgaagcataattagtggacacagtccaattttggtaatattggtattcgacttttaggaaaaaaaactggtgggagatccatgttaaatataacctgacccaaataaatttttatgaataatttttcttaaagaatcagataccatttgtatctaaaattattttaacccttcagccaaaaaatgacttcaaaaatactatagagataataaatgaataattattgggttcatccataagattaacctttttattcacctcattttattccatctaattattaaacttatttaattataaaatccaaacttttactacttttttataaactcaaaccgatatataatctcgttgtaattacataatctaaattttaattctcttttgtaaactcaaacagatattcaacctcgtttattgtaaaatataaactctaaccattcattctaaatccgaaccgatatataatctcggttaattataaaatttaacccttttataaacctaaaccgatatttaatcacgtttaattgtaaaatctaaatccttttataaattaaatctaaactttttaatgtcggtttgaatttataaacgggattataactaaaaaaaattctgttatgtttttagtcataaaatgttaatttgtttatgattatttttgcaaccatttgttttgtgtttataattgttttcaaccgaatgaaaatgaatttccaccagacttataccggacgaaaagagtcttttaatttcaattttttaattggagatgcaaaatcctcgttttctcatgtcagttgtcgacgggaacaaaaactgaactccgcttctaagatccttcgacggagagaaagatatttcagatctgatcggagagaatcattctcaaaatttctccattctaatttctctttctcgagagagtgaagagagacaacaaggaaggaagaggaaaaatg

SEQ ID NO: 26442 - DNA, 3000 bp, Unknown; identical to SEQ ID NO: 13479
  misc_feature (1)..( 3000): 2750-1469P.txt file - cDNA_ID_2713769; gDNA_ID_2214630; Annot_ID_136043

SEQ ID NO: 26443 - DNA, 3000 bp, Unknown; identical to SEQ ID NO: 13507
  misc_feature (1)..( 3000): 2750-1469P.txt file - cDNA_ID_2713781; gDNA_ID_2214632; Annot_ID_136074

SEQ ID NO: 26444 - DNA, 3000 bp, Unknown; identical to SEQ ID NO: 13507
  misc_feature (1)..( 3000): 2750-1469P.txt file - cDNA_ID_2713781; gDNA_ID_2214632; Annot_ID_187992

SEQ ID NO: 26445 - DNA, 2810 bp, Unknown
  misc_feature (1)..( 2810): 2750-1469P.txt file - cDNA_ID_2713793; gDNA_ID_2214633; Annot_ID_136090
ttatctatgaaaaaccattttctataagcaaatcttatcagaaagaaggcatttttatggagtccataatttttctgggcgagacagagcaaaactgggaagacaaaggatagactccaagcatctctttgtgatcaaacggagctgaagggagataaatgctcataatatgacacagaaagggtggagatggggagcacacttcgttggtgcaagcacaaaagtgagagtctgagagagatagagtcgatctggatatggtgaattaagatctccaatttgtgcgggtcttaactgttagcatgatgtgtaattatatgagttgaagggtttgatgttgagactcaaatgggtttgtgtgtagtagagaaagttgtttgtgtaatcacgggtatgtgttgacatgcactctccctttatatatatatagcgtaaacacaaagcaaaaactaaagatacagtttgtaaaccaagtagcttttaccatgaaataaacatacatatcacagggccttgagagacttgtcttattcccaagggacaaaaacacagagatcaatggtccaataacttgagaaggatggcctgttccatcggagggaaaaatgtcacaaagttgaaatctgtttacaaaaataaggggaagaataggagggtatggatgaaaaagagacttacggggcaacaagcatgagatctcattccctgatgaagctcagaggctgatatcaaaagcttctgcaaacggtactctcctgtctgagactgtcctctattctctgcatagcatataacttgtcgctctctcaggtgctcaaatgcctgtcatgtcaaccatttagaccaccacctttaaaccatggcatctcatgagagctataaacatacccttaggcagacattttgtgcgtagtagtctgaggtatgaaaagaatcgtgtatcgccttatactctggaatacacatggaatctcaagtcattttcatagtggtgccatggtttaaaccaaatttacagattacctttcatcacactgatgaagttgtatgagctttgctccttcacttctaacctcctcatacagaccagaagataaagctccagtacggaacaatctgctcaacaaagatagtgtcaatagatattcccaaggaaaatgtatatgcaacaccgcagcttattatacctctaacggcttccaactttggttgcctttgcatacttgaaagtgctgctttgaagttctcaagagagaggaggccagattccaaattcattaaagaaacagcgcagaatctaacatcaagagatagactcaacacagagaaaatgatatcttaaggaaacatctcatgattgtaatcgaagaacttacataaacttcaggaaactgttcacagtagaattagcattaaacaatgtcttaagtatgtctttaaatctcgtgtctgatgttaaattctgcacaataggttttttttttttgaaattggttagtatcagttgttcagaacaagaatcaacatcatctaaaagctaagcatgtcatagtagtaattgggattggatattagaaccttaatcttatcattgaaccgagaaacatatccactggggaagcctgagtctgctggtagagacagcaggtgtacaaacaaactagaaacatagttcctattagttaaataagttgattggaaaaatagttgactggctattacagaaaagaagctgctcattacccgtcaagttcttccctggaaggaggaagaaacaaaaattttctgtgtgaaaagcgagatctcactcttttctccagaagttggtcggcgtcctgtggtgacagattgcatattataagattttgaaccagagtagtattaacaagaaccaaagtcagctgtcatcaaacataaaaatacatacaagaaacagtttgtaaagcccaaagcacatatatctgtatagcgatgctcataccagtcgagaactaataccgacgacaacagcttgtgaggttacagattgcatagcatcgtccagcamactgtatagcaccgctgctttccctatatatatataagcagataatagggtgagtggatagaaaacaccaatgtccaattcctttgttcatcaaaggttaaaagaaaccagaattcttgcctgtgcaaacatgtcaaattcatcaagcacaaagatgatagtcttatgtgctagtccacatgccctgaaatatctctatcagtttgtctgcgttgaatatcaaaaaggctcatttatgtaaaggtaaaaatactgaccgcaacatggctataatgaattgtgaattgtcatcgaatgatgcctggaagtgcaagagagaaagcaagtcaactgagacattggctacacagcaaagagaaagaacattcggagagaacaatgtcataccattttggagaatagtaggtggtgttccatgcacaactgtttggcaatttcctgaaaaatcaatgtaagacggtgagtgaatgaatagattaggtgtaggaaatgagaatggtgggctctctccctctcttagaccttaaaggcacaattatcatcactatgcaagagtccattcaatctgatctgcaatcacattgagatggtagtaagatcataacgatgagattagatataggagatagttccaaatgtataagaaatcagacatactactgatactgaatcaggaaactgctccaataamtcacctasamcgagatccaagacctgaaatcaacccattttttgaaataaaagaagaaatcaracgccaatg

SEQ ID NO: 26446 - DNA, 3003 bp, Unknown
  misc_feature (1)..( 3003): 2750-1469P.txt file - cDNA_ID_2713800; gDNA_ID_2214633; Annot_ID_136086
ataaaatataagttgtcaattcaaaaagttccttattacactgatatactaagtattttcttatagtagaaagagtgttttatatgaaagcaacattgtttcttagaaaatattaaatttttattttgttgatccaaaatagtttatttatatttgagaaatttaatatatgagaactgtaaaatacaacgtttggagagaacgtaacactagaaaataccataaagaacacaacccgtgcactcacctcattaccgtcatcgacaagaccattcgagatcgcatcaccagtctttattatcaaggcaccagcaaatatgcaaaccttcagaacggtgcaggcttcactaacgtgataatttgtaatgttctgttttgagatcatctccaggcctagctaactttatgctaggttattcagctgtgtatgtttaaatgcggcatgcgttactgttttgataaagtagctttagaagaatgtagtgtgttgggaataagagtaattttgttttgtgtttaccaaattacagcacaacacagacatattcattcttcatgctcgtgatagtgcctagagaattaacgacttgtgatcacattattagaggaaactcctaactaataaggattaggataaacaacactacatgtggtacactcaacaactcaaagattatctcctgaaaccttatccaactgttcttcggccccaagcagtgatgtagatggctggtcaaaggcgaggacatggtctgactgatggtaagaagtgttcaagcctgattctagtattgggtgacccactacaatatcaggtgtataaccagctgcacctctcaccaatcgaggcttctttgataatctctcctctcctgtgctctcatctggagacccaatgttacaccctgagtctggtgttaaaggctcccggtaagatgagagagactcgtcaactgagagacttttgtctggtccacagtccttgccagacttgtcttgaagaggagactcagatgttggggcaggggttgcaggatctgaatcgcccgttactggggctgagggttcgccgagtactccactgagtcgttgttgctcttcaattatcttcttcaagtactttccttgtgcttctatccgtagttgcagctgtctttgcacctaagaaaaaatcacatcaaagaataatgtcatatgtaatgcaaaattcagtgctacactgaaaatcctactaattgtttcgttgttgcttgtctttcttaagtaggaatggtgaagcatacttctagttgctcgtgtaatcgtttctgaacttccatctgcaacttgagggcttcagttatctgcattcccctgtaatctcgaaacgatattgatcacttaatctgcggcgcgaggtaatatatatatagcatcacaaatcaagctcaaagagggaaatttcacgtacgacgagccgtccaacccagagagcatatctccagattctttcttatcagtttttttccctgaaaattgaaaaaaccagttttcaggtatataggaaactggtagaatgagaaagaagatgaagaaaatcaatgtccacactaccttcagaagacgaatctggaagatactttgcaagtcgatatttctgactcaaaatacacaaatgcaaaaatcagcaagggtaagagaaagagagacgagacaagatgccacacagtttgagaatacctgtaagtgactcttgacatgatatatagttaagccttgtacacccatcactctaagaacgcctttgggtgtagctcctttggaaatcaaaggaagaaaaatgtttaggaaccctaagcaaacagacgataggctttccctctcatggatagtagtaaagcatacaagaagagcaatttgattatattggtgtgcatattattaccacagatattgatgaggaaaacatgagttactaaatttaccatagactatacaagaaaaaaggaaacttactatcagggccaccaagttgagcaacggcatcaacgaagcgttcatgtagctcatgcgtccaacgcagacgttgtttggatgcatgactagaattggggcctccgttgtctgcttccatcagggctaagatataaacacgataaagggaaagtaatgagtagtggcaaagctaggaaatgataacatatgaggactggccagagagaaagagatagaaatggaaacaaggaagacgaaatagcgcccagaattagctagtaaaaacagtccaagtcaagtttaagacttgctccggcagatccaccacaggacaccaaaatcagagacatgttcactaaaatcggaggaatttgtcgccgagaaagcaaaaagaaaacacaatccaaggttatggaatctacgaacctgtgggtggtggatctatacacgacgcccctccattttcggaacttgctcttctccaagctaaatcttatctgaaatagaagatattgtgttacagactagtttactgagtccggtgggttacagggcgggcggcgatggagcagagtcctcctcaaaaaaattccagtcttcttcttatcgctcgatcgacgaattccaggcagtggcattgactattgctgcatttctttctgggtaagccgggcctctcggtataggcccaaaccattctaaggcccaaaccattatattaagttggttggtccaccaaagtcagcagcagctagaacaagagcgactctgcagctgctcttctcccgcttccttcctgttagttagcctcagagatcctcgttccccgataatggatttgggaaaactgatccagctgtctgcgctgctgtgcccatttcttctatcattacactttagaatcgctggggcctccgcccacatctactcttcccagcccttccacgatgtcggtaattctctcctcctctacggtggcagcgagggcatcttcgcctcttcccgatctttaatcaggtatattctatg

SEQ ID NO: 26447 - DNA, 3003 bp, Unknown
  misc_feature (1)..( 3003): 2750-1469P.txt file - cDNA_ID_2713826; gDNA_ID_2214636; Annot_ID_136137
cgtcaaattgtcatacaagataaaccaaaattaatttacttatatgtatttgcaggtatggttggtttgtccatgatgcgtcaggttctattatttctcaagttccaacttcagatccttgcccttcactcgaggatgacatgaatgtggataggttgaacgaggtcaacatgctccttactgaatcaggacccttgtctgtgcattcaactgctgaacaaacgacatctgtagagcccagtcagggtctagtatgtgcatctggtgtccatgatcgtcccgcaagatctagagatgattatgaacctgcttcaacgagtattactccacttgagcatttgagcggcggtaatgcacaatcaccaggagaatgggctgatagtcttactaacataagtataggtgatctactttctgaagtgcccgatgacatagatagtgatggtgttgatccacctgccaccgaaggttcacattacctccttcgagatgtcccatttacctctgactcttttgatgctgcaattgctgctcatatactaagacaccagaacaagccaagtgctcaactaccgctgacttctggctcttcctctctgtgggatgatgaagaaacacgtgatgccttctctttccaaaaaaatcgtttcgcaaattccaccgagctggctagtgttgcttctcctaaaggtgttggcagagtaaatggagagccttcacagttggtggaggtaactatatcagcctcaaattccacttccctcaattgtttacaaaactaaaccatctgattcaatactttctcttaggcttcatccggcgatgagggatcttataaccctcatgacgatggagatccaatggaagagggtccagcagaccctcatacgatggattctccagggaagaccccttgtggacttgcggatgtatactgggtaaatttagaaatctcatatatttccccaatgtaaaaaagtcatatatattcaacaacaacacatgtttcctctttgcagcccgactcgttaggaccactggatttagacattagatcgtcaaagtatacagatgatttgatccttagtgagagcctcgggggattgagccgtctgatagcaaccagccttgatgcgtttcagaactgctcgctctttgggttcgacaataagaaggacaagtctaacatggtatgaaatggaaccaaagctaaagcatggggtccaaatgttgatagttgaaaaagaaagtgacttcttgccttttgaaaaaagaaacttttatcaccaactgatagcttcactgtacaaaaatttgatgtaaccttttactcttcctttcacacattcttttgtgttgatacatgtttctctgtgtacacttttactgttaatttacatgtttatttggctaccatgccttctttcttttttttttctttttttttgttcttttgtttatagaagtttcatgacaaataagaatttcaattaatattcttaagttcttttaagagtgcgagtaaaagaacaatcgtaggacgcaaaatttaactcgctcattcaagagtagtgttgataagtccttttttttttcatttcaatattctacccgaaaaagattccaaacttctacttttctacacttgatcaccactataatcgaagatttatgaacaatagactctttaataaagtaaataaatcatttaaaactaagtttgtttgttgtcttgatcatatgtgttcaaattggttttctcttctattctctacattaaaacatcctccaacattcagttttctcactctcaatgaaccagtaatacacaccctaggtgcactagatttcattcaaaactaaatctggttcactaaaccaaaccatattgattttcaggaggaaaaccactttttttagtgtgtagtacgagtaagtttacaccctgagatgcagggttttttctttgtcttttgctaagtgcgtgagatgcagttttacccctagttagaggaaaacaatgaatttgtgtaattttaacattttcttgttatgaggaatatgctctgaataatgagaaccatacaagatacaacaatgacataagccaagttgtcataaaaggccaaatgtgctttaatgtgtgatacaccgctttacactggcctactctttcacttcacgtcaagttcgtaaacgaagagacaatctctacgtgccctccccttgaatattcagcatcatcttctttttttgaaatcaaatttgacggcttctgttgtcacaggatatactatagacaacaaaactacatatgatacaaggcatattcgagttctgatcattcacaataaaatacatgtgatagaagcaatttaaatatgtgcctgaaatatataaatcaagaaagccattaatcaaaggttaaagcaatatggattgtacgtgttgagtgtatttttttttttttgtcataccaagaataaaaacatcaggccgagacagtagtataagcgagggaagagatagattaggtcctcaattcaaaggacaccaacttttgatattttatagctagcagccgtaaatcatatttgttctatttttagcaatacaacatttcttagacaccaaaatcggtttagttaatcagatttcaagtatgattttatgagattctaagcatggatgattcttttcattggctacttttaaaataacagaaaggatctaaattttcatttgtagtaaatttgaaaacgttggcgtggccttgcatatatatttagaaaatcgtacagtggaattggtttaattggtaaagttttctaggaatgatgtagacgaaacaaataataagattatcctttaaaaattcacttataccacaatcaaatccatattgaatctcactcagaaccctgataaatatccactctcagtccatatatcactcaaaacttcaagaaaaaaagattcttcaaaagagcaaaaaaatcaatg

SEQ ID NO: 26448 - DNA, 3003 bp, Unknown
  misc_feature (1)..( 3003): 2750-1469P.txt file - cDNA_ID_2713830; gDNA_ID_2214636; Annot_ID_136136
tgaaaagggtttggatttggaatctgctggtttgacttatatatacgtgagagatgatgcatcttcatcaatcaatcataatggttggagacagtccgatcctgacctttttcattttttccataccatgtacagtatattatacaagtttgacttaggtgatgacaaaataattatattatcatttattattaactgataaacttcatattttgaacgtagtaacgattgatcttgacatcttgaaagtctaaaacagttgtaagaaaaacatagcttcagttttcaaaacctagagctagagtcaattaccccaaggttagaagatcatacacagaatttttttgaaatgttatccgaactcaatatgattatatcaagtgtaaaaactttatcatcgaggaaacatattaaaaagcatgtccttgactatagaaatgattaggttggtccacatttagaagatgtttgacctggcttcagccattccattttcaactacttgcatattcttgcaaatatacaaagcgttggtgtccgggtcagatacgagctaatatgaagatgatcaagtgcttggttacacaaaaccaccatgtcaaagattttatgcgaaaacctaaaacacgagcatgcatgtagctcgattgttcaaccagagaaatcaaactcggagctataccgaaattatgttctgattggactaatcgacttatagacgcatgttttcatatctaagtttttgatggcctttttagtccatataagtttttttaaaatgcagcatactaatatttgaattcagactctattttgatctagacctactaggaaaactcaaacaaattgagtttagtgatatattgagaggtaaaatactaaaatggtctaactaatacaacttacatgtttagtagaacttaaattatgctttatttacaagactaaaagagtagttaaacttgaaatcttaaactgtcgccgtagaaataacaattgggtcaagaaaagttttctaatccttatcaaaatagaaaagttttctaatataatagaaaaaacacccgtaagtgggaaaacatcttctacaaacttaataagaaaaggatatacatatctccaatccacatgcgaatagttttgggtcaaatctctacgcttcgcgtaacaaattgaatttgtcaaacaatttgagcatgacatgatgaaaaaaggccagagtcatgttaattcgtcgtatcgtaactccgacttctgactttctccattctttttaacgaaacgataagtcaacttttaaccgaaaaggactacaagtcaatttattcattaatgctctacgtgcataggttatacttattggttaccctatagaagttgaaccgtgagatcaaaaatcatgttagataaaccggctccgttctttgtgacgttgacatatatttttcttaggccagagactatagctagataaataactccattcttggctgctcgtaggatacgaacccaaaacttggtcatattttatctcaaaaataagatcccaaaaaatatcgactattagagctatcgataccatacgtgtttcaaagatgtaaatttgaacccctctaccttgaaagcgtgtataaggcttattttctgaaaaaaagtgttagctcatctaacatatacaaagattaaagattggatcgttgacagaagaaaagatttacaaaaatttggatcttgtgaattagttactattgggctaaataaaagcccatgtatgtatttattggaccagacctaatttttgtaccagggcctgaggactatatccaacacaaaccacaatttcaaatattattttggcgttttaacttctaaacgctttatctttatcatgcgacttgccagatgccaacccaagccacgtgcattacgattcaactaattttttgttgtctttttttcccctttttaacgaggcaaaatagtagaaatatttttctattttcatgaaattgtagaagaaaatagtaaaatttccgaattttcctaatctatagtttcactttagataaaataatacttagcgtgacgaaggcaactggcttattcaactttatgtgtttaataaaagataaaataaataataatttcgtatatatttctctcctttgttcataaaataattaaaatatttttgattgattctttcgaaaagtaaaaaaactcatttaattacaagaatataatatatgttaacccaccatgacaaacatatattttgacatcttagataacaagtaactaaattaattacattcctttttattttattttctttttaattttatgtgaatgtaaaaaacaagaaaaaaaataaaatttatttttctctctcgcttggttcaaccgtggttgttcatcggaaaaatatcttcggcttcaatttcgttcgatttaccctaaattctcgactagtgttcgtcaatcccacttccaattccacatttcaaaccttttcaggtaatatttctcatatttttcgtgttttttttcggggtcaaacttatttttttaaaaatttcaattcaaatttcgagtttgtatttagtaaccctagttcttaatttttcaatttttcgtcttcccttatgagatttagcttaattagggtattgaattaagtagaattgggtttttgtttttgttgtgatctggtgaaattaattttagggttttattgaaggtgaaatttgtttgttcttcgttatatcttcgaaattagggtttttcaaatttgtgtcgtggatgtaaaaattatgaattgcctgtaaaatttttctgtcggttgctaaatttcttgtgattttagttgatgatcgctatgtagagtttcgccttttttttgggattttgaatgttcatggtttaggattcattgctctgatttgtaggaagttgaaatcaaaagcatgaatgcttaaacagtttacgcattattgcgaaatg

SEQ ID NO: 26449 - DNA, 3000 bp, Unknown; identical to SEQ ID NO: 13548
  misc_feature (1)..( 3000): 2750-1469P.txt file - cDNA_ID_2713840; gDNA_ID_2214636; Annot_ID_136126

SEQ ID NO: 26450 - DNA, 3000 bp, Unknown; identical to SEQ ID NO: 13576
  misc_feature (1)..( 3000): 2750-1469P.txt file - cDNA_ID_2713844; gDNA_ID_2214637; Annot_ID_136156

SEQ ID NO: 26451 - DNA, 3000 bp, Unknown; identical to SEQ ID NO: 13565
  misc_feature (1)..( 3000): 2750-1469P.txt file - cDNA_ID_2713848; gDNA_ID_2214637; Annot_ID_136149

SEQ ID NO: 26452 - DNA, 3000 bp, Unknown; identical to SEQ ID NO: 13585
  misc_feature (1)..( 3000): 2750-1469P.txt file - cDNA_ID_2713852; gDNA_ID_2214638; Annot_ID_136173

SEQ ID NO: 26453 - DNA, 3003 bp, Unknown
  misc_feature (1)..( 3003): 2750-1469P.txt file - cDNA_ID_2713856; gDNA_ID_2214638; Annot_ID_136168
aaacacatcagattttaatgcccaaatttctctcattttcttgcttcgaaaccaaatattcaaagagagcgagagagagagatagatcaagaaagaaagagtgatgcagaagcaagagttcttggaattgttcaaggccgcacaacgagcggctaagtatgcgagtgatgagaattctccagaggtctcgaggtgtatccaattcatgaagcgtttgaaagaagctcctgcatctcttgattgtgacgtggtcgttaacacaaactccattggaaacggaatccgttttctccgagatcacaaaaaccccctaattcgatctgaggcagaacttctttcagatctttggctcaagtatctttacgccaccggtagaaaacagaagtcgacagattctgtttagttaaacagattcagagaaattcagattcaggttttgaatgtaactgtattaatgtgttagagacttgggtttgaatgtatatgacattatattactgcttcttaatatggcagattttgaataaagaaaaggtttcacgagagaagattagaacactaatatgtatgacaaaagctttcttcttgattcaatgaagtcacactcatttcaaatccataaataataaagcttacttaagtactatagttggttaaactcacaataatatgacaatgttttgctactaatcacatcacttggatcagttattttttgttaaaaccttgacttggatcttacactttgatgacgctcttggaagcatcataagattcctcatttccatggtggtttgcaagttattactgttgtttaccacgcaaattttcactagctcaagacacggtaacttctccaagaaatgcttcatttgattcagctctcttgtcgttccttgatagctcaatatctccagcaccttcacttgagatgatgataggcaagaggttatgctctcgtcggtatcatagcaaacacatacatccccacatctgtttgttatgtagtgatcgagaccctgaagcataacaaagaaaaagagtaatgttaacgacctaccaatatatatatggtgtttaggatgtgtttgtgacatgagataccatgaagatgagggtttctaggtttggagagttcttgatcagaagtggcagcatttgccatcctcttgccttgtcattcccaatagatagactaacaaggctgtcgaacaatggcatttctttacatgagaaataaagcagcttcaacaaaacacaatgtgttagtctgttgtcactcaataacacaaaagttgaaataaatcatcaaaagccccaagtgaatctcattctcgataagcaaaaaaaaagaagaatgttatttataaggaaagaacaatatatagaggaggctgacctctagagtgtggctagataagtgaaggattctaacatttctgattccattgatgagatttctcatatcagcgggaatggaaccgagagatccatttcttactcccaccattcttgtttcatccatccgaagattgagtctagcttcgatgagggaatccaacttaacattaggatacttacccaaaacataaccagagtgtttgtagtagataagattaggagcatctaatgaaatactagtaaacttgcgatcaaatcggatgtgtagtctctttagagatggagaagacacggaacaagtccaatctacacatcgccgctcctcaacaaccagttcttcgagaacaggacagcgagatataagagttccaacaacattatgacctccaacaaaattaactgagtcaagacataatgtcctaagcaaaggaagagaaacatcttgagaaagcttgattgtaaaaccacgtcctactctcagcttaaccaatgtcttgctcttaaagatcattgcaggcactggtggagattttccttttaaagtaatgaacacatcaagatccataacaccatggtcaagaacgttgcaaatccaactttgaatgcgagatgaatcagtgccacctcgaacaccaacatgactctttagagtgagcttctttatagaagaaccacgttgcgtatctagcaatttgtcaacgaaagccatgtaatttctgtgaatctcaatccggttttgcttagtcttaggcacagattgacgatcatcaatatcaagattggaaaccaaaacaaacatgttcttccacctcttagagagtactgaggttgaaacagcttcttttgtggagataagagacagaatacgcccaagaacctcatctggtagacggctgattacatctttagcattcattgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaaatggtaagtttcagttcttggatttgtatgattttgtaatgtgaatagggatttgaagatttacttacttttgaaattcaggcgtcggagaagaagctatcgaacccaatg

SEQ ID NO: 26454 - DNA, 3003 bp, Unknown
  misc_feature (1)..( 3003): 2750-1469P.txt file - cDNA_ID_2713874; gDNA_ID_2214639; Annot_ID_136205
actactgaacagaaaacaaatgcattttggagcttttaattggatacgtgaagcttggtcatggagcaaacgttttgaagaagttattttcagttggacgccgagaacgaacaaccaaccggctgatatgcttgcaaaatctcatctgccacaagacacttcctttatttatcattactttgtaccaaattttatcacaaacgccctacactgtaatcactattaatcatatcaattgaaagaaattgttaaaaaaaaaaaacctggggaaataaaccaaaccgaacttacggaaccgaaaccgaagaattaaaccgaatcgaaccgaaccgaaaatttgaaataaccgaatggatagtaaattctataaccgaaagaaccgaaaccgaatcggtaccaaattgaattatttcgggtaatcaaaaatatcggaaatataattatatttttaaaatattagttatttttatactaaataattaaaatacttgaaaatatatataaaataataaaaatacttaaaaataactgaaatatcgaaaaatatacaaagcaaaataatcgaatggatactaaatatttaaaccgaaagaaccggaaccgaaccaacatttcaaaataaccgaatggattaaacattagaaccaaaagaatcgataacctaatagaaaccaaaaccgaatgaataacctaacgcccataactacttatatctctctctcgtctcgccgtttttttcccaaaatcggttatttttgttttcttttatcccaaattcgaaataacggttaaccgaaataaccaatcggttcagtgcgaagaataaatctgagaatgtttggcacaaaagagaagacttttgatctgtggagattgcagtgagaataagtaatgataatggatataaaatttgattagtgtagaacttggatgagatattgtcgatcataatatttgaatatatatttttgaattcatatattgagaatacatatgccatgaaatattatatagtgaggactagaaataggagaactatcttgatgagaactagccaggaggcctagacaacaacactcaactccaccatcccaacttttcagacatttcccttcttcatatccttcatgtaagcatgttgcattgcattctggtgtgctataacatttcatctcacactgtttgattcctctgaattgccctatttgattcatatatcaacagtaaaaaaatagtcaatagaacatttaaagatttttattgcccccacataattttttttcttcttctttgcatctactatttactatttagactcaagtggatttccaccaaaaaaaagactcaagtggcaaaactatcattttcttaagataatctatgaaaaaaatgagataattacttataaacagataaattttttacctgaaatcatgggaatatagatgaaagtcaacatcatcaatgaaagtattataagagatgacatttttgtgatggccattagatgtttcttgagaatacaccaagttttttttatcggaaaatatagttagattcaaaagaaagaaaaacctagaaaaagtaatcaaaatcagtgttaagaatccgtaataagaggacatctcttgtcttctttaaaaaaaatattcaacatttttttatgaagtttaatattatatttaggatttacctttctttttggtcaaaatattgatgatttaccttttggttttataatatttctattattcattttaatggttttgactagaattgaataaattaacatcatatgaaccattcaaactcactttaatagatcttccataacatgaaagaatttatcaataatcttccatgatatatttttttaatatatcttccatattaatatattatatagtaaataatatttagcaaatattttatttaatagttttttacatgataattttagtcatatggtttcatcatctagttgcgttccccctttggtattatgtttttttttttaaagtagaattccgcaaataccgattttatgataccgctgtttttggtctatttaaaaaaaaaatacaaaataagatatcttaaaaatggtgtttgtcaaataaaacattgtttataccgcatttataaacagtcttaaaaagttttttaattaaagtgttaataaagtatcatagatttttgaacaacttttccctttataatatttttgaaatatgatatcaaaaaaatgctgtttgtcaaatataattttgttttgtttcattaagtataatcatatgtcagtttggtacaaaaccaaatcaaattggagacaaaagaccgaaacaatttcggttctaacaaaaaccagatttgaattttggtacacaaccaaatcaaatggaaacaaaatacttggtataaaaccagaattttggtttggtataaaaattggaaacaatagaccgaaacaatttcggttctaataaaaaaccagaatcgagatcactgcaaaccgaaccaatgtaatcctcttcggttccaatttttaaagtcaccgtgctttttcgtcattgtctgagaggaagaactgttccgttgacggagcttgatggcccaaccaccgaatcgtcatttctcaatagaaaaaccctttctttgtgattgcttcgttccacgaaattgtaagccaaaggaacattcatcgatccataatcaatatgcacttgcttctaacctcgttgacttcttcttcttcaacctttttgttactcgattaccaattcattgcctggaaattcttgaatcctatcaaagtcttctcctttgatttgtataataaacctaaagtgtctcacagatacgataactcagtttcctcttaaggtctttcttctctcttactaacatttacttttgggttctgttttgattgattgaagcgacatgggtttgacaaaaaactttgcttttcttgtgttttgttgtcaaagatactgtagcatg

SEQ ID NO: 26455 - DNA, 3003 bp, Unknown
  misc_feature (1)..( 3003): 2750-1469P.txt file - cDNA_ID_2713882; gDNA_ID_2214639; Annot_ID_136202
aaagagactcttgagatgcttgcttctctaggaatgtctgacactctcggcatctctgcagtcgacccacaacaagctatggcaccaatccctgctttcggcggcggcagggcacccagaagatactaagatggacgattggctctcttttttcacagttagggacaagaaagacttgtgtggttgtttattgtttcttttgattatgtcttaaactcaatgtgagactctttcgtattaatggtttttgagttatgtggaaccaaaattggagttcaaacattgatgatagtctcttatcatatatcctagtttttgcaacctgttaatccaggaggtgacggaaaacaccagaatgaaatgtgtcccaactttgatgatagtctcttatcatacatcctagtttttggcacataagattataaaacaaaatggtaagagattcttgtcgtaagcagaaaggtgggaagtagttactgaaagaaacctcaagaagtactaacctcatgatcttttcaactaaacgatcatcctgagcgatatgatgaacctttgtagagctggtaacgttgattacccaagatcctctatcaacttcacagagtaaatggtaaagtttcacccaatcaccaggtttaacccgataaaagagatgactgcttagatgaactctcaagatcgttccaacggttggaaagctgagcagtacatctcttgacagtaaagtatgaacagagagactgctaaacattgtacaccaaatagaagaagagtaagcgtaggatatggaaagcgtagagtcaagcctgaatgaatgactcagctcaaaacagataatctgaagattgaaaactcttttccttgctagttaatactcacttagccagaatagatgctgggggtgcatcagtcccgtcccaaacaaaaacagcgctcgtatcttcatcggcatggagaatctccatcacaagaaacagcagaaaacaaggtagtatcagtcaacaaaacataaaaggtatacagtttgagccaaaaaaagatttgtaagtaacaatgaagtgctttctcatgttaatagagagtatagagcatattaccctacacaccaaatcaaagcgttttcctatctacggagcaaggttttgttctgtaagatatactctgcatagctaagtaccaaaacaggaaatgaaagcttattggaactacattggtaacaaaccaaatcctcaccttcgaacaaggcaaaggaagaaacccatctactacaagcagcgtttactctttttccactatcaaaagtttgcatctacacaataaaaatccaaactttattacctcctccacaaaacacacaaggaaaatgaagactctttgtgccttaatgcgagtaaacagaatcatgtcgtcgtggttcttgatttgaggaagttgttcaagagtcctactatatacattaacagtaagtccaggacttggatacgtatcatcaattatccggagagtacaaatccaatctaagaaaaaaatccaactttcagattttgggtaaaatgttagagctttcacaaaacaaattatatgtatttgagtcaaatttagggggtttaggataagtaccattgttgcgacattgttttggttctctttgttcaaggacgataccaatgagactgacttcttggttgatgagtttaatggcgtctttgattttgatgagcttcggactgtctctcttcttcgccatctcccggctttgctacaacgttttcaagtattatcctgacgtcattagacagtgataatatggtgaaaatgaccatttgatttcgggaaacatgtcattatttttttttgtcaatatatgtcatttcataacttaactttaaagatgttttatacatcaacttaacgtatggttatttatatatatgaactaaatgttaactaatgatttgaaacatgagaatgtgcagaaaagacatatcactatctaggtataaacatttggatttatttgaattagaataattcgggttggagaattttcggattttatgattattctatttgtttttggttaggaaaggtgacgaattttgatcattttccttcggttttcaaagaaaaaaaaaacaaaaaaaaatagtcataaataaaaattagtttaaccttactaaattttgtctaaaatttgcaaaaaacaaattatatataattttaataaatataactaaatttttcttgatatcaaattatttaagatatgttatttaaaatatgttatttgttataaaattatagctaaatataactaaatgcaccgaattacatttagttattaattgttttcttagctttttcaatctcgtaaaattgttccattaatttttgtttttttcaagtttgaattaactacgtaaattaggtttggagaaagcaaaattagaatacttttgtaatcgaatgtctttgaagatttatagaacaaaagaaattgagcaaaattattacatgttccctagatgagtgtcaggaacttggtatatatggagtttagaagtaaggttaagaaaaaggttggcttcgaggaactggagtgcatttaagtggatgaaccgtgcataaggtactatacaagaagttttgaagggagaacttttgaaggaatgaactaaggaatgaacttttgaaggaatttgaactcttcctaaccaaagtatagaagacttcctaaccaaagtagtgtagtaaacgaaaaacaatcaaaatgtgacaaatcaaaggtaaagactagaccagtctctgctcaactgtatttttcaccaaccattgcaaaaaaaaatcgccgtcttactattaacccacgtgttaatcacaccaactaccaaaaatattcataatccaacttctatataaacttttgtttgaccataaattacaaaaaccatttgaattttctttcttcttcaaaagttcgaaacttttttttttccggcaatg

SEQ ID NO: 26456 - DNA, 3003 bp, Unknown
  misc_feature (1)..( 3003): 2750-1469P.txt file - cDNA_ID_2713890; gDNA_ID_2214639; Annot_ID_136196
caagcggcacacagaatccgggaacaggccatggtgactgaatgtttgggacgacaccgttaaaatgatccaatgtgtgtgagatcgattttaacatgtactcaaatgaatatctcccccatggaaatgtcttacaaaacgtaagatcacttgcagccctaacacagaaatcatcaattggactagccctttctccagtcttagtaggcacgacaatgctgcttgttagaaaatagaggaccgccatccgcaacctatcctttgatctagccggttccatctccattagcttggtttttacgtcttcacgtctaattaccccggttttgaagtacctgttggcgaagttcatattaccagcactctaataattagctggataggccttgcagttgaaaccagagatcaaagcatgctccctaataccatagcggatgggaactccattaacaacgaaccaaacctccttcttcttctcaatagatgtcgttcgaagaaaaagcatccacatcctcattaacttgtgggtatatccggaaggtaggtgatagatgtgcttgaaactcggatgctccataaaataattattttcaacattcgttagaggatgttccaagtcagcgaaggtcttcaacacctccgagatataacacctcgttgctaacttcatcttcttggtatactccgacgccgggaagtacataccaagtggctgcattgccatcgcttcctccatatcctgaaagaaacaaacattcattcatatatcactcaattgtaaatagtatgccacattattactctgtatttccaaaaagtattccccgaaattaccagtattacacaaatcgtactattcatatatcactcaattgtaaatagtactgccacattattactctgtatttccaaaaagtattccccgtaattaccagtattacacaaatcctactgttcatatttcactcaattgtaaatagtactgccacattattactctgtatttcctacaagtattccccgtaattaccagtataacacagatactcctattttactatatagtatttctcaaagttactagtactaactactgataaatcacaattgtagtattactctaaggtattacccacatccgccaatattacctaaatatcaacatagcatttcccaatgttactagtactgtccacagttcacaattgcattattacccaattagatcggtattacgaaatggaatacttaccacatttgcgatgtcctcgtctatggtcctctcctccacgggtttttccactatcacgtcctcgtctctctcgtcctcgtctccctcatcctccacggacttttccacattgacgtcctcgtcgctcgcggagctcctctcctcctcctcctcgataacggctaggccgtcatcttgtctctccgcctcttccacgggattagcacacgcgagttctttgtttgtctccgtctcctctgaatcggaatcggagcccaaggtttggctactactccctgattattcttcttcacttccttcttctttttcattttcatcttccacctcatcagtttgcatattctcttgagtttcttcagccggaatatgcttcagagcatcataaaacgtagaatcatcaagcatcgggctctccgtcgttggagccgtcgttggagccgttgtcgttagagccgctgtcgttggagccgcattggttgccatcgccgtcgcaatcgtttgtgccgtcgcagtcgtcttcgccggcgcctgaaccttcgctttcttcgccggcgcctgaaccttctctttcttcgccggcgcctgaaccttcgctttcttcgccggcaccttctccttcactttctccgccggcgccttaactttctctgtcttcgtcggcgccggcgcttctatctcctttcttttcccttgacctcctccacgcgtcttaggcggcatgactgatttcgaatcggaaatagaacggaaatactggtgaaagcaagaagaacgctcgattgaatttaaagaaatagggaatgttgtggttaatttcagcggttactaaggagaagaagtcaaaaaatcgaaaacggttgtaatgagaacaagaaacaatttcgaattggaaaatccctggaaatattaaggttttttttatttgattttcaaataaagagtaaaagtggttcgggtggtttggttcggaaacgaaccatgatttttctggtaattaataggttcggataaggatatactagtaatatccatctatttcgaattaagaaaaaataaataaattatttctgttttttacaatgattttttggcttcctctttgcaaaaaggactgccagacgatttttcgattttggaagaccgtggagatcaaaacagtctcttttgtctactcagtcccctcttgatctggtacgtttacatctgcaatctcctcatctctttaacccattttcatctcttcccttagagtttcaatcatcgaacaaaattattctgatttggtcattgatttgcttaaagaatgatctttctagttcaaagccaagttttttcagtacccatctcgatatctctttgtcccttgttgcaaaaatgtcgaatctttcatatgtctcatgttgagtaaaagctgcatacaaagtgttcgtaaaaatgccgcaacgaaagttacttgacattccagatcagattattatttttacatatagtatgcctatagaattatttcttgaaaatttgggcatgtcaataaattcttgttgcatagcgcattagcagattctaagtatagcacagtaagtaagttgcaatttggtttgcatatcgatttagttttagtatggtcagcttcttattaggattatcaaggaacttaggacttgcggtctatgtggtgaagcttctgtgatgatctctgaagtgtttttgttgaggacattatgagagagagaggtatagtctccaccatg

SEQ ID NO: 26457 - DNA, 3000 bp, Unknown; identical to SEQ ID NO: 13621
  misc_feature (1)..( 3000): 2750-1469P.txt file - cDNA_ID_2713894; gDNA_ID_2214640; Annot_ID_136226

SEQ ID NO: 26458 - DNA, 3000 bp, Unknown
  misc_feature (1)..( 3000): 2750-1469P.txt file - cDNA_ID_2713916; gDNA_ID_2214641; Annot_ID_136235
tcctgcattatacagagaagcccgagactttcgtaattatctgctaaacaatcctgttttcttaattccttcacaggctctgaaatttgtttagcttaaattatctactcaatgcaggtcagtgacttgataaactgtggtgtctatgtgtttacttcagatatcttcaatgcaattgaagaagtatatagccaaataagagacacatgtgagtattcattattggcctctctcagagacttgcaatattatcaattagagacctgcttcatcattttcatgattcttttggtcttttcataagttattcattgtataatctctttaaacttggcagctagcaactaccaatccgctacaaggtctgttcctgcagattttgtgagattagatcaagatatattgtcacctcttgctggaaagaagcaactatacacatatgagaacaaggatttctgggaacagatcaagactccggggtaagttggtggtaatcattgtttcagacgttcttggattactccttatgctaagaaattgctttaaacaggaaatctttgaaatgctcggctttatatctttcccaattccgcgaaacatcgcctcatattttagcttcaggagatggtactaataggaaaccaactataattggtgatgtttatattcacccatccgtaaaactgcatccaaccgcaaaggtgagtttatttgtttcatctcatgaattctagctaaacttctcattcagtttgcaaatgaaatgacacacttaaatttctttggaacaagatcggtccaaatgtgtcgatatcagcaaatgttcgtgttggacctggtgtaaggcttattagctgcataatcttagacgatgttgaaatcaaggtaatttggaatcagtgttttagaatgttcttcttgttatgaatccaaaagattcgttgtttaatgttctctactcttgttaaatgcaggagaatgctgttgttataaactcaattatcggatggaaatcttctataggtagatggtcaagagttcaagctagtggagattacaatgacaggcttgggattaccattcttggtaacttcattgttttctttttgttcaacaaatttttcgttatattttttctgattaatttgtttctgcaggtgaggctgtaactgtggaagatgaagtagcagtcataggaagcattgttctccagaataagactcttaatgttagtgttcaagatgatatcatcttgtgatttatcacaatgattatcgtttggattttttttctttttaattgaaacagagaaacttttacagaattgtgtattacatgaattgagttcacaggattagattttgagtaagtgaaactatggaagatttgtaaactctcactgtactttgtgtttagatactaaaaagattttagaagaaagagttttaaaagatctaagataacaaggaatcaaagaagttttgcttcttgattgtgtaatcactagtgttcaatacctccttaggctcctttcttttgtgcaaattgctcactagaaaaattgtttatcttgacttcgtttgtgggggtaggcccggacataataccggaacccgaagaaccgaactgaacttgactcgaaataaccaaacccgttctacttcggttccggctaattacttgatcgggttctgttttcaaataaccgtgggtaccggaaattacccgaactgaacccgatacccgtgggtactttttattacccgaacatatatatacatagggctgcgcatatgggtaacccgttcggattcgggtaaaacccgttcgggttcgggttaaatgggtaatggatttactacccaatagggtaaaatgaaaattttcgatttcggtctagttcgggtacattcgggttcgggtcggcttgggtaaagaatttcaggccctaagaatagccaaacaaatgaaaacgggtattttatgtgtagatagcgggtacccaacaaaaaaaaaaccttaaatattaacaaattttaataatttaattagatttagatatattatactaaattttgacaaacataacaaataatttttaaatagttgggtatttagatctaaaagtaattgatatatttagatttataattataattttagattattacattatattaagattaaatataattaatatttttgatattaaatctatgttcgggtatcctgtttgggtaacggataaaccccggaccgacctgatacccacgggtttactaaaactttacccaatgaagtaatttcttaaaaccctaacccaccccaacccgatttttcggttcgggtatcaggttcgatatcgggtcccgttttttgcccagccctatatatacatatgaggatatatatacactaataatgtgacttgtttaatgatttgagttatggaacaagcttaaaacaaggtttacttcttgttttatattattggcttaaggaaaaacttgttataatttcagatctttcgggttttatggatatttttatgtatgtttgggtatatttggacaaagtttgggtaagtagtactcaaacccgaaatagttttggttacttatggtttttttaactaatacctgaattatcggacccgaagtgaagccgaaccgaacccgacccgaaattgttgatataaccatacggatccaaaatttctaaacccaaaaattcgaacccgaaaaatccgacccgaccctgacccgaataccacatgcccagggctatgttaggggaaaaaaaaaaaatacatgtgggcttaaatggggtttgaaattaaaaccggtctgaatagacggttcattaagaaaaccggcaattaaaaaccgaacttcatagagagtcttctttacgcattctccgtcattcggttaagttgcatcgatcgttagggttttatcgagagagcaaggagagcgatttctcaaatcgactttaatg

SEQ ID NO: 26459 - DNA, 714 bp, Unknown; identical to SEQ ID NO: 13658
  misc_feature (1)..( 714): 2750-1469P.txt file - cDNA_ID_2713919; gDNA_ID_2214642; Annot_ID_188377

SEQ ID NO: 26460 - DNA, 714 bp, Unknown; identical to SEQ ID NO: 13658
  misc_feature (1)..( 714): 2750-1469P.txt file - cDNA_ID_2713919; gDNA_ID_2214642; Annot_ID_136289

SEQ ID NO: 26461 - DNA, 3000 bp, Unknown; identical to SEQ ID NO: 13664
  misc_feature (1)..( 3000): 2750-1469P.txt file - cDNA_ID_2713923; gDNA_ID_2214642; Annot_ID_136285

SEQ ID NO: 26462 - DNA, 3003 bp, Unknown
  misc_feature (1)..( 3003): 2750-1469P.txt file - cDNA_ID_2713938; gDNA_ID_2214642; Annot_ID_136267
gtgttgatcagttcctaataacaaaagacttatagattttgtaggaacgtacttatttactacaaaattcaacaaaacgaaagaccaattcaaactagactcttcttactacttcaagtaattaactgacttcatttacaagtcctagcattaggtttcagatttgtttgttcttttttttttttacaattagctaatcatcatattctcattatgtttaatacttgggacaggttctatataatgcggatcagagatacaccctttgacttttccgtactcactcaccacgcgagcgtgacacagtgtctaggatcaataggaggtcatgtttggtaccttggagtggctaaaccgacacttattgaagatggtgatgatggaaagatggtagataaattgaaatcaaggtctggtcacttgtacgctcctcctgcggttgaagagattcgcgtcttcagggtctcgggaccaaagtttattaaactgaaccacggtacgtggcatgttggaccactcttcagtgacagctacatggacttctacaaccttgagctcagcaacacaaatgtgagtgagaatggttttattgttaataatgtatggaatggtgatgaatgacttgtttttattgacgacattgttgttgttgatgatgatgttcaggcggtggatcgcacgacatatgatttcatcaaaaataaaggagtcaccatccgagttgaccccaacgatgttgacacatcgtcctcctaactcaatcttatcatcagtgtgtgcttctgttttcatgaataaattgagcaatcgtgaataaaatttgtatgcaactgtgtacaaattgttttttttttttttttttttttttcaataaatatcgaaaatacttgttttctcatattttcatgttaatcccatacttttaaaattgacaagaaaacctaaatatactttggtgtcttctgattgattttaaaaacattttgagtggatacaaaaagagctcaagatacaatcctctttatttttattttcttgtggtgcgtttcaacgatggcgaaatctccggtggaagtgaatttgattcctatcgaagctactccggagaacttcgcagagtatggtcaagtcattgaagcctctcgtgatggtgctggtttcggtccccacgacgctcaactagatctctctagaggaaccccacggtactcttttccccgattctcttaaatttcgttaatccttaagattatttgttaatcttcgtttaaattcctcatttttgatgctaatttatcaagctatgtgatttgtgttggttcctaaatactagtgttgtacaaggtatttataacaaagtcctagcttttaggtttcagattggtttgttctcaatgtgtaatataatttgacggcaggctctatatacttaggctgaaagaaacacccttagggtttttcaagatcacacatcacgcaaaggtgacacagtgtctaggatcaataggaggtgatgtttggtatatgggagtggctaagccgtctcttattgaagatgatgacgatgatggaaggagcgtagatacagtaaaatcaaagtctggtcacttatacattccacctgaggtggaagagattcgcgtcttcaggttctcgggaccaaagtttgtgaaactgcaccgtggtacatggcatgctggacccttgtttagtggcagctccttcatggatttctacaacttagagctcagcaacacaaatgtgagtgaagaatggttttaaattgttaatacacagtagtgtgatgaatgacattgacggtgatgttgatgctcaggtggtggatcacacgtcacatgatttcaccaagaataatggagtcagcttcggatttgacacattgtcttcctagctcaatcgtatcattggtgtgcttctgtttttccttgtggatctatatatgtaagcctgtgtagtgtgtacactctacacaaattggttatgtgcaataaaataccggtttaagttaaccaactttgtttccagtactccttaatctcctccatctggttttttaatcattcttcaatttgtggttttgtgttaaaaaaaaaaaggaaagcaaacctttgaatatattaaagaaaattggtgacatcattcggcgtttctagtaatctgctctgttgccagttacagtatatacttaattcattagtaaagtatatatatttaattttattaataaaaacgattagtaacgtgtaaccgtagccgttggatatatattacacctacacgtgcaatgcaaccatctttcgatcgcacaaaaagcaaacgaaaggccaagagaagagctcgagatcgatccgaatttgtggcaaaatcagattctctgggtacacaaagttttctcttcactttcatctttttcttcatatattattatattcgattttgcatcctgctctgtgagtgttcttctaattccaatcactatctctgactgattcatgttttcagtctcatgtgtttcattatacttttgttgaattcaattacaggttttgatactccatagatagagtgtgtacaatctgtacttatttagtgatgatccactttttgtattctttaattgaatttgagaaatcatattgaattaacgaatatgctaacttcaggaagacgatattagcaatcatggagcgtctaacatctcctcctcgtttgatgattgtctctgatcttgatcatactatggtataaagctgccatttttacgtctttttaaaagtttgtttgattgaatgattgatgtgattgtttgtgtaggttgatcatcatgatcctgagaatctatctctgctgagattcaattcgttgtgggaacacgcttatcgccatgactctcttcttgtgttttctacgggaagatcaccgacattgtataaagaactcagaaaggagaaacctttgttgacccctgatattaccattatg

SEQ ID NO: 26463 - DNA, 3003 bp, Unknown
  misc_feature (1)..( 3003): 2750-1469P.txt file - cDNA_ID_2713942; gDNA_ID_2214642; Annot_ID_136264
ctggtactcttaagaaaagtgagatattggcatcactaaataacgcaggacttcctgctaatgaagaaaatgctatagccatgatgagatttttgaaggctgataccgaggagtctatctcatacggacatttccgtaatttcatggttttgctgccatatgagcgcttacaagatgatcctcggtaagtatagtactttgttttgaaataaaattgatgttttattttgtagcggcttgtctttgcactaatgagtaaaatgccaatttgaccactagaactgtttggattgaaccggaccagtttccccttagtttctcccattcatgttgatttcctcaaacacttcaaacttataatttttgttgtcataccaatggtgattgatgctatttttacttgtatagtaacatctggtttgaagctgcgactgttgttgctgttgcaccccctgtggccttacctgctggagatgttctaaaatctgcattagcgggagggcttgcctctgctctctccacttccttaatgcatccgattgacacaatcaaggtgagtcctcttggtgcttttgcaagctgaatataagtaaatgctctgtttagacaagtttaggtgagaacttggctactacaaaagtctgcgtaattgacatctgcttctacaatatttgaatatttaaatagatgagtatgccaattattcctcctggcttcttgtggcatactgttgacggattcgttatcactttcatgccagacacgtgtgcaagcatcaaccttgtcatttcctgaagtaatagccaagcttccagagattggtgtccggggagtgtataggggttctattccagcaattcttggacaattttcaaggtcttttcagttgtttcaaatcaaagatattttcacttctacctattaaatttgatttccatgtggcttaatctctttcatcattgtagccatggcctgcggacaggaatattcgaagcaagcaaacttgtgttgatcaattttgctcccaatctcccagaaattcaggtgattatcactctctactcactgtttggctggtttcgtcaagattctaattttgtgcttcaagtatatgtattattatgtgttcttatagttcatggcatctagtaagtaaaccatatgttagaggaaaaatccaatatcaaggctatttcattgcagtacttagcttccttgatgcaatggttgacatggtagttggtagatcattgtatactactatttgttgcatctccttggttctaaagttctagtagttatgtaaagtttatggctagaataatatacacttgatgctgctggggctaaatggtctcttaattgcttggtttgataaagttgtgtatggtttctgaagtagaacccatccgcttttggttaacagttacatcgtttgcatttgtgctttctgatctgtgttttgtactcggtaaccaatgtgatcatttaatgcaggttcaatcgattgcatcattctgcagcacactattaggcacagctgtgcggattccatgtgaggtgctgaagcaacggttgcaggctggcatgtttaacaatgtaggggaagccattgtcgggacgtggaagcaagatggtccaagtggctttttccgtgggacaggcgcaactctttgccgcgaagttccactatacgttgttggcatgggactgtatgcagagtccaaaaaggtaagaaaaccgaaatgattggattatcataagggtcactactgtaattgttatattgattggggtttatgtgtgtattgtagatggtggcgcaagctctgggaagagaactggaggcatgggagacaatagcggttggggcggtgtcaggaggtattgcagcagttgtaacaaccccatttgatgtgatgaagacgagaatgatgactgcaacgccagggagaccgatctcaatgtctatggttgttgtatcgattctgcgtaatgagggaccgctaggtttgttcaaaggagcagtcccgaggttcttctgggtggctcctctaggtgctatgaactttgctgggtacgaactagccaagaaagctatgcagaagaacgaagatgcagtgctagcggatcagcttggtcagaagaagctttgctaatgggattttactttgctttgctgctacgaagttttttgggggcagcttaagccggagactcacctcttttgttaaaagctactttgcaaaattttgacaaaaaaaaaagggttcattgttttgttgtgcattgaggacagtttcatttactctttataaaaactctgcttcaaaaatgtgattttttgccctctctacaattggttgttgctttgacagttgcaattacttcaatggtatacagtagccttaaatcgccatattacgaatcttaaggtaaattcgttgcttctttttgtcaccaaacataagagacattggcaaatgttggtaaaaagaaataacgttgtgaatgtaatacactcaaaccaaatgattctgtcaatacaaaagcaactctgtaaacgtaacatgagaaactcaacaattcacatatgttttacaaaatctactttctgtggtattcctgaccaaagcatcaaacttgggctcgtattcaggagttattttgtccacgtacttggggatctaaatgcctgcagtaataagagattccaactttggtacttcaacacgtttcttctctcaatcctcctcacaacttcagtagtaaaaaagacaatcactttgaagggaaacacaaatgaaatgactgtcgaattcagtcaccggtaaacacccttatatgttctgttattttctttttagtcccatactttttttaaattcacaacaaaacccattattggagttttctgattatttttaaaaacagtttcgagtgaataaaaaagctcagatgcaatcatcactttcattttcttgtggtgtcaagtcaacgatg

SEQ ID NO: 26464 - DNA, 3003 bp, Unknown
  misc_feature (1)..( 3003): 2750-1469P.txt file - cDNA_ID_2713944; gDNA_ID_2214642; Annot_ID_136262
acattggcaatggcttgttgtcgagaaacgactgaaaaagaagaaaagctcgacgagggcggaaaagaggtacctcatgtcctgctccatgtattgtcaccagagtcagccctttgtaaacttggctccatccaccaacctgttctttcagtactcatgcattagtttccacagaagaaagaaatgagactgaggaaactgagtattgagttgtttttttctacctgtccatcatcgttccaagggtaccatttggagagtggttgtaacttgagggctctaatggagtatcgtgttccagtaatgggaaccactgaatcagtgtctccgctgcatccaaatttacagaacaagatatcaatcatgataccaaaccgggatgtacaagatgatgatcaaaaggagaagtagatatacctgaaaacccatatcctgagacctgcggcgatgagttctttgtagattggaagcatagacagaggagaatctgcccatttctctccaacgatgtcactaaacaagaaaactatgtcactgaaaatgaaccacaagagaacattttcttaaatttgttgacccactataatgtgttttttacctgcaccctttccatggataagctagtcctgttatattagcatgcatagccttttgaacctccggagaattgaaatacatgccggagtatttctctgtgcaagggtcataggctctccacatccatggcttagataaacaaaaaacgtagcaagtttagagatttgtcaaatcttgttacctatggactatgtcttggtagaataacttgaatctatagaagcagccataaagcaaatcaagtaatcaactcagacaatgaattggaatcaagtagcagagagaatccgaaagatttttttgcagtccagaatccagatatcatgtaatccccactctactttcttggactaaccaaagtacatctacttgttgaaataggctcatatattggtcattttgaatctggtagcacaaagagagggtctaatacactagatacgtagccaattctgcatataaaggtttgactttcatgttctgtctctagtaaagttggaacctcctaatgaccaaaactaccttactcgagctggtaatagtagttaaaggaatatgatgggcagtgatggaaaactcacatgacgaactctcgagaagcgagacctaagagctgcagcctcctttttacaagtgacagtgtaaatgctataaggatcaatattgccttgctccaagtctgcagcttccatggccttggtgcatttagaggacgggtgctcggatgatccaaattcacacgtgatccgtaagttgtggtaagtgagatcagatatcaacccatgagcccaccaatattcaaataaacccacgtaatcatggtagtcatcaatcacagcattcccaacctagaaacaaactcacgtttataccaacacaaaaagaacatgttaatagatttgtgcttctttttttcttgcttacaatgaagcctttaaagttgatagctggattgcgtttctcataaacaatctgtgacaactgaggaacataatgacctaaagaagaaaagtgaaaatgcttagctaagacaaagtttccaattgaatagaatcagtaataacaataacctgcatagctttctccagcaatgtagaactctctgtgtttgtattgaggaaacctctcaaaccatttcacaagaaacacataagcatcttccgctagaaaaaatcaaaccaaaatcatcaaatgattgataaatctagagaaagagaagtcaaaggtcaagactttaccagttctctgatctccggcagtatacaaatcggaggtagtattcgaatacgagaaaccaacaccagcaggagattcaaggaagagcaaattcgccactgacccaatataaagagtgttaatttaaggattgtgaaatcaaaatttggagagaaatggagaaacagagagagatgtacatttgttccaagagtaaggattgtggtaaagagttttgccatcaggattgattctaaaaggtccgatttcttcagcggcaccgtaagctacggaggaacaaccaggtccaccgttgagccagaggacaagaggcttagactcagggttttcactcggtggtgactcagtgagccagtagaatagtgctcttcctgctgactcgttgacggtaatgtaaccagagaagtgagagaaggagacatcgtttggttcaccgggaaggtgaaagattcggtctttttcttgttcgtgtctggaacaagaagcgtaatggagtagaataaggaagaagaagaagaggagaaggagtcgagccatggttggatcaaatgataagggtgaagatctcaatgtttttgatgataataaaatcagtgagtgatggtggggacagagtaagtgagattaataaatggcggttatatttgtatttcttacatcattgactttatttacaacgatgactttgtccttgcctatgttacattgtatcatcatctatttttgattcgaagagccaataagaaaccgaaaaacgtacacggactcttacttagctaaacaactcgagtaactaatggttatcccttaatacatgtcatatctagactctagtcatcgtttcggatccaaattcctcaatcagtcatgtgattttgtagagagacataaaacaatacacaaaaataaaattttgtccattaggtgttgaagataaaaaaaaaaaaaaaaaaaaaggtgtgcaagtgttatcaaggtcaaagaaaaaaagttcgaacacgagacttcatgcttgaagagagaaacagtaaccactagaccactaaaagaaatttataaagctacaagttttattaatatataaaggaaaataaaatctctaaaaccctacaacattcatttggaggaggagacctgaatctttgcaatctcgcaacagaaacggcgatg

SEQ ID NO: 26465 - DNA, 3003 bp, Unknown
  misc_feature (1)..( 3003): 2750-1469P.txt file - cDNA_ID_2713947; gDNA_ID_2214643; Annot_ID_136293
tgtggaattgtcagttaatgttttcatatacataatcaatagcctagttaaaatattatcaaacaataagagaagttaatggatggctactcactaatttaggtaactcaattaaaatgactgccaaaaaaataattctacaacagttttacaaaatctaaatttataacaacagatatctaaactaacattaatcaacgtctcagagtagttttcatttcactaacctttaacattatataaggatgtgttaagttctcctaagacgaaatcaatagaagcctcctccatgggaatgttacgctgagattatgcttggcttgtatacattttacatttccaaactcaaattttgtaaaatcagttaatatacaataaaagacgtcaagcctatacctttctctcaaaataaaatgggtaaacagtagctaacatgttcttatcaaataaacaaagtgttattattaacatatcaataactattagaattgccctaggattctaaatagcttagaagatgacactgaaatcccattctttaaaagaatttaactcttaaatgaagcactactgtaaagataatctgctcattaacctgtgacatttatatttctggatagctctattgataagatttctcttccctcttcatagtatagatgttatttgcaaaggttcatcaccttaaacagagacttactactttgcttttaacatactagggcacaactatatggtacattacatatgatatgccttaacttaaacttcctaccagtaagtaaatctgatacacaatagtgttgttttctataaattgatgtctcactaatctgttaaatcgagatttcagaatagctatgatgacgaaatctcagcagctcttccaaagtctcatgttacttccaaacctcattcatctgaataaatatacattgattttcactataacataaaaggacaaatcaatgtgccatatatatgaaacaacttttttgttatatatatatatataaatatgtatatatgaagtatcttaactttaactcaataacaatatcaaaatctacaaatctataaaactaaaattcaaaaatagagataaaaaaaactaaccttaacatatatatttcggaatacctacaatgacaaaaactataaaagaataaatatgattcagtatgaagcttacctcttcatacggttcacgaattataaaaatagaagtataaagcgagttgcagtaacaatttttctatgataatcgcgcaagtgattttttcttcttctagagatattcttcattttgttcggtgaattttttctcttttttgctaataagacaacaaatttctacagatggattatggattgattctaatagcaaggcgggaatcagatggggactttttaacgctcaaggtcgttgccttctcaaaggctccacgtcaatagagccaacaaactcagctttggatatggaggccattgcactacgggaagctctactgcagatgagacgggtcagctatcagaaagtcatattttgagggaactcgcgcatgctatatggtcatttagagtaggtaattcaataacgtcaacctattggggacccttagaaaatccaagaatacattaaggatatagtcgttatgtccaaaaactcttatgcctttctacatgtaaatcgacaagagaaaacagtaacggacacactagctaaaacagttagacatcagaacttggtttgtgttgtctcttggattttttaaatgtatgtcaatgttatatctagtgaacacttcttatactgtgtttccttgattaatggaatatttggccgacaaaaaaacgaaaaacacaaacgaatttcaagacaacatatatttgtccacaaataaacactaacatcaaatggcatatgactaaatggcttcaaaatctgttactattggatctattaaaatatggaacaattcttgggttcaccctttagggggtgaatccattcattcaccgccttttagttgactaatgagaatttgacatgtcatctatttaaaaaataaataatttaatcacaaaatttaaatcttaatcactattttatcaacccaaaccaaaatataatttcgtttaatcacaaaatctaaaccctaacagctattttatcaacccaaaccgaaatataattttgttttaatcacaaaatctaaaccctaaccactattttaacaacccaaaccaaaatataatttcgttttaatcacaaaatataaactgctggaatctgtaagtttaatcacaaatataatgtgaatttaacaagatgttagtttacaattattaaattgtttagttccgtaaaaaattgaacttttaaattttcacatctacacatttaatttctgaaaattttaaaattctcttttgttaactaaataattttttatttggtatataaaaaattataacgttttaaataaaactataaatatttgtattatattacattctattctaaatactattctaaatacatgtctatattgctactataatataaatatactattataatttcataaaacagaaataaatacataatatttttcataaaacaatatataaaaatactattgtattttcactaaataagtgcggattaggatctaatatgcaataaaacctaatttttcctttatacgattaactttataaaatctcagtttataagttaaattaaattttgtaaatttaaaaattgtttataaattcctatgaattgccaaattttattttaaactaaaatttcacatgttaatatagaaaaaaacattaatttttgtatttgttttcatcaaatgcaaatacaagatttctccattgagaccttttcgaccgtaaaccgattgcgatcaaattagctgatctgatcggaaaatcacaagaaaaccctagaaaactcctccggattcgaattctcgactcgattcaatg

SEQ ID NO: 26466 - DNA, 2584 bp, Unknown; identical to SEQ ID NO: 13693
  misc_feature (1)..( 2584): 2750-1469P.txt file - cDNA_ID_2713951; gDNA_ID_2214644; Annot_ID_136338

SEQ ID NO: 26467 - DNA, 3000 bp, Unknown
  misc_feature (1)..( 3000): 2750-1469P.txt file - cDNA_ID_2713955; gDNA_ID_2214644; Annot_ID_136337
agtcgctttagagacctcgggaattcaacaacttggatgggcaacacttgcttgccctttcactgaccagaaaggtgtgggtgatgctgatgattcatatgcttttgatggtcgaagggtaagcaaatggaacaaggaagctgaaccttatggtcaatcatgggttgctggggatgtcatcggttgctgcatagatttgaactgtgatgagatttacttctacaggaatggtgtctccctcggggctgcatttactggtattagaaaacttggacctggatttgggtattaccctgctatatctctctcccaaggtgagagatgcgagttaaatttcggcgcttacccgtttaagtaccctgttgacggtttccaacctcttcaagaagctccaactcgattttcatttgcaacagagctactacgatgcttctcaagactgctggataggccagaccgctcattggctgatacattaagtcgactgaggagatttgcctcagtcgaagaactcttttgccctgtttcgtctgccatatgtgatgagttcttttatatacttgagcaagaccctttgttggcggagtacttaggacggggtgcatttctgtcattcctcttggagactttcagaactcaagcaccgcatgattcgtcaagtttagacaaagttcttgatgtgtttcttgagttcccacaatctcatttgatctttgagcatgtagtaaacgctctggcttgtggctgcaaaacagcgacactgattttaaccgagtgtccatactccggaccttatccctatctggcgctggcttgtcatttgtttaaacgggaagaattgatggtacaatggtggagatctttgcatttcgagtttttgtttgaaggtttcttgtcatgcaggagttccaacaagcatgacttacagcacttaatgcctgttgtttggtggcctggatcctctgaagatatatcctacgagagtagcatgggatttacgatctccgctctctctgaagccattaacaaggtatgataggttatttctgacttattttatttttctataaataaccgctggcataagtctcctctggaatctgaggaacataattaagtaattctttctcttggaattcagattgaggagaagcagaggaacctctgtctcttggtcatacaattcataccacctgtatcacctccccagcttcctggttcagctttcaggggattcctacagaaccttttattgaagaacagaggcgcagataggactctggccccttctggagttacacgcaattcggttcttgtctctttgttctcagttatactccacttcttgtcagaaggttttgcaatgctgaagagtagtgaagccgtccatcacaatgttggttttcttcacagaggtggtcagcagaagtttccattgagtttgtttcttaaaaatgatccacatcgcgctgatattactaggcttggcgggctatttagtcatatatcgaagtcctaccccacagatgatcaagaagaagaaataatgcggtgggaagaaggttgtatggatgatgaacagaatagagtaactcacgcgactgagcaaaagccatgctgttgcttagcttatgataccgatcttactaaatccttgaaggatcgaggaaaaaatactgctcaaagttctcgtggtcgatgcagttccattcctgagagatcctctcatgttgctgcagaatgtagtgctggaagtttcagtgaagaaatagacgacaaacctagcacaagtaatcagtctgaccctgactttggttatcgtccagtaagatttatgcggactgcacttcaagagagtagaatctcatctgctatactaagcgaagaagaactattggatgctctattgctattataccatattgctgttgctccaaattttaagcaggtaattttaattattcccgtcttaattagattttgttgtattttttgtacgatacataccacaacctgaataagcttgagaggctgataggttctctttctgcttttcttaggcatcatattacatgtctcaccaatcgcaatcaatatcacttcttgaagaaactgataaacagataagagaacgggcttcttgtgaccaaataaagcgcttgaaggaagctcgcaacaactacaaagaagacgtgatggactgtgttagacattccgcatggtaagtttcacttaactcatggattgcgttaactccagaaggagggtgtagtgaagaggtttcagttatgattcatgtgaggcaacattacaatctatatttttgccctcattctgaatcattttgtcaggttccgcatctcattgttctctcgatggaagcaaaggggaatgtatgcattgtgcatgtgggttgtacagctacttctggttctcagcaaaatggattctgtgtttgtttatattccagagttctaccttgaatctttggtaaacagcttttgcacatttctggtacttcttgatataaatgtcaaatgaacatgtttcagtttctctttgatcaaagttagtagatcttccaacaacttattctgttgcgttttctctgtttctcaatgaaatccctaagtttacaatctctttgattatttcctcaggtagactgtttccatgtgcttcgcaagagcgatcctccgtttgtcccatcaacaacattcatcaaacaaggactttcatcatttgtatgcctaaactcttatcacacaatcttttttgtctgttatttttcctcatggctgactgttagttgattagctctaacatggtcattgcaaattcttgggtttccagatcactttcgtagttacacacttcaacgattcaaggatatcgaatacagatcttaaagatctacttctccagtcaatatccgtcctggtacagtacaaagagtacttggaagctttcgagaacaatgaggcagctactcgacacatg

SEQ ID NO: 26468 - DNA, 3003 bp, Unknown
  misc_feature (1)..( 3003): 2750-1469P.txt file - cDNA_ID_2713962; gDNA_ID_2214644; Annot_ID_136330
ttttgtacgcacaaagtcgggtgccaaaacaatctcccctgcatcattagtacaaaagacacaatgatgaaagtaaggattgcgaattagtgaagtagacgaaacatcataagacatcttggaccattcgtgttttgcagcatcctctataacccacaagttaattctataatcagatccaggaaacaggagtgcaggctttccctcgtagcgtgtcagctttggattcaagtccccgtctggtcctcctttaataagatcaaacttttcagatctaacatcaaagctcatgactgcatgattcgaagctgtgtcgagcatagctacataatacaaaacaccattgatacacaaatcaggagtatcttcatgacagagacagtgaggaggaaaatcttcaaccatcctccaagaattcccttttctcaaagtgaaaacctgaagctccttagctaaataccgtctctgataaacatgcatgcctttcatcatacacaacactttgtaatcaccatcaataggatcataacccatatggtggtatatacattcatgattagcatcaatcttgggcaggataatggatcgtctagtgctagggttagatactattagtctagggctagacactattagtgtagaaggaggtccatggcaaatcaaaccgtgaacagaaggagcaaaggttttaagctgtagatgagggcaattcataaggtaagttggtttagaagacgaagttgattcaccttgatcaatcaaggagaagaagcaatggattccgccgcctgcgattgtaaagatgagactttgtgggcgagtcgaagaattaatcaagtacgatttcatgaagtctctgttgcgaatgatggaagtatattcttttgatacggagaggaacctagctagggttttgacaggtaaccttttgagtatctccgggatgagatcaaacggaatctgaaccgagtttccactgcatgtaattagatcatcggatatcttcgtcttcttcgatctctgtttctccatggcggtgataagaacgaaaggcatcgatttgacttcacagtgagaaaaacttaaggaataagagaagaaatatgaaaggacggtgaaaaaacgtggtgccgttttaaacgggttggaatatgactaaacgtcgtgccgtcttattaataaggaagaaacttttgacgcatgtcacggatttaaacactacacgtttccactaatgaccattattaatccattatacacactaaattcggaatttagatgggccttgtaaaattgtttcgtaaccgaaataaatggaagattttaaatatgaccaaatgtaaggagactgtattgaaagacaaaatattaaaagttatttgagttttaataagttttggtatgattctggtcaacttggttgaattaggaaatttgttattcaaattttttcaaaattcagctaaaattatgagatttgaatttgtttttaacctaaaatttttcttgaattgtcatataaaattatttaaatcacttcaaatccactacttcatttttttacgatttgattgtatattttctaattactaatccaataatatatttagcaaaacttcttaattttgaataaactaaccaaatttggatatgtagcaaagtttgataatatcttctaaattctgttttttgacgattagattataaaagtttttggcaattttagtttttttcaagcaccaatgaggggaagttgttaggaatttgaaaatttcatattcataacatatatttcttttggttcttattaattgattttttagaaaaaaaattgttttaaaaaaattgatttttaggaaatgtaaatcataaaaactaatatatttataattagttttaatatattattttaatctatatgttttttctaaaaaatcaattaaaaaatcagagaaagtagttttttgccaaaaaaattctgatgccgaatttgagctttgtatcctcagttttcttaggtgttagtaagatattttgcttttaataaagaagataattttgtgaagaaaaaaaaagttttgaggagaaaaatagaggataattaagaaatgtttataaaatggtcaaaacaactaatgacatatttaaagggggaaaaatgtcatttaatccctcaactttcaaaaaatgatcattttatataccattttatatatgcgactgtttaatatatgaactaaacgttgactaatttttaaaacattaaattaatcaacgtttagtttatgtattaaacggccgcatatcaaattaatgtataaaatgacaattgaaagttgagagattaaacgacatttttccccgcatcactgtttcagcttcaccaaccccattattctctctattaattatcaaatgaattagttattagtcccttaattattcaaaaaaaaaaaaaaaaaaagtcgactcatcctccggcgggagtagaaaattcttcttggttctgcaggtggtaatcttgttttccttaatgaagtttcttagcgctaattttttatatgttttctcgtttaaaaagtgtcaatttttaaaaatcctttcccttttacggttcaatttgatttggataataattctctttttctctggaaagttcgaatttttttttgtttggaagcttggagaaaatattatactcttctcattgaatgatcaatttacaaatcctcatttgatcgatcttgtcaatttttgaaaaaaaaaatctgaactttgagaaaagttattgagtttcgatatctgtcggtcatggtttgattgtggctgttgggtaagacaacaaattaggtagggttttgtgatattgatgtccgtagtccttaattatggccaaattgttgtcttttaggttttgacagtagcaaagaaaagctgaatctagttagaaattgcttttgcagggtttttgaatagtttgtgtattgaagattgtctgaaatg

SEQ ID NO: 26469 - DNA, 3000 bp, Unknown; identical to SEQ ID NO: 13688
  misc_feature (1)..( 3000): 2750-1469P.txt file - cDNA_ID_2713978; gDNA_ID_2214644; Annot_ID_136320

SEQ ID NO: 26470 - DNA, 3003 bp, Unknown
  misc_feature (1)..( 3003): 2750-1469P.txt file - cDNA_ID_2713990; gDNA_ID_2214644; Annot_ID_136316
gagggtccagaataatgggcagtggtcactgttttgtcctaacgaagctccaggtttggcagattgctggggagctgaatttgagacactgtacactaagtatgaaagagaggtgagtccctatttcatccatgtatatgctgcttctttagtaactcaaattcctgttatctcaatacagttatgtttgttcatatcttcagggaaaggccaaaaaggttgttcaggcgcagcagctttggtacgaaatattgacatcccaggtagaaacaggaacaccatacatgcttttcaaggtaagtaacagtcatcattctgtagctacacgttatggccttataatcattggttcttactccaaatttgaatgctcttaaactataggattcatgcaaccgaaaaagtaatcagcaaaatctgggtaccataaagtcgtccaacttatgcactgaaatcattgagtacactagtccaacagaaactgctgtgtgcaatcttgcatctattgctttacccagatttgtaagggagaaggtgagagggagactggttttttaaaatttgctttctctttattactcaatgtatagctctaacattcttcatctcacaacagggtgtcccattagactctcatccacctaagctcgctggcagtctggactcaaagaatcgttactttgattttgaaaaattagcagaggtcagatacaagcactcgccttgcttgacctgaaatctgattcttaaggaattatctgtggagatatttccgtgtctgtgatgtgatgtttgactttttaatttttctgtgtggccaggtgactgctactgttactgttaatctcaataagataatagatgtgaattactatcctgtggagactgcaaaaacttcaaacatgcgtcatagacctattggtattggtgtacaaggccttgcagatgcatttatcctccttggaatgccatttgattctccagaggtagacttgttttgaattatgatcaatcttggaaaatataattttgttatctgttcttaagcagtttaatttgttactcaggcccaacaactgaataaggatatattcgaaaccatatactaccatgcactcaaagcatctacagagcttgctgcaagacttggcccctatgaaacctatgctggaagtcccgtgagtaaggtatgcatctcagccatcaattatatcaatttggttttcccaaacttcataagctaccattgtggattgttatgctgactttatcccatgcttctctagggaatccttcaacctgacatgtggaatgtaattccatcagaccgctgggactgggctgttcttagagatatgatatcaaagaatggagtgaggaactctcttttagtagcaccaatgccaactgcttcaaccagtcaaatccttgggaacaatgaatgttttgagccctacacatcaaacatctacagccgcagagtcttgaggtatgtgaatattaaatcatttgacaagtatgtttctggttttccccatttgatgcttactcacttggttgtcttggtttgtacagtggtgaattcgtagtggttaataagcatcttctccatgacctaactgatatgggactttggactccaacgctgaaaaacaaattaattaatgagaatggttctatagttaatgttgctgagatacctgatgacttgaaggcgatttacaggtatagcttccacttattttgtgttttcactctctactgtctagataaagaaatttgacttgtttcttctgtaaaacaacacagaactgtctgggaaatcaaacagagaacagtggtggacatggctgctgatcgtggatgctacatagatcaaagccaaagcttaaacatacacatggacaaacccaacttcgcaaaactcacttcgctacacttctatacttggaaaaaggtacaaaccttaatcatctaaactcttcatatgataattgtgaaataggttagagattctatagagtatctgatccttcactcatctgacaattactcttaatctcacttatgttgttgtgaatctaccttaagggtctgaaaaccgggatgtactacctgcgatcccgtgctgcagctgatgcgataaagttcaccgttgacacagccatgctcaaggtagaaaaaacaatgcaaactctttacgctgattcttcttgtgaactcagacattttacctatgagttgttttcgttggggtgaatgtaggagaagccgagtgtagcagaaggagacaaagaagtagaagaagaggataatgaaactaagttggcgcagatggtatgttccttgacaaaccctgaagagtgtttggcctgcggaagttgaagctctaagttatagtttgggtcttaaaaagttagaaagtaaaagcatgtctcttggacggtcttttttatttacttgcttatctgggtgtattttgttaatagtttcctaatgcttaatgttgcttgagtttttgtgtaatccaatttcgtttttaccttttctcttgaaacaataaggatttgtaacgagaattatgtataaccaccaccaccttacggtagattttactatccatatataaatattttaccatccatttataaatatttgtagtttggtactactaccaatggttgtaagtaatctgtaagaatatattctgatcattgtagattagaaaatgtgttactacaggtttcactagcttatcctagaactagaaacatgaaaattatgtatcgaatggtgaaaatattaatacaaacatatttacgtttaaatgcatgtgtacacaacaaagtttctaaagcaagctctatcatatagagaataaagtaaagcatgtagccaaacactctgaaactctgacgaatcgtttatcactgatttctctatcgatagtcccgccttcattgccaaatttaaactcgaaatctctctctcactcactcaatg

SEQ ID NO: 26471 - DNA, 3000 bp, Unknown; identical to SEQ ID NO: 13711
  misc_feature (1)..( 3000): 2750-1469P.txt file - cDNA_ID_2713996; gDNA_ID_2214645; Annot_ID_188488

SEQ ID NO: 26472 - DNA, 3000 bp, Unknown; identical to SEQ ID NO: 13711
  misc_feature (1)..( 3000): 2750-1469P.txt file - cDNA_ID_2713996; gDNA_ID_2214645; Annot_ID_136352

SEQ ID NO: 26473 - DNA, 3000 bp, Unknown; identical to SEQ ID NO: 13739
  misc_feature (1)..( 3000): 2750-1469P.txt file - cDNA_ID_2714000; gDNA_ID_2214647; Annot_ID_136386

SEQ ID NO: 26474 - DNA, 3000 bp, Unknown; identical to SEQ ID NO: 13738
  misc_feature (1)..( 3000): 2750-1469P.txt file - cDNA_ID_2714004; gDNA_ID_2214647; Annot_ID_136385

SEQ ID NO: 26475 - DNA, 3000 bp, Unknown; identical to SEQ ID NO: 13737
  misc_feature (1)..( 3000): 2750-1469P.txt file - cDNA_ID_2714010; gDNA_ID_2214647; Annot_ID_136382

SEQ ID NO: 26476 - DNA, 3000 bp, Unknown
  misc_feature (1)..( 3000): 2750-1469P.txt file - cDNA_ID_2714018; gDNA_ID_2214647; Annot_ID_136379
agactcgaatgtctacttctatgatctaaccaaaccgaagcacacatgtgtaaacaagctacaggttagacaataacttcttttctttttttttatctgaaacttttgtgtatggattttgaattataggaaacaggattcacgagttgtgagaaatggatgcttgcagggtcacaggtttccagtaatgtgtgttgcgtggaaccatggggagaacttgttggcttcgtctgatttctatggtgttgtcattgtatggaaaagagcaaagacaagctcataaggtttgtctataatattataaatgaatctaaatccgtcatttttgccacaaaggctttgggtttggcatcatctctgtatcgctaatctcaaaactgtgtcaatttagtttcccatctcttataaagatatagttctgtgacactcctatgcacagattcaatagcttaaatggttggaacagacacgtccttaatgagttaataactctttccatagataagttggtagacaatttgaagagatcaagttaattgtactcgcaatgttttttgttttgtcacattatcatgaaccagattaattatcagtaaaattaatgaagattacataaacaacattccattgtagtctagttggtcaagatactcagctctcacccaagagacccaggttcaacaagttccggcaagctggttcatctaattcttcaggggaccaaatggaatatgatacttggttctcttagagaaatgtggctctaggattatattgaattcaaattatgtaactgatgagcatttggtgcttatattagtgtggaagtggttggactagataatcatgctaataattaaacgtatttcaaccagcaaaaagaatccgagtgttttgtgtattaattcttttactaaaagcaatagaatctcaacttcaacgtaagtagggcactaataaaaacttaacatttacaattctcttatttcccaagcaaatatcttcggcgtcatgttcatattggattaataataataagaagaagggttggttggtcgtcgtatattatgaagacactcttccctatccactgactctatctgtccattgtccaggtctctctctctctttctccttctgccatctctgtcccaattcagacttctttctcttcgctacccatcatttcacgttcttcacttatccaccccaatttactatttttattttcttttcaagtttttattctcatattttgaagtgtaaatttaaataaaatgcttacctatgttttcccacaaaattaactcttgtgtatttcgtaattttttttttcatagaaaataactaaatcacttaattcacaaaaagtctattttggtctctccatgcaaaaactataacctttcagtgtgttggtaagaaaaggtggtaccaccattttctatcacactaagatatctcaccacacattttaatttgacttacctcttaccaccatttcgtaccaccttatactacaaatcagacttattataaaatgtcttggagttgggattttctcaatttgtttctgattcgtaatcgtaaagtcctccatgacaagatatggacctacacttagtgaaaagaaagtaaaagttagaaaatttgtagaaatacctaaaatctgtgggcacaaaaagacaaagctaagtggggaaaaaggccacttattcattatttatgagaaagagataagaatatgaagtgttttttttttgtttattccttgcaaaaatagttgtatgcaaatgcaactatatagtaaatagcatgtggaccatcacagatattattcgaaagaacaaaaaaaaatcaaatgttgaaacttgaaagtgaaatttaaagacaaagaagaagaaactgtaaaaagcttaccaaaaaagtgaaattattttattgaaaagaagttgaaaaaaaacatccgtgtgtaaactttgacacgtcgttacccaaattattccccactctaataaagatggactagtctacacaaaaattaatattatctttgattacaaatcggacatgaaatatttaaaaaattgcatagcaccaaaattagatatgaaaaacgttcattatatatttgtcttattctccaaatatgcttgataaacacattattatagaagaattacgaaaatatcttttactattgacaccaatcaggaatatatcaaatatttttagataagaatataaaaaacacagaaaatgattgtatggtggttatagcttcattcaattttattgcagcaaacaaacagaaaggccagagagacgaaagagagaggcattagggtttaggattaggttttagaaaagggtttagatctctaccaactggtttgttaagaacataatctccttaccacatttttactcttgaaaacattttgatctgtttttgttatcttcaccaaaagacttgactccaagaaacaagaagaagaatcaagaagcaagttcaagaaccagcttttaatgaaatctctacttcaaaaaggaaacttgctttaaggaggatggatcttttgttttcttgaatcttttgtgtgggtaaaacattttgtattatcaagattttgatttgaggagataaagagtttgttgttaagtttgtgttcttgggatcatcaagagttaaaacaaaaaaaaaaaaacatttcttttttccttcttcaatttgagatttagtgtctcctttaacacccacaaagccagcagatgctttcctggtaattctttaatctatcctttcttcttctttttaaattcttaaattcatgcagagagataattctcataattttcattggttcaatttcttaaaatttgcttaattaagattttattacataatgtgaagtataaaaagggtttagtgttgtttgtgtttgattctgaaacagatgactccttgtttgatctgatcataagaagaagaagactatg

SEQ ID NO: 26477 - DNA, 3003 bp, Unknown
  misc_feature (1)..( 3003): 2750-1469P.txt file - cDNA_ID_2714022; gDNA_ID_2214647; Annot_ID_136378
ttttctttctcccccattttcatgaaatattaaaaatatctcaaaagagcataatacgacattaatttgcattaatcgtcaagttgcaattatgtgtctaatcatatttacaatgctacacaaataaatatattatagttatcaataaactctctaatttggcgtcttgtttctcccttaccatttgagaactcaatttttctccaagagaaaaacaagaattccaaggagagataattaagttatgggtatgtcaccattaacggtgaagaaacttggtttcatcttcatgattgtttcagcttctgctctttctgtctcctttgcaggtttcacttctctcacccactctcttctgttttgttgcagcttttctctatacttcatgtgcgcaagaaattctttagtccttgttagaaagaaatgatcacaattgtataatctttagtccttgttagaaagaaatgatcaatattgtagtttgtcgttgtgtaaagaaactactaaacaatgatgatcatgatttagttatactgtatgtacaattaagtaacctatttttcttatagatgtaacaaataaacttcttttgttatgcaggccgaccatcgatttttgttcataaaaaaataaatcttcgcgaagaggttagtctaactaacatatgaaggggaatgtgtttcatgtaactttgtgcataaataagcatacattttctaaatttgaatacataataaatcttttttgctttcaataaataattttggagctgaatttggttaaatgataatgtgactcagatggtggaaagaagcatgcatgagcatgagaggcttctaagaatgaacacaaaggattatgggaacaacagtccgtcacctagacttgagagacctcctttcaagcttatacccaattgatgacattagaattggttctaatccatccttaaataatatatacatatataggtagaattagtttcagtgactatatagttccatcgaaatttggagatgtaatataaataaaggtaagaagctagcttgagctatgctatactcttatatttggtgtgctgcatagattttggcattttgccatacatccatggcatcacaatcatgtgtctttgtttttggttttcaaatatatatttatgttgcatgcaatattatttatatgtatatatatatatatatatatatatatgagaatttgaattcttactattagacagagatagtctaacagtaaaaaatttgtgatttgagttctataacggttcgctaataatttctaatcaacctctagatctattattatgatattttctgagaaattccttaggcatgacgatttttaatctatatgaatttacatcgaattttattgtttttcttgttttagttaacaatttttctgtttagtttgatttcaacactaagaactttccgtgtgaacaaaagaactttgtgaatctgatccttaagtattataatgaactcttaatttgagggacttacttgaagtctaatttgatatatgtcaattaccaattaagaaagccttcccatttgtttgatacaacacaatcgaggtgacactagtatggccaaagagatagttcacgatagaaaatcaaaaatcaaactttgcctcaccaaagattgatgtagtagaaactaaaaacaccatgagaaactctcatgttagaaaatcaaaattcaaataataatcaaaataaatttatattcaagagttgtatatatatatatatatatactagagtcgtcggatgcatctaaaccatagtccttgattcatatatgtgacgttttcatctccacaaatgggtaattgtgttattacatagtttaaccaagacgacatcgtctatatacaaccatttagggcatgtgttgtccaaattatttttgctatgaatcatagcgtataacaatgtttgtaccaattttgtattattattcaagtcaaaacataaaaaaaatgtttgtttttggtcaatgacctttacgtaagtcacatacaaaataaaattgtaagaaagatgcatatagaatctttaaagcattctgaaatttgataaaagtagacattaataatgagagtggaataatataattatatgcttatatacatctttcttacaaattcattttgtctatgaccctttactaatttagataattacatactcttatcacctctctcttagttacagttaatgaattatgaacaaaaatatggtaatatgacattaatgtgtttaaccttcgaaagatatatcgatggcgcaagtaaaaaaaagagttgaaacgagtttttaaaagagagacaatttacatgagatatttttcgttttaattcttagaattgaaactgttagttactctcaattttgttcattaaacactctcattattgatttctcttatcagcactgatggtattagacctgtggcaccaatagcacctcttgaggggttttatgcaaatccaaaagttaaagatgtcaattggaattggaagtaattcaaagggcttttatgcaaaagtttgtttttctcataaaagtttaaatggaccggactatagtctgggtcgcaattaaaatcgcttcaaattcccgagtcagagtctctcagcttcgaagcacgagcgagcgaggcaaaccaaaaagaatccaatttacatcatcttctccaaaattcagctcgaaattttcaacctttactggtttaatggacattctccagaccgatcaagcttcctcaaacggtatacgaatctctctgtgaaaaaaattaggtctttcttctgattttagtgtcactacattatatgcatgtcgttcccaaacccgattttgtgttagttgatccaaatatttgaagaaattatgagtaattttgcaatgttctgaagccaaagttgttgtctttcttgtttttgtttatttggagagtaatgtgacagatg

SEQ ID NO: 26478 - DNA, 1673 bp, Unknown; identical to SEQ ID NO: 13756
  misc_feature (1)..( 1673): 2750-1469P.txt file - cDNA_ID_2714038; gDNA_ID_2214649; Annot_ID_136408

SEQ ID NO: 26479 - DNA, 3003 bp, Unknown
  misc_feature (1)..( 3003): 2750-1469P.txt file - cDNA_ID_2714056; gDNA_ID_2214652; Annot_ID_136452
catcagtgcaaaacaacagcgcaacagtttcaaagtccatgaatttcaacagttaaagagatgataggtagaccctaacctgacccatttcttagctgaacgagaagccagagtcgccttgtcctgattcttgctagaagaccccttccttcgggatgacccattttgcttattcccactaaacgcattgttttccttacaccttcttaaaccaatcgactccatacccgatttcaccaactcacaattaccaatcttccttctcttcttctcctcaaaacaatcaatttcatcaagctccacactttcagtcttcacagccaccgcctgatctagtaaacactcccgtagcggcctcttacggcgacgatagtagacgcgaacaatctcaggacgctgaatccgcaacttataatcatccgaacgacaacaatcgtcactagcactaacaccgctaccttcaatctcgaattgctcaatcatcggaagcttctgggccttaaccttcttagacatcagactgtgagaaccaacggcattaacacagcacaatgccgatgaaggaatagagtagatactctcaatagaatcgtagcgaatcggagcttccactagatcgtggacatcaatttcgatctgggtttcgttagaaaaacacgccatggagattattcggagggagaaagcacagggcttcgtaaaggagacacctttgctcactctctctatccttctttcactaaacccccaaaaaaattgctagggaatttcgtggattggagaaattagggtttaggaagaagaatcagagaaaaagggaaaaaaacagatcctttggagggagaagctaaaaggcttttttacgtttcccgccgggtttattaagatgatgacaagtctttcagatctattgctctgtctccttatatatctccgcatacatacattcatatatagtgtgtgtgtgtatgtatataaaaattaatatctggttaataaaaacatataaaactaaaaataaaataaataaaaattccacttgtagaaaaaaaaaatcccggttgtcatgtattttattttcaacaagagtcttttttttttgggcaaaattcaacaagagtctctgattcttttatatagttttgttttcagataattgttgtttaccagtttttgtgtaatcttcactacatggaatttgttttgttttttttcagttcatacgtatatttttgggtttttagtctgttaagtatagtgtataagacatatttttctggttaatccaaattaaattccattggaacaaaaagacaagattgactagaatttgaatgaaggtagaaatcaaccgaattgctcataaattcaattattgaatggggttcttcaagtaatactacctattttctcaaatgagctagagaattttcttgtgaggaaattccaacgatttgctcccttggtattacttgttttggattgttctgaagttttctagaataatataatatttcaacctaaaaagcttagtttgtggataaataatcaaacatatgttaaagatttttgtgatagatacaagattttttctatgaatcggacaagtggaactctaatccagtttttaaggtgtgataagttgaagtaaagatatgaggttaaaagaaacatttcaactcacttcccttatcttcattcttaaatgaacggctattcatagcaattacttgatttggattcataaaccgaatatctgtctagtaggagtagtctttacttaacttaactaaagaacaatatacggttgactgtagtatattagtatgcttttgacacatggaaaataccgctgctaacttgatcgcatccagtgacttttgcagtgtgtcatatatgttaataaggatgtaatcatcatggttaacagtagttgcattttcttatgcggtagcatacaatgctcactagtgctctaaattgatccacatagggatgctatacacgctagagacatatatatttaaaagtaagtaaggttaaaatacttgctttcatgagcttcaagataggtgatgtgtgtacctccaaagttcttcccatcaactaggcattagaatatgtcgtttcctagatacttggggcagattggcggcttatcagcttttcggatgaaattttgatacttggacaaactggcagctgatggatggaacttattgtcaaagtatccatatagcgtttgttggttggctttctctagatacccacaaaatttacacaacacatatggcctatggtcacaaaattctttgatgtcatctaacattgggattcatcatcgcttacatgatttacgtccatatatacttggacataaatattatggaatgaacaattttaaattttcatcaaaataccaaccacactcacttaggattatgaccagaacaaataaaataatacatacttgattaaaaggagaaaaacatttttttatgtctttgttagtttttattttaaactatatattcatcaaaaaaaaagagggaaaatcacattttcagacacatacatgtccaaaaatatttgttttcccctcaaattcacctgaacttaattagtaagagaatcagtgacgtcatttagtaagagaagacccggttcggaataaaccggctaaagaagacccgggtcaatcagaatcaaaattgggtggttttggttagttaaacaaccctagggatttaaatactgtaaatcgtccagctctatttgtccctctcctccactctcgccaactatcaatcaaatcttcttctccttcttctccgccattcttgtccctcttaaaccctatcatgctcttctgagattctcccctcctctaattcagctctctctcttggttgggaatttcaaatcgaatatcaaccactgcctctgatcgtcatcaaggtttactctgtttagtgtccggattctcaaactccacggagaatg

SEQ ID NO: 26480 - DNA, 3003 bp, Unknown
  misc_feature (1)..( 3003): 2750-1469P.txt file - cDNA_ID_2714080; gDNA_ID_2214652; Annot_ID_136442
ttaatggcaaatatttaaggccaaactttccggtcttatttgtatcctccttgatgtattaatgaatttttatttcaagactatatagttaaagatcacaatgagtgacgaaagattgttttagatgttaaaaaaaaagtgaaatcaattcatttacttgtggcatatttggctaatttgaaagcacaaatatgagccaaagtacatttgatttaaaaacaaaagtcgacaaatagttgcattaagaaacaagaaaaaaacattgtttcagttttgcaaatcgtgatgatcacttaagcctgaaacttcccacgaatcagaggatccagacgattgcctatgacattataggtagcttccgatggatgaatcgagtcaaagaacataaactccgaccgattttgacacacaggagaaaagacattacacatgaagctcgtctccaagaaccctgttccacaacatcctctcttcgtctctttgaaccctgtttcgattccacacacacgaatcatatatatataaacaaataagataacttgtggagcaagaaaaatctttatgtacataccgtatttgctagggttttggatcatctccatcataggattatagacatcggcgtaaaggaatttgcttcctggaagagatgcttcgatttggggcaagagcttctgaagtttctcattgtacaaaacagagtctttgttatggtgttccaagcagaatctaaaaatgttgcggaatttagcagtcatatggatcggtaaacaccccattggcggtaaacctccaaccaaaacattccggacacctaaactgtaaagctcctgcatatacaccggagagattaacaaaacaaacaaattatcataaaactttcagtcactatagtctgttccaaaaccctaattgtggtaatatatatatgaagaaatattttagacgttacccgcacgaaattttcaagcctcttaagaataaaatcttggtaaccagaaatgaaaggatactcgagacgccttgagggaatatcgtaatagttcaaaatgaaatcattaggccctgcactcacaaccacgaaagcattgtttatgatctccatcgctttcttgtctcccacgatacctttgagacgagcaatgtaactcttgaacatgtttggttgttccgagacacgaatggcttgtgtcgagagactggttaggtcgtcgtaaccgcaccagctgatgcgaaacagactccggttagaatgtcttggtcggagagatttggttgtaagaaaggaggaataaactctttgatgttgagtttggttgcgattatgtcggagataagttttccgtttgagaatcttccgttagcttttccgtctggaagatccatgccgtaaggaaagtgttcagctctgaagattgttggtaaagggtagttgttgttgcctgtgtcgacggttgaatcgccgaagattagaatcgctgggaagagcggtttcgttgttgcatttgcggctgcgtcgcaggacgctagtaatgttgttgtgatgaagagagttaaggttatggctttagaagtcgacattttttgttttggtttttgttttttagtagatttgaagaaatgtgttgtttttgtggtgtatttataaggtgactttttttttgttaccaagctggctttgtgaggttgtttttcttttaaagtgtgtaacaaatggatgaagtcaagagctttgaaccttatagtctaaataaagattttgttaagatattgatgagcttttcacaaaactgaaaaacaatgtggtcaaaagaaaataaatttcgttggtcgagcaaaggaaaatagaaaagcaaacgtttttgtttagcgtttaagaattgataatgtgaaaaaacaaatcgataaagaaacaaacaaattaaaccaacatatcttgattccaactgaactccaattctgaattctggtttaagaaaatgacctaaacttaagctgagagtgttttgtcgttttcttgctaacaagtcatattaagattgctatatttattaaaatttaacattaacccaaaagaaaaaaagattaacatgtttataaatacctgaaccacaaaaaaaaactaataaattctgttctttcatatgatatggataacatttaacaacatactataacatgttccagcatgagatacttaacttactaaacacgaatctagagacagttagaacaagtgtctagaaaaataatttataccaatatctgaaaccaaaatcaaactctctgaagtaggccatacttcttctgttcgtgtggccagcggcgactccgtgcatagttttctttagataaatccaatattgataagttgaaaaaaaaacaatttgaaaatttacactttttaagtttttataaattaatgggacgattttaacatttcttgatgaccaatgacaacattgcttgatgttgtaaacaatgttatgaagaagatgtcaacttcatgtcttctcaggtcgcaattcaattttatatcatgtaaataaatgggattactagtgatctcttctgcaatacactttttaatatcagaatataatttctcatgttcatttgaatacactttgttttctccttccaattaagtagtatacaaattttcacaacaatactttatgtttctcgatgtgattcaatgtttatgcaacattattattagtaaaatagatgtccataaattaaatagaagttgaaacttgaaagacaaaccgagacgaatcccaaaatggaaacccaatgtttctcgaacacacgtttcatggaatcattgattcgtttgcatatggccccacaacaaagatggcatatatgcaataattgatgcttctacgtcgccacttttctaagaaagaaaccatctcctttatataataatctttcctcaccactcaatatgttatatccgataacaaaaaacaatcacagagagaaaaaccaatg

SEQ ID NO: 26481 - DNA, 3000 bp, Unknown; identical to SEQ ID NO: 13791
  misc_feature (1)..( 3000): 2750-1469P.txt file - cDNA_ID_2714082; gDNA_ID_2214652; Annot_ID_136437

SEQ ID NO: 26482 - DNA, 2962 bp, Unknown; identical to SEQ ID NO: 13833
  misc_feature (1)..( 2962): 2750-1469P.txt file - cDNA_ID_2714092; gDNA_ID_2214656; Annot_ID_188777

SEQ ID NO: 26483 - DNA, 2962 bp, Unknown; identical to SEQ ID NO: 13833
  misc_feature (1)..( 2962): 2750-1469P.txt file - cDNA_ID_2714092; gDNA_ID_2214656; Annot_ID_136502

SEQ ID NO: 26484 - DNA, 3000 bp, Unknown; identical to SEQ ID NO: 13875
  misc_feature (1)..( 3000): 2750-1469P.txt file - cDNA_ID_2714122; gDNA_ID_2214663; Annot_ID_188938

SEQ ID NO: 26485 - DNA, 3000 bp, Unknown; identical to SEQ ID NO: 13875
  misc_feature (1)..( 3000): 2750-1469P.txt file - cDNA_ID_2714122; gDNA_ID_2214663; Annot_ID_136553

SEQ ID NO: 26486 - DNA, 3003 bp, Unknown
  misc_feature (1)..( 3003): 2750-1469P.txt file - cDNA_ID_2714125; gDNA_ID_2214663; Annot_ID_136552
ttttaaaaagcatttgatttagctgttttatcgtaatttatctaaattgtttttttgtctcgtcaatctagtgacactcccttctgtacggaggcatgtcgagaaaaacagcaggaggctgataaagggaaacataaattagagaagataattgaaaaagaagatgaaattagataaaaagttgaaaagcatactcataacaatgttgattgatttcatatattaacatcatcctaatttttattcttgtcaaaaaattaggaatgacaatagttttttccccctacattttagtagttaatatttcccattttaaaaagtcaaaccccatcatgtatcatatatattgtaagataagatatggtgaaatcttcttgatatatgtactagatttctatgtaagaaaaaatttataaagcacatattttattcttttggtaaaaaatttcaaatgtaaatgtttgagaccaaaaaaaaactttattttgactagttgtagattttttcttctttttccttttttttttttttttttttttttctttttccttttactatcttattctctatcttcttttttaatataaatatgggtgtgacaggtatgaaaaaaataaaaaaaattagaatttttttttcttctctcattttagtttatttctgaaaaaaatgagttaatttgataacaaataaaatttgtgtggattgagaagaatttagacgaaaaaaaattcttcaagagtatataccagtgcacactcgtaaaatcgaacactgttttgaaatagtattaaattaaattaaaaactagtctatagtattaaattaaaaactagtctatagtattctttcgcccaaagaaaaaaaaaaagaaaaaagtttatagtattaaactaaaaactaatctataatggcatgtcggaatttcttttaatcgatatatgaaacattgttcagggtgattttccaaatagataaatagggttcgagctcccgaacttatagcttttgggccttcctcgtcttcagtttggacagctacgtaggattctatataaaatcacaaaactttagaggcaagtgatgttcgtcttgcgttaggactgctccattgcaaacaagtattgtttatggatatttgtgaaatttctgagtgaaacaaacattttccttgttttcaaatttcaaccaagtctcatggtctgttttactaatattagtgtttaaaactctataaaacacatccttagtatttttcggattaccacatgtttgctttttgttgaagaaaatttatctctagtggctagacatacgaacatcgaaaatttagcaaaacgatttcttttaaatttcattattttcaaataaaacaaaaatcttaaaatgcttggatttttaaccatttaaattatcaccttttagttttttttcttttttttttcgtgtgcaaggattttattgattaaatgcgtttgagttatacagagccgaaaatgaaaaaatcttttcggatacaaagccgacgggtacatagaaacccccagagacatgaggccaaaaaaggcgaacaaacaaaacaagccttaaaagaaaatatacaaagataacagttacaagtaataggtaaagcctccaaaacaacaacactgaaaattcttcccaacaagcagccgattaacactttcatggaacaggtaacagctaccgaagtaatagttaaagtctccattttcttctgttttatagaaaatttaggtaatatttcatatatatatatatatcactcagaaattacacaaatattcaaaaaaaatctgaacattgggagcaaactttttgaagcaaatcagatcataaaattagataacccgtagttacaaaaaaaatacttattgttctataatataaactcagctctaatcagattccatttgctaatttaaccgtataaagatatttctaatttacaagattttaaaatacgagaatgacagtaggaattagaaaaaactaatataaagcagaagaatataatcgtcaacacgtgataaaataataacccaatggataatttaatactattacagaaccaaaacaatcaataagcaaaaaaaaaaggcaaagtcccggaacttgcgtcagaagaattttgactagaaagaaaaaaaatcaatttcgacggccatttttttctctcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattaggtgaagtgaaagttttcttctttctgtagtatttgagatatttttgtttgcgtgggtcaaatcaaatctttatccgatctatttggtgtgagtattggtatatagtcatcaaagtttcaatctttatctattggaatctattcaaaagggcatttttatccattattggtgtgagtgatgatttgttcttgttgaaagtatattttatctgaatattcatcacttacttattagtttacttatccaagttgataacgaatctattctaaatcatgttcatcatttttagtgggttactttttacttctttactctttaagtttctatgcataatttatgattgttataggcagctaagaatatcttgggaaatttagtatcgtgtgttggttatactttaattagctgcttcttgtgaggaagttgactttttagctactacatcagaaggtactatagtgtctcttaaaagctttcttgatgaatgatatcttcttagttgtactaatttttgtgtgtcttctgattgcaataattgttgtccacagatg

SEQ ID NO: 26487 - DNA, 3003 bp, Unknown
  misc_feature (1)..( 3003): 2750-1469P.txt file - cDNA_ID_2714129; gDNA_ID_2214663; Annot_ID_136549
accaaaaccttcagcttctgatccatagtaagcactgaagtcaataaagagataaaaagctccctgcaagtaaacaatgccaacaatcaagaaaaagacgaagaagaaactagccagtaatagcctcaaagataaacggagaggtacctgaggttcagagatcttaacacctttgatatcacctaagcttttaaccaagaaatctcgtctttctctataagctttaaccatctctgcaaccgtttctcctccagctttgcctaacccaagcgcagcaacacctgctttctgagcaatgctactagctcctgaactaaccttaaaacaaaaaccagaaccgatttcatctcatgatcgctgcattttttcgataaagatttagagagaaatatgtttatatctagatacctggccttgtaatttactgcaagctgccacaatatgtttaggaccagcaagatatccaagcctccaacccgtcattgcgaaagcctttacatatcatatgatcagtaaagaagaatttgatcggtcgacattagaagccaactcaataataaatactttacctttgagaaaccgtttactgtcaaagttctttcatacatgtcaggcaaagaagcaaagcttgtgtgtgttgcaggtgcataaataatgtgttcatatatttcatccgaaagcacctataaaagaaatgaacgaaacagagttttgttttccagcttaaacagttcagcaaaaacaaactgacttaaaaagaccaaggaggcgttttatgctatataccagaagtcttggatgcttagcaatgatccgtgcaatctcttcgagcaaactcttggggtaaacagatccagtagggttggaaggagagcagagaataagaagtctagatttttcagtcaatttagactcaagatcctttggatccaacaaaaaattgttagaaatcttggtaggaataaccacgggcgttgcatcagccaatctcgcctgttctgtgtaactcacccaatacggtgcaggaattataacctagtgaaatacaattcattgttacaaacaaaatcacatcgaaagaattcaacaaaagctcgaaagacacggttttaattacttcatctccaggagaacaaactgcaagcactgcttgtaagagactttgtttagctccattactaaccaagatctgatcaggcgcataagacaatccattctcctctgaaaacaaccagaatacaaacaatttgactccgtttcgacataactgatttacaaagcaaaagcgtttctttataccttttagctttcgacatattgcttctctgagttctgtaatacctgcatttaacgtatacctagtaaaaccttctcgaatcgcgttgatcccagcctatacgaaacaatcgattcagaacaaaccacagagagagacagaacatggcaaaaccagtaggagaaatgtattaacctcagctacgactttgggagtgtcgaaatcgggttctcccgcagctagtctaataaccggaacaccggattgaacaagagtggctgcaagatcggttataaccatagtcttggaaggttttaaggactgaactcgcgggctaagtgacatatctactgatgatgaaagagtctcagcatcatttggtttggccatagcgcagattctagatgacatattccctgacttacagtacctaaccattacagagacctaagtcaactacattgaccagtgattggagcaatgattcagatttctaatcaaaagagtgctcaaaagtgacgaaattgaatcgaagattagaatagagacgaaactcacgagaaggagagacggaggggttgttggaaccgaactgacccgattggtttctttgaatctgggaatgattcacctctggcggcggcggaggaaatgacggcgactgaactctgagaagccattggagaagttgggttggtgagaagagagataaagagtcgacctttgaggtgggatttgtaaacgagagaggcggagagaatgtgggaggagttggtggaacaatgttaagaaaatgaaattaaaaatattttaaaatgacatttatatatgttcaaaattagccaccaaccaaccctttgaatttgcaaaccagagttagaaagctagtcgccggcggctgatgatgtcaccgggaaagatttttcgtttgtttcattttatcagtcacacacttgtataactatattattcaatcattaaaccctaatcttaatcctaaaaatatgggaaaatatatatctatagctataaaaaaagttaatattcttaaggcattaggcataatctagttaatagactccaatcttgggatcaagtaaatgcctaaaataaggattataacttagaagctttggagtgagattgctacgagaataaacaaggatcacaacaacagacactcgatgccaaacttacttaactcttaatttaacaaggagagaagagaaacgaaccagggatcagattcaggaaagcaagtaactaagcaagctcttttggagaagaaaagaaagacaaggacaagtttctcggttttgggattttacgttttaactttacaaaacaggattaaaccgaaattgaaccgtacaaaacctgtgcttaataccgtcatctcaaatattgaaccgtaataaatcgacaacaatataaaattgattttggttcactaagaggaccagacttttctctcggacttgagacactggagagactgaatacgaccatgtcctcttcgctccattgctcgggtaaacttttaacaagggttcgaaatcgaatacacgaatatctcggtttgttcaattactgaaaccaatcgaattttttaatctgtttcgattttctagttttagcatttccggtttagttcgatttaaattattcggttaccgtttttgtttagaatcacagaaaaaggtgagattaaggaggagcgaaacatg

SEQ ID NO: 26488 - DNA, 3003 bp, Unknown
  misc_feature (1)..( 3003): 2750-1469P.txt file - cDNA_ID_2714169; gDNA_ID_2213638; Annot_ID_132200
ctcattgtctgcaacatcaggacccactatttcaggtggacgtgctgcatcaaatggtcgtactggaccttcattgtctaggccaagctctcctggacctagagttagaaacaccccgcaacagccaattgtgctagcagacttccctcttgatacaccacctaatctgagaacatctctcccggacagaccaatatcagctggcaggtccaggccagttggtggtagcagcatggctaaggcaagtccagaacccaaaggtcccatcacaagaaggaattcatctcctattgtgacgagaggaagactcactgagacccaaggaaaaggccgttttggtggtaatgggcagcatctcacagatgcaccagagccccgaaggatttcaaacgtttctgacataacttcacggagaaccgtgaagacctcgacaactgtcacggacaataacaacgggcttgggaggtcattctcaaaaagttcactcgatatggccattagacacatggtacatatgtctcttctcactaaatgcaagtagctttataccatgcaatgaatatctcaacattttttatggtgtgtgtaggacataagaaatggaaagactaatggttgcgcactatcaaccacaacgctattccctcagagcatcagaccagcctcatccaagatccagccaatccgttcagggaataatcattcggattctatcagcagcaatggcacagagaacgggaatgaagcaaacgagggtagaagactgatggggaagttgagtgacatggacatgtatgagagctcaaggtatgatgcattgttgctgaaagaggacgtcaaaaacacaaactggttacatagcatcgatgaccggtcgtcagatcacggactcatgtttgacaatggaggattcgagctacttccagagccatttgccccactataacacacacacacacacaccccacaagtaaacacctttttttctttctaaaatcacttctcttttttttttttttttttttttaaattttatcttacacaatttgtttgcttgtcgatggtggaaagatataaggctcaagtggttcttggttctttggttattgattcttgattcatggctattgagtgaggtttgtaactttgtagttataatatttgaagagatggtaacgtataagagggtacctcatgttcactcttgttggaaacgatcatgaacgaaaaaacaattagaatgtgaaaagaggaaagagagggtcacacgactcacgcgcctaacgtgaatcaatgacagagctaaagttaataatgggtgacaacgaagcacacaaccaacaacaggccagtgtagttctgataaaagaaaaaaattaattccagaaattgactttcattaatgtcatatttgagatttaagaagttttaaatttttgttatttattttctcttttatgttaccccaaaataaataaataccctcattaatgtcacataccaaactcctcctcttcagggggtccatatttaagaaagataccctcttacccgaattaaaaatatcaaataaagtaagctcaatttgcaacatataataatttgttgaatattccccactcttgttgttttccttgcccattttttgatcttgaaatacttttatcttcttattgtttaacgaatatcacaatcatccattttcatttatacattgcatattttcaaaaaagaagccatatatttatttaatcaactggtgacccattcaatagaacattacgatgcttttaaaagaataaggaaattaaatgttgggaattcagtaaatgccgtttattaaaagctcttatgtataaattcatttagaataaaaacaaagagaaattaacaaaaggacaaatatttaattgagcttagcaataaaaaaaaaatctaaaaaattcggaagagagtcaaagggggacttaaagccaaagagagcaaagcaaatcggagtacagagaagaagaagagagattggaatctgaaactgtaacatcgagatttacgtttctccgtcggcgtcacgccgaagcttccatactccagaaaccccaaaacgcttatttctcaaaaatctccactctctctcttctgaatcttcaatcacttggggttgtgtcactgaatctgcatcaatggcgattccagattcctcactcttttctgcttttgactttagctctagcttcttcttcacgaaatgccgttgttgttaaaaagtgatttctccactatcccatttcctttggcatttattctccactctctctcacttgtcttcttcttcttctacgatcagctcaccaatgtcctgaaccattctcctctgaatcaacctctaaggtctctctcactttcgatctctgttttccctcttgttttggggtttattagcttcgttgtttattcctttaaaagatttcttctttctcaatttcaattactccgtttagcttagctggagaaaccctagtttgtagattgcagatctgggttaatcaagtatctgtgcacacatttatgtctaaaattagttactttcgtaattggatttgttttttttgtgaagatttattatttgaagtcaaacagatttcagctgattgaatcaatgtgtgcatatagcttccataatttcatattttgatttgagaatcgagtaatgttgctttggactttatcatcagcattcccactttggtttgagaaattacgctattgtatctttgtcattattaaggaagcttttcgttgtgttgatgatctttttactcatgatacctgtgatgtgtaggtgtcattcttggctactttatccatagatacatttctcatattgagtttagcttttatgtggctataaatcattacatgatgtgttttgtgttctcttgcagttgctgttgaatgagaaagctttgatgtgagcgagcctgagagtgtaacaaaggactgatg

SEQ ID NO: 26489 - DNA, 3003 bp, Unknown
  misc_feature (1)..( 3003): 2750-1469P.txt file - cDNA_ID_2714169; gDNA_ID_2213638; Annot_ID_181105
attgtctgcaacatcaggacccactatttcaggtggacgtgctgcatcaaatggtcgtactggaccttcattgtctaggccaagctctcctggacctagagttagaaacaccccgcaacagccaattgtgctagcagacttccctcttgatacaccacctaatctgagaacatctctcccggacagaccaatatcagctggcaggtccaggccagttggtggtagcagcatggctaaggcaagtccagaacccaaaggtcccatcacaagaaggaattcatctcctattgtgacgagaggaagactcactgagacccaaggaaaaggccgttttggtggtaatgggcagcatctcacagatgcaccagagccccgaaggatttcaaacgtttctgacataacttcacggagaaccgtgaagacctcgacaactgtcacggacaataacaacgggcttgggaggtcattctcaaaaagttcactcgatatggccattagacacatggtacatatgtctcttctcactaaatgcaagtagctttataccatgcaatgaatatctcaacattttttatggtgtgtgtaggacataagaaatggaaagactaatggttgcgcactatcaaccacaacgctattccctcagagcatcagaccagcctcatccaagatccagccaatccgttcagggaataatcattcggattctatcagcagcaatggcacagagaacgggaatgaagcaaacgagggtagaagactgatggggaagttgagtgacatggacatgtatgagagctcaaggtatgatgcattgttgctgaaagaggacgtcaaaaacacaaactggttacatagcatcgatgaccggtcgtcagatcacggactcatgtttgacaatggaggattcgagctacttccagagccatttgccccactataacacacacacacacacaccccacaagtaaacacctttttttctttctaaaatcacttctcttttttttttttttttttttttaaattttatcttacacaatttgtttgcttgtcgatggtggaaagatataaggctcaagtggttcttggttctttggttattgattcttgattcatggctattgagtgaggtttgtaactttgtagttataatatttgaagagatggtaacgtataagagggtacctcatgttcactcttgttggaaacgatcatgaacgaaaaaacaattagaatgtgaaaagaggaaagagagggtcacacgactcacgcgcctaacgtgaatcaatgacagagctaaagttaataatgggtgacaacgaagcacacaaccaacaacaggccagtgtagttctgataaaagaaaaaaattaattccagaaattgactttcattaatgtcatatttgagatttaagaagttttaaatttttgttatttattttctcttttatgttaccccaaaataaataaataccctcattaatgtcacataccaaactcctcctcttcagggggtccatatttaagaaagataccctcttacccgaattaaaaatatcaaataaagtaagctcaatttgcaacatataataatttgttgaatattccccactcttgttgttttccttgcccattttttgatcttgaaatacttttatcttcttattgtttaacgaatatcacaatcatccattttcatttatacattgcatattttcaaaaaagaagccatatatttatttaatcaactggtgacccattcaatagaacattacgatgcttttaaaagaataaggaaattaaatgttgggaattcagtaaatgccgtttattaaaagctcttatgtataaattcatttagaataaaaacaaagagaaattaacaaaaggacaaatatttaattgagcttagcaataaaaaaaaaatctaaaaaattcggaagagagtcaaagggggacttaaagccaaagagagcaaagcaaatcggagtacagagaagaagaagagagattggaatctgaaactgtaacatcgagatttacgtttctccgtcggcgtcacgccgaagcttccatactccagaaaccccaaaacgcttatttctcaaaaatctccactctctctcttctgaatcttcaatcacttggggttgtgtcactgaatctgcatcaatggcgattccagattcctcactcttttctgcttttgactttagctctagcttcttcttcacgaaatgccgttgttgttaaaaagtgatttctccactatcccatttcctttggcatttattctccactctctctcacttgtcttcttcttcttctacgatcagctcaccaatgtcctgaaccattctcctctgaatcaacctctaaggtctctctcactttcgatctctgttttccctcttgttttggggtttattagcttcgttgtttattcctttaaaagatttcttctttctcaatttcaattactccgtttagcttagctggagaaaccctagtttgtagattgcagatctgggttaatcaagtatctgtgcacacatttatgtctaaaattagttactttcgtaattggatttgttttttttgtgaagatttattatttgaagtcaaacagatttcagctgattgaatcaatgtgtgcatatagcttccataatttcatattttgatttgagaatcgagtaatgttgctttggactttatcatcagcattcccactttggtttgagaaattacgctattgtatctttgtcattattaaggaagcttttcgttgtgttgatgatctttttactcatgatacctgtgatgtgtaggtgtcattcttggctactttatccatagatacatttctcatattgagtttagcttttatgtggctataaatcattacatgatgtgttttgtgttctcttgcagttgctgttgaatgagaaagctttgatgtgagcgagcctgagagtgtaacaaaggactgatgatg

SEQ ID NO: 26490 - DNA, 3003 bp, Unknown
  misc_feature (1)..( 3003): 2750-1469P.txt file - cDNA_ID_2714172; gDNA_ID_2213638; Annot_ID_132199
ctcctcttgagcactcgagaatctttattctccgttactttcttatttctcaagaatgcattagcgtctttgtctgcacacaaagcaaaagcagagagatagggattggtctgtaattcccaagactctattttcagtactatcgattctcccggcgatctggtgagtgagatagagattcacgatgggctcagacagcactttgtctctcccttcttcatctcctccttgtaacaatcgctcctctgttcctccaactttcaccactcggtctgtcttctttctctatctctcccccgagttctgtattaatctctgttaagcttatctgtattcacttgttattatgaatgtaatggtttgagttttgtttttatgaaaattacagcatattctctgatgttgcgggtgacatcattgttgttgtcgatggagaatcatttctacttcacaaggttagtgcacacttttctggtttgagtttttttttttttttctttacagtttttagatcaaacgcatcagagaataataataaacattgcagtttccgttagtagctaggagtggaaagatgaggaagatggtgagagatctcaaggactcttcttctatgattgagcttagagatttccctggtggaccttcgacgtttgaactcaccatgaaattttgctacggcattaatttcgatatcactgcctttaacgtggtctctctccgttgcgctgctggttatcttgagatgactgaggactacaaagaacagaacttgatctttcgagccgagaattacctcgaccagatcgtttttcgcagttttcatgaatctgtcctagtactttgctcctgcgagacgcaagagattgctgaaacatatgaaattcctgaccggtgcgtggaggccatcgccatgaatgcttgcagaaagcagttagtatcaggtttatcagaggagctcaaggggagagattgtctcgagatgtggactgaagaactctctgctctcgggattgattactacgtccaagttgtatctgcgatggcgaggttaagcgtgcggtcagagagtatcgtcgcttctctggtgcattacgctaaaacatcattaaagggtatcatcgatcgaaactgccaggaacagaggaaaatcgttgaagccatggttaaccttttgccgaatgacgaaaaaggatcttactctttatcaattattcctctcggtttcctctttggaatgctcaaggtcggaactataatagatatagagatctcttgcaggctcgagcttgaacgtagaatcgggcatcagttagagaccgcgtctctcgatgatctgcttataccttctgtccaaaacgaagattcaatgtacgatgtggataccgtccacaggatactcacattctttcttgagaggattgaagaggaagatgatgaatgtggttacgattcggattccactggacaacacagttcgttgctgaaagtgggacggatcatggatgcttacttggttgagatcgcaccggatccatacctgagtctacacaagtttacggctattatagagacactacccgaacactcacgtatcgttgacgatgggatctacagagccattgatatgtatctcaaggtaaacaaaaacacaattgaacaaagtctttttatgttttgaaaacatctgaaactgataatcaaatatggaaattaggctcatccattattgacagaagaagaacgcaagaagctatgcaacttcattgactgcaagaaactttcacaagaagcaagcaaccacgtggcacaaaacgatcggctgcctgtacaaatggtggttagagtgctttacacagaacagttgcgactgaagaaagctctgtcgggagattcagaagaagggtcgtgggttttgccttctggagtacaaagccgagcggtttcgccaagagacacgtatgcagcgttgaggagagaaaacagagagctgaagctggaaatatcaaggatgagagtgagagtgagcgagttagagaaagaacataatttgatgaaacatgagatgatggagaaatccggtaataatggtggaacgttcttgacgtcactgtccaaaggaattggaaggatcgcgacattcggtggagaaacccggcaaaaggtgaaccggaaatcaaggtcggtgtcggagagaaaatcaagtagaagcggtagataaaaacgtcaccgtttatgtggttgctatctaaacggagacaagtcatgtgtaacaggatgaataatgggccgggaggagtgtgaagtaggcccattaaaaaacaaagaaaggtctcgttttcagcctataaaaacaaggaaaacatgggattaaatggggtccggtccgagccgtctttgtccatatttatcttgataagaaaagaaatatataaaataaagtatttttttaagaaagatattaagacagtaaaaatgtttataagtgttggtcgttgtacacggttaagttgttttgttaactagtgtaaaatttggttttctgataagtttccggaaatagtacgtcacctataactagaaaattataaaaagatttggttaaatctcaccttctaaaatttactaatatagaaagagaagaccacgtggtgtctaactcatacacatacataaaccaacttgtttatagcatactataatattaccaagaaattaggaaactaccttcacttctccgcctcataaataaataatttacatctaaaaaaagaaaaggagtatgattgatgaaagatgaacatgcatcgtgataacattagatggttacaatatcctcaccaacttggaagtgacacaaattatacattactactagttagtactagtagatctgaatctctctctctttcttcttctctaatgccgtaaattgtaagctaactcttcccacatagtgcctcgattctcgcttttgctctctctctctttcctccgacaatg

SEQ ID NO: 26491 - DNA, 3003 bp, Unknown; identical to SEQ ID NO: 26490
  misc_feature (1)..( 3003): 2750-1469P.txt file - cDNA_ID_2714172; gDNA_ID_2213638; Annot_ID_181104

SEQ ID NO: 26492 - DNA, 3000 bp, Unknown; identical to SEQ ID NO: 10220
  misc_feature (1)..( 3000): 2750-1469P.txt file - cDNA_ID_2714183; gDNA_ID_2213638; Annot_ID_132191

SEQ ID NO: 26493 - DNA, 3000 bp, Unknown; identical to SEQ ID NO: 10220
  misc_feature (1)..( 3000): 2750-1469P.txt file - cDNA_ID_2714183; gDNA_ID_2213638; Annot_ID_181095

SEQ ID NO: 26494 - DNA, 3003 bp, Unknown
  misc_feature (1)..( 3003): 2750-1469P.txt file - cDNA_ID_2714191; gDNA_ID_2213638; Annot_ID_132188
gttactgtttacagatatgtatcacgactagcacatcagctggattggatcagattctaccatggatgttctaccataaggttctaggcgtctcaacattcttccttttcgttgaagggaaagctgctactccgagtatttctaaagtgctcgagtctattcctgtgagttgaactacctctcttcgcgtccactgtttattttgttttggctgtatatctctagctctttagtcctgtaggtataaatttgtatttaaggtatgcagttttcgataaatgtagtcccatgtctcttgcagggtgttaaagtaatatacaggacgaaagagcttgaggagaagcaagcgaagaggttagttagttatcccattgcatatttgcgacaaagctatagctcttcaaggcactaaacacatgttttgttgtatattctgaaattgtagcattgttttgttgtattttctactactgatcattttactgtcattcttttttgttttgtttcatcagccggatttggaatgagacctggctttcgtctttcttttataagccctgcaattatgagttatttgtcaaacaatctctcaacatggaaatggctattgtcatggctagggtaagtatttcttttagaccttatttggttcagttttgactcatgtctcatgttacattctcatttttcttgttcttactaaatatcaggatgcgggcatggattggatacttcatcttgacactgatgagctgatatacccagcaggtgctcgtgagtactcactaagacggttgctgcttgatgttcctccaaatgtggatatggttatatttccaaattacgtgagtgatatctcattcacacttcttgcattgcttattttcagctagttttgtgagtctaaagtttcttttatgatctggcctttgctatgaataatgcttttggattttgttgtttaggaaagcagcgtagaaagagatgatatcaaggatccttttacagaggtataattcagtttattactgtctttacgtaagagagtaggtttattaatatttgtttgttatgttagtattacttctgagatatgtgtggtgcaagcaggtgtcaatgttcaagaagaattatgatcatcttccaaaagatacatattttggaatgtacaaagaagcaacacgaaataatccaaattactttttgacttatggtaacggcaaatcagttgctcgggttcaagatcaccttcgtccaaatggagcacacagatggcataattacatgaaaactcccaagtatgtctatcatatattcaaacataactaaattttctattggttgaggaacatgataggactttgttgttactctaatatagaaccatgtaactatcttaaaggagttagcagtggagtggagttccggttaacagcgtagttaattttttctgtttgtgaagccaatttttttttggaaatactaacctgatgattcttgctagtgagatcaaattggaggaggctgctgtcctacactacacatattcaaaattttctgacttaacatccaggcgtgatcgatgtggctgtaagcctacaaaagaagacgtgaaaagatgctttatgttggactttgacagatctgtgagcatcttttcttaaaatctctaaaagtccttagtcatttcttaaaatctctatatttcacttcctcttacccttttatgatgctgtatggatcaacattgtaggcatttataattgcgtcaacagcaactgacgaagaaatgctaagctggtaagagccttagcatcgttcttggttacttgtgaaatagataacttctgacactctttgaacaagtttggtcctattgtgattacaaaaatatctggtcttgatcaaaaagtaatctaccctgtgtaggtaccgtgaacacgttgtgtggggtgacaaagacgtgaagacgaaactccttaggaagggtattctgactcgcatctattcaccaatggtaagaacatactctgcaattcattatacaaaattccaaacacaagtcctggaatgttgagttcttgcaagtcaattgtaaaatattatatacatttgtggtaaaatgcaggttgttatacaagcattgaaagaatctggtgtcttcagctcggttgtctcatcagcttctacaaatctgtcaaagaaaaagttcttatcatcaattcacaaaagcaactcatccaggtctactgcatctgagtcccttccatcaaaggaaagcaagtctgagggcatctctgcaaggcaccttcttgaggctgaatcagccatccctcctttatcgccacctgggatggaacaagctagattttttacagaggattaacaggttttagcacggagctgatgcattcgcttttactgatattgatactggttgcaatatgagtgctgtgtagctttaggatggcaaatgaagtggaacaaagaagagtgaagaaagcggctttgtgtgattcttcctaatcatattgaaaagtcatcgattctcttgtctcattttgctctccctctgcaacttatgatagatgagtttgcagcatttttctgttgtcattgttacttctatgtaagtttattactatgtacagaacttcaaagcacagagccttggactcatttttctacttacatcgatcgccttataactacaccactactgtcatggcctcttcatgggcaagagtaataccaaccttattaattcaagtttaatacaaatcgattaacatgcacctaaccggtaatgactcaacacgtatgttatcatgaggatgacacaatctaggattccaaaaaaaggtatgaagaaagagtcaatggtccataaacgaagatttggcaccaaaaagcggagactcctcaagttatatataaaaagcagagtaagaaggaggttttgatgtgatgattgttgtctgagagagagagaagaagaagatg

SEQ ID NO: 26495 - DNA, 3003 bp, Unknown; identical to SEQ ID NO: 26494
  misc_feature (1)..( 3003): 2750-1469P.txt file - cDNA_ID_2714191; gDNA_ID_2213638; Annot_ID_181092

SEQ ID NO: 26496 - DNA, 2016 bp, Unknown; identical to SEQ ID NO: 10825
  misc_feature (1)..( 2016): 2750-1469P.txt file - cDNA_ID_2714199; gDNA_ID_2214450; Annot_ID_132933

SEQ ID NO: 26497 - DNA, 3003 bp, Unknown
  misc_feature (1)..( 3003): 2750-1469P.txt file - cDNA_ID_2714203; gDNA_ID_2214450; Annot_ID_132932
atgagtaatgttcgagctctctgattggccagccatccaagaaggacctctgtcttgagccatcagacctgctaattggttattgttgtagtctccacgatattgacctcctccctgaaacaataaacaagattacaagcagtgagacccaaaagcaaaaccaaaaagatgtagagtttccatttagatgatttattaatctaaagcagaacatgattttaacggaatcagaactagaagtctagaaatatgatgatagcttgacaatgaaaaaagatgagaagaattattgccagaagaaatcatttctcatatctgattaagaataacaatgatagatgtttgagagaattctcattaaagggtaatctctactcgttgaaggtgtagtgctcggaagaaagcacatagataaagcaacataatttcatactcagtctgcaaaacatcaaacatatcgcctaaaggtcaaaaagtaagagtatcaatacctgatatgttggctgactaggcagatgtggctgtccctgcgggaattgaggtccaccggaagcagggggtctgttgcctgactgcaaaattggctcaaataacgagttctagtcagtcaaaaacttcataattcacaatgagggaaataaaaggaaaccgacaatagctactcataagtcataactctgactcacatgatacatgggttgagaaagatgctgagtaggtgcgccatggtgctgaaatccagtgtttggaccagtttgagcttgtccatattgatgatgatatggtctagactgttgctgtgccacatgaggacctccaccagagtgcattggttgttgttgcaactgagtggaggaagctggtatatcaagatgatgaaaaggaggttgctgggatgttggatgatgggaagccggaggaggcgcgttttgaacttgagaagactgtggatgagacatagaagtgacagcaggattcagatgtccctgacgctggggatgcgaaaaacgaggctgtgattgagcactatttgcagaaacagaaggcggtggtggaggcataggcattggttgtggtgttgggtgttttcgaatcggggcttgtggctgcatcgtattggctggctcatgtacactgccaccgccttggaaagaagacatatgagcttgaacgtttggctttggcgggatagattgatgagattgttgaggttgttgtacagcttgtggctcaactttcggagtctaatagaaacagatttttgtaaaatttaagatgcttgaaatgaaatctattaacaaaatgacttaagaggacgcaagtacataccacttgaggaggctgaaccattccgagcatgatttgtgcctggcatttcaacaaacatagcatcatcatcaccatatacaaattctgaaatctatttgtaaatagaggcataaacctaaagattgttcatatctggaaactaacacaaaaccctaattgttaacctacctgcttcttcaacaatactaaacccaaactagtccaatcaatttactcaagtaagaagctccaaatcagaattcctcattgcttataagaccacacggattgcagatttagaagatggaaaagattagcgaagtgaagaagaacctggaaaagagccttcgtcaaaagagggttccgaatcagaatctccctcgcttgttgatggttttgatcaatcaacgtctgcacaattagattcgactgatcaaaaaaacagaattcgaaaaaaagaagaagaaatcaattgttctctattcaaatccgtaaaggatagtgttatagctgataatcggaaaagtatagaaaagaaagaagagagaaccttcatttgagacataatatcatagagctgacttttagtcattccggcgagatttgccggtaaacctccgtctccgccgatctgcttacccgccatggttctcgtcggtaatcgctaccgagcttaacctgtgtgttaaagacgcaacacaagagtacttgtgaacaaacctgggccaagtataatacgggcccaattagtataattccggcccatttaaaattctagacttattagtctatggcgcctgtagatcaactctttttttggtcaaaaatttaccatttttctcaaaacaaaacacaacaataaaatatagagatgcattagatatgtacgttaaatatatttatatgaaattattaatatgtttctttacatgtaccatgttaattgtacacgtaacatgcatgtatattgtataatatgtcttttggaaaagcaaaagcttataaacacaagtttacattagagagaagcgtgtgacacggttttggcctcttcactttcttgttgctccagaaatcttctttttatcttgtctccatccataattttcatacgaagatagttttctttatttcatccataatattcaatatatattggattcttgcctttggtaagtcggtaaacatcatcaactttatttttattctttcaggtaaaaatagagtcttccactacattcatcttccacaagttttgctaattttaagttttgggtaagaataactaacccatgtatatttcacaattcattcataacaaatcaaatgattatgagatatacttatgggttatatatctcaagggattcagtgatctttaaacttggcacttggtataatttcagcatgccctttaaagaatgagtaggcgtataatcttgtctcaagaaaattataagaagtccaaatttataaacatgtattgagacaattaaaagattagaattaaaaaaaagaaaaaaaaaagaaaaagagacgcactcaactcaactttctattttttatttttgtaaaactacaaactttgcttttgattttgtagccgaggtagtctctctctctccatttgataggaagaagaagaaagatacaaaaagataaaagaaagagagaaaaagagttttaattaaaatg

SEQ ID NO: 26498 - DNA, 3000 bp, Unknown; identical to SEQ ID NO: 10806
  misc_feature (1)..( 3000): 2750-1469P.txt file - cDNA_ID_2714215; gDNA_ID_2214450; Annot_ID_132929

SEQ ID NO: 26499 - DNA, 3000 bp, Unknown; identical to SEQ ID NO: 10806
  misc_feature (1)..( 3000): 2750-1469P.txt file - cDNA_ID_2714215; gDNA_ID_2214450; Annot_ID_182447

SEQ ID NO: 26500 - DNA, 3000 bp, Unknown; identical to SEQ ID NO: 10807
  misc_feature (1)..( 3000): 2750-1469P.txt file - cDNA_ID_2714219; gDNA_ID_2214450; Annot_ID_132928

SEQ ID NO: 26501 - DNA, 3000 bp, Unknown; identical to SEQ ID NO: 10807
  misc_feature (1)..( 3000): 2750-1469P.txt file - cDNA_ID_2714219; gDNA_ID_2214450; Annot_ID_182446

SEQ ID NO: 26502 - DNA, 3000 bp, Unknown; identical to SEQ ID NO: 10808
  misc_feature (1)..( 3000): 2750-1469P.txt file - cDNA_ID_2714223; gDNA_ID_2214450; Annot_ID_132927

SEQ ID NO: 26503 - DNA, 3000 bp, Unknown
  misc_feature (1)..( 3000): 2750-1469P.txt file - cDNA_ID_2714233; gDNA_ID_2214450; Annot_ID_132923
ggatacggacaatgacaatcagtggcgattattttggcgtttggggagttaaggaaagatttgaagttagggttcttcaagtactggcagatacaatgctgttgctccttcaccttgctgcaacacagatccgatggctcagaccctttcattatggtctccaagcatggactcagctgcgcaggattacatggatctactgcagcgactctgttttcttgggcaacaattaaaatgagaaggattgtacaagtgaaaaacactggttttgtgcaagaacccttcattgtctcactaagttatagaaagaagaagaagatatttggtttggagtttaaagtgggtttctctcgttctatttatagaagaaaatgtctttgagtgagtcacgttactcaaacgagagtttgtggttgcaggagatctcgatatgtctaaaagagattaacttttttctaaaaggctcggacaaagcataaaaacacctaggcaccattttggagaagttatgaaaccacgtgtaaccaaaatagatgtcagctttcggctacccccagtgaaggtatatgaatttgttgacacttaaacaaagtaatgagaacaccttcataattatatattttacttcattactattgtactaagcacaaaatatgacttaaatttctaattatattcaaaaggcagaacttacagccaacatggaccaaaaactgatctgtttccattcactaggcagttgcttcctttcaaaatcttcaatgtagtgcataagtctgtggcccaaaaccaagaccaattagagttcattgatcacaatgttaaacatatatcaggccatgaaagaataaaagaagataagctgcagtatatattaagtttactcagacacttttctagaatccatattctccatgtggtatcagccaccaaggttttcatacttagcacataatgaataggataaacaaagcccaagacacatgattaagcaagcaatcacacgcttaaagattaaatagtctctaacaagcacagtgttagaaaatctctaaagtactaaataatttgtatatccatttaatcaagttatacaagtagaaaatgcaaaatgtgacaaaaaaataagagactgtaaaatacagaagaaaatgttctctttgcgagtaccgtatggtgcgaaatccaaaacttaccatgtgttaatcactttcagagtaagaataagacgagcgattagctttcagggcatcagtcttaatattgacatcagacaagccaacatcattgaaaccatcaaactctacatcggaatcagacgaatcaccatctctcaagtcatcactctcaatatctgaatcagacgaatcaccatggccatcactctcaatatcagagtcaatatcgtcaaccttatgtgcatcgttaactggatacttacgcaccacatccatcacttcatcatcactatcatcgtgcttccctgataacttcctaatcatcaatgcctcaaataaatcaggtatagcatcctcatttccatcatccaaaaagctttgaattctttttttcagctctgaaataccaattggattaagaaagtaagcaaaattataatctttacatgaaaaattatgagctgatcagctaactctgtcattgcaaaattctcttccttttcattcaaaactgtacattttcttgagaaccaaacaaaagaagttgagttgaagaaatgtcaccttctttagaaagaacctcttcagttctgaaaccacgcgacgagtcggactcggaagagaagaagacgaaccgggaaatagctcgttcgaagagaggaacaacaacacgagggttgttgattctcaaatggcggaaatttgcgggtgagtgaaggatatttcgagccagtaaactgggaactctctgcagaaatcgtctcatgggattcgcctcaagactagggtttatcagaggattagggatttgaatcaagagccaatagtttttttttttaatctgttaacagattaaccgctcttcttcgtttccggttttcataactgatcagaccggatcggcccgagatgacctgtccgttttcattgtcgtttatggaacagcgcacatacaggcccagcccattctagcccaaacttcaattttcgctcaaatttggacgactaatcagttatgtgacgcaccaaatattttcgacgatttatcaccttttattattcctttaatctcgatccagcaaatccggaccaatattctttggatacttgtgtgtggcagactcttttatgtataaaatatacagatttataattttgtggcggtataaacaaaaatatactactaacctgtgacttgtgatcctctaatgtttctttgttttttcatacctcgaaataaataaaaattgaaatacctctgacaaagaaaaaaaagtaaaagttgacacatgagagcttttctatttatacaagcaaaagacaataaatatcctcaaatctatcttcgtttctgaccaaaaaagtgaacccaaagcaattttttttttttttaatcaagtcaaatcttgatactttgataggaagtaagaaaaaaaaacagaggggtccaactctacaaagaccggtgagaatctattatagctacaaatacctattttacactcacatctcaaaatttcaaacatagcaacagtgctaaaagcctaaaactctaaagtaaagtataaaccacacatttacatgtgagtatgtgacatgtgaaagaaaatatctaatttggttacttgtagacttcaaacacaaactagagaataaatgaaaaagtagaatttgattagttaacgtactaattacttaaattagtttcactaatccaacttaagaaagccctttcacttaccttcttcctcgccctgtgtctccattatcctctatctctcttttgttttttctctctctcacagagaaaaagaacacaatg

SEQ ID NO: 26504 - DNA, 3000 bp, Unknown; identical to SEQ ID NO: 26503
  misc_feature (1)..( 3000): 2750-1469P.txt file - cDNA_ID_2714233; gDNA_ID_2214450; Annot_ID_182441

SEQ ID NO: 26505 - DNA, 3003 bp, Unknown
  misc_feature (1)..( 3003): 2750-1469P.txt file - cDNA_ID_2714237; gDNA_ID_2214450; Annot_ID_132922
aggaaaaaaagttaactgatgaattagaaagttgcagcatcattgggaccagttttgcatttacggccaagagctacccacacgaccaccactacgattttcatgtactgctagtattgatttattagtagtttaatacagctcatttagtcacttgttaaaaaatattatactaatcttagtatgttaatctacacttaacgtgccttcaatacaataaaaagaatataattggataccaaaaattagagaaatggacccagtggctattaacttctcacactggagagagagtgacatcaaactacaaaccaattttattttattttttttccaaaacggaactgaaagttgtttgaaaatccctcattggctcttcttctacatttatatttcttttactatacaatatcttagctctctgatacaactattaaatgcttaatatatgaataatacgtggtttagagtaactaacaaacgtaaataaaataacaatatttctccctactcgtggcaacataagctgaacagagccaagtacaaacaagttgactttctgctacaaactttgactatcccgacaagaaaaaaccttaagattgatcaggaaggatctcatcggttcttctatcttgtctctgaccattcttcttcttcttcttctcaacaacacttctgataatttaacattgcatctcctactcattctcatcgtcttcgtcttcaatcttctacacgaatgtcgcagtgaaattttttgactctttcagcttcttctcgccatctctaatggcgatcccttccttcctctctccaaatttacacttttacccttctaccaaactcgttccgagtcgactcactctttcctcatcctccttcgtttgttgtttatcagtagaccgccaaattaaccattcctccgtctccaacgaaacctccggcttacgagttgtcatatccgccggaggcaccgccggacacatctcttcagccttagcgatcggagacgagctaaaatcagccgacccacttgctcgaatcctcttcatcggattcccaaacagtatggagagcacgacggttccatccgccggattcgatttctcaacaatctccaccgtcggatcatcatcgtcccgaccattcctctgtttcacctctttcctcaaattccctctccgcttgatccaatccaccttcgaatcctacaaaatcctccgcgaactaaaaccacaaatcgtcatcggcaccggaggacacgcctcttttccggtctgtttcgccgccgtgatctcaagaactaaattcgtaatccaagaacaagattcaatccctggaaccactaactggattctgtctttcttcgccgatacaatcttcgctcctttcaactgtacagtcactaacctccccaaacgagtcgccgcgaagtgtgtcgtctacgggaacccgataagacaaacgcttagacgatactcgtcgaaaggagcggcgcgtgtgagcttcttcggacagtgggctggagctgtgtcggaaccgaaagttgtgcttttgcttggtgggtctttaggagccaatgccattaacatagctttgcttaactgttactcgcagttgttgtctgaacatgagaactggttctttgtttggcaaactggtgttgaagcttttgatgaaatggatagtcttgttagaagtcatcctcgtctctttctatctccgtgagttatacaacaacatttttaactgtttagctgcttttgtattgactaataactcaaaatgtgttttattatgtggtataaggtttttgaggtcgataggtgtggcgtatgcggctgcagatttggttatctcgagagctggtgcaatgacttgctcagagattatggctttaggcaaaccttctattctggtatttgaaatctataagctgattcatcgaatttgctaatggagtgtgttgtttcttgttttaaaacattgaatgttcttttgttttgttttttaagataccatcaccgcatagcgatgaaggggatcaagtaaggaatgcttctttaatggcggacattgttggatcaaagttaataacagaagaggagctagatacgatcactcttagagctgccatggaagatattctaggtgactaaaaactctacaaagtagaaaacactcacaaatttcaactctcattatctcattgagttggttccaaatgatagggaatgaagaactgatgatggaaatgagcgagcgggcattcaaagctgcgaaagcggacgctgcatcagatgttgctaaacacattatttctattatcaaatccaaagataagtaggtatgttgtatgaaccgtgttacagattacactagtgttgtgaaacaaagtatgtgtatgattgatgagcctcttagtagattttgaggaaacattcttgattgtgttggctaatttggcctagcaatagagagtgaataaaaaaaaatccttatatttggaaatagttgcgtttcttcttcctgttatctttactacttgtatatgaatcaaaactgatcctttgcatcttcttcttaactcaattatctatccgagtccggaaccttctcagctacgcagagtctctcttgagaatgtaactggatcagtgtatgtaaatgaagttaagctattttaacacctagatcaacaacccaaacattgcgtataagttatctatttcgtggacagttatataaacaaaatgttagttaagtacacgctttggaatcgtaaagatattttatattttggataaaattgcaccgacattttatccaatttcactaatttaagtcattttttctccattttgaaattgaaaatcttaaaccacaaaaattagaaatggagcggaaagcgactgagtaagatctttcaccttctatataaaccttagttctgctccggcgacatcgtcgggataccgctagtgattaacggtggttatg

SEQ ID NO: 26506 - DNA, 3003 bp, Unknown
  misc_feature (1)..( 3003): 2750-1469P.txt file - cDNA_ID_2714241; gDNA_ID_2214450; Annot_ID_132921
atcatgaggttttcggtaaggaggactctggcttttaggcagaccgagtttcacccaccattcttcattccccgttggccaccaaggcggaggcgtccctttctccaacggatacttcctttgaggaggatcacaatgttgcatcaaagaagataacaaagaccctaaagtagcatcttgcaaatcctggagaacaaactgtgaattcctattcccatcagatttcccaaacgctaaacactcctcttcgtatttagcaatagcagcaggaccgttcttatcaaacttcactttctctttccaccaagctcttatattgtcagaggaaccactcacaggcttgcccttttccggtattataccatagacaaacccgcgaactttgcagacttccataagcttcaacatgtacttaaggataccatcttgagctctagacattttcttcctctgagcttgatcagagattttcttaggtgtctccttcgtttgagctccttgagagccagctttttgtcgctctttgattcttttaagcctgacacgatctttccacatccgtctctcaaggtcgtcagcatcaatctcttcatcactcacatcaatctcagcaacattatcactagctaaatcatcaggctcattctccatcctatccacaataagcaaactctcaaaaattaacagctttctaaagtttttgatttgataaacaaaacaaaatccatatatatcattatcttatgttgtcaatacagaggaaaacccaagtattcattgattcatcagctgattgagattgaactaatgattcatataaaccctaaattcacaagcatgaaagggaaattaatgaaattgaatcaaatgttcttcacctgatgtctgctacggacatagcaagatcgcccatttaaacaaaatcaatcaaaaacctttaacaacgataatctgaagcgccgaaattaaagaaatttagggtttttattctttctcctgtcgttctcaggggaagaagagagtaaaaaatggctgcgaattgtggagaggcaaagttttgatttagtcggaccaaagccaaagtattgttgtggcaataacccaacccccaaaggccaaatttttttttttttttttgttgttgcaaaaaccaagttgttttcttcggtttctgtttttttttttctttaatgtaaaaaaatattttgttactttatatctgttgtcgagtcaatctctctttctgtctctcgttttttttttctcaacacggatttttattggctcaacaaatagaataatagtatttattttgagtaattagttacgaggaataccaatgaagtttattgtatttaactgtccggattagtaaaaaaaactcaattttgccattaacctattcttttccccataaattaaagtcttttgggttttaatttggctttaaataaaaagcacattttcttaacttttttgggtttaaaatttgcataatgctaaatgctaacgtataccactcaatagcaaattgttgtcctacatagtgctaaatgctataactcaagcaaactgttcatcaagtcacttgacttctatcaaaacatgatgcatatggcagatagcacataggtaaacataattaaaattattttgaataaatttctattctaaacttttaattagacacacatttatatttttgtaatgttttttatgtttattttacaaacacactattcattttgaatgttttaatccaattattgtaagcaatctcaaaacaagaatagtttcatgctcattaagagattaagagaaatataaagataaaatttgatagctcatgaatgagttttattgtccaaggaaagaaaagaactttagattgtcaccaaaattagtaagactttgatgcaatcataaaatgggaaaaaaaggagagtagcctctttgacaactctctgagttaatcacattaattcacactataaatataagagattacttgtttagataacctaattacatgggcttctagacaatgataagcctttgaactataaaccatatgaattaaaccttttttatggaccctctaataattattacgttcaactttactcatttatcctagtcattttccacatccgatccaacttaaaaataatggtatcatttttctgaaccaccagtgtataaaggagaaggaaaaaaagttaactgatgaattagaaagttgcagcatcattgggaccagttttgcatttacggccaagagctacccacacgaccaccactacgattttcatgtactgctagtattgatttattagtagtttaatacagctcatttagtcacttgttaaaaaatattatactaatcttagtatgttaatctacacttaacgtgccttcaatacaataaaaagaatataattggataccaaaaattagagaaatggacccagtggctattaacttctcacactggagagagagtgacatcaaactacaaaccaattttattttattttttttccaaaacggaactgaaagttgtttgaaaatccctcattggctcttcttctacatttatatttcttttactatacaatatcttagctctctgatacaactattaaatgcttaatatatgaataatacgtggtttagagtaactaacaaacgtaaataaaataacaatatttctccctactcgtggcaacataagctgaacagagccaagtacaaacaagttgactttctgctacaaactttgactatcccgacaagaaaaaaccttaagattgatcaggaaggatctcatcggttcttctatcttgtctctgaccattcttcttcttcttcttctcaacaacacttctgataatttaacattgcatctcctactcattctcatcgtcttcgtcttcaatcttctacacgaatgtcgcagtgaaattttttgactctttcagcttcttctcgccatctctaatg

SEQ ID NO: 26507 - DNA, 3003 bp, Unknown; identical to SEQ ID NO: 26506
  misc_feature (1)..( 3003): 2750-1469P.txt file - cDNA_ID_2714241; gDNA_ID_2214450; Annot_ID_182439

SEQ ID NO: 26508 - DNA, 3000 bp, Unknown; identical to SEQ ID NO: 10811
  misc_feature (1)..( 3000): 2750-1469P.txt file - cDNA_ID_2714244; gDNA_ID_2214450; Annot_ID_132920

SEQ ID NO: 26509 - DNA, 3003 bp, Unknown
  misc_feature (1)..( 3003): 2750-1469P.txt file - cDNA_ID_2714248; gDNA_ID_2214450; Annot_ID_132919
gttattatgcagatgtatgtcaatgaaggtttagtcgtacaggcaaaagctctgtttgagaggttccagttggattgtgtgctttcgtcaacgacacttgcagcagttattgatgtctatgctgaaaagggactgtgggttgaagcggagactgtgttctatgggaaaagaaacatgtcaggccagaggaatgatgttttggagtacaatgtcatgatcaaggcttatggtaaggccaaacttcatgagaaagcactttctctcttcaaagggatgaagaaccaagggacttggcctgatgagtgcacttacaattccctattccagatgcttgctggggttgatttagtggacgaagcccagcggatcttggctgaaatgctggattcgggctgtaaacctggatgcaagacctatgctgctatgatagctagctatgtgcggcttggcctgttgtctgatgcagttgacctgtacgaggcaatggaaaaaacaggggtgaaaccgaatgaagttgtttatggttccttaattaatgggtttgctgagagtggaatggtcgaagaagcgattcaatactttagaatgatggaagaacatggcgttcagtccaatcatatcgttctgacttcccttatcaaggcttatagcaaagtggggtgtcttgaagaagctaggagagtgtatgacaaaatgaaggattcagaaggtggcccagatgttgctgcatcaaacagcatgctaagtctgtgtgcagatcttggcatagtttctgaagcagaatccattttcaatgctctcagagaaaaaggcacatgtgatgttatttcgtttgcaacaatgatgtacttgtacaagggcatgggcatgctcgacgaggctattgaagtggctgaagaaatgagagagtctggtctactaagtgactgcacttcatttaatcaggttatggcttgctacgctgctgatgggcagttaagtgaatgctgtgaactgtttcatgagatgttagttgaaagaaagctcttgctggattggggaacatttaaaacgctcttcacgctcttgaagaaaggtggggtgccaagtgaagctgtgtcgcagctacaaaccgcatacaatgaagctaaaccactggcaacaccagcaatcactgcaactctgttctcagccatgggtttgtatgcatatgcgctggaatcatgccaagagctcacaagtggtgaaattcctcgcgagcattttgcatacaacgcagtgatatacacttatagtgcatcaggagacattgacatggccctaaaggcatacatgagaatgcaggaaaaaggtctagaaccagatattgtcacgcaagcctaccttgttgggatatacgggaaagcgggaatggtggaaggtgtgaagagggtacatagccggctgacgtttggggagcttgaaccaagccaatcgttgtttaaagcagttagagatgcttatgtgagtgcaaacagacaggacttggctgatgtggtgaagaaagagatgagcattgcttttgaagctgaaagggagtgtagttcaagatctggagaagaagaagaagacgatgaagaggaaaattctgaagaagacgaggcattttgaagtgtagccacagatgtatgtaagaaatattgtagaatataggatttagtggaaatggactgtacagtttcacagaagccaaaggaaatatgcatacttaagcctcagattgatctctggtaaagaaatgtgtatcttaaaactgttatagaaagaaaaaaaaaggttccacagggtcaaatctataaaagcgagcacctttggctatggttttggtagaggaattagcatacgctccttacaacaatagattgatttgcatcatcgggttggtcttctgttggttttggtctctggattgaacatctttctcctgtcttgcttgctcttattttcaattgtatagcatcaaagcccatgaaaagagccagatgttctggaattgattccaatttggaatcttgtcagttactggtgatgaatatcaacatggaagatatgaaacagagtagccagcaaattccttccattcggaacaaagagtctctcagcttcagtcaaagtatatcagttattgatctcaagaaagtaatagtagtgagcaatgaagatgatgatggagctctagagttgaagaacagaggagtggaacgaaccagtggagaactcttgaagaccacagtgtcaatgtgtttattgttgtctttgtctttctctaaaagttgtaaaaaaaaagggtgtgaagctaaagctaaatggtatgtaagcaatgttttgcaattttaaatttacaaaataacactcggagtttctgaaagtttaattttgacccataatatttgatatttgaggcattgtcctggaattaaaaccaaattgaaactccttcgcgtgtgttttctgctgcatttttacctcttagcgtctccggcgaaaacccactacgactgagtatggcgctcgaaatcgaagctcgagagtaagatttcgctttctcttacaaaccctagttttcgtttagtgtcactgatatgaattgtgctccaagaaccatcgtttacgaatgctcagatggatcttaggttacatgtttggagaaaacatcttgaatgttggtttttttatatcctccatactaaagttgtggtttttaaatctacccataatttgttttagcttggttcttctaaagctaattgcttctgaatatctagattcctccgtagctattcttcgtttaaattaacgtcgtatacgaaaatttgagggagatcatcgttagagtgttttgattctttgcaatgcgtctcgaggaaaaatccaatttgtataaatttgaactcttgttaattctcggcttggattgaaaccattgacagtattattagccattttgttagtaatattggatggagaacgttttgatgctatatg

SEQ ID NO: 26510 - DNA, 3000 bp, Unknown; identical to SEQ ID NO: 10804
  misc_feature (1)..( 3000): 2750-1469P.txt file - cDNA_ID_2714260; gDNA_ID_2214450; Annot_ID_132915

SEQ ID NO: 26511 - DNA, 3000 bp, Unknown; identical to SEQ ID NO: 10804
  misc_feature (1)..( 3000): 2750-1469P.txt file - cDNA_ID_2714260; gDNA_ID_2214450; Annot_ID_182432

SEQ ID NO: 26512 - DNA, 3003 bp, Unknown
  misc_feature (1)..( 3003): 2750-1469P.txt file - cDNA_ID_2714264; gDNA_ID_2214450; Annot_ID_132914
tcactaagcttagtgcgtgaacttgaaaagatgatgacgaaacataattaaattgcaccaagacagacttaacgtcaattgaggcatttaaaacggttactttttgtttctataaacagcatagaatctacatcaatttattcattactatgtcaaaaaagaaaattctgagaaaactgtgagatacattttttgtccttaattcactaatatataaataaaaatacttacgggaatgttttctttaaaattttgcattagaacaataaaaaaactatccaaagtggtttaaagcaatttctttgattcattttaaacgctagcaaccgcaaactcaacatttgcatatggtagtaggagaaccaatcaagttctaaatcaattttcatttttcgatcaaatatatcaaaagtctttttggtcatataattaaaactgtatttttattttttttaataaatagtatagcgtttcgatcttttatacttgtatctcttttgggaataaaagaagaatagcaattgtcacggcaattaaggaccattaactttttatattttgagaatgactagaaatagcttaaggtgtcaattctaaagaaaagacaaatgagaatttaactgaatattcacttgaaaagcacgtggttaattgtatattgcagtgtccggtgaatcttactaagatagagctcaattaattaacgagttagataattagtactccgttatcttgcttttgatgaaactctattttcgtgaagagacaccgttatctcttcgatcattcaacatatctatcactatatacatatgtaattaattagtttatatagtggttacgacttacaacttacaatagagatagctatgtatgtcatatatgcacaaaatatatgagtttattatagtatatgattaatgtcaaaatatggacaaccacacgtatgcatgtatgatttatgtaataggtaatcattgtatcttctttgaacttattaaatggtgtgagctatgagccaatagttgaccaacacgaatatttatgatttttccagtgatcaactctatagtgtccacacgattgtgaggttcagaaaccatcaggtaatttttttttaatgtatcattaattaaggtaactctttatgtgtcttggaaattgttttccaccatagaagatgattatttgttgaaataatttatacgtaattttttttaaaaattaaactttacattttaatttttatatactggaatgataaatacggtaaaaaacaaaaatatactattaccgtggttttcatattcatccccccccccattcgacttaaatatgttatctacttttccaactatgacacttctcaaaaatctattttatagtataaaggatctgtattccataaaataaaacaagaaaaaaggaaaacgattggaggttttaagtgctcaagggtagttggctaacaattcaattttgggcggcttgagatttgtccgaaaacataagaaaagatttttgatttggaataaatcttatagtaacattaaaacatacaaaaaaaaaaaaaaaagtaaatggggcttgagttttgtccgaaaacataagaaaatatttttgatttggtataaatcttagtaacatttaaacaaacaaaaaaagaagaagtgaatggagagtttctatttactacacgttatgtttggtttaagccaataaaaaaaagcgtttacgtaaccataaaacatagcgtgtgtgattttgctcagaaaagaagagtttaataggccaaagcagcaagattaaaagttaaaagttaaaaccgtaaaagaacattcgtttctcccgggaggtttgactaatttgactgtaccacgtgaaatggacgcgcgaatgataatgcgtctagtgacgcatgccacgtcatagttatcctatcagaaagcaaaacaaaaaaaacaatctttcagtttttgtttttatgtcgtaaaaagaatttggtgcattccaattggtgacagccacacattttttttggtgctgggaccacttccccacctatcacttttctcctctatctcatactcctccttcgttaaatcattgaaaaaaatcttgctaatgtgttttaattagtttaagtttctatatctatgcacgctagtttaggaattaagtatggcattattttgttgaatgcgtcgaggtggttatccttttttaagaatccacttataattttttttctttaagaacccacttatacataaaatgatacgtgaaaaaatatatggtctcattgtctatctacacatctttataagtcgaaactcataaccaccatccattatgtgttgtctagattatttttttttcgctttcaaatcgcatggttaaatatgatctgagtaaataccactgaaaaatatttagaatgaaacatcctaatcatccacaaatttatttttgccttggtttcacatatactgtgcccaatctctaatacataatattttgatctgtttaaaatattttcttattgtccggatctaaaagggtatccctagtgttgatataggccaaggcccatttatattctatagcacgtgaacgcccaaagttagtggttcacaaatcacaaatcaaaccgcaaatcatgtaaaccacacatcaaaccgatttggtcaacaatatcctttctcttcccaataatttttgactcatcagagaataatttggtcttcgtctctgcgcgcgtctctgtctgtctctttcagattcaactggagcaagtacgaaacataaatatcaataaattaaaggaaaaaaaataacagtagagaagaagaacatgttttcaactcctcgggagcaaaaaaaataattcagcaagagaaacggcgaataaggtggaaatgatttgacgaagaaacgcttggctgagagtaaaatcggaaaaacaaaatctgtaatttattattatcagcctctaaatcaatg

SEQ ID NO: 26513 - DNA, 3003 bp, Unknown; identical to SEQ ID NO: 26512
  misc_feature (1)..( 3003): 2750-1469P.txt file - cDNA_ID_2714264; gDNA_ID_2214450; Annot_ID_182431

SEQ ID NO: 26514 - DNA, 3000 bp, Unknown; identical to SEQ ID NO: 10802
  misc_feature (1)..( 3000): 2750-1469P.txt file - cDNA_ID_2714268; gDNA_ID_2214450; Annot_ID_132913

SEQ ID NO: 26515 - DNA, 3000 bp, Unknown; identical to SEQ ID NO: 10801
  misc_feature (1)..( 3000): 2750-1469P.txt file - cDNA_ID_2714272; gDNA_ID_2214450; Annot_ID_132912

SEQ ID NO: 26516 - DNA, 3000 bp, Unknown; identical to SEQ ID NO: 10001
  misc_feature (1)..( 3000): 2750-1469P.txt file - cDNA_ID_2714302; gDNA_ID_2213359; Annot_ID_131834

SEQ ID NO: 26517 - DNA, 3000 bp, Unknown; identical to SEQ ID NO: 10002
  misc_feature (1)..( 3000): 2750-1469P.txt file - cDNA_ID_2714310; gDNA_ID_2213359; Annot_ID_180734

SEQ ID NO: 26518 - DNA, 3000 bp, Unknown; identical to SEQ ID NO: 10002
  misc_feature (1)..( 3000): 2750-1469P.txt file - cDNA_ID_2714310; gDNA_ID_2213359; Annot_ID_131832

SEQ ID NO: 26519 - DNA, 3003 bp, Unknown
  misc_feature (1)..( 3003): 2750-1469P.txt file - cDNA_ID_2714316; gDNA_ID_2213359; Annot_ID_180731
aatgctgatttggttggaaaatgttccaatctgtggatccaacatttcaaatagaacaactccataataatctttttcaaagtaaaaggtgaactcagagcaagaaaaagaaaataattccagtcaaccgaaggtgagttttatcaaggaaaggcttccacagcaaaattttgactagcgagttgcttgcgcctgtgtgtgttccaagagctgattcactaacttgtatgttcgtcctgataagcctttggtgtggtttatcaactgctcatgcctgcataaagcggaaacaagattagattgtagaatacgaatgatatcatagatttaagcttattctacttacacgttgggctgagtaggctccatgattacagttcctgactcagaatcaatcttggcatcaagctttgaggtgcggattaggttcacaatccatctctcggcctcctcatagttcagattcaatttttcagcaagtaccctgacaagggaaatataggctcgacatgagtacaaagttaaaccacaagaccgcaacaattcttctcaacttaaatagctggatatggcaattttcatgtgttgggaaagataaggaatagagaaaattccaaacattgagcaatccggagagcagagttatgtgtaaacatatacaaccaaatgtgagaacttaccccatgtcaatcctttgatgaattttgcaataggtttcaaagacgaataggcgggcattttcaagaaattcatctctcagtggtacagttgaaaagtttccatcctcaactcgcttgccaaggaatggatcattcacaatgacctacatcatgttaaaatgtcagagtattgattgcacagttctgcacaaacaaaaatatctatacatgtggatgagttacctcttcacactctttcatcttcttttgagccccatcaaagtcataattgacaaacacacatgccaggaactcgataattggatctttgtaggagtagtgctcttgctgaatgaccttaatgaattctttcaattgtggtcttctccttttgttgacaatgaaagcagttgccaagtagcgcagcaagtgtggagcactagtttggatggcattcagatacctgaaaaagtaaatcaaattagtatacagaactgcagcatgaaaacaaagtgaattatttttcagcaaatgcccatacacaaagcacaatcttaagaataggtctggatgaaaagaaggagaagactctaaaactagtgactgctaattacttgtaggcacatcaggactaacattaactataaacaaagttctacacacaaacaccacctatacataacttcatcgcatctagatcatgcttatcttaaaacgcaaggaaatagatggtgatgaaaggtataaagaagagatgcagataacagagaggtagaggcttacttgtcttggttaaaaagatcaatgatctgtgtccttccattatcatggttaaaaaagatatacagaccccaatgcatcaaccaaatcctgttctgcacctggtttaacggcgatgaaaaactctgaaaaaacaaatggtagttagcatatatactctcacatctatattgatttcaaaggtcgcaaactagaagaagttttaaatactaacctttgagtcaataatctctttgagacggttaagctcttcaagagcaatatcccagttttgcatcaatatttcagatgcgagctttccccacaaggcactcaaactcctctcaaggttagagcacagggtcctgtactggtaaagataatcagcagcaccagaatagttgccacattcaaactgaaacttggcgtactggtacaaagcctcaatctggtctggaccaatctgataagacaccaagccatataagatttgtgttccacaatacacaaacaaaaccaaatctggataacatttcacaaaattaaacaacttaatcatccaaatcacaacctggtagcgttccttgagcatttggagattgtactgcttgtcagctcttagctcctgcacagcgttagggttcaaaagaaaagacacgagtggtgcagcagcctcctccaaagatttgagcctagcgacaacctctgttcttctctccaccatttctatcaccacaaatttcaacattcatcatcaaacaaacaaaccagtacacaaaaacgcaaattcacagacatatccagagaggaatacacaagaataccttgaggagcgtcttcagtgtggtagagactcttgtgaatatccatggcgtaatcaaccatgttcgtctggttcaaaagctggattttagacttcaggatctgctcatcagggtaaagctgacgctcttgaaggaactcgaatataggaaacaccaagtgtctgtccaggttaggcgctattagtggcgtcaggtcatagttctgtttgctttcctccatcgtcgctaatctctcaatctccgccgcttcccgcactggcaaaatcttcttaagacggcagagatgaagtttcagagacgacgaggtaaaaaatcctgtatattgaaattagggttttctcgaatatgagctttcaatatttataaattcgcccctttacttcttatatattgttgtttaccccacaaggtatttttatctccaaaacgataacttagccgtcgttatctgatcggccggtaccggaggggttaagaaaaaataataattaaatgttttttgtggagaggcgcacggtaagaagctttattcgtttggcgtatgttagtagtctggacttctttctgtaccgcctgtgtccactaacttgcgcatgttcgtctttaacctttcgccctcttcctctatcatactggattagggttcttcttcgagacgaactctttttctttctcgtgacgaatgtttctgtctagaagcttttaaggattaagactctccaaaattttgacgccgtgttattctcttcccgtctctcatg

SEQ ID NO: 26520 - DNA, 3003 bp, Unknown; identical to SEQ ID NO: 26519
  misc_feature (1)..( 3003): 2750-1469P.txt file - cDNA_ID_2714316; gDNA_ID_2213359; Annot_ID_131829

SEQ ID NO: 26521 - DNA, 3000 bp, Unknown; identical to SEQ ID NO: 10011
  misc_feature (1)..( 3000): 2750-1469P.txt file - cDNA_ID_2714320; gDNA_ID_2213359; Annot_ID_131828

SEQ ID NO: 26522 - DNA, 3003 bp, Unknown
  misc_feature (1)..( 3003): 2750-1469P.txt file - cDNA_ID_2714324; gDNA_ID_2213359; Annot_ID_131827
cataatttaacccttgtggtctgaaatttgtactaattctttttgttcttactcattttctaacctgctatgctgtaagaaactatttaaacctaggtaagttgagataactaattttgtataaattttaagagtctgattacacacgacttcagttttaaagacaggaagtataattttacttgttattgataaaggcattacaattaccaacacgttaacagtaaagtcttgttttaatgaagtcattacttgtaaatgataagtcattacagtccctcaaactttatttattgtataatgaatgatagtaccaatatctatattagttttcaaatataaatataccattcccttgatagaatattggttcggctcaataaaagttaatatcatacttaggctgcttgttgggatagaacaatccccaaaacttctcaacataaggaggagtcggcttttgattctcgtcataaatggcaaataaatatgtctcgatttctttccctggtctcttcggtgtcccattcttcacatgcttaatcaaattattgttataaattctcgcattctctatgtttgtatcggttcctcctcccgttggccatccagtctccgccacaactatttccaatgatgcgccacccgatttctctagagccgagtacatcgcatcgagcatcgcatcaaataggttttggtaagatctaggagggtccgaaacgattcctgaaggagccgtgaagagagcgtaatcgagccggatttggcctacattgcccgcgtagctgaagtaagtgtagaggtttaagagtaaaggagagttcttgcttaccaagaaacgtatgattggttccattaccaccataacatctcccctaaacgaacctttcgatggtggataagactctcggagcactcccatgtctaccgatgtggatacctgttaaattccgtacaattataataaaacagagttgaaacttacaatttttgttatataaagataaaaagaataaaacgcaattaagttcttaaccaaatttacactaaaacattgaatatctcctatttttaataagataagttcgcaaatgttgaacttaaaatgaaattttgattaatgctaaaaagaatatttatcttatgaaaatacgtaatcgatatatatgagtaatgattataccttgatacgaccaccgagtccggctgctaaaaccgcccggtcaatgttttccatggcagggactaggaactgtgcgtaagagtcggagattttaacttcattcccaacagatatgtaacggaacctgacgccattcgcgtagttcatgacgtaggtttgtacccacgcgttagcttgtgattggctcgaggccacgctctgtaggtaagagttgggaagacccagcgttacctcgatgttggagccacgtagggcggctagaacgtcgtggtccggactgtatagcctaactcgttggatgtttttctgtttgaagagcgcaatggtttctgctggtgaagggaggttgttgccgtttcttccatagcaaacgccgacttgtccacctgttaaatatcaatccaatatttaatacattcatcacatgtggcataattcatgagagaattaatgtgttactaaatatttcatgagagaattaatgtgttccttcttttgtcatagaactaaaaaccttagactttactacatgttaatcctaatattttttatttctaatgaattatttacattcttagcaaaaataaaaaagagaattaatgtgttactaaaatttagtgactctattttttttcattgttgttaatcataaaacatatctaatcatttgaatatttgttttcaacttttattttcaagtatttgaaacatcagtataagtggtaaattataatttcaatatttaaataattttgttttaaagctaaaaataatagttaaaaaggtctcaaaagttcaagatattgacatggtttgattactctatgtcagggtgatattataatataatcacacatgttatattttctatatacataatgaaataaagaggtattaagtgacctgttggatttgtattgacgaagaatagaccgagaagaagggtcaaggacgccaagaatcggagatccatcgtcgttaggtgaagaaagagatgatttgtagaaaattaagagcgaggtggaaatcatttactgttatgacattgatcctagctagcataaacaatatatatagtaaattctagagaaagaacattaatatataaccaaatgtaaaatgtcaatatgaaactaaaattaatacacggaattaggcaacaagataaaataatgagttggtaatctctgaataattaatacaatggtgtaatatatggtaagctacataatcagagacagagagagacatttgtctttcttgactcttcataagtgcactcacaagtcaaacaacgcgtgtgatttatgagggcttagccgttaaaggtgtggttgaaatcaagtaaagaactttaattcagacaaaatcaaatgctggttgggctaaccaaaactactagtaatactaatggtctttaaacgaaatgagcccaataaagaacctgagacaaatctgagcccacttgaaagctaaaagccgcctaaaaaggaaacctaagcttaaaccagctaaaccgaaataattaaatggattcgttttttctcatctccgatccctaaagtcaaagattaaaccacactaaaccgaaattgtcatatgcgcgtaatttcttcgcaacattttgaccgaacaacttcaaaatcaaacgagcggacggtcaagattgtccgatcagtatcgtctttttagtcagtcagtcctgaacgccggctagatcaaccactccatctctcgtgctgaccacgctccgattctccatttctttcccttttgacttttcacttccaatttttcggtatcagatctggacgatg

SEQ ID NO: 26523 - DNA, 3003 bp, Unknown
  misc_feature (1)..( 3003): 2750-1469P.txt file - cDNA_ID_2714342; gDNA_ID_2213359; Annot_ID_131822
ctacaatgttgacaatgagctcaagcgtccgatcctcattaacgctgggcttagcttggttggattctttgtcacactcaagttgattcctgtagctgctagatacgttctgaggcgtaatatgtttggttttgatatcaacaaaagaggcactcctcaaggagaagttagagtgtatgtttttccttcttagatttgtctttgtttagttctcagattagtgttcagcgtttttctagaaatggatgtctcttagatttgattttttgtataggaggaaaactatgagatgtctcattttctgattgatgttctatggatgtttacgcttgatttgatctcaggggacttaaagtcttttgatgtgcttattttcagcaatcttatttctttgtaggcctgagtcattgggaattgttgtcggtattgtcttcttgatagtggcgattgtatttcagttctttaatttcactgaagattcggtggtaagtgtcctggtctcaaaagctcaagcttgatcatttatttattgtgaactatgaacttggtagctcttggctcatttactttgaatgcaatttatcaatctggctaaatgactcggtgcagtggcttgtggagtataatgcagcactggcgtctatttgcttcatgatattgcttggatttgtagatgacgtccttgatgtgccttggagagtgtaggtgcagttctcattttgttggattaaaaattcatgatttagttttgttttcttattaactcttgtcaatttgcaggaaacttctcttgccatcttttgcaacccttccactgttgatggcttatgctggacatacaactatcgtcataccgaaacctttagtttcttatattggcttggaagtgtttgatctaggtacaattcatcttgtatatagtgttaaaccatcaatagctattttgaaattcatttccttagttgtatatttatcgtggcaggacgtatatataagttatatatggcgctactggctgtcttttgcacaaattctattaacattcacgctggtttgaatggccttgaaatcggtcaaaccgtagttattgcagctgctgtaagttctgctgtcaaaatgcgtcgcaatgcttcatttttttggtcccatttttccttctgttggtttctcgtaagtaaagttatgataaatctcagtaacttgtagattctgatacacaacgttatgcaaatcggagcatctgttgatactgagtatcatcaagctcatgccttctcaatctatcttactcagccattgatggcaacatccttggcaatgcttgcctacaattggtaatctttggatctttcaagtcattttctcttaaatcaatcaggtaaactagcaaagcagaatgctttctctaaccacgttcatgtcccctctttggtgatgttaggtacccttctgcagtttttgttggagacacttacacagtctttgctggaatgactatggcagttgttggcattctcggtcacttcaggtatacttctaaccataccgtccttattgcaatgtacttagattcatcatttacatttaacttatgtgtgagccttcaattaactaactacttatgaaactttgctttttgcagtgaaaccctgttaatcttttttcttcctcaagtgttgaactttttactgtcacttccgcaggtttgatacctttctccatctcacactttctgttacttttcaatacatttgaaagcatctaacttgctattgtataactcttcagcttgctggcattgtcaaatgtccacgacatcgtctccccaagtaagctattttttgtccatttttcataagaggcaaagccaacaagtaaacaacacatgactcttcctctctcttttttaaaccaggtatgatcctgctacgggactgttaacaggaacaaaagatgggacactcgtgaacgtctacttgaggatttttggtaggaaaacagaaaagtctctatgtattcatcttcttgttttccaggtaaacttgttaatgcccatattatcatctctaaatacaagttggtttattctgagagagagaaatcacaagattggtgttttgtgtgttctattgcaggctcttgcttgcgcattttgtttcatgcttaggcattttctagctggttggtacaaataaatctctgcaacatgaagaaactctaaacctgttcctcttttcatctctctctctgccttcacaaatcatacaaacacagaacttgttttgcttcatgtccaacaatctactagaatcatcgttttagttcacttatatagagagttttcatctaaaggcgagtgtatctcaacaatataaagccaatgaaatgaatcagaacaaatttgtcttggaatttaaatttaactacaaatgctgatcttattttgataactttgattaataaactaaataatttttagattaaagttttgctaatatagcatgcattaaatgaagtgtccatttacatatatttttgaattttaaaaatgcgcttttaatattagacagactactgtcgtactagaataataaagaatgtaataaaaaaatagaaggagaatcggaaaagaaacccacttatagaatgccatgtgtcaaaacataacaagcgaagtatgtttatatagtaagaaaactcttttgccctaaatatcccaaattgtcatatgttctttccttatgtggctctctcttctctttctctttctctttcctttttctctttcgatcaacaaaaccacatctctgaactgaaccaatttctcttctcccccttccggttatcggattaccagatctcgtttcccgcgatctagtttattctttgaaaaaggtaaatgttcaatttttttattttattcaaaatctcccctggattcaggagatgatgatttgaaattgacgatgatgtttgtgtgtaaaagtgatagaagcagaaatg

SEQ ID NO: 26524 - DNA, 3003 bp, Unknown
  misc_feature (1)..( 3003): 2750-1469P.txt file - cDNA_ID_2714346; gDNA_ID_2213359; Annot_ID_131821
cgttttccgaaatatatagtcacagctcttggctatcacatgtaggcatttattattgcttcaacagcgagttcagaggaaatgctgcaatggtattaatatagatttaaatataatcactgctcttcatcccattttcaactgctgcaatctaaccagcttcactaatacaggtacagagagcatgttgtgtggactgatgaaaaattgaagttgaaactccttaggaagggaattctaacccgcatttatgctcccatggttagttccacaaactcaaaccacgctctttatttgacatgaacgatcagtgtttggttttccacaagctatcatctcttacaggttataatccaagagctaagagaagcgggtgtttttagctctgtggtaatcgcagctcacaagtctccttcgaagaactcttcaactgctgattcgacatcaggcattacccgagaatcatctcaggaaactggtaagaggagggtgttggaattccatcttgatgttgacggtgaatcccaagcatcagcggtaccaccacaatcgcctccaggcttggaagcaacccagatggaactataatatgaaacgtgtttacaaagggtgggattttttagaatgatttatgaacagttttgaacctgagctctggtgtacatttaggaaagttttcgtttaggttatacacacagatgattctacaggtgaagaggaatgtcatatagcaggggttgtatcatacttgatgattctataacttggaatacaaaatcattgtcttccagatcggactactagtcttcttttgtgctcctttatcttcatatgtacatgattgatcctcagcattacacacttgtggtttttctttcctctcgctctgttttgctaggtccttatcaattaggaaggttctgcaattacgtttccagaactcctgtcatcaagtatcaaattatctctctaccttccattcttcagatttatggttttcctgaaatgtgaagtttggtttctcaacatctttagcttcttatgagtcactcagctgatgtcacaaacagcttcatgttgacttaaaccttacagaaacttaatgtttcagactgagaacatgagcaataatttagaagagagtacttaagtcaaattagtagcaaccaggcattgacaagtactgataaggttgtggaccataacaaccaataagaacaacttaaaagaacttatacatgttggacgtatgatttagtagttactgcattgtttaaacttttcttgttaaaatctttcttacactttgatacaaaagaaaaagatggtcatattcttaaatactttatagtttgtgcctttttcatgtgatacataactctgaaatctaaaataaattcttattacatacagaaactattcaaggtggagacatttaggaaaccgtacaacacacagaaaccagtccacttaacattttaccaaattaataagtttaataatatcatctctaatccaaattttgaaccgccatggtttttgtaagccttgcgccgtcaaagtttagatatccgccatggtttgggaatgctgaaacgccgtaagagaagtttcacgctcagactcgtaccctttttgggtatactttcggatggctgattctatggatcttgttttgcgaagacgatgagccaagccaacgccatggtttgtgcgccgccgccgccatatctgccgtgatttgtgaattaaacgctgggacagaagtttgctactcgtagccttctttttgggtatgatatctgagctttgattccaaccgtcgagactaaagcatcccgtagtctcattgaaggtttcttctaactacagctatgcgatcaaggttctgaccacagcgagccttacaaaagtcaatgtaccttatgtagacagttgcattcttagcagtgagagaggactcactgggtggctccatagtttgaatggctactgacacaatcctcaagccggaaagatcatgatccgtggtggtcctatcagatatggcaacagaaagttccagatacagacgaatccagtcattggctcgcagctctgattcatcatccaccacgtaaaatcggtttctgttttcgaaagggttctccagcgggaactcaggcaagctacccatgcggtagaattctctttccaacgacgttttaatgattgtccctaaaatatacaatgatgaatgaaatactagttgttgtaataataataatgatgtgttaatgaacacgcctacccaagtaaggagtcacatgtagtataataataatttaattacctggacgacgtctttcagcaataaaggaggtcaaaacaagccggccacaagcttcttcataaacggaagtctgaaaagtaaaacgccttccactagatggctgcattgcaaccaaagtaatgtagaaacagcaagcaccagcagccagagtcctgttgtatctcttaacgtgagagagctttaagtttgtcccctgataaatcaaaaacgaaatttgaataaaaagaagagcaagagtggataaagaaagagaagaaaggaagacaagagtcttacactttgattaaaaaaaagatagtatagttagtaattgcctaattaatttcacaaagagagatgataatcaaagaagttaaataagtctatgggatgcattcttaatagtaatcttgttaacttctttcttacattatgagtctttgattatataaaaaaaaaagatattagtaatttgcctaatttcacatgaatcccatagacttatttatttctttatactttgcttttttgggcctttttgataattcataaataagtggtgttgatacgatgtcgtattgttgtgcgtgggcaagttgtaattaaatgctacaggctttgaagcttcagcgaaaagtggaagaagcaaatccagaggcggggaaccagaaatagccaacggatccgccatg

SEQ ID NO: 26525 - DNA, 3000 bp, Unknown; identical to SEQ ID NO: 10007
  misc_feature (1)..( 3000): 2750-1469P.txt file - cDNA_ID_2714361; gDNA_ID_2213359; Annot_ID_131817

SEQ ID NO: 26526 - DNA, 3000 bp, Unknown; identical to SEQ ID NO: 10000
  misc_feature (1)..( 3000): 2750-1469P.txt file - cDNA_ID_2714365; gDNA_ID_2213359; Annot_ID_131816

SEQ ID NO: 26527 - DNA, 3003 bp, Unknown
  misc_feature (1)..( 3003): 2750-1469P.txt file - cDNA_ID_2714406; gDNA_ID_2213624; Annot_ID_132010
tttcacaagggggaaactggaagagctatttagagattcgggatgtgttgcgaagctgaggatgaaaatcggatctaacggcgaagaggcggcgccggctgtgacggataataggaattatgtggtggatttgtatttggagagagatattggagatttagaggtggcgagtgaggcgatattgaggtttcctggagtagtggagcatgggatgtttctgggaatggcgactacgttgatcgtcgccggcaaatttggtgttaccgtcaaggataggtttggataaaagtgtcatttgaaaaccattagggtttatggtttgattttgattttcgatggattctctctggttctgtaaaccctttcctcctattggtttaaaactttgacttattttttaaaactttgtagaattttgacttttggaggctgtttactgcattgcccctgaccttatagtattcactaaattgccccggaactttttcaatctacaaaacgccaggaacttttacgattttcttaaaaagtccttgaacttctgatatataataaattgccccggaagttttgatatttaagaagtattactgttttgagtattttccagaacttctgatatatatactaattgtccgaaaacttttaatattcaccgagtctgtcccaaaatcaaaatgttcgagtctcttcattggtgtttcgggaatatttgccgtcactgtcaaatccattacgcttatgttactggactttgtggtgtagtttcgtgaaagtaaacgagcaagatacaaaaaaaagaaaagcataatgggcctttttatagaacaatgggcttttgggtataaaattattttcaaattgcatcgaatgcaatttgacaacaatctatatgttggcagccaaacctcatcaacaagggtatatattgctcaacttgcttcgtttgtgtaaagtggattcgtttcgtgtcagattttagtttcacttcagaatattcacgtaacatttacagacttatagggtaaaattttaagaaagctaattcatatgccattgtagaccagcgcgaagaaaacaatttaataaaacaaataacatgatatgatattatataatattcatctagatcttcatattctacatgaaatatgtggttaggtagactcgataacaaaagaaattgaaataaaagacacttttttcaaatattttaatgggagaacaaaatatcatgttatgggttgtttttggcacaaagcaagaaagttgcatcctcaataaaaacagatctcagacattttgggttcacatgatcctctcacatgcttcctctcacgcatttgaacactcttgactctaccaaataacccactccaatggcatgttaatattttatgaatcacaaccaaacatatatcgactttaaaaacaaattagtatcttactttaatgttagaaagaaaaacttttcatataagagatacacttttttcttttcgtattaaagataaaagtagagacgtatatcaaataccaaacccaccactcatacacattaaagtgattttggtataaaaactgttatcagcttctttgtaatatagctctttgttggttgtaaaatgtcctagaatagtttcataaaaatgtaaggcattggagtgagacactttaatagtttaattgcccacgtcaaaagaaaacttttatttccgtcgatgtggagaaaaatgttgccgtcactaggaagagtctaaaaagtcttaagatcacataacccaaaccgcaagttatggtaaaattcaaagtcttaaagtcaggtccgaaagcaaatacttatttaaaaataccctcttttcctgcaaattactttgaaaaaaatatatataaaaattctatctcacgtaactcttgaaggcaacctacaataacactactcatgtgatagaaaaacgcaatccatgtgaaaataatcatgtcctaaattcaacctatatcagtaaaaaatttggtcaaaattaagaaaataaacgctattttctttaatcaaacaaacgccacacatccaacattagttactgataggttgtagtggcgattgttaaacttgtaatggcgattgaattagatattcaggtgaattgtatagactatagacacaaaacaatgcatgattgatagaaactaatacaaacttatggcaaaatacataaacccatagtaaaaaaacaaaacacatgactctcgaataataatggtccaatcaatgtagcagcgtcccgattaaaggaccacgtggctacagaagatacagccacaagagacaccgagacggaagggagggacgccaccaccacgttaagtttatttagatccatcgagtcgagtcccctagtgggacccacttgtactcaatgtgcataatcaaattaattgaatcttaatttttaaacaaccatgctttaacagaattataaccaaatcattaattgtcaataaaaatctttatatttttattttaccattttaatttttaaaaattaatttctttatcttctctcagatttcttcctatataaacccaatacattaccagtttaatacctaacaattactcaattagtacaagttgttatacaactaaatcttcatttgttaaatcatctttactcaaattgaatagtagtgtgcgtgtgaaaacaagaaaagtggaaaaggacaaaagagagagtaaaggacgcctcctaataaagcactcttcttccttttcactttcctcattgaagagagagccaaattcagcttaaagccccataagcgtaagcgtaagcgcggggataaatctctctcttcctcacctgcgttttcgtggagcatcttcttcaacaatggctgcttctccgatctgatcatatcctgatttgaattttgctatctctcatgcctcgaactcgttttgtcgacgtagcatcctagtgactgaggaagaagaagaagatg

SEQ ID NO: 26528 - DNA, 3000 bp, Unknown
  misc_feature (1)..( 3000): 2750-1469P.txt file - cDNA_ID_2714424; gDNA_ID_2213624; Annot_ID_132003
gaagaaccaactatagctagttgtgtaaaaatttcaatatttcaaaataagttagtggaatgtgtataatcaatgtgtttaatatcaaagtattttcgggtgatttatgtttttatttacgattatgcaaattattatattagtggaattaattgaagttatttaaaaataaatacgaaaaaaggaaaatcggttaagtgctcaggttggttaaaaattaattaagagaaaataaacaaaaagctacgtgctgttggagttttgttggttttgtgaaggcaaattagtcagcgaaaaaagtgttgtgaagtggttttgtggtaatctatgcggctgtgccaagtgaaatccatacatcatcagataataaaatatcaactttttatctctatattttatcttccattacgtagtttttgacacatagaagatccaacagcgtttaactagattttcttcggagccattaaatatagtttgttcctcaatcgaagtagatatgcggctgatgatgcagccataaaaaaagaaaggtatttgtagtcataactttcttagtaaatgactttaggtttagaaaatgacgcgtaactaatcaagaaaattagtagtaaccgtaattaacttggaacgtaaccatagcaaaatatttccgaccactcgcaaggagacaagtcaatttgtaagtgaaattagaaattgtgtttcttacgaaacggttaatttattgcacaatttggtctgcttcttgttttctttataactattttgagtatgtttgttacatgcatggatgatcagaaatgtaatatattattcttcgaataaaactgtggcaccgtgcacatatccaaccttaatacattatagtctaatcttaatatatttttgtagttcaaaccttgctgtgaatttgtatataatatactgggagattttattcttgtacaactcaaaacaaattaatgcctcacgtaaaacaaacacctgtttaatccttagaatgagtgatctttaaataaaatcccaagaatattagaatttgaaatttcataatattatggtgcttatgatgagatgacatttaagtatctcgctggatatttcaaatcaactgtttgggacgaaactgatatgactgattattaaattatgacttcgcataactcgaaagttgaaacacaaaaatggatatgttagatttgaaactgtgaaaaggacgcaaacaaatggagagatgagaagcggcacacgaagggaaaacgcaaacgcgcgtttgaacatatcaaggtgggacttaaggtaaaatcgtcgtttgatggcgacaaccgcatttttagctaggtgggagatgggcttttggataacctccacgtgtacagtaccccagacatcgacggcttccagtcattttgactaggaacaccaaaacatagacaggctcaaaagtcaatagtactagcaattatctgtgaaaccaaaaacgaaccaaacctgaaatttgtagaactggattgatcacaaaatctgtatataataggaactttgtatatataatggttgattttgttttaaattttgttgattcagagtcaaattgattaattttggtttaatttgatttttttcctcacactcttcaaaaagttaatttggtgtattttcttgttaaatttaatttttaggtttcttggatttgtctgaattattttttaaaagcatgaatatatattgtagttgtataatatatgatgtgtattcaaatgaaaagcatagagtatatatatatatatatgtataaccactatttgcgtgttttttacgttagaactcatgctagatgataatctttggagtagcatcaagagaagtttaaaaggaactatagttccaacttgtaacaaataaagaatatgttaggtttttgggctgtttttgattctcccttttgaaaaattatttgttgatgctgggttcattttgggcctggctaggtatattttatattgtcagtcttttatagactgatgggttactttttcgctactttcaatattaatgaagaaaaagtttataaaaaaaaacagaaaaaacaaaaagaattagttttagagaacattaggtttgctagatttcggctaactcgcagagaaatggttcgacctttaaggcaaacataactacaaatttcaatggttgaaatttggtgtttggacatgcgaataaagatctgtttagtgaaggaatgtttgtgagacctcccacaagcttggatgataaccttagctttaaccattataggtctgcgataatgcatgttacgggaggctgaaggagctaaaacgataacatggttaagacaatttttgagagattggaaaaactcattctaattttttttgtaacgcgtaagttagagaaaatatcttaataacgggacgaaatatagtggacgaactaggcccaaaagtttccatggtttctttcttgtattagttccattagaagaatgttgattttttcgtaaaagatccatttgagaagacagaactattaaccttgttattcacaaaaagaattatgaagtatgaaccctgtttaattttcagttaatttttgatagatataaaccatataattaatggatatattatatacgtatatatatatattcattttttaagaaaaatcaatactcttgtcatgtacatataatattcaaattctagttttataatgtagaagcttactaattaaaaaaaaaaccattcctttttggaagataaattctaggaaagtagcgactcaatagtcaagagaatgaaagcaaagaacaacaaagttatttgacaccacacactcgtatgcataaatacgcaaaaccccaaagaacttcttcaacttctctcctcaacttttaagtattccacacatacaaacacacacacacacttgacttttctcatataatttcgacagctcgtgaaggacaaagacatg

SEQ ID NO: 26529 - DNA, 3003 bp, Unknown
  misc_feature (1)..( 3003): 2750-1469P.txt file - cDNA_ID_2714428; gDNA_ID_2213627; Annot_ID_132088
agaccgagtcatttacaagcaaatggaatcacgagagaagttaccaacctcgatcatagtttcatcgaaattgagaggaccatttgaaggaataataacagggttgaattcgttaaccgtcttcaagctcccaatgaaagaggattcaccactgtaaacctcatcgatgttgaaatccttggccagctcagtcacaatctttgactctgcatgtccaccctggtccctctttggcggcattgtatagtatgggattttacctgcataaccattcatattagagacaatgatgagttaagaaactggttttcaaaaatgcttttacgcttcaagtttacgaggaacaaaaaaagatccgcaccttcattccagtcatgcaaaacaattctggcagcagcatcaatatccacaagaccaccctttttaagtttaccccttacagtggcgactttgtaaaggaaatcatcaactgcctcgaagctcgggattttgtagagagtcaccagcatatctttaggacaaagcttgagaatttccttcactatttttttcacaaagcagaagatttccaagttaggtcactcagattataacctttaaaagacaaagcacaaaaataagtgtgattctatcttgagcttatatccaattacctggactaactgggtcatccaacttctcgattcttttacaatttcggagagctatggaagcatcatttcctgatgatttcaacatcacaactccaggacaatccagcaacttcacgtttttgtccaagtgaacctcttgcagagatctagtcagtccaggagtggcaccaacattgacaacatgcgctctcttcagactgttaataagactactcttgccgacattaggcagtccaataataccaactgtgatagatttttttaactgccaaagaacaacaaaggaagatttaattgaaactgaatgatataacttgatgctaaggtaggatgattaaagtttaaactatggaaccaacctcatgacttcttgagtagttcttcaacaatttgataagagtgtctgctccaagacaatcactcgtctgcaacatattgcttggttttgatgccttagatgatttccaacccaagtttgatctctgttcctgggtgctacacttgaaggcaacagctggaaattcttccctaaggtacataagccatttctcagcagcctctcggggaacaagatctggagagagtgaatcagttacaaaaattaattacaccacccagagtaaacaaacaacttattacgtccacgagtaaagactgaatatatgaacttaccaatcttgttcagcagcaacacaagatgcttattgggaccggcttgcatcaccatcctctccatgtcagtacaacgagtgccaagaggatcacgggcatcaagaacctccaaaatgacatcagacaattcaatgactttaactagctccttgtagaaagccctctccgagttatctgtgaaacaaaagacattagtgcatgtaaaggcagagagaaagcacataaacgcgtgaagaaggtatccaaaacaactcacctcgaacattgacaactttaggtaagtcctctatggtctctccttctgtcttggtatcctcatcatcaaccaaaccaagtttcctctttttggcctgaatagatttattaggagagatcagaacacaagcaccactccaaaatacgagtaaatcaaacagcaagacatgaaaaatgcaatcttttatcaatcaatcaaaactcagaacacaaaggaaatagctttaagaatttcgacctgaacttaaagttatatgattactaaatatctgaacatgtatcatagctgtgagttacaatgttaaaagaatgagattaccctttctttgcgagcttctttcttctgttcaatctcctcaagagcacgggcacgtcgaacttcaagggctttaagctcttgttccttgaaaggccagtcattgggtatacctgggtctttctctactcttggcttacggtgaaggccaagctttttagcatcctttgccttcttcttgtggtgctccttcacctttttcaggaccttatgcttctgcttcaaggtcaccctcttactcttactctctgcaaaaaaccatcaaaccaatcaataaaaccccagtaggaatcctgaactgaatgatatgattcaaattcattcaataagacagatccagaatatcaatatgattgaaggatgtatcttacttttactccgtttcaccatctttctcgccctgggatgagagcgacgcaaacagaaaaactgagtaggttaaaagaaaagggtttatggagaaggaagatggacatatcggcgccaaattagggttttgctattagatgtacttggatcattacccgacccgttatagttgacccgaatcaacttaaaaatattgaaaaaataattggggtgagagaggctcgaactctcgacctcaggattactcagatagctatgagacctacgcgctagccaactgcgccaccaccccgatgttagtaatctttactgattatgtaattaacttcaattgacattcgttatccaaagtcataataaccttgacttggaccagtcacctgaaagtcttgagtttttttcccttaagatcccgccgggctccggtgctggcggttaaacccttccaaaacctgaaattcgtttagcttaggacaaacaagtgaagcccaccatacagaaatgtctaacagaagcctccatttgaagaaaatatcatggctttcttctcggattctctcaggtttccgaattttgatcgtcttcttcgattctagctttctgggttcccactgtttaagcgttcttaacgatcttttttggttgtcgttttgctcactagacaatgttcacggtcgatttcgccgatcaatcactactccagccacttgtttagctccttcactcgatggagacatg

SEQ ID NO: 26530 - DNA, 3000 bp, Unknown; identical to SEQ ID NO: 10157
  misc_feature (1)..( 3000): 2750-1469P.txt file - cDNA_ID_2714432; gDNA_ID_2213627; Annot_ID_195924

SEQ ID NO: 26531 - DNA, 3000 bp, Unknown; identical to SEQ ID NO: 10157
  misc_feature (1)..( 3000): 2750-1469P.txt file - cDNA_ID_2714432; gDNA_ID_2213627; Annot_ID_132087

SEQ ID NO: 26532 - DNA, 3000 bp, Unknown; identical to SEQ ID NO: 10156
  misc_feature (1)..( 3000): 2750-1469P.txt file - cDNA_ID_2714444; gDNA_ID_2213627; Annot_ID_195921

SEQ ID NO: 26533 - DNA, 3000 bp, Unknown; identical to SEQ ID NO: 10156
  misc_feature (1)..( 3000): 2750-1469P.txt file - cDNA_ID_2714444; gDNA_ID_2213627; Annot_ID_132084

SEQ ID NO: 26534 - DNA, 3000 bp, Unknown; identical to SEQ ID NO: 10155
  misc_feature (1)..( 3000): 2750-1469P.txt file - cDNA_ID_2714448; gDNA_ID_2213627; Annot_ID_195920

SEQ ID NO: 26535 - DNA, 3000 bp, Unknown; identical to SEQ ID NO: 10155
  misc_feature (1)..( 3000): 2750-1469P.txt file - cDNA_ID_2714448; gDNA_ID_2213627; Annot_ID_132083

SEQ ID NO: 26536 - DNA, 3000 bp, Unknown
  misc_feature (1)..( 3000): 2750-1469P.txt file - cDNA_ID_2714475; gDNA_ID_2213627; Annot_ID_132075
ccgtgcaactagaggatgggtaagaaccatcttgaaagagaagttgaaagccttcccagactacaagcccaaggatatcgctgaggacataaagaaagagtatggtattcagttgaattactcacaggcatggagggcaaaagagattgcccgagagcagctacagggttcttataaagaggcgtatagtcaacttcccctaatctgtgagaagatcaaggagacaaatcctggcagtattgccactttcatgacaaaagaagattcgagcttccatcgtcttttcatatcattctatgcttcaatatctgggtttaaacaaggttcccgccctctcctgttccttgacaacgctatcttaaactcaaaataccaaggggttatgcttgttgcaacagcttctgacgctgaagatggcatatttccagtagcctttgctattgtggattcagagacagaggagaactggctttggtttttggaacaactcaaaactgcgttgtctgagtcgcgaataatcacttttgttgcagatttccagaatggtctgaagaatgcgatagcgcaggtctttgaaaaagacgcacatcatgcatactgtctaggccagcttgctgaaaaactaaatgtggacttgaaggggcagttttcccatgaagcaagacggtatatgctcaacgatttctactctgtggcatatgcaacaacacccgtgggttattaccttgccttggagaatataaaaagcatatctcctgatgcttacaactgggttatagaaagtgaaccacaccattgggcaaatgcgctgttccaaggagagagatataacaagatgaactcaaactttgggaaagacttctacagctgggtttctgaagcacatgagtttcccattacccaaatgattgacgaatttcgagcaaagatgatgcaatctatttataccaggcaggttaaatcccgggaatgggtcacaactctaacaccatctaacgaagagaagctacagaaagaaatagaacttgcgcaattacttcaggtttcatcgccagaagggagcttattccaggttaatggaggagaatcttcggtcagtatagttgatatcaatcagtgtgattgtgactgcaagacctggcggctaactgggttaccttgtagccatgcaattgccgtgattggatgcatagagaaaagcccgtatgagtattgctctacgtacttaacagttgagagtcaccggttaatgtatgcagagtcgattcaacctgtcccaaacatggacaggatgatgctggatgatccgccggaggggttagtttgcgtgactcctccacccacacggaggacaccgggaagaccaaagataaagaaggttgagccgttggacatgatgaaacgtcagctacagtgtagcaagtgcaagggactaggacataacaagaaaacatgcaaagctacttagttgttaggatgttttggttagtttaaagtagtagatgattttggatctcttctcttcttgtgtgatgaagaataaagatctcgttcgttttcagatcaaagcgagcttttttttcttcgcagaacttgttggttgatgtatgacattcacattcgaactttttgatctatgaaattggtttaagaattaataaatgtaacttacaatcctatcccataatcatagtaaaaattacgaaaatgccaccgtttcattactccttttggcggctttaactcttctccctctcagagagttcggaaactctcagcagaaaaaccctaaaattcttaagcttcgtttacacacacatacagagactgtatctgtacattcgcatcgttttgtaaaaatggaggtatcttctgtgaaaaagcttgagcagctggagtactctttagagtcagtcactgatctctcttcgtcttccgtttcgtcgtcctctccagctgtagctacgttttcctacgttgatggagtcacggagctccgatttctgcaatcggattcgacccattgtttcaattttgatctcgcttccgctcaggtgaatgtcgattcacatgcttatgttactgttccgctggttcttatcggttttgattattttttcccatctcgtttaaaacgtttgtttttgctacatgaagatgacgaaactctgttatttttctgtaactaatctgagattgaagatggttttcatactaatttttacaattgacgatatattttaattctgaaagtttgaattttggtaaaacttgttttgcttatgttttataatcttattgggtcttgttgtatctgagaatgcgtgcattgatcgtattatatctttgtcaatgtttttcccctcagttattcaagttggggccagtccatttcatctgtgtatctgatggttcaagttcttcagaggaggtacgttatgtttgagtacttgggagcaggatcaatttctttagttattctttaaagtgaatatcttgtctcgccttctttattaatccacttttcttcataatgaaatgattttgtgaaacagaaatcattctccaaaggagtcaatataaaattcaaaaatgagaaggatagcaaggatttttgtgagtcctttgaagagtggagaaatgattctgttgttcaaggtgcgccattgtatcaatttactttcttggaggtgttatagcatgaatgccttatgtttgcttttcttctggcttttaattaagaaagtattgaagccccattatagaatagttttatgaaaatctatgtttttttctcagactgtaaagaaccaatttctctctgtggctacttgtgcattcactgtcattgcccatttcaaaatctatgcataatattattgcatactcctttactgtcttctcacttttccgtttctaggatcatccttgcaaaatggaacagtttcagctaataaaagcaagttcgacaataagatagaggcgtcatcggcaaaaatg

SEQ ID NO: 26537 - DNA, 3003 bp, Unknown
  misc_feature (1)..( 3003): 2750-1469P.txt file - cDNA_ID_2714479; gDNA_ID_2213627; Annot_ID_132074
aatctttaaacaacaattcgaatttcactatcaagcctgatcatcagagaaccacattgttacccttttctatgtacatcaaattatcaaacacgtaaagtgtgcatctaacttgctaaatactatctacatgaagaagaagaagaacttcaaaactattctttaagagtttccttattatgctggcatcactcggctttcagttgcagaatctcctttgctgtcctagcccggaaatatggcatttgttcctgtggaaatcatacaaacagtttcaattataagcagtcttacgtctttcaaaatgacactcacctactaaagacaatggcaggtttagtatctttctgctatttacctgagtgaaacaaagatccagacctctgctatagaagtcgatgtatttcaccataaacattccacaatcgaatctacaaaaatcggagacaaagttattatgaatgtatgaactagtagtagctgacatcttttttaggaagacagtacccatttctctgcattggaaggtcctggacaaattcttgtctccatcgacttacatcaaggtctacttcactcttatccctcacttcatcgacaaagtatctagcctgacaaatgaaaaactacagaatcaggatatatatgttatgacacaaaacatggtttccttactcatatattaccagtgcatcgaggattttaggctcccttcctttgaaagagtcaagatactggaatttctggtcctttatattaattacagccaaagtccagtggatgttcatatggatagggataaatatctgaaaacaaacaaggtctcttagatggtaaaatgaaaaaaaaatgtttgattatctcaaaaaggagtttaatacagagagtggtcgcagaagaagcacacaacaagtttaccttgtcacagtctttgagatggtagcccaacctcttcattgaagtccatcttctcactgcaccatagttgtatccagtcgccgaattaactaactgaggtgtgatttaaggtaatgtcttcttgttaatattcatgagcatatataggggctaaaatttaaatttcattagccatagaaatgggtataaccttagtgaagaaaaatgtattgaaaaaatgacatttaagaaacttctttggttctctagcttccctttctttcagcaataccatataaagattaatgacctacatagaacaaagtccaaggtttttaccaaatcatagaggtcctaattagacaagaaaattatattcaatctctaagaagaaatcacgtgagatttagatgcgtcgactaacctcatcgttcaaccatttgcctggtttaaggcacctcaagattttcccggtaatatcaatatttgagttcttatgagtaaccaagatgtttctgcagcgagagacgttcatacaattacatcacaaaaacaaaaatgaaatctcagagcaagtaaacaagagagcaagaatcaaaatcatacgaatcattagctgagaatgcacgcctgactgctgtctcctcctctctagaaagaggtacaaatgcctcacgttgtacaacctgaaaatcaattatagaacaatgaggcaccccgatttcacaaaatctaaagaaaccgaccgattcatatcacaaagcatacacgcttaaactttagccacacctctactggttcttcatcttgtctccaaaaggaagacaagcttcgtagtaaagcacgacctctctctttaaaaaaatcaacaaagcctctgtctttcagtttagaagtccggttcacagcactctcaagaacctttctgtatgcttcaaaacttgtgacatcagtcacagggcgattcacaacgagtgaactactattagctttagaacattcacccaccctcaagctcccatttttcagactggcaacctcagaaaacaatccatttcccatctccgccttctcttccacctcgtccacctccatagccacgttttcgacaccctccctacttgtatcatcagatatcatttcaacatctccaagctcatcatcaacatcaattacttctctatccgttctatagcgtaaagacgaatcaagtgcatttcttttccacatgtcattgttccttgtgagaaaggttcccaacacattaccagaaccttgtcgtgtgctacgatctcgaccgctattgagtatccgcacaggcgcatgaacttgtctccgcaacgaagatttcacttctgggtaacggtaaattcctggagccatgggtcttgatgaatgtgagaaaccggagtgtttacaagggtttaaaccggcgctccgtttgtggtaaccatccatatccattggtctgaaacagtaggaaccataaccctcgaaattcaaaatttgatcccacaaaactgaaaggtcaaaatcccccaattcagagttcaaaaccctagattggtttttcatgaaataactctcgggaagcaagcaagtttcaacttttcattaaactcactggcgtttccgatacacagattcggacccggacatgagacccgggcgggttttgttttggaagagataggtcaaactcaaatatgttgacttatctcataccctctagccgaaagggaggtttctgggtcatgttgtttcttactcggctaaacctatgttttttcttctcgttaaaccctctctgctctctgttctcctgaaagctgggcttttcacttcagaatttccttaaaaataaaagctttgatctttttagttattatcttcttcgatcgtgttaaattttgagacaaatcggtgatttggaacaggaaaatcaggaagatgcggatgctattaagaccaggtaatctgtgtatgcgcatttcagtttctgaaaattttcagtgtttaatctgctcgattttgagctgaattctggtcgtttcttcatagtattgtagcctggaggttgataactcccatatgaactattctatg

SEQ ID NO: 26538 - DNA, 3000 bp, Unknown; identical to SEQ ID NO: 10147
  misc_feature (1)..( 3000): 2750-1469P.txt file - cDNA_ID_2714491; gDNA_ID_2213627; Annot_ID_132070

SEQ ID NO: 26539 - DNA, 1021 bp, Unknown; identical to SEQ ID NO: 10146
  misc_feature (1)..( 1021): 2750-1469P.txt file - cDNA_ID_2714499; gDNA_ID_2213627; Annot_ID_195902

SEQ ID NO: 26540 - DNA, 3000 bp, Unknown
  misc_feature (1)..( 3000): 2750-1469P.txt file - cDNA_ID_2714499; gDNA_ID_2936587; Annot_ID_195129
atggtggaatctgtattgttctctttgaagaactgcttgagctccacaagtgagtcgcagtttatctcttcaacaaaatgaaaatgcggtacacttgtagccatagtcattgtcttgaccattgctcggctgaatcccctgagaataaggatatagcttcaggtggttaattcagatacaagatgggttcatgtacaatgcaaattgccaacaaaggcgtaccttagaggaactgttttatcttcaaagttactactagctttagtggaaaccgagtctcctcctataacagcatgctcagaagaaactgaatctgttacaaatcctttctggtcactaaaccggagaacatcctctttcaaaactctaccatctttaccagttccagttataacattgatatctatgccaaggtcttttgcaaggttacgaaccgcaggcgttgagagagctccaagaagattttctgttccctgctttgaacctcccagagttacaatttctgaactatcagtggttagaagcgaatcctgcgagtcttcaaccgccaacctaaccagagtctctccaaccttgcatcaatagattttgccacatataagtacttataaaagtgaaacatttgatacctgatctatcagaacctttaaacatatatatatagataacacaaaagcttaacatgtcaaaatctcttagtgttcatggtttacaatagagtaacatgctcaaacttagcctctaacaccataaagaaagaaaatgtatctaaccttaataatgtcacctggagaatgtgaaatcagagccactttccctttaaaacgacttgtgatctctatagttgctttatcgctctgaacttcacagagtggctgaaactcttccacagaatctccctgcaaaaggaaaaacaccaaaatgtctatatcataacgaaacgaaacagaacaattgaaaaaaagaaactttgagcggagaaaccaaagagacctctttgacaaaccacttgagaagctcacattcagcaataccttccccagtttgagctagtggcacatcaattaaccctgaatttgaatcagtggccatggcttcgttcgaaaaccagcttctacttcctccaccccatttcatcaactgtgaaaaatatgacaaacttgtttgatcctttgtccaaaaattaccagaaaaaccacacattctaagcaaacagagttttccaagtttaagtctctctgataaatttattttctttctaaatttatacagtttcgatgtttctttttccgcctagaagagcttctcggaagctaatgtcatgcctcaaaattaatttgaaaaaaaaaactgaaaaaggaaggaaatttggtgagaagaaacatacagtgggagggtgaacaaagaatgggcgcgacgccggagaggaagacgactgagaaagatactccggtacccggaacggcggagagcaaacagatgacgagctgaatgggcggagaaaccggtggcttcgccagatccgtcgcgcgatcattgttatgaacggttggtctttggtaaaaaacaaaaaacagtacaagggagaagaaatagacaaacagattgagttgatggaagatgtttctaagaagagagcttaaaaagataaatgttacgtacccgtgtgtttgtttctgttcgagtatccggattaagactaaggtactgattagtattaataactatttggattagtaccaaaagaaaaagagaaaaaaaactatcggattggcttatctatgccacatcagcaatatcacggagaggatcaacggtacacgcgtatcctcatgtacatcactttttttttttccttcagatggtgggctatatatatcgacttcaaaaaaagccttttacaagcagatccactaaagccgaaaagaaaaatgccaaaaggccagacttacaaagtggacacacttttctcatagacagaattcattaaagcaagaaagataaccttaaccaacataagattgcacttgattattctttgttacactttgaagtttgaacaattaaaaatgaacaaacaagttagagatgtgaatgtgaggctacttccaaaatacaatctatttcatcactaaacgcctaacattatctttggaaagtgagctacctaccaacccaaaattacatctaacttacgtcttttgtcttttgagttttgccaaccgtctttgatcttggaagatattcgtttacgtcctttaagttttaagcaaatccatcattgttagtgaagtcttaagttttagacgttttattactgttatggttaactgtatgaaagttgatacttagtcatgtgaaaagatatttcaccggaccataaatagagagaataaaaaacaagttatggtttgaatacttgtctaaaactattgattgcatttacatttgttttttaatctgattaaacaaaaaacggatgtcatggtagaattaacatatattacaagatataatattcagcatgatcgattatatgtcataaataaatcgcaaaaaaaaaaaactaataatgttaaaaaaaaaaagagatactctttctagtaaagtttatttacaactgtaaaatcctatatagggtcgcttagttacaaatccgtagtatcaagataagatccgccaagtttggtagtcgcaggactatgaccagccaaacatatttattagtaataaatccgcagagtttaaatgcaaatattttgttcctaattcgtgattaattcaacttatacataaattggatacgaataacaaataaaaattcacatatcgaaaacattatcaaagtaccgttgctttgaggagtgtgccactctaccatattatcactgacgtcatcatcttttgcaattatataatcatctgatttctcacgtctcctctctttttcattaattccgaaaattttgactcgcaaaatctcaacgaagctcgaaaatg

SEQ ID NO: 26541 - DNA, 1021 bp, Unknown; identical to SEQ ID NO: 10146
  misc_feature (1)..( 1021): 2750-1469P.txt file - cDNA_ID_2714499; gDNA_ID_2213627; Annot_ID_132068

SEQ ID NO: 26542 - DNA, 3003 bp, Unknown
  misc_feature (1)..( 3003): 2750-1469P.txt file - cDNA_ID_2714503; gDNA_ID_2213619; Annot_ID_131957
acgtaatctgaatattaagaaaaaggataaatatgaaaagatatgatgtaaatatgtaatcgatgcatactcttaattatgcaatgtaattctttttttgtgacattaatacattatatatcctttatcttataaaacacaagtcacttggcaaatcatgttttgacatgtggcaaatttatcaaaaacaaaatccacaatgtaaaacaaaaatgaatttttcgacaaaactcaaaataaaattaaatgtgaaaacagtgtacaaaattaaaacattatcgtcaattttcccacgatcactctcaaaagaaaataaaaatcaacccacatattctccatactcccacaatttctttttcttctattcaaactatgtaactcttttttttcaattaaaacattcaaactaactattgggaaacaaagacagatacgatctcaaacctatatatacaaatctcggtatcatctttctattgttgatattggtttttaaaagaaggttgagagtaaaatcatttaggagcgagaccttctttgtaacaagagtcttcaatctctaatcagttcatataaggcaatatggccagcgtatgttatatttcttttattttattgattgcgtttagatgagtatattaatgctttctgtttttgaattatcttttattatgtatgtttaatatctttttgcttcatagatcaaccactaaaaataaacaagcaaacttgatcgatagaggataaaacacaaacaaagtagaagacttgagcaagaaaaacaccaatggcaaagtagtaggaggttgaagacgaagtagaagtgtacaacattaagacataaatgatatcatctatgtattgagtcaacttcactctggtaacttttttttgtctatgactataatctatgtttgtattgagtctttgaataccatatgtaattttttattttatagcttttgtatgtattctagaaagcattgaagttggaagctaattctctatatttggaagactaataattttgtgatatcaacttcaattctccattatatatcaaattatcatctgaaaaaataaaatccacaaatacatgaaacgatatatttttccctacacgattatatactaatctatttataaaattaatttttcatgtataaatatcgataatatgtaacatatcataacatttaaattcaaaaaaagaatgtatcataacattaattttcggtgctatgcaccgggtataatactagttacaaataaagtataaaaggaattaaacttttatatagataattaacacaaacaaaatattagagacgatttcaaataaattatgaggatatagatgagaaaaatactatatagaataacaatagtaagaaattaaaaataaataaatcaatttgtacatataaattagaaagaaaaatatagataaataattaaacaatattaatagtatcacataggtcaattaaaattttatatacaatagttaaagagtattatatctcaaaactaagttttgatactgcgtagaacaaatcatgtttcaagcaaaaatgatcaaattcctatgatgctggaaatgcttgacgatccacatgagactggctatgtgcatgtatggagaaaaacgtgttgttcgacaacgcgtgcatgccttcttccacctaagtgacgacgcatcacaaaaagttatctagtagtgttaatagttcatgttccatctgccgaaattacacacaatataacgtattcgattatttgttatccaacaacttaaacgattcgaccaactcactcaaccttttgtcactagttccagtcatatatttcttataaatactcgttcactacatctgtacagatcgaaagaatctcttgatatattacaacacacccataattcataaagactagctcatatacctttgatatatgagatttgatctatatgtcgttctccttaactagatatcgctaattgggcttgcattcaacaagcaacatatatcgcttattacattcgacgatactcagcttctacatcttaagtctctctttttttctgagctcaccatcaagtataagaacacaattctacctcttatttgtctactcccaattttttgtttttggtttttcactattctgacatcttatcgtattatgattaacgttaagaatgtcgtctcgaaaatcacctacctagctattgtttcaagattcgactcccatgcgcgtcccatcaagaacaaaccatccagaagcatcaacctccaactattagagaataatgtcccattcgcccctcgctggtcaaatcgcttccatttgattcacataagtccaacaacaacgatgatctctggtgtactactaccaaaactcaaccttgagacagattctcaaaatactatatgttctattaactattttaacttgaatcaagttgataattgtagagagaaattttttgttcacttcttattaatttgtaaaacatttattttaaaacccattaccgttaagctttgatacaatgatacatgttattttctgattaaaaatggttataaacttgaacggtataagactttagtgtatagagaacaatttagagaatctgtatttatgtaaccgcgacctttcggaaacgtagaaggtggtcgcacaaacaaaccaatcaaacccttaatcgatggcactcttttaatgtctaataaacttcggttcgtcactcgaccggacaattaaatatgtgattaaaagtgtgaatttccggttcggtagagattactggtatttgttaatccgggccggaccgggccgtatctgaattatgaacactttcctaatgtcatagaatcgttcgtgccgtcgtcgctgcgatctgaccaaaatcaaaagtgttacgattcggtatcatcgtctctctcatttgtgattttgtcaaaccctgctctcttttctccaagtgctctcatg

SEQ ID NO: 26543 - DNA, 3003 bp, Unknown
  misc_feature (1)..( 3003): 2750-1469P.txt file - cDNA_ID_2714517; gDNA_ID_2213619; Annot_ID_131942
gccggaagatgcaccatctcggttccgactctcccagtagctccacgtcacttgatcgtccagctgagatagatgtggaggattttgcgatgaagcatcacaagatggcattgttaaggggtcgaatcgaaattgagcgatgggaagctcattctcaccggtgaggcaatttttccattgggattgtttttcaatgttccagagattttgtttactcttgccatgtttctaatgttctctatgtcagggtttctcagtgtcgaatgaagaaaggtttgcttcttactggtgtcggtgataaggttaggattttttttagtatacaattcgattaggtattgtatgtgttatctaagtagcactggctaagttaatctgactactttgatcaggttatgcgcctctggtcattaaaaagctacaaatgcatggaagaatactcccttcctgatgcttcttccttgattgacttcgattttgatgagagtaaggtaaaccttctctaaaggtcatggatattacttaaactgggaatgagctaaaaatggatttaatgatcaatgatgatacagaaacctcagtcaagtcactgacatgaatttctgaaaccaccagtatagcagtataatctgtttccatgtcacagtttgcctcacctgttgtagctgaatatttccttttggctaaatcttgctattttctatagaaattggaagttgtatctctagcatgggagtattttgattctgttgttgttgttgttgttgagattgttggcttggttggtacccgcattagcatatggaggagaaatggacaaagaagcatttttccatctcgtgcaggcacctttcctaaaggcctttgtatgcggtatgtcagaagatactctcctgatatcaagttcctgagaacctatctgtttctatagaaagatcaactgatattccatgttactgacaaaagtcggtgtgatacttcaacatggctacctagcccctctgcccctgtaaggttgttggcttctctatccacactgataagttgtatgttttctttttcaaccagttacattgacccagaagctgtagttggatgcgaggatggaacagctcgtgtatttgatatgtacagtaagacatgttcacagatcattaggtaagctatgtattatgtgtctgttgtgttatggaacaacacagtgaaactggaaaagaacggtttttcattatcaaaattgtttacaatttcttttgagaaagctaaatcacaattttcctatcagattggttaataactatgtatgtaattgcaggactcagggtgggccaataacatgcttatctctaagcgataatcaactatttcttagtgggtcgtcactcgggagagtaacagtatctgaccctttgatggatcaaccagtggccactcttaaatccacgataactgcaggaggtaaactcaaactcaatgtcagattgcatctccagtgacatttcttaaagcaacctccattctctacaggtatacagacaatctgttttaaccaaggcactaatctcgccttcattggaacaactggtggatatgtttcatgctgggacctcaggtatgttaaaatagtcgtctaaggtttttttcaaagatgcaagttttaattcactatcttaagacgttataaccaactattatctaacaggaaaatggatagattgtgggaaaaacgagtgagtcctaatgtcgtgtactcaatacaacagctaaggaatgacacatcggttatggtagctggtggaatagacggtgtgctgcgtatgattgatcagaagagtggaagggttttatctagagttataatggacgataaattctccacaacatcaacaaggaacaaccaagtggtgatagagaaaagaagaggaaaaagagtttctcaagacatggagattgataaaatcgaaaggaaagttcggcctcaaatcagttgcatagcaatggggatgaagaagatggtaacggctcacaatggtaaatgcataagtgtatggaagttcaatctctcgtaaagtaacaataaacttgtttgtaagtgacgaaattggtaacaatagcattataaatgattgatttaaagacaaaaccgattggattgtgtaagagctacaaaagttgaaacactggaaacaaaaaaagaagggtttgttgtctatttggcggatttcttggatggctcaggttgagattcagctttgatgatattgagttgaccaccttctttacaagctgcattagttgctttcacttcattgcaatggtttatgaatttcgtaagctcctgctccacacaacaccaaccaataactcacaattaaagatccaatcgattcagaatttagggagattgaagaatatagaaattacccgatcagtgtccatctctttcgtcatctttgttggtttcacatttctcttccctggaacaagaagatgataaaatctgagaaatcaaaatcgaaagggatttgtgtgaagtaaaaaaaaagtgaatacctttgcgagtttgaatggatttgccatggcgattaggagcaatagtcttcctcttctgttggcccttgaactgattgctcttctgcgtcatctttggatcgtcgtttctagctagggttttctcttctgtcgaagggtttttgttgtaatagaagaagaagaagaacaacaatcaaaagcctatataatgggctcttaaggcctttatttatatgggctgattaattattgggcccaatttggagttttctaaattcaactctgctaaatttttgggaggcagaagattttgttccgaggaagacacggatacgcagaaagcggtaaaatcctccttcttcgtcgtccttgtaaaaaccctttctcatttttggaaggttctttcaaaatcctttcttcgattgctttcggattctcgctcgcttcttcgatttttggttttgattcatg

SEQ ID NO: 26544 - DNA, 3003 bp, Unknown
  misc_feature (1)..( 3003): 2750-1469P.txt file - cDNA_ID_2714521; gDNA_ID_2213619; Annot_ID_131940
tgtgtgagatctgtaaatttggtcactctttttgttgatatgtatattgaatttgatcattcgtgtcttgcagttaaacaaggtcatggcggaagtctaaaataaagagttttccgtctttgttttcttaaataaaagaaaaaattagttacaaaaatagagaattctgttttgccaaattttaggaaacaatttttctgaaaactttttgttttggtttaacttttaagggttacaaaaattgaaaaaagcaaagcttgtttggagtagttacagagggaaattaattgttaagttgttacaaaaggttatgtgtgattaaaatagttgtcaataaccaaaaatgtatccataaaatcagttcattcattgtctcaattctttcatacaaacttcattctgctttctttcataaagatccaatcaaacataattgaatgggagaactacaagactggtcggtaaccacttgtctcctccttttattgtttcaagcgtcacaaatccattgcacgagccaaacacatgttttaaaccgtcttttgtaccgctcgaagcgagggtttggttcgtcggttgacacgaaccatttaaatgccatccgtcacttaagcgtgtcttcaccccaaaacaccagcggtgttaaccaacaagagcaaaaggagagagatctaattgagaatctgcccggacagccttcagttagttttagacaatatggcggttatgtgaccgtgaatgagtcagcaggtcgatccttgtactattatttcgtggaagccaccaaaaccaaaaagtctttaccccttgttctatggctaaacggaggtatgtatctaccatctagttctacttttttttgttttttcctattcgttgagaaatcatacaagtaacaaaattgatgaattttgtccacaaaacataaacattcatacacaattatatatatatctatttttaaaatatgcaggacctggttgttcctccctatatggggcatttcaagagcttggtccattccgcatatatggcgacggcaaaacactctataccaatccttattcatggaacaacggtacaaaccttcttcttatggaatctttcgtctatcttcttttttttggatagtactatatttattattagaatctcccgcaaaatttaaaagtattatttacgtgtggattcgcagtggcgaacatattattcttagaatctccagtaggaacgggattctcgtacacgaacacagagtcggatttggagaatcccggggacatgaaagcagcagctgataaatacatcttcttggtgaaatggctggagaggtttccggaatataaaggaagagaattttacattgctggtgagagttacgccgggcactatgttccacaactcgcacaaaccatccttgttcataacaagaaccaaaacttcatcaacctacgtggcattttgattggtaacccgactctgaacgacatagtcgaaacaacgggttcgtttgattatttagtaagccatgctttactctcacaagatagtctccttagctacaaggaaaactgcgcaactgacactccaaaaatggaggtggattgcatcgcattgagtatgaaaatcgacgacgacataaaaaaaatgaacctatacaacatattgactcctacgtgcataaacgccacgttgaccccgttgactaaccaatccaaagaatgcaccactgtgctgcagtatgaaccgtgcggaatgcaatacatagcagcttacttaaaccgggaagacgttcagcgttccatgcacgtcacgaaattgccgcacacgtggatgctatgtaatgaagccacaggattcaattggaaccagacggattattctgcatcgatgctacctattctcaaagagctgatgaaacatgatcaacttcgagtctgggtgtacactggcgacacggatacggtgattccgttgacagttacaatgcacgctctgaagatgatgaatctaacggctgttacggactggcttccgtggtttagtgaaggacaggtgggaggtttcacagaggaatacaaaggcaattttagatacgccacagtgataggagctggtcatgaagttcctctttacaaacctaaggctgctcttactctttttaaacattttatccgcaactctcctctccctcttaccccttgatcatctatacactttgtaacaacaccacaacactcttttttcttttttctttttcacattcatgtaattattatataggtaaatgttaattgtgattttcttggataatctgcaaaactaacagaaaaaaacggatttaaaatttaagtaactaaccaaaaaaattgcgtattttgtatatcataaattttttggatcgttaagtagatctttctactttcacatgcatgaacataaggtgccaacaacaagctagatataacatttttttaccgattattccgacatggtgaaaatggtgtttccccttataaaatagccaaacttttttgtttatttggagtaagtttataaccacaaagatgaattttatttatttattttcatgtttgatttgcgacgaatgttaaaacatataatttaacactaaaaatttgtactgaactgcaatacattacatatataaacaatattttctaaaaattggctcatttattgtaattctattcagttctagaaaagaactcgtagactcaacgactagtaattttaataaaattacgttaatttcgtattttttcttttttcttttgtcatcagatattatttagggccaatcttttaggaatcgcgtcatatttcgttaatttcgttcaatagcgcaaaaaaaggtttcgatatctaaattattgatacagttcaaatcataataaattcggaattcagggtttaataaatttcggtttacatagatgaataatcggttcagttgagagtcgtgttttgtttaaaaaaatg

SEQ ID NO: 26545 - DNA, 3003 bp, Unknown
  misc_feature (1)..( 3003): 2750-1469P.txt file - cDNA_ID_2714528; gDNA_ID_2213619; Annot_ID_131938
aaaggacaaagatctaattcagcagctccccggacaaccttctgacgttactttcaaacagtacggtggttatgtggccgtaaacaaaccagccggtcggtttttgtactattatttcgttgaaaccatcaaacccggtaacactactcctcttgtgatctggttcaacggaggtatgtacatatagagaacatgtattccctctagaaactcctttacttggaactagttatatattttatttttttacaggaccgggctgctcatctctaggtggggcatttaaagagcttggtccattccgcgtacatagcgacggcaaaactcttttccgcaatccttattcatggaacaacggtacctagctataatttctaaaaatatattattagaaaccaacaaggtatattctcaagacatattgagatcaactaagtatgctattacatatggaattgcagaggcgaacgtgttgttcttagaaacgccggtagggacagggttctcatactcaaactctccaataaatgggaaacaaggagacaaggcaacagcagaggataactacatgttcttggtgaattggcttgaaaggtttccggaatataaaggaagagacatttacatcgccggtcagagttacgctggccactatgttccccaacttgcccaaatcatccttcaccgtaacaaccagaccttaatcaacctgcgtggcattttgattggtaatccatcacttaacagggagatccaggatgatttcggctacaaatttatgtttagtcatggtttgatatcccaacagcaaatggacaattataataaattctgcacggactccgacttatatgattgggacaagtgccatttggcgtcccaaaaaatagaagctcaaaaaacacacttggacatttacaacatatacgctccattgtgcctaaactccacattgagcagcgaacccaagaaatgcaccacaataatgaaggctgatccgtgcagtgggaactatttgaaggcgtatcttaacataaaagaggttcaagaagcgatacatgccaacaccacgaaaataccgtatgagtggacctcttgcaatacgaaactactttgggaatggaacgaaaaagataggtatgtctcattgacacctatccttcaggagctgatggggaagggtgtccgagtcatgctgtacaatggagacgtggacctggtgattccatttacatctacattggccgtggtgaagacgatgaatctgacggttgtaaaggaatggcgtccgtggtttaccggaggacatgtgggagggttcacagaggattacaaagggaacttaacctttgtaactgtgaaaggagcaggtcatagtgttcctacggaccaacctatacatgctcttaatatctttacaagctttatccgtaacactccactccctcaaacagcctgatttctaacttgtaccacccctataaacttaataggacactttggtccattgattgaatgatctaatgataagtatgatgtgtatgcgtctgtgatacaacactcaacaaattatacttaagttaattattgtcaaggaaataaaatttcgaaattatcaagcataaatttaatacagcagtagccactttacataaacaaagttcaatcccaaaaatgcattgtttctcttccaaacataacttgttcaaatctataacattcctgttgttttactgatcatcattccaagttagcagatgaatattcccatttccttgatattctcttaataggccaaaattgtgtcataatgtctctagttagattcggttgcttatctcttgtaatgcaacgcttctctcggaacggcattgtcgaattctccggtgaccaataatctgattgcaccagcagggaatctgttattttgatctgatccttcaattggctgtgagagtgagaacaatggacgatgattatactagagagatgatggatctcaagaccttagacactcgaaccctagagaagaaagatgttctcgctaagatccgggtaacttttttatagggttcctgcttccagatctttggttagtggatctaatgtctttgatatattctcgatgatgtatacatttggaatcatgtgaattctcgtacttagaaattgagtctggtgaaaaagttataatcttaattggattctttaacgttttgtgtgactactgtaaatttggtcactctttgtgtgttgatatgtattgaatctccatcaacattcgtgtcttactgtcttgtggtactacaaggtcttgctgtcacgtgagtaaccagagggtccagagaggaggacgggagagatgcccccataattattttctgaatcgcgacttcaacttaagtttttcgattagtcaagaaacgtaactacacatttgatagcattattacgtctccaatagtaaagtcctctattgctacttcacacgaaaaaaatgtttgtggatctcttgaagtaactagctaaatcgtgaggatattgagctggaaattgtctaagatttgagaattattagacggtttctaaacgctcaaaagggacttgaagaaattcgacttttttttattggaacctaggcaactatatcattatttacaaagaattagtttcatttgatttataagtttgttacagttaaacctcgaaaatataacgatagataatggctgctaaaaaaagataaaaaaaaatgtggattcaatgtttgataagaaaaaaatattgttatattttatctacggaggacaggtagttattatgttctggccttgtcggatttgttgttaagtttctacaaaaggttaaatgggttattaaaatagttgtcaaaagccaaaataaaacctataaaaatgctgccattcatattccaaaccattcgtctccatttcttttcaaatccttctcctaattctcataggattccaaaataagagaatg

SEQ ID NO: 26546 - DNA, 3000 bp, Unknown; identical to SEQ ID NO: 10049
  misc_feature (1)..( 3000): 2750-1469P.txt file - cDNA_ID_2714531; gDNA_ID_2213621; Annot_ID_131977

SEQ ID NO: 26547 - DNA, 3000 bp, Unknown; identical to SEQ ID NO: 10047
  misc_feature (1)..( 3000): 2750-1469P.txt file - cDNA_ID_2714547; gDNA_ID_2213621; Annot_ID_131973

SEQ ID NO: 26548 - DNA, 3003 bp, Unknown
  misc_feature (1)..( 3003): 2750-1469P.txt file - cDNA_ID_2714551; gDNA_ID_2213621; Annot_ID_131972
actttgctcagtttaataacctgaatgcttcttcccgccagagaaaacctttgacgataaaggtatactaattaagacgtctttcattgactttagtactctatgaaaaatctccatttagttgttttcctcttatcagtttttgttctgtctatattctataggatgctcaagctttaaacgagtggcggtttacaaagctaaaagagtacagagacagaaacattgaagtagaaaatgaagcttttgatcggtacatgagtaatgtgaatttactcgaagaagcattttcatttacatctgttcctgatgaagagagtcatggaacagcagctcctgagcaaaacaaagaggaaaatattgtttcagagcttaaactgaggctgagatcgaactctgcaagaacagagagctttaagaagcggatcgcggagacagtcaaagccggtttggtgaagcttaagagactggatttaggcagttcttcagatgatcaagatgatatcaaaaggcgggtcaaaagaaagaaatgggaagagaaaggttcagctttgaatgaaataatcgataaactgaacaaagcaagaaccgaagaggatctcaaatcttgcttagagatgaaatcaaagctctgtggtcaagtttctcccactgctgcttccgagaagaacaagatctttccgggtgtagtccgaaaagttgagatgagtgaagaagcacttcaaaaaatcgctgagaatctccaatcttttgacaaagttggaatgttgtgaagtcgagaacatcctgtggatgaactgaaaagtttgagtggcaagaaaatttctagatccttcgtgaccacggtattgtacaatgatcaaacatccctcaaaactgatcctgaagactccaaagactcaagagattcttgtaaagtagtgttgagcatcatttagatattagaactcagccatggataaagctgttgattctatctcattggatttttttcactgtgtgttgttgctttgttagatttgaaattgctcattggattacctttgacttaataaatagttggtttggtttggtattggataaccgctcagtctaattagaccggtttgtttttttggaaaaaaatgaatccatccatccataggccactttcaacacgtatatttgaaaacgactaaaaccaaactcttagattctagttttgttttgctgccccaattccactattgatcaaaacatatccaaaagtttttgtggaactaaaaagtaaaaataacgtttagtttgtttccaatttcaaccatatatatcttattcatatatgcatgttgtggttgtctcgtgtgtgtagtattcatttacattatgcaaaccaactggaaacatgttgaatgggttatgggttggtggttgggacttgaggatcaaacaactcaaatgagctcattataagttaagctctcaataatcattaatttatttttgttaccacctaatatttctacgaagggttggtgtaacaatttttaattgtaagataattgtgtaatcattttcaatattaatttttattatgtatttattttaaaaagttatataatacgtaacacatttagtacttggttttggtagcttcatcaatgtaccatccgaagttccaaaaaataaaaaaaaatgtcgatttcaccgttggtgaaaaagaaactaaattgatatgtattattcattttttagaagagattatgggtttaaatctgaaacttcttagttaaatttttaattaatttatttattttgcatgctttattatatatttgaaattagaatctacatgattaatgatttttttctcagatagaataaaaaatatatttactgataaattattcttttacatctttccggattcgctactaatgtgtttttgttaactttaaccagattgcttatggattatgatatatagtatccattacttaaaaagtaaaagagatgaaaaaccaagaataattaatgtcaccaaactatcaacaacaacaaaaagagagtgtaatattcaagataaacgaatcctattatataaaaaaaggtgggaagaagttgctgtctaatgatgtaattatgttaactagtgtgctaaggaaagaaatcaagcaagtctcacacatacacatgttatgacttatgattagcgacaagcatttcattttattttatttttgctaagcaaaccttttgtttagtaaaatagacaatgtgcaaaaaattccaaacttcttaaattgaaaaaaatactatatttaaatttacctttttaagtaagaaattaaaagattttgtagtacactacatgttttaaaacaaccactatccaaacaaaaacttggtcaccgaataaactgtagaaatatcgatttccgtcatttaaattcactttatttttggttgtttttttcttggaatatgcaagagtaatggcgtggttgaagacacgagagagagagagagaatcctaaagaaaaagccaaagcatattaagaagaagagaaccaaaacgaacaaacccaaccctaaagaaacactattattaaacctatatttatagacatttaaagagagagtgaaaggtgcagaagaaaacagagacagagttcaaataccttaagatcacatcatcatatagcttttgtatcattaaaatggcagttcaagctcaacaccattcctccaatctcctcttcctcaataaaaggttcattttctctctgtaaattcattatttgcttttagttttgcttattgattacggttttatgtttctttgtgtgaacagaaacgggaaagagaaagaacatagtaattttacattacaatcacaagcagctggagattttcttgatcaaaccaatatgttattcaacaatggaagttcgtaaaagttctcttgttttttccattaaaatttaccaaaattaggagacaaaatgagaatgtgtgtgtatg

SEQ ID NO: 26549 - DNA, 3000 bp, Unknown; identical to SEQ ID NO: 11070
  misc_feature (1)..( 3000): 2750-1469P.txt file - cDNA_ID_2714595; gDNA_ID_2214478; Annot_ID_133154

SEQ ID NO: 26550 - DNA, 3003 bp, Unknown
  misc_feature (1)..( 3003): 2750-1469P.txt file - cDNA_ID_2714599; gDNA_ID_2214471; Annot_ID_133086
cgatcttacggaggagatcaatggtgggaacttcatcggcggcagtcaatatctcttcgtctgacttgattagaaccctagctctcgtcaaagcgataagccctttgtcaacgacggatccgatcggattcgcgagagatgccaccgaatcccaaaaatgtcggagaggatcagcgacggtgtgaaatttaccgccgtaaaacaccttagctccggcgtagaatctctgcagatccagtgcttcataatctagaagctttttagcttcggggtacgcggtgatgaaaatctgaaatcctctgtcgagaaagaagccgtcgacgatatctgtacggacgcgtccgccgacgccatcggaagcttcgaggagtaggaaagggattcgtttggaggtgagctggtttgcggcggctaaaccagcgagtccagcgccgatgatgatgacgccagtttgattcttccgaatgtacggatcttccgtggaagattgagctccggaaaagcgttgatatcggtgatttgcatggccgcggcggcgagggaagaaatgagaagtagatgaggttgggagagagatcgccacgggcattttaaaagtttggataaggtttttctcattcctttactttattttccccgggaaaattatttgtctagaaaaaataatatatatatattcaaataattatttaaaagattcgaataagtcttgttttcttgattcttttccttattaatctgaacaaaaacaaattatgaagaccagagtcctagtcccagagaggaccgttgtcctagagacggatacagcccaagagacgaccttagtcctgcggaagatgaagaccaatgaagagtaggaagactggtgattgcttataggccgtctattttggcttataatgattttaaataagtgtaatggattttgttgcttaatacttcgtctgctatcttgttttaaatatttaagaaaataaaacgactttcgggattgtctttttctttctgttccatgtcttcttaactgctatgagtaaaagagctctcccagactcttcttctatctccaaaagcttttatttttgtttgtttattttggtactgataatatctgagtatatatataatatagtagaaacaatgagcaaaagtcaatatgtccgagtggttaaggagattgactcgaaatcaattgggctttgcccgcgcaggttcgaatcctgctgttgacggaattgtttttctttttagcttttgttgggttgtgaaaagtataacaaccttaataatttcgtttttttaatctaaaaatatacggtagttttctcatcatcaccaataagaattgtttgatatgaaacaacagaatcaggaaaatttgttaaaatgtcagaaaatggaaaaatctctaactgaacaaaagtaacaaaaaaaactcccttagaaacagaggaatcatgatgagagacaaaattatacagagacgtggagatgtctgtaacgttgtctcatccatcatcatgtcttcttcttctcttccttctcttttccggtcatccctccgtcctcggaacctccatccccgacgcggtgaacacggcggcgcgtttggtaaacagagcgagaagagcaaaactgtcgagagaatttctacaagcgcacaacgatgcacgtgtttcttcaggcgtgccaacgctcggatgggacagagacctggcccgattcgctgataaatgggctaaacaacgtaagtccgattgcagtatgatacattcaggtgggccttacggtgagaacattttctggcaccggcgtaagaagacgtggtcgccggagaaagtggtgacgagatggtttgaggaaaggtttaactacgacgtgaaaacaaacacgtgcgcaccgggaaagatgtgcggccattacacgcagatggtgtggagagagaccacagccgttggatgcgcacgtgtgaaatgccataacggtcgtggctatcttgtggtgtgtgaatatgatccacgcgggaattacgaaggtgaaagaccattttgatcaaaacagttaaaatgaaaaaattgttagagattcaaaatattttttcttcttctaatgtaatgaagatggtatattattcttggtccttacatatatacagccatgtattgaagaggtataaattcaaatggttcggaatcttttaattttatatattaaagatcaataataaaaaaaaacgtcgacagcagggttcgaacctgcgcgggcgaagcccaatagatttcaagtctatctccttaaccactcggacatatcgacttgttgtatttgtttcgtaagatttgaatacaaaaccgaattctctgttgcctaaatcggagcttttcatcccttgactctctaagacatctgaagcagctaaagtgttggatgtttcacataacgacatgggcggcaagcacccagtggacacaacaaggtacctttgttcttggccgccctctaattcgggtgaaattggaagagaggtgcttggtatatactaggatgcgtatttggtgcttagagatttgatgaaactgaagcagttagatattagagacaacgacctaatatttgcaggtgaagagttcagctcttttgtccgccaggtttttccaaagcttgtatggcttgatggccacaaactcgcaagttaaagataaatgttaggccacttgttttaattaaagtataaaactctttcgtttttttggattcattttcatgaaatcaaaagactacaagtctacacgtgcttcaagcttgaggctctaaatgaagtggtaggaaagaatgaaataataataaaaaaagtcagaaaaatggatggtctgagatcaaagtgaaacctactccacatacacatcccaacttcttccccgccatgtggacttttctttttcctactttctctctctgcattctctcttacacctgtctttatctgaaaaataaccgatg

SEQ ID NO: 26551 - DNA, 3000 bp, Unknown; identical to SEQ ID NO: 11007
  misc_feature (1)..( 3000): 2750-1469P.txt file - cDNA_ID_2714606; gDNA_ID_2214471; Annot_ID_133082

SEQ ID NO: 26552 - DNA, 3003 bp, Unknown
  misc_feature (1)..( 3003): 2750-1469P.txt file - cDNA_ID_2714610; gDNA_ID_2214471; Annot_ID_133081
aacgtgacttgtgtccgctcctattaacatagttttgttgtggttcatgaaatggcatctgaaatatttgtttgaaacataaaaacatgaacacaatgggtagtcatagtatatgtaatctgtaaaaaaaatcatgtttaaaacgatttttagaatatcttttcaatacaaacatagactcaaaacaatataagatttaacttacttagtaccataaaagatttaagagacaaaccttgagacagtgatgtcagtgctttctcgtgtgatatcaatcaaaccatcatagtaattcttgagactacaccgatcaatccaaatattgtgcgattttggtttgatctgaatagcgtctgcgtctggtcccacaccgccttcaaattcaagattgcagattataacgttttcacactcttttagccttaacccttttcccgttatcttcactttttgtcctctcccgtccaccgttgtgtgcgatgatacgttgacaaacgaagacagattgatcgttcccgatacatcgaacacgatccataaaggttctggcctcttgcaagcctctcgcaacgatcctggaccctcgtctgcacataagattattcgtttttatatgaactaagactcgaaccgcacaacatcgtactgccactcaattttaatatgaatttgaaaccagaggtgtccaaatttgactaaaccgacccaatgcttagacatcaatatggtggatatcagaattactttggcgtaaatgagtaagaatattttaaaaagacgtaagcagctctgatccaatgataatttcatttacattaccaatttgaacatggttaggatatcagccaccattttttcttaagatatatgcaagcaaaattcagaatccaacaaatggttaatttgcttttttttttttaccacagaaaaacaaattacgttgcttttaagattttttttttttgtttttaaattactttggaagttttgttcctatttggagtatttggctgacatatcacttgatcatattttttttctatttggagtaacaaaacagagaactacaaattaaataaaaaaaatatataaatccaagaatttgagggataaatgaaggaaaaaggggacttttgaaatttaccagctaaagaagtgacgtggcaaatcggaccatttagaccaccaacggcggcgcggccgaaaccttcggcctttccggcgagagagcggaggctggagtctacgtggcaataaggtcccactgtcatgtggtgatcggatggcgatgacggagctggagctggagctggagcggctgtatatggtggtgggaaaggtgaattgggagcttcgccgggaaaattagaaccgccgtgatgggatctgtgaatgccatgtaagtttcccatatctaatttatataacaaatgttgaattcaatttcggacagtttcagtttttgtatttttgggatataattgctctttgtttcaactgaaccatattgatggtagctttgttggaactgtgccagaatattgttctttttttgtcggaaaaaaaaaaactttttcatttttttttgttgccgacacaaatctatttttatttatttgaataaaatgttggaaaatgtttgtctttttgttaagacgatttcaaatttatagatattttcgcatgataagattctttaatttttatagagtccctttttattttgaatttacattttcatatcaccacttagcttaattttaaaaggaaatgacaaaccaaaataaaaatatgacaaatttttttttttggttattggacagaagtttaagaaatgtggctaaaggcttaaacatgatttagaaataatttttcaaaagtatagatatccttaatgaagcccaacacacatgtttgagactcgtcacaagtgttgacaaaccaaaaactaaagcccattgctaactaaccaagtttttttttccaattttcctaaaccgtatattgaagatatatgtacagtattcggtgaatttaaatcggaatgaaatgctgacgtgggaaacatccctaactgaagaagatgaagaagaagaaaaggcaacccaaaaaaaggtaattcagctgcttctcctacaaataatcagatcgcaaacccttgccgtgacactgaaggcaccggtggccgacggcttattcatctttctccaatcggagagtcgtcgttttttacaatatcatgatcccgctttgaaatttctctgttttctaatctctcaaaatgggatccagaatcgaagaaggtacaatgatttctccttctccttcattttacatttctgactccaatcgttacgaaaattcgttgcggaattagacaatgcgtgttattagggttaggtcttgaaatatctcttagggtgttatttttttttaatcattttcttcaacggatctctagtttacgtgataaacaaacaaacattgtgtaatcaatctcactctcgcagagaaggaactggaaccaggtatggagaagggtctggcgacggatccaacgagtcctacagggagtactgtagcggacctgtcgccaactccaaccccaaggaagactctggttctgtccaattcgggtaaggctttaatggtgtctaactcgagcaagtccttggggctttcgaattcagggaaaaggtttgatccaacggggaagaagaagtatgttaaacaggtcacgggacggcacaacgacaccgagcttcacctagctgctcaaagaggagacttggcttctgttaagcagattcttagtgacattgattctcagattactggtaccattaccggagctgattttgatgacgaggtagctcaaataatgacatccgtagtaaacgaggtgaatgagctgggggagacaccgcttttacagcagcagagaaaggaaacatagatgttgtcaaggaattgttgccttacacgaccattgaatctcttatg

SEQ ID NO: 26553 - DNA, 3000 bp, Unknown; identical to SEQ ID NO: 11005
  misc_feature (1)..( 3000): 2750-1469P.txt file - cDNA_ID_2714614; gDNA_ID_2214471; Annot_ID_133080

SEQ ID NO: 26554 - DNA, 3000 bp, Unknown; identical to SEQ ID NO: 11005
  misc_feature (1)..( 3000): 2750-1469P.txt file - cDNA_ID_2714614; gDNA_ID_2214471; Annot_ID_183019

SEQ ID NO: 26555 - DNA, 3000 bp, Unknown; identical to SEQ ID NO: 11003
  misc_feature (1)..( 3000): 2750-1469P.txt file - cDNA_ID_2714633; gDNA_ID_2214471; Annot_ID_133073

SEQ ID NO: 26556 - DNA, 3003 bp, Unknown
  misc_feature (1)..( 3003): 2750-1469P.txt file - cDNA_ID_2714639; gDNA_ID_2214471; Annot_ID_133107
gtctgcacaaagatttgcataccacctctcaacctcagaaccaagtggagagttgactctttctggatgttgtaatcagccaaggtaaggccatcctcgagctgtttaccagcaaagataagtcgttgctggtctaaaggaatgccttccttgttctggatcttagccttgacattatgaatggagtcggaggtttcaacatcaagtgttatggtcttttctgtaagagtctttgcgtagatttgaattgtcatctgtaaacaattttttttatgggagagaaaggaggattctgaatggtaagaaccaaaaagatcaggcgaaaaaagatgatgagaagagatagaagaaacaaataccttgagagagagtagtagtacttcacagaaaacttttgcagaacgatcgatttagggtttgagtaaaagcgtttctcagtttatatagaagaggaaaagttttggatttaaatcagctttcgataattataaaatattcgacttaatctgttaattaaataattcgaaatttagtattatcttgtttatcgctttgatttttttataaaatgcgaaccaaaacaattcttgctttgattatttttataaaatacgaaccaaaacaattcttgctcttstgatatggcgtgcacctcaaaatagaaggttctgaggggtggcactttagtctttcttcaccttacaagatcactagcatctgaaatcgcttggaaaatgaaatattcctgaattgcttagagtttagacttcaattagagtaataaaattccactctccaaaaacattcatgcattgcacaaagctatatatataatcaaacctttactaccaaactttaagagtttgtttgcagaattcaattattagagactttcaaaccgaaagactcaaaaataaaaagttgctcaacatagaaattgaagtccatgcttctattattgtgtcgccatgatggaactcatgtaagcagacttcttgccagatgctcccgagctgttgctagcgcttgtgttagtgtctgcaataccgaaatgtaaacagagggttcaaattagaagttcacgtttgtgtttatagccaaaccagaccaaagttatagcaaaactaaatcaagactattgcttttccacagggagatgtaacaataatagtcaaaagtgtcgttacctgttcagagagtgaaccactagcttctgtgctctgcattgctactttccccgcaatgacgtttggatccgtttcaagaaccacccttaacacatattccataataagccacaatcagacaatagctaactgctaagatatatgggacaagcttaaaaaaggttgagcaaatctttagcatgcttaagacttttatgtaattgtcgtgtagggctaaactattaaacttgcatacccttgatcgaccatttcatcaaggcatagaaagatgagatccaagttctcaagggcttccatcttttccacattgctcctggtaaaaaaaaaaagggatgcatcatactttagttgtggagatggttgatcaataaataaaggcatattcagttgtcaagtcaaacaaatacctcagaagaagtgcaacagcatcaaaaaagccttgaagaacagaagctaagatgagctcgttttcattttcacctccagtaacaaagaagtgaaggtcctgggcaaacttatagacaataatattgctgtccaacagtgtgatctcagctgcacataaaacatcgatatggctatttgaaagagataagtatataagcatacacgaagtcaggaaacatgatagaaattgtgtagatgaaaaatgttatgtagtcttaccttctgtacgagcattggtcttagaggtctttgagaatacatacttctcaaaacttaacttggcggcattagttggccagtcatccgagtaatacttgacagccacacgctttccttcagagtctagaagaagaatgttctttaccaaaggacaagaatcctattcaatgtacattggaaagtcagtaattaagttccagtccaaaaaaagagtaaaactcctacaaagctgtatgattgcggcaacatacacacattctaacagaatacgaaatacaatcatataatgcatatgtacttacaggagacattgttgtaagacttgagatgtacctgaaacagtgacaaaaacaaaaccaagtagtatctgagtcaaaaactttcgattttaacaagatattaaaaacttcaacccacactcacagttgttctagtcactggtacaaaagagtacatatactaagatcatatgtgacattatgtgtgtagtgtagtaaatgtaatgttgatgatctccatgacaagatagctattatttcaaccagggattacaaatggagattgacgtatttaataatagacaacgaatcaccaaaattcggattgatacatacatgcattaatcacataactaaatcttatcggagaatcacataactaagcacagatgagaacgcaaacaaatgattcaagactcaaataggcagcaatggatctcgataatcataatccaaaggatcaccggaataaaagatcggagaagaagtaatggattggaggattcaaatgtgaaaagcgcaagatcgtcgagacagaagaaatcgcctcggagtgagagagagctcctttcgctgtttcagtgtcacactgcttatcgggatctgaatgcttaatttcatctgaccggtttttataatttattgatatccggttcatttgaccatggccgtttaagaacataggctgatgccgtttcttattttcagacactaactktgtgccgttttatttcatggaaatcgaaatgttctctgcttctctgctggagctagagaaggtataaaagtaaactttttcaggtccaacgcagcaaaaagtctcctctttcctctctttctctctctgcgtccttctgaggctggaagcgatg

SEQ ID NO: 26557 - DNA, 3003 bp, Unknown; identical to SEQ ID NO: 26556
  misc_feature (1)..( 3003): 2750-1469P.txt file - cDNA_ID_2714639; gDNA_ID_2214471; Annot_ID_183047

SEQ ID NO: 26558 - DNA, 3000 bp, Unknown; identical to SEQ ID NO: 11010
  misc_feature (1)..( 3000): 2750-1469P.txt file - cDNA_ID_2714662; gDNA_ID_2214471; Annot_ID_133098

SEQ ID NO: 26559 - DNA, 3000 bp, Unknown; identical to SEQ ID NO: 11011
  misc_feature (1)..( 3000): 2750-1469P.txt file - cDNA_ID_2714666; gDNA_ID_2214471; Annot_ID_133097

SEQ ID NO: 26560 - DNA, 3000 bp, Unknown; identical to SEQ ID NO: 11011
  misc_feature (1)..( 3000): 2750-1469P.txt file - cDNA_ID_2714666; gDNA_ID_2214471; Annot_ID_183035

SEQ ID NO: 26561 - DNA, 3003 bp, Unknown
  misc_feature (1)..( 3003): 2750-1469P.txt file - cDNA_ID_2714670; gDNA_ID_2214471; Annot_ID_133095
aatgagtaattggtaagaatataatttgattactcattcaaaagtagatgtcaatctaacttacattttcttcaatgtagttcaaacaaccatcattggggacaaaggcagcaatctttttaccattcttgatcaactgaactctagcacacttacggatagcagagttaggctgcttagcctcaataccactgcataatcaaacacagagtctcatcaaagtcaagatctatactactaacaaaatcaagaaatggtaaatatatatgtttatacaaacttacattttctcaagaacgattcctttagcgtgagaagaacaagcaaaaggcttcttccactcgttgcctcgattagacttcttgtaatgcttgtccgcccacctctgagtaatccgaagctgcttaagcttgcgaccagctcccataccacgtgtcttactgaagatattcaaatagaagataaaagaaattgagaaccaaaggacatttcatcagatgaaatcaactcactcagaacatataaaacaaattcggagttgataaagaacataaagttataatctaaatcacaaatacttaacacaagaggagagtgtagtaaggaaaaaaatcaaaaatcataatcataatttccacatttcagaccaaataactccaacgtttataagaaaaaactacgaattatagcaacttcgtagcttcaacagggtgattaacaaagtattactacacgacgtatgaatgtcattcaaatcccttaattcaaccatcccgacccgagataacgaaaacggcaaggcaccaaagagaaaccggaataaacaaaaaaaacataaaacaaatcctaaacccgacataacaaaaacacgatcacttataagcggagagatgagactgaaacataaagagtctaagagaggataccgtaccccatgttgacgacggcgcgagtgaaaaagtcgagagatgagctgaaactgctaaaggcgcgacgttttaagttcgtgagagattgaaaaaccctagtgataagaaaataggtatatataggcttgggtcaagactcgtgagagccctggtttaggcattaaccggtctgcaatgaaattgattaaacggcaaatgattatttttatatttgggcttaacaagaaggcccatcacatgtcaacccaaatattatgccaactccttaaggtaataatacgggaaaaatgtcgttttatacgtgaactttaaaaaatggccatttaatacgaaaatttttgtgtggccaaataaaacataataaaaacgttgaccggccgtttcacacaaatattattgttgactacgccaaagtctccatgccgttatctttcattaacggatccgttaattccgttaacacatgttaattagtttccgtcaatactcaaaacgacgtcgttttattgaaatcaaaaaatcaaaattcctaaaattgatttcaaaatctctaaattccaaaaaaacaaatccttaattcctaaattccaaaaatcaaatccctaaattctaaaaaccaaatccctaacagcctcttattttcagcaattggtcgtcgtaatagtcatcgtcgtaaagatcctcaagagagctaaagaagggccttcgctttgatgtttcctccttgttcatcatcgatcttgttcctcccccttcgtgaattcaaacgaacaactgctgtcaatagtcgaatgttattattcatattcaaattggttctcatgtgtgtgtgttcgtaacattttattcacaagacaacaaaacaaaaacagggaaacttccaacatgatgaaataagattatgagagtgagaaaagaaccttggacaacgggattgagattcctaaagaagaacatgatgttgccatgtgaagcagatggattgaagaaaaatgaattggattccattttggaatttagggattttgaaatcaatttgggaattttgattttttgatttcaatgaaatgacgtcgttttgagtattacaggaaactaattaacgtgtggtaacggaattaacgtatccgttagaaaaagataacggtatggggattttggcctggtcaacaataacatttgtgtgaaacgaccggtcaacatttttattatgttttatttggccacacaaaaaattcacgtattaaatggtcactttttgaaagtttacgtataaaacgacatttttcccgtaataccgtatacgctgcattgaaacattccagtcctagtcacgtgcacggtgcacctactagcccacgactcccacactatccgccacgtcagaaaacgaaaccggttgtagcaggtaaaaggcacacaaagctaagcataaggaagcgcgcgacacgcaccggttcagccggtactctgcgtcgataaacgacatgcaagaccgtccattttcttaaaaaagcgatcttgatctgacggtccttatttgtttattcaaccggtaaaatacaaaaaaatcaggaaaaggatcgtggatcgtcaatggcggactggagtaaatttctttgacaataaccagtcctaaatcaaggtagaatattgcaaaaatgttcaatggaagaagatagattggtgaccatgattatcaacgacgtctaagctgtttctgcgtcatttggtaagtgaagcttttgtctctttcgatttctctaatgcaaaaaaaaagggagaaagattttgattcgttattgaaattattctctttgagttattttaattagaaagaagtaatttttatatatatttgtcaagaaaaaaagtgagcttgaagttcacgcttgtaaaggtgtcagttttgcagctcattatcgccatgttcttctctctcgcgctctttgtgttttcttctctttgctcataagaacccactttaatgtatgttcaggtcttcttcttcttcgtcttgttgctctgaagagttggtcctgacttgggatttagggatttcgttttgataatg

SEQ ID NO: 26562 - DNA, 3003 bp, Unknown; identical to SEQ ID NO: 26561
  misc_feature (1)..( 3003): 2750-1469P.txt file - cDNA_ID_2714670; gDNA_ID_2214471; Annot_ID_183033

SEQ ID NO: 26563 - DNA, 3003 bp, Unknown
  misc_feature (1)..( 3003): 2750-1469P.txt file - cDNA_ID_2714682; gDNA_ID_2214471; Annot_ID_133090
agcaaattttcactctttaacgctccatttcgtacattactttgatcatttttctttttatctatttttttcgtcgaccgttttctttgacgatgtttgttatatgattctaaaagcatccacaatggtagactcttagcaaaactcttaacaaatatttaaaaaattatataatttaaatattagataaatctcttaaatttggtaaaacttaggtcaattgtctcttagttaagagacaaatagtcgggttttattaggcccactagttcgttaaaggctaaagcagtgcccggttcttatagcggaggtaactttaaatattgggcccttactgaaaggtaaattagttgggtttattgggctttattataaggcccactaattcagcagtaaccctaacgaaaccctagcatatattagttcttaaacttcagctgagagaaaaccctaatttctcaaagagtctaaagagacggagagtgagagaagagagaaacatttcgagacaaatggccgccgccgctgctcgtcctctcgtcaccatccaaaccttggatggtgacatgtccaccgatcaatcctccaccgtcgtacttcccgacgtcatgacggcgccagttcgaccagacatcgttaacttcgttcacgcccaaatctccaacaacagccgtcagccatacgccgtatcgaagaaggccggtcaccagacctccgccgagtcctggggaaccggacgtgccgtgtctcgtatccctcgtgttcccggtggtggtactcaccgtgctggtcaagctgcgttcggtaacatgtgtcgtggtggtcgtatgttcgctccaaccaagatctggcgccgctggcaccgtcgtgtcaatgtcaacatgaagcgtcacgcaatcgtctcagctatcgctgcaactgctgttcctgcgcttgtgatggctcgtggtcacaagatcgagaatgttcctgagatgcctcttgttgtgagtgactccgccgaagctgtggagaagacctcagctgcgatcaaggttttgaaacagatcggtgcttatgatgatgctgagaaggcaaagaacagcattggaatccgtcctggtaaaggtaaaatgaggaaccgtcgttacatttctaggaaaggtcctctggtggtttatggaactgaaggatctaagatagttaaggcgtttagaaaccttcctggtgttgagctttgtcatgtggagaggcttaatttgttgaagcttgctcctggtggtcaccttggtcggtttgtgatctggaccaagtctgcctttgagaagcttgagtctatctatggttcgtttgagaagccatcagagaagaagaaggggtatgtgcttcctcgtgcaaagatggtgaatgctgatcttgccaggattatcaattcagatgagattcagagtgttgtgaatccgatcaagaaggatgcgaagagggctgttcttaagaagaatccattgaagaatctcaatgtgatgttgaagttgaatccttatgctaagaccgcgaagaggatgtcactgttagctgaagcacagagagttaaggctaagaaggagaagctcgccaagaagaggaaaaccgttaccaaggtaatctcaatacttgacttgttctcttatcaaccgtttttggattgtctttgtttagttactgattacattttgatctgtggttgcatttcatttgacttaacttatattgcaattgttctaattgactgagtttgtgtatgttaagctatacaataatctgttcccctctggtttagtctatgactatagtagtctttctttactagatcttaccttttctgttctgaattgtggtctagtagtttgtcttgtaaatctgttgtgtacgattctttgtcttgatattgattttaggttgagctattaagcaattgaatctcttagcactttcttgtcccttgtgaaaattgttcttcatatgtcctcttttctaactccactttgaaatatctatttttcttacatcaggaggaggcgttggcaatcaaagcagcaggcaagtcgtggtacaagactatgatctccgacagtgattacaccgagtttgataacttcaccaaatggctcggtgctagccagtaataatctcgtctgctttggaacactttccatattttagtcaaaagattttggtttttttaatctgttttgtctttgggtgtctggatatcaagttgaattatgaacaagtttcacttttttacatctccatttcttacttcgcctttatcagtttcatttatttatctcttgctccttcgtttcctatgatgatgcttgttatgttatgaacctacttaaaaacaagctgaagctttctttggtttaccccagcagaaacattaatcaagttcaattgatcaatatgtcgattgatttactgtttaaaggcatagtgtgtctatcaacccttaagtctttttggtggatagtgaagctcaaacccaattcaaatgtcgatcaaccctaacgtttttgtgctcgatagtaaagcatgagtataaaaagaacgtcgcttcttcctacaatcacacagatcatttgaagctttgattagttggtacaacatactcgaggaatacagaatgacacgtggtgtgtatctgttggataaatttgtattattcttctttactatggatggtttctggaaggcgcgccaagagtccttctttttccatctacaaatcatgaccgtccatctccaaaagaagactgaaacagtgaaactagaagcttcattttgatcatcagccagttttataaattgatccgtatactaaagtaacaactactagcactttcttctgtgatcgatcattgtgtttaaactaaaggtttgtatgttcttgtaatcttattgatctcgataggttctccattctctttaggttttaaagccttcaacgatttccagaaggaagcgaatttgaaaaaaatg

SEQ ID NO: 26564 - DNA, 3003 bp, Unknown
  misc_feature (1)..( 3003): 2750-1469P.txt file - cDNA_ID_2714694; gDNA_ID_2213622; Annot_ID_131999
tttcgtagccatagatggacagatgaagctatatcagaaacgtttggtgtcgtctgtttggtgtcttattaagctgtaagtaacggaaacgttttattttatttataggtttatgaaacccttgctggaattaaagtcgaagggagacttcctgttctgaagaaacaagacctactgaaatctcttccagctgaatggccttcagaccctacaactgacatacatagactaaatatgggaaactcgaagacattggttgttcttgatgatgatccaactggcacacaaactgttcatgacgtagaggttttaactgaatggttagccttgcatctttctctatgaaaaactgaacttatcgtgtcaacaaaaaagatatcatgaatctttcactgaaataattggcaagtcgctagcctagaaactaatggaaggaattgataattgcttattgcttttccctacattttgacaggagtgttgaatctatttctgagcagtttagaaaaaagcctgcatgcttcttcattttgacaaattcaaggtccctgagccctgagaaggtcaagacaatttttattttgtgtaatctacttattgcagagtcccaatttcatggaacaatgaaactttatttttacatcaacttcaccaatgccaagctctaactgcatatttcatcaacaggctagtgaattgatcaaagacatctgttccaacctatgtgctgcatcaaaagaagttggcaatgctgactacacgattgttctgaggggtgattcaacattacgtggtcattttcctcaggcaagtttggtaaccctatcatgaaatagcagactatcatgtcaatgttatgatttcagcttggcatctgtttctgtcataacttgatattatgatccacacacaggaagcagatgctgctgtctcaatacttggggaaatggatgcatggattatttgccccttcttccttcaagggggacgttatactattgatgatgtgcattatgttgcggattctgataggtatgtctttgtgagcaacgtgtgtgtgtgtgtgtgtgtgtaattttttcaaactttcagaatcagggaaaagttcccttcagaggatgaagattgatggtcttcattttgaatattgcaggctcgttcctgcaggagagacagagtttgccaaagatgcatcctttggatataaatcctcaaatctccgtgaggtcttaattcttccaacaagggaatcatcttatgttatttgaccctttaagaaattaatagtaaggaacaatttgatatgatttcagtgggttgaggagaaaacagctggcgtcattccggctaacagcgttcagtcgatctcaattcagcttttaagaaaaggtggccctgatgcagtgtgtgagtttctgtgcagtttaaagaaggtaaatttttctaagcagatttcgcgacgacttctggatgttgctttccgtgaacttttggtcttcatagttgtggaatcagttagtcccagttgtgtagaaagtcttaactctatttccatttcatatgtaaatcaggggtctacatgtattgtcaacgccgctagtgaaagagacatggctgtatttgcagccgggatgatccaggtaagccgcccaattattcttctagtctttttagtttttgaggcatattcaattagaggatacatttatttttctcttatattcttggtcccttcgttcgattgaacattatatttggcaggcagaactgaaagggagatcctttttatgccgcactgctgctagctttgtgtctgctctaatagggattattccaaaagatcctgtgttgccaaaagatttcgaatctaacaaagaaagcagtggtgcactaatagttgtaggctcatatgtcccgaaaacaacaaagcaggttagattatctactaacaacactaatttctttgatatcttctcaatgaaataaaattaaagagccctgagtcattttcttctaactaacaggttgaagaacttcaatcacaacataaccagaatttaaggagcatcgaggtaagagaagtagatgtaacacgggatacttatattagtatataccacatgttatgcatgctttgtttgctaagttctagcaatgatcaacagatctctgtagaaaaagttgctctcaagtcatctgaagtgagagatgaagaaatcagaagagcagttgagatggccgatgctttccttcgggctggcagggagactctaattatgagcagtcgtgaactcatcacgggaaaaagttgttctctatctcaaatctttatatatttgtgtcgttggtataaaatcatgactgaggaatatcatcattaacgggtctatattcattttgacagcatcttcggaaagtcttgatattaacagcaaagtgagctccgctctggttgaagtagtgagccagatatcgaccagacctcgttatattcttgctaaggtatttagcttctatatttatctttccatctcataaacttcctgacacactctgtcaatccccagttgaaatggtaactgttctatgatccaaagcctttcgatttttttttatgacactgtaacgtcattgtttagggtggaattacgtcatcagacacagcaacgaaagccctgaaagcacgacgtgcacttgtgattggtcaagcccttgctggtgttccagtatggaagttaggtccagaaagtagacatccaggggtcccctacattgttttccctggtaaatcttaatttgtattcaaaacatttaactgaataaaaataggtattcttaatcaactctttttccttatatgtaacaggtaatgttggtaacagcacagcgcttgcagaagttgtgaagtcttggtcagtggtagcaggacggtcgacaaaagagctgcttctggtgagtatccttctcgttctctagcttcatatatctcttctcatattgatg

SEQ ID NO: 26565 - DNA, 3003 bp, Unknown
  misc_feature (1)..( 3003): 2750-1469P.txt file - cDNA_ID_2714698; gDNA_ID_2213622; Annot_ID_131998
ttttcttttctaaacttgattgagacatagtgcgattaaagtgtagaatgtgattaatacgatagagtagagtagagtagagagaagaaaacgcacatggacgaaggatgggtctgattgtgaagagctgggcgatagggcagagctcgagtcacgacgctacctaactcatcattagacatggcttctccctccgttttgtttttgtttttcatttttatactttgacatcataataataaatttatagttcatctgtttttagaaattccaaaagccaaaaacaaagattacataacataagtcggtaccatgaaacaaacaatatatcatatcaatatatatacagctcaatagttgtctggaactctggatacatttattcatttaattaaaggaaaatttgttagttgccacttttttatacagtatgttttttaatcaaggttttctattgttaaaacaaaagcattataaaaaaacatgccatgtataatcattactgtagatttggtattcagatgtagacagataaattcatgttactcaatagattaacgttataaatttaattaataatttgtagtcgattaagaaaattatatagacttcatatgtgtacattatacgtatacagtaacacacagattagtatcaatttttaggctttatagatgtaagaataactatatcaaattttgttgaacattattagtttttatgtctggtgtatatgtctatatatgtggctgtatgtttacttgcgtatatgtatttgtcgctgtcagattttaaaacagttcaaattatgtgatttgatttgtcaagtgccctggactttggactctacttgttttgttgtttatcgctcgttttgttggattaaaataaattaaatcgaatccatttgatgaactgtcatatggtttagtatatcaataattttacaacacaaagtcactaacactcggataacattattattatactaacacatccattagctagaagcctagaactaaagtgaaaaggggatcttaattagctatcgtcaacatatttaaatcagggaattattattaattacattatctgggagttggaatgtcaaaatcttgacaggaactaaaaagctagcttccaaaaacgttagctattaaattctagctaaggagtaacatatacattttaacagtctttttaaaaatatataactgagatatgtgtatcataaactggagtttgcaaactagttgttcgtattgtaacgttatagttaaaatcttccatattcaggtgcactaatttacatgtttatgactaagtagaagataaaaatgaaaattaagaaccataatacgaccatttataaatctggagattagacaatatgttggtaattaaagagttgttggaagttattagtactattatttggatttcatagtacatatagatcagttataacctttagttgaaataaaaacgttaccgaacatggtctgattaatttccaacaaatgaaaacctagctgataaagacgtgaaataaatatagtagatcatcagaagaagagtgttgccacgacagccgatgcaaagctaagtccaccgaagttgatggccggggctgagcttgttggcttggccgtcgaaggagctgcatttccggttgatccgcttcctgttcctgcgttttaataagaataaaattacattaataatccaaaattttaaaaacttagttttataccacgaaaaatataattctcgtataaaaccctcgcaattcgatttaaatttcaaatatttaaacttctatgtattcataccggtactggtggaagatgccggaggagttttcggggttgccggcggtgttgaagacgaattagtaccttcgttaacacaaaatattgtcgcattaattaggctagatatataagaaataaaaacggcgtgacattaggctaaattaagaaactaattaaaacgacgtcgtagtatggtttattcaccggcgctggttttgcatagtgacacgtcagctttggcgccacaagccttggggagatcgagagcgttttctttagtgaggttaagcgatttgagcatatcaacgttgttaaagacagcgcagagacacgtggcgtctttggctacgatctcattcaacggcatgcaacacgtcgccggcggcggagtcgccaagtgaagatacggctgacacggcatcagtttctgaatacacggcagtgagtgtgcgtctcctcctgcaccgccgctcggtggtgaagtcatctgagcattagacgacgtaacgtagcaaaatacaagaacgacggcgacggcgaatctaacagcctccatttcaaaacgttaaatatctctttgtattatgttctttctatctttagttggttgtgaagatgtgaaagttgtaaaacatgcgtgtggtttatatatgtacacaaggtggttataatttttggtttttgaatttaatccagctcaccagcctgatttttcgagataatcagtttctgatcctatcattatgcattggaaacgaagactaagctctggattaattagaaaatcgttacatttattattacaggagttgccaattttaagagtttagatgtttgttcatatagaaagtgtaatgatatggtaccttaaatggaatgatatcatatatgttttctcacctaacacaatacaacttcttatcatttttttttaataaatatgtataatgtacgattactatttctttttgatcaaaaaagttttgcttttggcagataagttaaaggctaaaaggctgttggatatggacttccacgtaagagcctacacgatgtaacgttacattaatctcaatttgttaaattatagtatcatatatatatatatagagagagacagagagatgcatatgaaattggtttgttgactgtaaattacatcggagaattgtagtgatcggagaaaatg

SEQ ID NO: 26566 - DNA, 3000 bp, Unknown; identical to SEQ ID NO: 10065
  misc_feature (1)..( 3000): 2750-1469P.txt file - cDNA_ID_2714705; gDNA_ID_2213622; Annot_ID_195754

SEQ ID NO: 26567 - DNA, 3000 bp, Unknown; identical to SEQ ID NO: 10065
  misc_feature (1)..( 3000): 2750-1469P.txt file - cDNA_ID_2714705; gDNA_ID_2213622; Annot_ID_131995

SEQ ID NO: 26568 - DNA, 3003 bp, Unknown
  misc_feature (1)..( 3003): 2750-1469P.txt file - cDNA_ID_2714711; gDNA_ID_2213622; Annot_ID_131993
gaagggttctatgggtctgattggcctatacaagcaaaggtgaagcgtaaggagatgtcttccgctgatgcacattatatctttgtgcgtgagctgcgttttggtaaagcctatgagacatctactcaaagaacttgcatggaagggtgtaatcagatagctggatttgtgcattaccggtttattttagaggaagagatacctgtcctttatgtgtatgaaatacagctggaatcccgggttcaaggaaagggactaggagaatttttaatgcagttgattgagctcattgcttctaaggttgattccaaaattagtctcttatattcctatttttcgatattgatggcattagcttctgttttcagattcatagcctgatgataatattgttatgttcgttttcatcttctcagaatcggatgagtgcgatcgtgctaactgttctaacatctaatgcattggcaatgactttctacatgagcaagttagggtaagaggtacaccttttggaagatgatcttatttcatgtaacaactcagatgatattttttgcaagtgttcatgggttcctaatatttctgtttcttgctgtagtcagtcatttctatttctcgactctttactgatattggctcgtccaaacatctgaattcccattcgtttttatacagatacagaatatcaagcatttctccctcaaaagctaatcttccggtacagaatcagtagtcttatttttcattattttgtataaggcattcactaaaagaacttctacaattttttgtgtttgcagactctctcggtgaagtatgagatactttgcaaaacttttgattccgaagctaaatctgtgttggaggtttgccctttcgctgcaccactcacatttatgacaaaactgctgatctaatataatatgtgagtgcttcttttgctttttatcttggtattgtattattaagactgctatgattgctttattttgcaagaagaatgatgaagaacctaccaaagattgagtatcaagcatggaatagcacatatagattcactgtaagtttccactttggtctactggagatatcagcaatcgtttattgtttagttttctgaaaaatctgttgcttgaatctgacagaccacagaggggtgtgataagatgcatttagaaaacagacgaatccgatgaagacttggttcctccaatgacttggttcacaccagaggcagatacagaactccaacaatgcctagcaactgccaaattgaccattttgaaacctgagtcctcgcaacaaaccagtcgtttgcaaccagcggagactaaatttggtaagctgtgagtacttctaggctttcttaaccttacggggagattgtgcagttatatactaggactaggacttagtagagtgagaacaattgttgaatttggttttgatataatgaatcagagagatatcttttcttttacaaaattgccaaaagtattgaatcatgagtgcttgaaccttaatttattgtagatagacaaatgtgagatagaatatgaattgcgtaacatagaaggacttaaggacctcattatcatataattaaattgaggaaaagatcttgttcttttttcatagtttggggtcagaaagcgatcattttaatttaaaacatataatgtatatatcaaaaatgaaacaaaaagataataataaagagaggaatggggtgatctgtccgtatcaaaattgtggctctaatagtttgtgtgattaagaaatatagttgtcacatccgacaccatgtgatgcgacttgatttgcccattatcccaaccattttataatcttttgtcatgaacttttctttcatacagttttataagactaaagagatattttgaaatcgaattactacataatacatatcaattactcaagtatcaaatcatctaattaatcaagtgatttttttaactcaagaataatgtatttttccctttacaaaaatcgaaggttacaacttacaaaactgaacaatgagactagttttggcctttttgggggcaaaccggcaaagagtaatatcacgaaagcaagtggaagtcagagacggatcggaaacacacaaaaaaaggatatcttccaaataatcacaaaaaaatatcttcttcataatttgctaacgtttcacattttttatccacagaatctttttctgtacggattagagaaacagatcagattctttgaagaagacacagcgcgtggtgtacactagcgagagtgagtgttagctttgttctgagccacaagatatctctctctcagtgtcaaccttctcgaaatttccatgaacattaaataatgataaaaatctgaatctgacgtggcacatctctgctatttaatataaaaaattggtcacttgctatttctagtaccttctttctttcttcactctctcctgtctcctcttctcactgtttcctatttcgtaattttctcgagaaatcgtcttttcttgtttacgctaatttgatttctcgagaaaaaaaaaaggaagcagaagaagattcttattttatctttacactgttcagaaatcttcggtggacggataacttgcagagttctgattgaggtttctttttcttttccctgttttctcttggatcttgtttcttcatgtgcggactatacaaaaaactgattcggtgaaattaatcagctttatgctctgttttgttcgctttcaggctggttttgtgagaattatagttgcagcaagaaagcgtttcagatattttttaatggccgctgaggtaataattgactagagattgatgaattaagagtagttattgacgcttatagaagaagtagattctatatgaagaaagtttctttttttggaagaacttgaagtaaaagccatttaatttcatttcttgtttccacttcaggatcgaagtgaggaactaagcagcaatgtagaaaatg

SEQ ID NO: 26569 - DNA, 3003 bp, Unknown
  misc_feature (1)..( 3003): 2750-1469P.txt file - cDNA_ID_2714723; gDNA_ID_2213622; Annot_ID_131990
atgttgaacaatcaagaaatactctatacttcgccaaccgagccaaggaagttacaaacaatgcccacgtgaacatggtaatgatctttgttccatgcttttggttcatcttagtgcccttttggatgaaaacaaactaaaatatttacttcctgtctattatctacaggttgtctctgataagcaactagtgaaacatcttcagaaagaagtggctagattggaggccgagcgtcgcacccctggtccatcgacagaaaaggatttcaagatccagcaggtttctgtccatttcagatcaccaaaatatataattgaaccaaagctttggtacttagtttatggctattttgtgacattctcagatggaaatggaaatcggagagcttagaagacaaagagatgatgcacaaattcaacttgaggagttacgccaaaagcttcaaggggatcagcaacaaaataaggtctcttaatctacctctctgtctatctactgtactaaatatattcacaagcgttggctgaagtttaaactaaaccttttgttgaatctcagggcttaaatccttttgaatctccagacccaccggtcagaaaatgtctttcctattctgttgccgtaacgcctagctcggagaacaaaacgctaaaccggaatgagagagcaagaaagactacgatgcgccaatctatgatacggcaatcatcaactgctccatttacattgatgcatgaaatccgcaaactcgaacaccttcaagaacagttaggggaggaagcaacgaaagcccttgaagtgttacaaaaggaagtagcttgccatagactagggaatcaagatgcagctcagacgatagctaagcttcaagcagagataagggaaatgcgtactgttaaaccatctgcaatgcttaaagaggttggagatgtcatagctcctaacaagagcgtaagtgccaatctcaaggaagagataacaaggctccattcacaaggaagcaccattgcgaatctagaggagcaacttgagagcgttcagaagtcaatagataagttggtgatgtctcttccgagcaatatcagtgctggagatgagactccaaagacaaagaatcatcatcatcaatcaaagaagaagaagcttcttcctctgacaccaagcagcgcatccaaccgccagaacttcttgaaatctccatgctctccgctttcagcttctaggcaagtcttggattgtgatgctgagaacaaagctcctcaagaaaacaacagttctgcagctagaggggcgacgacaccacaggggtctgagaaagagactccacagaaaggagaagaaagcggagatgtctcgtcaagagaaggtactccaggctacagaagatcaagctcagtgaacatgaagaaaatgcagcaaatgtttcaaaacgcagcagaggagaatgtaagaagcataagagcatacgtaaccgaactcaaagaacgagtagctaaactacagtaccagaaacaacttctcgtttgtcaggttagataaagatcacaacccataaataaaccttttttcctccttttatattttctcatcagttttgaacttacgcaggtgcttgagttggaagcaaatgatggagctggatatagtgtagagaacgaggagaacacgataatggaagatgaagagcagaatcaagtggcgtggcatataactttcatagaggaaagacaacagatcatagagctgtggcatgtctgccatgtctccataatccacaggacacaattctacctactgttcaaaggtgaccaagccgatcaaatctacatggaagtcgagctaagacggttaacttggttagaacaacatctagcagaagtaggaaacgcaactccagctcgaaactgcgatgaatctgtggtttctctatcatcaaggtaatgaatgaatgaataactctcacttggaaaaatgttgttgtaaaagtttcttcaactaatatggtcttgtttcgttttcagtataaaagcattgagaagagagcgagagtttttggcgaaaagggttaactcgagattgacgcctgaggagagagaggagctgtatatgaaatgggatgtgccattggaagggaaacagaggaaacttcagttcgtgaacaagctatggactgatccttatgattcaaggcacgtgcaagagagtgcagagatagttgcgaagctagttggattctgtgaaagtggcaacatctctaaagagatgtttgagctcaatttcgcagtgccttcagataaaagacagtggaacattggttgggacaacatctctaatcttcttcacctatgaagacttattgtgtgtttatgatttgtaaaagtacacgacacttctttgtctcctctgaatttgattaaataagctttaccagactcgtctgattatgtttaatatagtggtctagatttcttaaaccttgtgaggacaagcttgctaaaccctcaagtccaactgctaaccaaaagttgtccaaaacactgcgttttattggaaacaacgatgtgccaacgtggcatatttggaagactctcctcgtctttttcgctggacaaccatataattatctcagctactaaccaacaaataaaaaatcaaaatattatttaaatgttaatgttgttctctcgaatcattccttaagaaagattttcactttccaatttgcttcactgtcttgtcgattctgcttctccaaaaaatttcttctttagttctgagtttttctctgttctgaaaaaccccaaattttgttttttttggccattcaaaatttcagaagaaggcgatacaaaatcgtctttgaattctctttgtttatgatctgttcaagtaaaggaacggtcgtaattgctactagaagctcatttcccagattactaaaccggattcaaaatcgaaatgatgttccgattagtgtcatagctactcgacgatcatcaatg

SEQ ID NO: 26570 - DNA, 3003 bp, Unknown
  misc_feature (1)..( 3003): 2750-1469P.txt file - cDNA_ID_2714727; gDNA_ID_2213622; Annot_ID_131989
taaagattattaaaagttttggtcaatgacgataacaattctcgaccaatttggtcaaagtatacgttctggagtctgacgaaactaatcttaaatgttaatcacatcaagaacagaaattggtactaatcttagaagaaaagtggtactaatcttagaagaagtaaaagcttgaatctaaatgataaacgactaaccttggttagtgttatcgtcgcaggaggagttgtgaggtctgtccgcacatagacaccggaaactctccgaatctaacgccgaaccacaaatcccaccggaatcaatgcatctccggcaagctttgtcttccatgatgtacctcaaatcgaatccttttctcaaagcttccacaaaagttagttcggaccgttgaagctcgtccttagcagacctcagcatcggaatttctgcatatttcatacaaccttcgtcagaatccgacgatcgcaagacatgatatgtcaccggatcctcgtagctttcttcgcaagaaatctgcaacggagctacgccggaacagttgacgaatacatcgatcgtctcggtgttggagtctaatgtgaactgattcttcccgttgaagttccaaatgtttaggcaacctccgtctagtagactatcatcggcaacggaaattttatgatcctccagattcgcagaaacaacgcgaagagtgatgttcccgatcgctagggttaggttttgatcaccctcgcaggagagtttgaatgacgaatgaccgcagaatttgggtttattgaatccaccccagaacggatacgtggtactctcgaataccctgtgtccagatccacatgtcagattacgtgagcgacactcctcgtactgttgatcggctgagaagcacgacgggaggtcagcgacggagaagacgacgaagctgatgaagaaaaaaaagatggacattgggttttgacaactaaagccttctttttttttttttggtgagaggttttggggattttatggaagattggtcaaaatgatcggtgacgacttttattaattacagtccggcgaatttaaaacagattatgatcgctgattagtgattacattataactacatcctaaataaattatttatgtatatgaacggtcagagattcatacagatctttaatggttatttgacttgttggaaactatagtgtgtttttttttggacagactgaaagcgacttgatagttgatacctataaatatcgacttcatagttacatacaaatgcaattgttcgactaaggttaattaatgacttatttgtaagttataaacattttaattctttgacccaaaagaacatttttaagtatgtcaacaatttttcttgaaaattccactgcgattttatgcttccaatatataacaggactgcaaacttataaaattgatgaatataagaaaacattatatatataaaggaatgaagagaactgatgattatacacaaaaagaaaaaaaaacgttaatcgaattacaaaagagtattatgtgaaaatttatgttagtatttcattaaacctcactaaggacttcaatcataattttgtaaaagaaattgcagactggtgaaatagtccaatagcatataattgcatcaaaatctgagtgaacatggttttgatatactttattatgaagtcaactgaatgatagacttgtgatccaatcaaaaacacaccattgaataaatagcaaagagatggagaattgattgttttttttttttgaagtttgaatttttgaccaaggaaaatgagaatacatgtgttatcttttgagtttatttatccatttatgttgttttcttaatatttgtatacacatattcaactaaagttgctataaaaaacgaaatatacaggcttgcagatatttcaaaatctcatgccgaagaccttgactccacacctcaaagactcgtataataatattccaatcccacttgctgcaatagaggggaggttctgcctagtgaagtataatgagggtgtaaacgtagtttactatttttatacgccaaattggttagtagttactatttcccgcttgatctgcaaataaattaaaattgtagaggatgaaaaagaaaataacaataaatgaccgttttgtgttaagggccaataataattacaagaagacaaaatacatcaaaattggcagctaagaaaaaaaacaaaataccgaagtaataattaaagatgaaatgataattgacagaaaaaaaaaaaatctatagagaaaatttgcagaaacagtaaatgagaaaattatccatggaaaaaattgaggtaaaggtgatttctagaagaaattaaaacgtggggagagcttttgaaataagctaaaaataaaagcccctcaaaagaaacgtggaaagaactagccgttagaggttcgtcagattcaaaatctcactctgcacgggtttccgtaaagacaaaagaacccccaaaacccgttcttcttcttcatcatttctaccacaaagatacacgaaacccagaaaccgctctcactatcttctcctctcaatattcttttattcttttaatttatctctatcgtcgatctgagacgattctacattcttagctgcctgagatctctctctttgatctgagagtaaaactccgattcatttgttcgtttttttctctgtaagtgtttttgatctctcttaactattgtttttgttagaactatttagtgaaatgacgtttttaggaagttttgaatataacatttctggatttgatgaaattaatctgaagaagctaaattttccttttatgagcaaaaactaaagattacctttttatggattaagtctgcacaatgttgccttatatgaacttttttccatagatctgatagatttgggggagaatttaagcttagaattaagttgatctattagatctgatgaaaaaattgggaatattttgtagggaaatg

SEQ ID NO: 26571 - DNA, 3000 bp, Unknown; identical to SEQ ID NO: 10068
  misc_feature (1)..( 3000): 2750-1469P.txt file - cDNA_ID_2714731; gDNA_ID_2213622; Annot_ID_195746

SEQ ID NO: 26572 - DNA, 3000 bp, Unknown; identical to SEQ ID NO: 10059
  misc_feature (1)..( 3000): 2750-1469P.txt file - cDNA_ID_2714731; gDNA_ID_2213622; Annot_ID_131988

SEQ ID NO: 26573 - DNA, 3000 bp, Unknown; identical to SEQ ID NO: 10057
  misc_feature (1)..( 3000): 2750-1469P.txt file - cDNA_ID_2714743; gDNA_ID_2213622; Annot_ID_131985

SEQ ID NO: 26574 - DNA, 3000 bp, Unknown; identical to SEQ ID NO: 10056
  misc_feature (1)..( 3000): 2750-1469P.txt file - cDNA_ID_2714751; gDNA_ID_2213622; Annot_ID_131983

SEQ ID NO: 26575 - DNA, 3003 bp, Unknown
  misc_feature (1)..( 3003): 2750-1469P.txt file - cDNA_ID_2714755; gDNA_ID_2213622; Annot_ID_131982
aggcgcatatcttcctcctttaaacccgttaatccaaccccgaacctcctcgttaatcctctccagtccatactctatatgctcagctaaaagaccaccgtgaacaaaaaccgaatcaccaacaacagcaactgtttgattcttagtcaagaatctctttgcaatcggaccatcaggtctcaatgcagcaatcctagctctaattccttcaaaacagtcggctctcatacgagggaagctcatcggaatcccttcgtaaggatccttaggtttatcaagaccactgcataaagtcttcatcttgttccctaaacaataccaatcagcccaaatctgaaattcctctaaacctttcttagtcacatatctaaagtcaccttctatattcatgatctcatggttcccattcatagtcagaatcttacctccagctctctcagcctctcgtttcaatttctctaagaaataaagtatcttcaactcctctccacctcgatctagtacgtcgcccacctgaacaaccatcgttgatccaccagtccatctgtccgacgaatcaatcagaccagcgatcttgaatgcttctctagacttctcgagatcgccatggagatcaccgattgcaacgagtcgctccggcttctcgaacctcgtttgcagaatctcattttgtgagctaggatcttggggcaggaagatgccggagacggagtaatcaacgaaagtgtcgacgaaggaagagatgagcttgggaatgcttttgcagattccgctagggttttctctgcttgacattttccgtgataaatggcggccaagaacaatgcgcctttataagtttccttattaagcagtttattaaattaattcattgactagccaataaacgaagccaattagtgagtgactctttttgtctgtgtatcttctagatattgttcaagttgggctttggatctcctacaaggccacgcccattgttttgttgctcatgaattaagtaggcccattaacccagatagttggaaatgagttgaaccagagtattggactctgagcagcagagcagcccagagttgagaccagacgagatcttccaagcttagttgtataaaccaacgatgagtgaccggtattgaagtccctttactacaatttgcgagctgtcttatgtctattttatatacaagagttacagtacacaaatagttttttactaaaagacaagaaataagaaaacaagattcattctccttatgacaacaaaaaaaagaaagaaaacaagattcattcatacaaaaaggaggaagttgtgtcagaattgcaaccaatttaaatacatttagaaccgtcaacgcctctattgtttgttgtgactcttccaagtatgaaggttattgtattaatttatcctcaagttttttataacattgatatgataatggttttaaacgctttatgcgttattgtaaaatttatttaccccacaatagaaaaagaaaaatgcaattgtttagttttcataagtcacaatcgtagaaatattttaatataaattgaggtgtttgttgtatgtttatttgttctctttggataagtcacgacttgccaagaagaaggagcgtgagagatcgtgttaatgtggggtctttcttcttcaattaattacgatctaaattgctgagtttttttttttaataatgatttgactttcttttcctactattatactaaaatgatattttatcccaaatgtagtaaatttaatagcgatatctaatataagtttcagctaaatttaattcaatactcttttttttttttttttgaaaaacagtaacactgttatttgaaaaaattcaaaagcatttaaatatagtggaaacaaaactttatcctttgaacttttttataaagaaaaagtttagattcttctactgtttaaaaagaaaagaaccattaagtacgttaatgcggttaccgaacatgacattaagctttcgtttccttaattatccgagtggtccaattctttaattacgaaattatgaaagcgaattaataattagttaacgaaagtgacattgagaacgcgtttgcgtttcagttatggcgtgcaaacaaagctaaacaaaaaattcagagagattaaaaaaaaacaaaaggaatccaaaggaaataaatgattttgtttgcttttgcttgcaaataaaaatcattaaaaaaaaacgaggcgtaacaggaaggagaagaagcaggggtccatcatcaaatacaacattgtagcaattgcgttttcgactttatagagatattttcatagagatggtctcgaagctaacaagttgacaaatttcttcgttataagagagatagatgagttgcaggagagtgctgaagtcgatacaagccttggcggctcatagtttactcttctgtttcacgcttttattggtgcttaaactcgatcacaccgtctcttcctcatggtggttagtctcttttctctctttcaattctcttttctctgaaattgactgcatgattcaaattctttgcttctgatttgttcaatttcgattttcgtttttggtgtggaggagaatcatttccctgatttcataatttggggattttgaatttgaggaccttgtctttttgccccccgttgaatttcgaagctaaagattgtctctttttgtttaggcaaagtatcagtttttgtttttgagagaattgaaaaagcagatcctttaacaatttcccgattcattgtttctatttgccgttaatagcaacaaaagcaatcacgtcaatagtttttactgtataaagtttttgcaaattttggtaagtcatgtatgcattttgtatcctagtgtgttaaaaagttacatcctttagaggtatgcatttaccaatgactttcacgaaaccaaaaggattcagctttttacttgggtctgataaaaaatatttctgtatttggggttatgcaggatg

SEQ ID NO: 26576 - DNA, 3000 bp, Unknown
  misc_feature (1)..( 3000): 2750-1469P.txt file - cDNA_ID_2714759; gDNA_ID_2213622; Annot_ID_131981
attgcatcatcagttatgctgtcgtcgtctcctggcatcaatgctcgacacattctgaagataaagcttgcagtcattaggatctttagatttatatgatttacatttggtgtgtgttcacgagacacatagatcaatacctcaaattgtctaccagtattgttaattcaaaagccaacaatggtaagaaagcaatcttcaaactgacagctggtggccaacgagctgcatttaagatagaacagtccacaatcagatgaaatgggagaaagtgcaaaaagaaaaaccttcatacagaatcaagaaaattgtaacacaagaactacttttagatgtcctccaacttaaccatccgtattatccgaaatacaaacagtagcaagaagaaactttgagaatcatagccaatgtttatatttagtattgaagaaatcagtgtgttcgcatgccaaatagtaaaaaactatcacccaaaaaacctatgaagtgcaaaatctgtaggttacaggatatttaccataagaactctcgaggtatatacagaggagtaattcaaatgctacaagtaacggtgtcgcgacaacagcatggcaaggagcccactgtaaaccaaacgggatcataaacacatcagtacaaatcataggaacgacattgagtgatattttgctaaaagaggtaagaaagtgaaaagggacatacatgacggttacgtggagcaacaggagcaggaagagagaatctgccccttgcaacaactgcatgaaaagcccacagcgggaaaaacaccatcctgcataaccccaaatacagaaatattttttatcagacccaagtaaaaagctgaatccttttggtttcgtgaaagtcattggtaaatgcatacctctaaaggatgtaactttttaacacactaggatacaaaatgcatacatgacttaccaaaatttgcaaaaactttatacagtaaaaactattgacgtgattgcttttgttgctattaacggcaaatagaaacaatgaatcgggaaattgttaaaggatctgctttttcaattctctcaaaaacaaaaactgatactttgcctaaacaaaaagagacaatctttagcttcgaaattcaacggggggcaaaaagacaaggtcctcaaattcaaaatccccaaattatgaaatcagggaaatgattctcctccacaccaaaaacgaaaatcgaaattgaacaaatcagaagcaaagaatttgaatcatgcagtcaatttcagagaaaagagaattgaaagagagaaaagagactaaccaccatgaggaagagacggtgtgatcgagtttaagcaccaataaaagcgtgaaacagaagagtaaactatgagccgccaaggcttgtatcgacttcagcactctcctgcaactcatctatctctcttataacgaagaaatttgtcaacttgttagcttcgagaccatctctatgaaaatatctctataaagtcgaaaacgcaattgctacaatgttgtatttgatgatggacccctgcttcttctccttcctgttacgcctcgtttttttttaatgatttttatttgcaagcaaaagcaaacaaaatcatttatttcctttggattccttttgtttttttttaatctctctgaattttttgtttagctttgtttgcacgccataactgaaacgcaaacgcgttctcaatgtcactttcgttaactaattattaattcgctttcataatttcgtaattaaagaattggaccactcggataattaaggaaacgaaagcttaatgtcatgttcggtaaccgcattaacgtacttaatggttcttttctttttaaacagtagaagaatctaaactttttctttataaaaaagttcaaaggataaagttttgtttccactatatttaaatgcttttgaattttttcaaataacagtgttactgtttttcaaaaaaaaaaaaaaaagagtattgaattaaatttagctgaaacttatattagatatcgctattaaatttactacatttgggataaaatatcattttagtataatagtaggaaaagaaagtcaaatcattattaaaaaaaaaaactcagcaatttagatcgtaattaattgaagaagaaagaccccacattaacacgatctctcacgctccttcttcttggcaagtcgtgacttatccaaagagaacaaataaacatacaacaaacacctcaatttatattaaaatatttctacgattgtgacttatgaaaactaaacaattgcatttttctttttctattgtggggtaaataaattttacaataacgcataaagcgtttaaaaccattatcatatcaatgttataaaaaacttgaggataaattaatacaataaccttcatacttggaagagtcacaacaaacaatagaggcgttgacggttctaaatgtatttaaattggttgcaattctgacacaacttcctcctttttgtatgaatgaatcttgttttctttcttttttttgttgtcataaggagaatgaatcttgttttcttatttcttgtcttttagtaaaaaactatttgtgtactgtaactcttgtatataaaatagacataagacagctcgcaaattgtagtaaagggacttcaataccggtcactcatcgttggtttatacaactaagcttggaagatctcgtctggtctcaactctgggctgctctgctgctcagagtccaatactctggttcaactcatttccaactatctgggttaatgggcctacttaattcatgagcaacaaaacaatgggcgtggccttgtaggagatccaaagcccaacttgaacaatatctagaagatacacagacaaaaagagtcactcactaattggcttcgtttattggctagtcaatgaattaatttaataaactgcttaataaggaaacttataaaggcgcattgttcttggccgccatttatcacggaaaatg

SEQ ID NO: 26577 - DNA, 3000 bp, Unknown; identical to SEQ ID NO: 10054
  misc_feature (1)..( 3000): 2750-1469P.txt file - cDNA_ID_2714763; gDNA_ID_2213622; Annot_ID_131980

SEQ ID NO: 26578 - DNA, 3000 bp, Unknown; identical to SEQ ID NO: 10095
  misc_feature (1)..( 3000): 2750-1469P.txt file - cDNA_ID_2714779; gDNA_ID_2213625; Annot_ID_195835

SEQ ID NO: 26579 - DNA, 3000 bp, Unknown; identical to SEQ ID NO: 10095
  misc_feature (1)..( 3000): 2750-1469P.txt file - cDNA_ID_2714779; gDNA_ID_2213625; Annot_ID_132032

SEQ ID NO: 26580 - DNA, 3000 bp, Unknown; identical to SEQ ID NO: 10096
  misc_feature (1)..( 3000): 2750-1469P.txt file - cDNA_ID_2714783; gDNA_ID_2213625; Annot_ID_132031

SEQ ID NO: 26581 - DNA, 3000 bp, Unknown; identical to SEQ ID NO: 10097
  misc_feature (1)..( 3000): 2750-1469P.txt file - cDNA_ID_2714791; gDNA_ID_2213625; Annot_ID_195831

SEQ ID NO: 26582 - DNA, 3000 bp, Unknown; identical to SEQ ID NO: 10097
  misc_feature (1)..( 3000): 2750-1469P.txt file - cDNA_ID_2714791; gDNA_ID_2213625; Annot_ID_132028

SEQ ID NO: 26583 - DNA, 3000 bp, Unknown
  misc_feature (1)..( 3000): 2750-1469P.txt file - cDNA_ID_2714801; gDNA_ID_2213625; Annot_ID_195828
aagcacatgtcatgaagaatctgcagaagagatactagttagactatctgtaaaaggatgcttaatttgataagtacgttgtgacaaaacttacacgacaagctttttatttttgttctcgatcaggagatgcactagttgagatgacttttgatctgcttcgcatttcaaatactgcagaggcacgaagaagaaataaacttactatcccgaaacacatatacgtatataaatattgaccttacaataataatacctcacaatacagaccagaaggcgttttcgactttgactcatctcccaatctaacttccgtaacgttcctaagctcccgatctaactctcacaggattcctaaggccagccttggccaggtctgcaacagcttgtgtttgtgtagctgaaaagaggccagtcctacgttgctttggcaagcgagatataatgtaattgacctgcttctggaaccccatatccaaaagtctatcggcctcatctaagataagaatctcgagatttcgaaaatccagaaactccattcgtttcatcatatctgaaagccttccaggggtgccgatcaagagattggctccttcttcttcgagagtattcatgtcagcttccacctctcgacctccaacaagcaggacagagttcacatttggcaaagtcgagacgaacggctcttgccaccttatgtatctgcgctgatagctctctcgttggcgatataatcacccccattacctgagattgaaattgttaacatatagcataagctactactcttgatattcggctaattctccttacctggtgtggcttcggagggtaggagttggatcgacggataatctctatgaagggaaggaggaaagctagggtttttccagaaccagtggctgcgtcgacgacaacatccttgtggctgcagaggaaagggatcgtctcggcctgaaccggagtgcagacctcgaaaccggaccggtcaagcgcctcgatgatatcttctgagagcggaggtttgagttcagagaaacgcggcggcgcctcctcgatgatagtgttcggtggcgatgaatccatgacggccgccgcttgcttgttgctcactccagctttattttttagacctacagcaaaattttgttcgaattaggtagtttttggtccagtttctactaaagcccactaagagaagagatacatctctcggcccattgttaaagtaaagctctagtcattgcttaaaagaatacctctaaacattgacatttgacagtaacaaactcggagagcattcagagatctacaaacagatattctgtcacggttacctctgaaatcattggtgaaatgtatcttgtctaaaagaagttggcatctttaatccgctcgagagcattcagagatcttacttgcgccgatcgatgacgacaaggcctcgattgtcgttcatcaacttccccgttcggacgtgatggtgtgtttcactctgtttatcaagaagaggaaccactgtgtaatatcacagtacggagatggtaggcgttctagggaatatcaggtatacacaatgacggtgggatcaggtgaagaatctaattcttggagagtgatcacatgtaagcatgatcattcaccagttactgaaggactatgtaaaggaggtttcttgtattatggagctgatgagtccaatagtgacaaatctgtggtagtgagcttcaacgtgagttctgaagagtttagcgtcattgaattgcctgaggaagtcaagattgatcatcgttggagattggtgaactacaatggggaagttgccttagtagatgactctgagtttgactttggtattgtgaaagaaccgaatggcaatggagtatttgaattgtgggtaaggaacgaaactgatggaacttggtggagaaactgcattgagattcctcattgggaacaacatgttggaaatatggagtttttcttcaaaggtaccattggaactggagaacttgtgttcgctcaagactctgtgattgagagatcattctatgtggtttattatgatacagtcacacaaaatctcagaagatttacgattgaaggtgtagctagagatcagcttcatgatgttcgaaccttcttggatcatgttgatagtacttggcttatgtgaagaacaagagttaggttgttatatatatgcgagaatcagattttgagtttttacaaaatctattaaaatttggagatcttaacttcttttttctcgacaatatctgtaagaaaataaaataaaaatagacatttgttggtatcacaaaaataatatagacctccttggtatttgcgtatcctctcatctatatcgccagtggctccgtggccttcaaatcaattctcaaattttgtatatatatatactaagattaagatttgactattgttataaccattggtgtttctccagaatttgtacagcaacatgcccactaactcattggtaagctggcacttcgttttcgctctaaatttgatttgctgagttctaaagccttttggatcatgatgttattgttatggttgttttacttcttttgcgggttcgatctctcatcgaagtttgggtctattctctttgctcttcctcttctaactaaaaaaacataacgttaccatcgactagggtttttggtgatttttcgtttttctcatgattaagattggttttgaggtttttcccttttcaattaggatttctagtaatgatatattgtaaggctttaagttggattgttccttgtctgtatataaagtccctttatgatcaataagaaatcaaacaattaaccctaactctctctaagagcgacttgcgttaaaaggaagcttgctaaaatctttctcacgttaacaaactgcacgaaaccgaaatcacaggctcatatcaagtctcttatcgaagtttgtgtctatctaaaaacatagggccaagctatg

SEQ ID NO: 26584 - DNA, 3000 bp, Unknown; identical to SEQ ID NO: 26583
  misc_feature (1)..( 3000): 2750-1469P.txt file - cDNA_ID_2714801; gDNA_ID_2213625; Annot_ID_132025

SEQ ID NO: 26585 - DNA, 3003 bp, Unknown
  misc_feature (1)..( 3003): 2750-1469P.txt file - cDNA_ID_2714805; gDNA_ID_2213625; Annot_ID_195827
ttcgtcgactggatcaccagaaaaagtgtagtaactagaagaagaaagacaagtttttctgttgttttgatcatctctagaaaaagtctccaaaagaaaagttattgagtttgaatattcttcaacaaaattcgctgtaaagtgttgactaatatgaagaaatttcatattaggggttggtaagcctgtacgaatgagtcgtttgtgggaaaagtaggttgattcgatcatcgatgtccatttttttgataagactttgaatctagccagtgattttattggaagatggtgaaagatcccttcagctatatcatctggtataaatattgtcttgggattattatgtttatcattctccattcttttcctacgatgatgattcttggagtagatttgtgtatctctatatataaagaaaataatgatctaatgttggatttttaactttagatttaacattaactgtggcgaaaaatatataacactattaatttatattagaataataaagagcaaataaataaacatgtatttgtttatgctataaataataaatgttgattaatatatgtttatattattcctaaaaataatgaaaataaattaagacaatttatgattaaatatgctttcatttaattttctttagcaattaatcccttagaattaattctttgatagattttaaaatttcatctacaaattcttgaaaaaggtttggtatctacttttttaatcctaattaactagattagaacatgtccgatgtgcaatagaccgtggtatataacgatgcatgtatcatccattctttaacaattaatcaccttcaacaatgcaacactctaaagtcttaacactctaaaaaagatttaacactaataatttagtttacaattatgaattagaaataataaatatgtataataggctataaatatatataatataatcttacaataatttaaaatatagaaatgaaaatcttacaataaatcttacaatttgaatactgtaaaatgattgtaacattgatctaataacatattgataatgtgaaattgccgagctttttttcttctgcagaccgagggatagagaggagatggagaggcttcaggagagaagggtgacatcaatacgcagcgttttgaaagaacctaggaattaaatttacatttaaccaaatcaatgtaataaaaccattggtccggtctgaccaatttaccgctccctaactaaaccgactacgtaccgttttgaaatccttccctaatcagaatcttgagattacagagagagcagcaaacgtcgtcgttttaggtcttatctaattaacctaatcatatatatgaaagttggtcaactctctcccacaatttgacacatcagcacatgagagcttggcacctagacttcataaaataaataatacataattagtaattaattcaacataataactaaaataggaggatataattaatcagaacttgaaccatcactctttctacattttttaattcaatatattctctttaattttgagatccaaacatgttacacatactaaattttaacccgcggtataccgagggaacaatttattttttaaatttagtatatataaaagtttataaattgtatctatctataaaataattttattttatagtttacaaatgttattaagtaacgtcctgccaaacccgtcctctaaaaaaaaaaccatttattttattaatgttgatcttatttatgatatgtttatgaatcattgtctaaatattttgtaattttgtagtaattaaatgctatcagattatatctctgcgctttgatgattataatcgaattgttatagttatggagagaagcaatatcaaaaatgataattttgtagtaattaaatgatattaaatatgttggaagtaatattttagtaaataatcgtgtagttaatgtggagagattttgggaagattgttaaatgtcaaatatttaattcgaagattttctttttaattatcaaaaacaaacattaaaatccagtggcaactattgtaaataagtccaactacaggatttatttcacaaaatggctgcaaaaatgtatatatagattccttgcctaaaaattagacgattattatgaaagaaactaaatgaatatgcaaattaaatatatctaagctttttgagatttatgctaagaaaacaagtaatttgaaagatgtttaaggagctatccttataactaatacaaattatgacaagaatttaactaaatttttcaagaacatcaagttgaatatgattatattggatatgcagagacatggttaataaagacatgttatatttttaatgtaagaattaaattttctaaaatttcaccgtctcacaaactaaatatataactaaaagaacaaggatatataaattaaaaaaacaacggagaatctagaacaacaataaaaaacaattcaagcactttcgttttcagatgaactaatatagttggactttttgaaaacaattacaaatcatatttatgtttaaaaaaacagatgcattcaactttactttatatgaacatacattatataaaacaattagtaaatagtaatacataaatccgtagtgaagattaaataaataaaaagtctaattaaaggaagcgggacgatgatacaaaccgaagtgaagattagtgaccctggatgggccttcgtgggcttctatttgggtttagtgtttaaagcccatttcctctttattgtcgtgtacttaagcttttcttcttctctgtaaacgagtatcaaaaagatcaatcaaaatcaacaatcatcttcttctgatttctcacctctttcttctacttctcatcataattctgttagttctttgataagcccatttcgtgcctatcagacgacaactaaaccctacacgcttacataaaaacgcgacctttgagaattttgtccggcgacagaaatg

SEQ ID NO: 26586 - DNA, 3003 bp, Unknown; identical to SEQ ID NO: 26585
  misc_feature (1)..( 3003): 2750-1469P.txt file - cDNA_ID_2714805; gDNA_ID_2213625; Annot_ID_132024

SEQ ID NO: 26587 - DNA, 3003 bp, Unknown
  misc_feature (1)..( 3003): 2750-1469P.txt file - cDNA_ID_2714812; gDNA_ID_2213625; Annot_ID_132022
tctccgacatcggtggtttctttagcaccgttggtcggcttcgttcttcaaatttagtttttgcctttcaaccttgttcgattctattttgcttcggttttaattggttttgatttctctttctcttcatttcgatctaaatttgtaatttttcgatcctcccttctttaaggggcttaatttgttcttcaagcttattgagttttcattttaaaagatcaaatttttagttacggattgaagtttaatttagtgtcttttgtttgattttgatgaaattagagctgttgtttgtctttcttgttgccgatgcttgttgaatcgtttgggtttatgttgtttttcctttaaatggcagaagtcgaagtcgatagtttgtgagctatttctttcttgaaggttttaaattttacagtcattgtcacagaagatttgtcaattgtctcatcggatttgtagctgcttccgatttggcgtttacagcaattccggtgaacttaagttttttgtggttatgattctccacctgcgacattctgcaactcatcattttctgtttccacgtgtcctctttaccgtgtctctagtgccatgtgggctttgacttattagcacattagctttctcttcttcagaaggtggtctttgggcttttgtccgtttatggcctgttatatggctttgtaaaatatggcttgttaaaaggctttgtaatataaataataaaacagttgtgacaaaaaaaaaaaaatatatagtttgatggtgattggtgaacttcttttttttccaagattgcagtaaacgtcgtctttagctccaaaaacaacctttgtcttgttcagctaatggcgatttttgaatggcggcacagaagacggccattcgacggcggaggaactcgtcgccgtcgtttcttcagcccattgtattcgagaaatttcaagagaacgattctcttcgctgtgattttcttagctatcttccctcctctctacttccatttcaagctccgacgaattcgtcagattgtcgcgcaaaagtgcgattggcttcaccatcctccacttgtctgtgctcacggcggcgattccaccctcgctttcccaaacactgtacgtacactctcgatctcttcttcttcacactcttgctactaacctttttaaaccttaatctcttggactcttctcaatcgtagatggacgcttacagtttcgctatacgttctcgagttgattgcattgaagtcgatgtttctcgttcctccgatggtgttttattcgctcttcacaacaggttacagactctgatccttgttgtatcatcttcttctaatgtttctgtgtttggattctcatcggtgttcttcttattcatcttctgatcacacgcacagtcagggatctgcagcgtattgctcgtaactcttctgttcaagttggagatctgagtatgaaacaggtctcatctctccctctctctctttaccagcttttgggatatgcttttttgcatccatttttcataaaccttttgatgatctttttgcagatcaaggaactcgatgtctcggagattgttaaaggaaccttgggaagtagtaggattcctactcttgaagaggctttagcggtaatgcctgtttttttaattactatcttgtcattgctttgctttgtaatttctgcttagtaacaagtggctgaagctagttttgatcttgaatcatctagttgatatcgaattcagtccggaaagtgatccttgatgccaaagttggaccgccaatgtatgaaaaggggttagcacaagacatcctttctattgtaagtactatgtttttgttagctcttgtacttgtaaagctttagtacaatgtgctcgagatttataaacatgttttgattccttaatagcgttgcttaatcatttatttcctggtatctttgtacacaaagctagaacagcttactatagatacttgaaaaaacaagagtatggataaattgttgatgtttcaatggtggtatttctggctttgctcacatgaatcgccaatcctctgttgttagattgagagagcgcagtgcaataattgcatcgtatgggccaaaagcgacactttggctagggacataattagacgagcaccagatactatggtaaacagaaatggattgtcttgtgaggatcagatagagaagtttcttgctcatttcctagtgattttggcaggtgggatacattgtgatggtagatcctttgactggggcgagaaacagcctgctgagaatgaagggagctagggttgtgggagtttatcatcccttgatcgatgaagaattagttagagttgtccgtcggtaagcaatcgatttcaatgttttcaaataaaaacacacctgctcatgtgtttacaaccttgctcgatctgatcaacaggagaaacaaagaggtgtatgcatggactgtggatgatgctgatcccatgaaaaggatgcttcacttaggtgtggatgctgttgtgacgagcgatccatctatgtttcagggtctcatggaagatcttagaactgagtgtcttgaagaaggtttttcaatacggacgtgagaatttctttttcgagcattcttaatgactgtaataccaactcagaagtttttggcaaagatctttctttatgttgttttgctgatccacaagtttttgacaactacacactacgacgccttgatacacagtaagacgagtctttctcaagaaaagcaaagtatggccggttcttgatgaagccattgcttctatcgatacagctactgataatctgatccaggagactctgaggcaacacttttcggactgcacagtgaaaacaatctcacacagatatcttcttttatacataacgatatgagcctgctcctagaacaaggtctaatacacttgtatttaagtttaaataatcagatgactgatattaagtctgtttatataatatg

SEQ ID NO: 26588 - DNA, 584 bp, Unknown; identical to SEQ ID NO: 10117
  misc_feature (1)..( 584): 2750-1469P.txt file - cDNA_ID_2714819; gDNA_ID_2213626; Annot_ID_195883

SEQ ID NO: 26589 - DNA, 584 bp, Unknown; identical to SEQ ID NO: 10117
  misc_feature (1)..( 584): 2750-1469P.txt file - cDNA_ID_2714819; gDNA_ID_2213626; Annot_ID_132067

SEQ ID NO: 26590 - DNA, 3003 bp, Unknown
  misc_feature (1)..( 3003): 2750-1469P.txt file - cDNA_ID_2714825; gDNA_ID_2213626; Annot_ID_195880
agagattgcagacagaattggcaacttcgttaaggagaagggagctcctttggagctgttgtctaaactgagacaagaagggagtgagttcttagataaccagtcatcaagagaagctcttgatgagttgagtatcatgtttgaagctcttaaaagatcaaagtgcagtgagagaatagtctttgatctaagtctagctagaggtcttgattactacaccggcgtcatctttgaagctgtttgtataggagcagaggtaaaatcccgcattttggcttcctgcaattcaattaaagaaattgtagtgtatggcctttgaattcttctttctgcaggtgggatcaattggtgctggtgggcgatatgataaccttataggaatgtttggaacaaagcaagtccctgcggttgggatgagcctgggaatcgagagagtgtttaacataatggaagaacttaacgagaaacagaaacaagtaacttgccaaacccttatgctgtttgtcgaccttgttttaaaagaatggtttttgaagtttgtgttatttgctatgaatataggtgattcgaccaacggagacacaggtgttggttagtataatggtggataataaactagcggaagcagcagaactggtaagtcagttatggggtgctaagatcaacgcagagtatctagtgagcaagaggaaagaaaagcatttcaatcgtgcaaaggaatcagggattccttggatggtgatggtaggcgaaaaagaactcagtggaagttttgtgacattgaagaagctcgagaagggaagtgaagagaaagaagatcaaacatgtactagagatcgtttcgtggaagaattgaagaaactactctgagtcgttgaaaagaaatgaaaggtacacacactcactcctggttcgatgcccagacaaaaggaatcacagtgttttgcattcttttttgctgttttccttggtttgtttgataatggtgttttgcatgactcatgattgtggagacaagaacttagagattttgatgttgatgaagttttccgtatttaactaattagaggagatatacgtaaatgttaagccaattatcagaattacgtttctttcaaaaaaatccttatccctgataacctaatctgcgatcttatcagaaaaaagaaagaaaaaataagtaggaaatgaggtggaagaatataagaccgaaaagagaaaataaaacacaacaggtaaggttgtctccaaaaataaaaaaagtgatctgcagatctgtgtgatcgcatttgcatgagatgagaggaagaaagatggtacgtgttggtttctgtacctctctgccgacatgtggtggcttcaagtaactaaggtcacttgtgtattcacatctcacgtttccattgactattgtctctactcattttcgattcaactactgaaaatatttggtaagaaacaaacaggcgatttaccatcccctactgatcatttatataaaaaaacaatgagttctttggttccttaaataagaagaattcacggtggttattcttttatatacaatagtttactaagcgatacaataattaaatctgataaagagtctcaccctcatgggatgattgactgattgtgagaccctaaatatgattttgatctaaaaataaatgatctgttttattgaattttcacaattttaataattcttcatattatatattgatgatattctagtggatgtcggaaaattatgtgtaagaaacgtcttatccaagcccatgttaattctgccagcctgaaacaaaaaaaatataaatattttcatacattaatacgtaaaaaataataaaataatgattcatcagaaagaaaaaaatctgataacataatttttggatgtattattaatatagtttttttattattagagagagtgacccatctccattactgtttctatctctctcttctccattctctctctctatagagacacacaaaagtagaaagacgaagaagaagagagaacgggtttgtagttggtggttgcgtttctttctcgtttatattcttctttcttttttgttttcatctttcaattcctttttttcttttttgtttataatctaatcgacgcacgaacagagcaatctcaagctcttcttcttccccacaattgaatctgattctgagatcctcttaccttctgtttgatctctctgtttcctggtgagtctcctttcagctcgaattcgaatttggcaattcgatattaacaagtttagttttttttttctcaatgattcttcttttgattggttgcagacgaaggagatattgtagagaaagaaaggggttctcatgattctcgtgttttgagtctctttccagtataaattaaaacttacacttgtctttctttttctttttggtggaaatctacgtagatctgttccttttttctcataaaacttttgggtttaaatttctgtacaaataaaatatttgtaagaagaaaaaaacgtttttttaaacaagactcgaaaagggtcagacccagaagtctcatcttttaccttttttcttggtcagctttgaaaggcttcatcttttttttattccgttttttttttcttcattcaattttgacgatttgggtttaaaaatcactgcttgtgtatgtatgtatactggttgttgacgaattagattttgctcaaaagggttcttgcacaaagtagctggaactaaattttgaggtttgtttcttacaaactaaatcatcatatcatcctattactctttgtggtgatcattgggatctaaagacgggttttgtcttcttacagagatctcttttgcatagtttgaatcatcattgctctttccggtgagaattgtgatctaaaggttcaatctttctcgctggaggaccgtcggggtgattgtaccattgttggtctggagtgcctgctcaatataatcagggcccttaaaatg

SEQ ID NO: 26591 - DNA, 3003 bp, Unknown; identical to SEQ ID NO: 26590
  misc_feature (1)..( 3003): 2750-1469P.txt file - cDNA_ID_2714825; gDNA_ID_2213626; Annot_ID_132064

SEQ ID NO: 26592 - DNA, 3000 bp, Unknown; identical to SEQ ID NO: 10126
  misc_feature (1)..( 3000): 2750-1469P.txt file - cDNA_ID_2714845; gDNA_ID_2213626; Annot_ID_132056

SEQ ID NO: 26593 - DNA, 3003 bp, Unknown
  misc_feature (1)..( 3003): 2750-1469P.txt file - cDNA_ID_2714854; gDNA_ID_2213626; Annot_ID_132054
taatgactaatgcactttcctcttcttgttcttatctttttcgaataattttcttagtagaaggcttttggtttaggtgctagttatgtggatgccatgcttaaaggctctagtcttaggttttttgaaagattgatgatagtttcattcgtcaatcgaaaaaaaaaacttattgatcaaatatatgtgcagcagaagtagaaccagcaaaatccaagaatttagagcaatcaaagcacactataggatctgaaacaaataagtcaaagggacctcttccagccggattctttgataatcagaaaactgattcttcaaataccaaaaccaccagtgaacctaaacagagtcagacacagaccactggtccagaaacaaaaccaatggtgaatggaaaccttccaaccggtttttttgataataaagaagctgacctgcttgcccatggaatcaagctcgtcaaaccagatatcaagtgagtttcttctctttttttttttgttgcttttacttttccagatgcagaaaatcaaagtgaaacctcattgttgtggaccttgtgatccagttactttcctacattctcaatttgaatggttcatatgatcttatgggtttgtacctaagaattctcttcgtgaacttatataaacatggatcttcttacagggatgaatataaagaatttgagaagttgatacaagatgatttgcaggtagtggatagccgcatggaagaagaagaggtcagataactttctgtcactatgataaattgctgacagtatcataagctctttcttaaacttaaaatcgcttttctcgcactctaattgtcaggttgatgctgcggaaactatagaagaggaggaacaacgagagcaaaggtaatttgattcattactttgttatagcaagaagatggaaatgttgagacttgtttaagattaagtaaacacttggcttctccttttaatcttattctgcagatcatacaaagagaaagtagagattctgaagaggaagaaaatggaacttaaagcggcaagattagcgaagcgcagtaaaacctctgaggggtctgttaaaaagccgaagaagacagaagaagaatcgcccagcgatgaggaggatgacgaggattctgctgttgattggagagctcaacatctttgaataaactagaaaagactgtttaaaaatctgtaccctggtaaaacatacaatgttctatgagaatatacagtgaaaactaatcaatctcatatatatacaattatcagtttcagaggatcaattggtatttgaggtatagttatcggttaatgggtataattcaagaacgtaattttcataaccagagttgccaaaaaggccgaaatatctggggatgaaacctgaaactgtggcagttccgaccagtttcaggtgataaactaaaaaaaaaaaagtgattatgactggtggtcgtatcattctagttttgagtgagaatgtttcagatattgatcatttggtggcacaaaacataatgacgaaagtggtaaatttaacaatcatctttaaagttaaaactcttattattgttaaacaaatacatgtggaataataaataattgagacaattccagaaaccaattaggggtcaaatatgtcgagaaactaattaggggtcaagtattgaagaaggaagaagaccactaactaaacatattcatatttttttgtgaatttttggactatttgtgattaccaaccatatgcttatataacttataaaaaaaatgcattaggctttccactataaaccattgacatttgaaatatttaaatcaagatatatgcataaccaaaaaaaaaagggttatgttatcttgtttataacttgaaaaggagtccacaaaacaaagagagagagaacagccaaagcaaaggtcggttaatgcacaatcgatgatataacaaatatcccattagaacataaaattagttaactaattacttctgacctaactgaatgcactcaatctcctataataccttaacattatctagcttgactaatcatataaattgtcacgtgaattttctaatggtaaagtgtttcacaacgggaatcaaagtttagggacatttcagtttagagtctatccatcataacacttgtatcccaacttggtttttccaaatttgttttagataaaataccatttttcgaattcatcgtcttcatgtgaattttaggaaaaaaagagtgacaaaacacacacacgcacacacacatcggcttcgacctacataaccaaacgatatcttgtaaaataccacacacaatcacaagtgtttaatcttatgatctctaatctcttatgcatgtttaaacgtgataaaggagaaatcgtttagcattagaaagaaagaaacatttacgaataaaatgatcgaaaaagtgacttcctcgaactttatcacatcacgataccttatcacatgtacgtaacacgtaatgacttattgtttatcttgtggttataaaagactctcttatcatttatatggtgctcttcataggtcattctaaaaataaacccatatctcactggttcaccttattttttaaaacatattattattcttttacactacgttatcttttattatgaccataaaaatattaatatagcatgggctttttgaatcacaatttgaacttttaatgtaaaaaataaacaacagcactaacaaaaaaaaaccgaaaatttgtgtataaatttcgccgattccatggtgttgttcatcgaattaacttgagttgctatttttttctctatctgataagtttcgaaatttgaaaacacaggcgccaattttaggcatataactgaaaatcacaaaaaggaaataagagagaaagagagagaaagagaaagagagagaaaaacagagaggttgtcttcttcgtcaaatatccgattatctggtatcgtgattcggaggtgtaatg

SEQ ID NO: 26594 - DNA, 3003 bp, Unknown
  misc_feature (1)..( 3003): 2750-1469P.txt file - cDNA_ID_2714861; gDNA_ID_2213626; Annot_ID_132052
agaatcttagaaaacactaacccacatcgaaatgagttttaattgcagggcacagacagaatcattcaaaattatacatataaattgagtgaaagagaaaaaagagagaccttgatgaggtgttttgtggtttgaagaagcttagcagcaccaagaagcatagcaacatgagtatcatgaccacaagcatgcatctttccatctactttacttttcgattcccattccactaattcctttttttgtccccattttttcaaattcattagtcaaacaaagcaatctaaaaatcagagtaaaaatcggaactttgattattagatttcaaacctgtaacggaagtgcgtccatgtcggctctaagtccgaaaacaggtttcgaacaggatccgatccaagcgacgacgccagtcttcgccacaggatacttatacttcactccaagcgagtcaagctcgtctcgaacgagttgactcgttttgaactcctgaaaccctgtctctgggttctcatgaatctttctcctaattcctctcatccactcgaagaactcaggatccttggctgaatgaagcatcccgcgagcgagtgactcgagacccgaaccagaatcgtagctcccagctgaagacagaggagggagaaagaagaaggtaacgaagatgacaaagaagctccctgagaaatccattctgatttcttttgtttgtcgatgtaaactggcaagtgtcaatgaaagaaaggacaacggtgaatacgatgatgatgaaggagaaggagttggatcaccgatccatttttaatatttatatagtacgtaatttacacacgtttttggaaactcttttaatcgtttttaaatacgtatacgcctctaatgtgaaattcataatttatggttgtaatgtgaagaaaataatgaaataccaaagataaaatatgaaaatgatacaatgtagtatatttacggtataaaaggaatatttacttgaaatgaattagtacgtttaatacacgattttaccatttatgttaatgaaaattaacacttttaaaataaaacatggcatgaattagagttgtgagaatcacatgtaggcctttaaggttcttaaatttttaattccttataacataggcccatgtatttgattgacatataggccattgggttcttcgacttttaaattacttataacaaaggcccacctatttgaagcgcattgttaaacattttgtttatattttgattatgatcgaaaattctctagaacaattcgtacaaaagaagctgtttacgaaagtagctgtacatgcgaacataatcaataaaaatgtaaatgactaatgaaacatcagaatatccgtacaaaattgtgactttatattatttagttataggtacaaagttgtggagagtaaaaaaataaaaaaggtaaaaagttgtggaatagacctatgaaacaatcacaaacatacaaccaaaatgcaaattgtaattacgcaacagaggctttcttttcaaggaagtcaagtgtaagatttgcaaatgccccaattattatttgagagaaaaagggatattgctaatcacaattaacggtcacattacaattcccttttttctctgttatttcctcttctttcacaattaagttcttaacggtcacataaatattttgttttttatataatgagtttaattaagttgaagaatcaactgataaggttgatgatccgatcctcaaaagtatactaaccacaacactgtctacgttcatgttagtacctacttcaaagtccatgtacgttgggactggctgtatcttccgccgagagcagcagagagcgtcatcgctgtcttggaacgagagaaaggtcgagactatctctaaggcaaccaaaagcttagctatgatgaagacatctttctctctctctttgcctatgaatggagaatacaacaaataatataaagtgatggacatttctatgctttgcttctcttctccaaagagaaatagatgaaaaagattgttgattttcgtttctctcgaagaagaagaaagaagaagaaggtgaatagagacttttgatttctcaagaatgaacaagtagattgtagagtgttagtgtttagttctgttcttaggttgcagagattgtgtatgtgtggcgtttgatgtctcgtgttggagaggtggtctcgtttagagtgttagtgtttagttctgttcttctgttgatctgtgttttttttaaatgtaaattacacaagtatgcaaaacaaatctcttctcagaaaggggctactgttatatcatgagatttataagacaaaatgtaaaatatcggaaaaataaaacaacataattttggtgttgaatgagtttttcttgtccacacaacggcagaagcagtagacgattgttcctttgtctcttgatcacaaaccgatttcaaagtgttcttcgcatttttctcatcaatgtaagtgaaccagccagagaaagacaagtatgcaccaatatcattccggccccatattcagaataaattagaacatctttttccttccgtgttatgcacttgttctaaaaaaaaagaattccggcccatattcagaataaggagtccagtccaatagtctcaagtccaaacccgactcgggtctgtccgacccggaaaagagaactgattacagaatgcgggttttgtcaagagaaagttggatgataaaattgaggtgaaatctaatcttcaaatgatcattggttagctttttgtataacggattttctgaaatcctcttatttcccatatcggaccgtgattattgggtgatttcggatgcctaattgggtaattaatataatacagtataagattagatgcctcgaatattcgctctgtgcctaaccacaaaaaccgtaacttttggttttctctgaaacacatcccaaagtaaagaaagcatcactcttttcgtcttctctcgaaaatg

SEQ ID NO: 26595 - DNA, 3000 bp, Unknown; identical to SEQ ID NO: 10115
  misc_feature (1)..( 3000): 2750-1469P.txt file - cDNA_ID_2714868; gDNA_ID_2213626; Annot_ID_132049

SEQ ID NO: 26596 - DNA, 3000 bp, Unknown; identical to SEQ ID NO: 10114
  misc_feature (1)..( 3000): 2750-1469P.txt file - cDNA_ID_2714872; gDNA_ID_2213626; Annot_ID_195861

SEQ ID NO: 26597 - DNA, 3000 bp, Unknown; identical to SEQ ID NO: 10114
  misc_feature (1)..( 3000): 2750-1469P.txt file - cDNA_ID_2714872; gDNA_ID_2213626; Annot_ID_132048

SEQ ID NO: 26598 - DNA, 3003 bp, Unknown
  misc_feature (1)..( 3003): 2750-1469P.txt file - cDNA_ID_2714877; gDNA_ID_2213626; Annot_ID_195859
agagcctttgcacacttgaagtagcatcttgctccttctttaaagcctgggttttctcttcattcacagtttcaagctcattcttcagtttctctgcttctttttcactcttagatgattcttcttctgcaatacctagcttctgttcagatttctcaagatcaaccttttgactagcaactgtcatctccaataactcaattttctccttaagatcagtaatttcagattccatatcgtgcaatctactattgcttacttccagctgctttgtcacagataccagagataccgaagcacatttctccagcttgttagcttcttccaaccgtttctccagttctttcgctttgttttgccactcgtcagcaaagccatgcgcataagattctgccatttttgcagcttctaagtcaacattaagctgctcaatgatcatctctagttccttgacctttgcttccaaacttctcgcattctcaaggtctctttttagatccactatctccgcccctagctttaaagcaatctcattcttggagatgatttccttctctcgagttgaatcaagcaaagccttcaaccgtattaactctgacgacaagatttcaactttctctgcatgaattgcagccatcttactagcatcatctgcacgacacaaagccttactcttggcatctttagcattagccaattcttgattgacattctccagctcctgtgttaccaaaagaagagtagctgattctgaagcatgttggttcttgacattctctagttctttcttcaactcttcttcttttctctgaaccgcctctatccctgcctcaacaacctcaaatttctcaatttcgaagttctccagggactttttctgagcttctaaagcctcatctagtttctcagatgcctcttcagcttctttccgcgcttctttaagttgatcaagtgctttagctttttcattctcgagcgatgctatcagctcattggctttctttaaatcttccttgatttgaactgactgaggttgcgattctgatactctcacagcccgtatttgagttttctgcaaacaatcataagacaacaaaacaatggatatcaacatttgcagcatagtgtgtcaaaactaaaccaagttaagaccaggcaaactattatgaacacacttacttctggtggggttggagctttgggggacctcttatcagtactaggctttgagttagaagaagggcgctcgaacgaaagccgtgactgttgttgagtcggtgaaggagaattagaatcaggtttagtcacaatccgagtgagtctaggcactcttagagatgttgaagatgatttcctcaaagtagtgtcagataaaccatttctgcttcagaaaacaacaaaggtctctcatcaagcaagcaaaacaaaacaaaacaaaacaaaacacgtgagaattgattacacttgccaaaatcattaaaaaaaaaaaactaagaactctgccatggagccttagattaactaaattataaagtagaagagaagacaaataaaaatcaacataaatacaacatcacaacaacaactaagaactctgcaatgaaattattattattttttatatataagtgaagctgcttgtaagattaaaaaaatcacagaaacaggaacaatcagacaaatgtgttacaaatagaatcactaaaaaccaggagattaaaccctaaacccaaacctagtcagatctaccacatcatcatagacaacctcaagatagacccagatcggaatttgaatcgacgaaatattccaccgacatcaaaaaaaggatcggagaatgaatcttaataaggaaaaagacacttacttaatcttagaagccatagtcacagcctctgtctcgttgctgcggatcagtgagaagtaaattacgttagaggaggcgaccaaggaaaaattgagacttgatatacattattaaattatggaacctggaaactcaaatttgctcgaactctaactgggttcccatttttagcgtagagatcaagatcaagagagagagagacaatgattcggattaaggaaacgactgatgaacctaacgtagaagaaaatgatactcctagttggtgaggttttgtctcacgagtggccacactccccaaaaagtgtcaaaatgcaaactataaaataaattaaatgaattaaaaaaaatccgattcggtttcctacgtgataaacgcaaacaataacacgactaaataatcgcttgaattatcatcataaaactaaaacgtgagattagggagattaaaagactagtcttccccatagctaatgcggaataatatctgtataccgttactataaatattcgatatgtaccaaacttttttgtttgtttttttctagtaacaaaaagaagagtatatatatgcaacttagggaaatttctgaaatatgtaaaagatactatttgattgattgataactaactttgttatacatcgcattcgcaatatcttgttgaatacaatatctctacgactctaccattaggcaaactttttatcgggcccagtggcccatatttattaaggtccatttattaaccgcaagaaggactgggagtctcaaagttgacctggctccttccataaaagcagtttagtaaataaatggactgtaatcagattgatatttgaaaaaaaatgcttctgaaaacaaaaattcacttggaaaactttaaaaattagtcgcgggaaaatgagagagatttttggcgggatctctatataattttccattagttattaattatttattttatgagagtaacttgagatttgagaataagaaaagttgaaatttgtaaaagatatgagaaattagtaaattccagaaacttattagaagcggcggatcgaattcgcgacgagcgttccattagggtttcgaatcaacatcaacaaacgacgagagaaaactttttaaaacatg

SEQ ID NO: 26599 - DNA, 3003 bp, Unknown; identical to SEQ ID NO: 26598
  misc_feature (1)..( 3003): 2750-1469P.txt file - cDNA_ID_2714877; gDNA_ID_2213626; Annot_ID_132046

SEQ ID NO: 26600 - DNA, 3003 bp, Unknown
  misc_feature (1)..( 3003): 2750-1469P.txt file - cDNA_ID_2714898; gDNA_ID_2213626; Annot_ID_132040
tctgctgagaaaattggtttaagaaacctggactttggacagcctttgctagaaaggacatcatctgttgctgcctctgctccatcacatgaactttctgccccacattctgcagatgatgttcggtaacttgttgttgctgcctcaaccttacaagttcctgcataaggacgttcttatcgcgctgaagtctttccacttcctcttcgagtccaaatttgcccacttcaacgcacgcacccacagatgagtgctgaacttgaggttgttgtggaggctgcacttgtgcaggttttcgccggacaatactctttagtatttgcttttggcctcttaaaaagccctcgtttgcaaactcccagcggtctggatcaacttttctaaaaccctgaaaaaaagaagcatggagaatggaacagtcatcaaccgcaagaagttacttggattccgttgcaataggaagccaacatagaagatttgtataaacataaagaccattaaatacgttaataacaactattctagatatggtatgatacgttcactgggtctagctgcagcaccaaactaccatggtccaaggaaactaatacagttgttagtgtatcggcatgtacctggacggacaaatacaaacgaatggaaagctaacatgggacaactgatagaaattttgttttgtgacttaagaggccagaaatggaagtgctgaatcaaccaatcgtcagacacatatgagcacatgtccaaataagcctgcaaagttcgtggaaccttttggtaagtaaataagaacaggggaggaacaagctacgcaagagtatacacttgttagttttgcttgacctaagaaaattcattccagcctcacagacacggatgcaagctcagatacttagaaaaacaaaaacatatatgcctgcagttcacagggtatacatgtacaaaaaacaactgaagaacaatacaaatatgtgaaattatcttgcacgagtttgtcagaacccaaaaagatccaatcttaacagttagtgcaactaaaatcaacattaacacaacctactagacgtgcatagttcaaccaccagcgtcaacaactatataggaacatcaatcagtagcatcatactatacactaaataggagtcgacttctcaaagcaccttcttgcaaccttaaatcattcgtgagttttatcaataactaatgcttaattcaaccacaaaaaaaacaagagagtaaaataaaaatgaagcacataaagtaagattccctaaaatcgaactacgaaattgaagaaaatcgaatcaatgaagagaaaaacaaataaaaaagaatcgatcgaagttcactcacataagtattgagctgtctgacgaagctggagaaattgttgtgcttgaaatactttggtagaaactgtttggcgaactcaggcacgttccaaaccacgaagctgttgtttccgctgctccaagacaccacgtcgtccgtcaatggatcgtcaaccatatcgtacgttttgctcagaaaaggcggaatggagctcatcaccgccgtcgaagatttcgccgtcgctacagattcgcaaaccgttcccataaatcaaaatcgcaattgattccggtgtaccgtcttcttcaacaattccgagattcactactccggtcttcgcaaaccttacagagatttatattcgaagatcatctcttagcgacgaagagaagaagaaagaagctctctctctctctgtctacacttatattaaactctggagatagcttttacctctgctcttttatttatacactctgatttttttaattccagaaagcggtggagtttcgcagagtgatataacgtgtcgtaatctctaccgttgatctgattacctctgcaacgtccgattattaaattaaaaaattagttttgttgttaagataagaaataccacgtgggctggactaacgtgcttggcctttttaaaaaaacattaattaacgtacgtacctggtctttttctgattaacgtatctggtcctaagctctttttttcatacgtggcactggactcgcgttacttttctcaattttttccatttgcgtttcacgtttttttttggataattttctgctactcaaagttttgttgttacgaaaacgttgagtctctctctctctgcttgccgccgagacggccaataattttttttttaagacaatatttataaatctgaaataaacatcgatccagatttgtggattatagaaatcttatcaaattttataagattatttctttctatgatatctaacggctcatcatgtaagactaatctaaatttgtaacgaagaaaagtggaaaacacataacaagtgtattggcccgcctaatcgagttaatagggcaaggaaattctcctttactgcctaactcttctccagtttgatttttattttttgttgtggaggggaatattttaaggttctcttaccatagtacagacttataacgaataataataaaaagcagattatgaatcgaaagtacgaattttttcaaatccatttttttcagatagaaaaaacagtacgaatttttattgttaaaaatggttatattattgaaaatggaacaatttttcatttaagagaatcgaatattccattcataaatagtacattagtactctccttctaaaagaggcacgtgattggttgtcgcaaagcacacgagccaagatgcttcacttggaacgagaaaaagccccaagagacagaggagagggcaaagcaagcaagcacctttttctttcccatgctcgaaactcggttcttgattgattccttcgccgaagattaaccaatcaaatccaaacaaacccactcagatccagattcgttaaatctatccggatccatttacttcaacgggtcggatccagtgatctggcacttcacaatgggaagtggcttttctggttcttcggataccaaacaatg

SEQ ID NO: 26601 - DNA, 3000 bp, Unknown; identical to SEQ ID NO: 10109
  misc_feature (1)..( 3000): 2750-1469P.txt file - cDNA_ID_2714901; gDNA_ID_2213626; Annot_ID_195853

SEQ ID NO: 26602 - DNA, 3000 bp, Unknown; identical to SEQ ID NO: 10109
  misc_feature (1)..( 3000): 2750-1469P.txt file - cDNA_ID_2714901; gDNA_ID_2213626; Annot_ID_132039

SEQ ID NO: 26603 - DNA, 3000 bp, Unknown; identical to SEQ ID NO: 10108
  misc_feature (1)..( 3000): 2750-1469P.txt file - cDNA_ID_2714911; gDNA_ID_2213626; Annot_ID_195849

SEQ ID NO: 26604 - DNA, 3000 bp, Unknown; identical to SEQ ID NO: 10108
  misc_feature (1)..( 3000): 2750-1469P.txt file - cDNA_ID_2714911; gDNA_ID_2213626; Annot_ID_132035

SEQ ID NO: 26605 - DNA, 3000 bp, Unknown; identical to SEQ ID NO: 10107
  misc_feature (1)..( 3000): 2750-1469P.txt file - cDNA_ID_2714915; gDNA_ID_2213626; Annot_ID_195848

SEQ ID NO: 26606 - DNA, 469 bp, Unknown; identical to SEQ ID NO: 10275
  misc_feature (1)..( 469): 2750-1469P.txt file - cDNA_ID_2714915; gDNA_ID_2213640; Annot_ID_132264

SEQ ID NO: 26607 - DNA, 469 bp, Unknown; identical to SEQ ID NO: 10275
  misc_feature (1)..( 469): 2750-1469P.txt file - cDNA_ID_2714915; gDNA_ID_2213640; Annot_ID_181211

SEQ ID NO: 26608 - DNA, 3000 bp, Unknown; identical to SEQ ID NO: 10107
  misc_feature (1)..( 3000): 2750-1469P.txt file - cDNA_ID_2714915; gDNA_ID_2213626; Annot_ID_132034

SEQ ID NO: 26609 - DNA, 3003 bp, Unknown
  misc_feature (1)..( 3003): 2750-1469P.txt file - cDNA_ID_2714938; gDNA_ID_2213633; Annot_ID_180933
acccactcttattttccagagagagaaggagatttccggttaaccagaaataaattccggcgacagcttgttttttgttttatacatagtttccgacgtttgacggatctctctttccaattagtcggattttaataattttttgcttagcttggttcgttttccggctaagatcggattatgttttttgtttttctctcctctttctacatgatttcagtgtaaatcccgcttgctgtcaattggtttatttcatgttcatctgttggcttgaatcttctccaaagttagagaaatatcttcgccgtaatatcttcatcgttatgcgaagtggacctttctttaggtcttgggcggagattcttcctttgaagttggggttgagatgaagatctacactatctcctattattcaaggtggaaacaacagatccaatttgatatgcggcggtaatatctttaggaggatgtctccaagagcgtgaattgaagctttcacctggtggttacgaccgtcgtcggacgtgacagcaaattgaagatttggcggtgagcaaccaaaggtgttccggcggttttctcgcttgtgccacatgaatccattaggttttagcatcaaacacgtgtctcttacgtatcttctttgtgtaattgagtttattttaaaattaggcttcaaaagactttgtatcacgtatcttgtaatctgtcctttatgagtttcgtttttttttaaacgatttatttcattagttgaatcaagtgtgattacaatgtaaagcagataaaatgaaatatggaacaaaataatgatattggaatgagttgtcatttgttattctgtgttataaaacgaaaattgccgacaaaaaaaaagaattttcggttacgaaaatataaaatcttatagatatagaaaatgtaaaaggtcttttgtaagaataatacttttctactaaaatattaagaatatagcatattatatatatcaattatgtaaataacatcaaaggtatgaaaaatgactaatggtggtggtggttattccggtgatggtagtttcagcacgattccggtgaagattccaacggcacaagttcaggcgatattccgaccatagattttcatcgatgatattccaacgatatagatatcagcgatggtggttgcgaagattacggtggtgattccagtgatagtggtggtgactttgtgatggtgatggtgatgacgtggggatgatggtggtgccgttgtggttgtgatggtgatggtggtacagtggtgatatgatatccatgataaatagtaacagtgtggtggttttagtagtgagaacgtggtggttacgatggtggcggtgatgacgttgtgatggtagtggtgactgtggtggtgatgacatagagatgatcacgttgtaataccggcgtcggtgatagaggtgactataacgtcggcgagttaattggtttggcttaggatcaattatttccaaaataccgaaaatacacattatatcattaaaccatttttttggttagttacataatataatatttttatatgttatttatgcaaatttcccaaatgtaaatcacttgggcacgtgtcaagagaaagcgcgtaatcatcacgtaatcaagcgaaagggttttgcttacaaaatcctgagccgtctttcaaagcccaataactggcccaaacattctcagtaatatttcgacctaaatccttatttagacgcatctttattcgataaaagataataacaaaacttatctctttgccttgtctgctttttcatccaaaggtccaattagcttcttaagcccaaatctctctctctttctctctttctcttcctctctcaatctactcgccggagatcggctcgattcctccgtcaccaccgcatccgaccggagatttccttccgttttctttacttcacaacgcagagcttcaatttctccctcgcaggtattcttcgcgaaaccctaaactctcactaatttcccctggatctaattggggatttttgagttttgcctcgattgtttgttaaattgttagcttttgtttgttaagtttaaatgttttggtttcactcatggaggcaaatcaattttgaaaaaaacttgaaattgttgtttgtgtttgtgtttgtgtgatataaagaaaaaagcccgatctttttttttgtttgattaaattctgtgttttgtttgaatcagtttcgttgtgttgaaaactttgtaatctgggctctagttttctcaagagacatggaataatcacaatgtcaacgaatcagttggctaagcgatttcggttaggttagtttccggttaacaaaaactaatccgacccgattaagtcactcctaggccttacccgacccggctcatcgattagtcacacgaagcttgactttaccatttctttcgagtttctctgttgagtatcgagaatcgagaaaagaactttgctcaatctttgtttctcgtttggtaatcttcgtttctaagaattggaatggtctttttcataggattcatgatagtttttggctgcaattttgtatctttcttctgattatgtgaggaatttgattttgttgtcgttgtcgttgtttcgtcttagggatttgcgagaatcattgaacaatttttcaactttgacaattaatagcacgaaatgagcttcagatttatgtgtttgagtattcaaagatatagcttttatatttgcctttgtgggtttcatggagctgaatctgtatacttatagctcattagtaaagtctgttgttgttttcccatcatttgcttctggtttgacattgtgttgagtagtaagattagagctttcttgctttacatgaagcatttcatttgtggaaagtgcttcaatccatttgggtttctctctgatttggaagatatgtctggtgaaaactttatctgggtattgcttcttttcagtgattgatcaaagatg

SEQ ID NO: 26610 - DNA, 3003 bp, Unknown; identical to SEQ ID NO: 26609
  misc_feature (1)..( 3003): 2750-1469P.txt file - cDNA_ID_2714938; gDNA_ID_2213633; Annot_ID_132090

SEQ ID NO: 26611 - DNA, 3000 bp, Unknown; identical to SEQ ID NO: 10172
  misc_feature (1)..( 3000): 2750-1469P.txt file - cDNA_ID_2715000; gDNA_ID_2213634; Annot_ID_132113

SEQ ID NO: 26612 - DNA, 3000 bp, Unknown; identical to SEQ ID NO: 10172
  misc_feature (1)..( 3000): 2750-1469P.txt file - cDNA_ID_2715000; gDNA_ID_2213634; Annot_ID_180978

SEQ ID NO: 26613 - DNA, 3000 bp, Unknown; identical to SEQ ID NO: 10180
  misc_feature (1)..( 3000): 2750-1469P.txt file - cDNA_ID_2715010; gDNA_ID_2213634; Annot_ID_132110

SEQ ID NO: 26614 - DNA, 3000 bp, Unknown; identical to SEQ ID NO: 10173
  misc_feature (1)..( 3000): 2750-1469P.txt file - cDNA_ID_2715026; gDNA_ID_2213634; Annot_ID_132106

SEQ ID NO: 26615 - DNA, 3000 bp, Unknown; identical to SEQ ID NO: 10173
  misc_feature (1)..( 3000): 2750-1469P.txt file - cDNA_ID_2715026; gDNA_ID_2213634; Annot_ID_180971

SEQ ID NO: 26616 - DNA, 3000 bp, Unknown; identical to SEQ ID NO: 10175
  misc_feature (1)..( 3000): 2750-1469P.txt file - cDNA_ID_2715040; gDNA_ID_2213634; Annot_ID_132103

SEQ ID NO: 26617 - DNA, 3000 bp, Unknown; identical to SEQ ID NO: 10175
  misc_feature (1)..( 3000): 2750-1469P.txt file - cDNA_ID_2715040; gDNA_ID_2213634; Annot_ID_180968

SEQ ID NO: 26618 - DNA, 3003 bp, Unknown
  misc_feature (1)..( 3003): 2750-1469P.txt file - cDNA_ID_2715052; gDNA_ID_2213634; Annot_ID_132099
gccatatagagaaatagaattgttatttttgttagtcaagtgtgggttaacccgaattcaagttccacttgaagaggaaacttcgtatcaaaagacaaaaaaccatgtttggtccggaaaaagttttcttataaaaaagagagaattttccggtaaacaaaaatactgtagaaagtacacaatatataaaagaaatcatctagtaggaggagtaatgttttgatataccaaaaacaaaaaggaagggtaataatgtttgcaaactagtcattatataaaattgaaagtggttgcctatgaatacaaacatgttcatgcaagtgtacttccatgtgcttctcctctcattctcaatccacccaattctgcttcacatgtgcatatgtacatatatgcatattgtggtccgtacgtaacgtttgtttttaaatattattattgttatacgatttacaaatacttatttttctagcactcttaaataaataaaaacaattgcgtaaaatatgagataattgaaaaaataaaatatatatataagctaaagatataaaagtgtcaaaatttaaaaaggttaggtcaccattctctgtagattttagggcgagaaatcaagtcttagggttaagtttaagagttagggtttatgatttattttttgaaatcttaatttgagtttaatttccagggtttatgaagaaatatatacagatactttacagtttataatttggagtttggattaggactaattttaacaccttttaactctcacaaaatctaaactattttcttaattttgatattaattttatattattttcataaaatttcaactattaatcctaggaatatcttatgtttaaaaataaaagtttaacatgatctccgtgtggatcttttaatcaatattcaagtaagtaagttatttttacattcacatagaagtcagaccattataaactaaatccattaaaaaaactacatatggtaaaagactaaaagatggtcttatttccaagtattatggaaaaatgaaaaatgtatttagcttagtaaatatcttgagaccagcaaaatgattgagcattgggaatcggaattctgacaaaaccaatcaaatgtgacagattattagagtataactagtaattaatgtaggcttaaggcttcatgacaccaaactgtaagtaataaatttgggtattagtacatgagtaattcattacaaaaccaatttcagtatcttgtctttagattttttgttgaagccaaatacgttctcgcaaatcttccatctaaaatgatactaacaaatgatcagaagcataacaaaccaacaaaataaaataaatttccagcccataaaattggaaaaaaaaaaaaatatatacggaatcttccgtaacgattcgtacatgttttcactgtcatataatgtcacaaatcacaagactgcatttgttctgatctaatttatattcaattactaccaaaaccataattatttatatggatcacacgtttattttttatacgtctgacattaacaaatacacatggtaaaaactgttggaaaacaacaagtttagttaatagtacagttttgctatatagatcgtaccatttgttttcgtgataataataacatatatgaatctatataattcttaaccgataattaattaacacggaacttacgcgttcataggcacatatgacatagaagaaaagcatcgaattttaaaatagttcaacttgtgactaatcattatgcatgttactgtgttttggtgaattggaaaaagcttgatctgaaagaataataataaaaggcagtttgtataatgataaaaatataacagtatataataaggtgggagcataagtaacgtgaaggcagtttgatctgtcgggaattttttttgtatactttatgctcctaattatggtaattagataagttaaagtatagttttaacttaactcgtgaactcatcattttttttaacaagaatcccgtttctgaactcaaacgcaatcacaaaaacaaatacgtattgggattcataaatgccttaataaacgaaattttgtttttttttcttcttttcttttgaattatagtattgggctcacaacataattcaaaagtctttaatttacttattagatccaacaaacagaagtgatccgacccaatactttgggccgtagttgggcctaaataatattctccgtcggattatttgcgatcacttccttcctcattctcgccgtcgatcagcttctaacggcgcctcatcggtcgtcaagccttaccttctcatcccagctttggtagattctcttctttggtttagctgtttcagtctttgattttacttagcttgatcctccgaatatgagaataatgtttctattatgtttatcttcattcttcaatgtgaactcatgaatctggaatttgggcaaacaaagagtttcttccgaatgtgaacttgattgcttacaaattttgaaacttttttgtttatttgtttgctttgttcattgttgaaattgaacaaagtctttgatctgctcagtgcccacctaatatgatttatggtgtcagatggcatggcttgtggtttctgtttctctgattgttatatggttggcttctttctgcaaaatattcttccgagcaacatctatctccggagctgctattcttgatgatggcaagtagcccgatgatggtttccaccatctcaatagcttctttctttcaaaagctaatctttttttctttctacagaatttgatatctttttgtatttgatttcaggtaaaacccctcagaagaaaaatgtactgtttgttatcgcacatcctgatgatgaatcgatgtaagattttgagaatgtatctctctgtctgttgttggaatcaatgaaatgtcaagattattattgttcttcttcttcttcttatgattatgctgagagattagtcatg

SEQ ID NO: 26619 - DNA, 3000 bp, Unknown; identical to SEQ ID NO: 10202
  misc_feature (1)..( 3000): 2750-1469P.txt file - cDNA_ID_2715060; gDNA_ID_2213635; Annot_ID_132150

SEQ ID NO: 26620 - DNA, 3000 bp, Unknown; identical to SEQ ID NO: 10202
  misc_feature (1)..( 3000): 2750-1469P.txt file - cDNA_ID_2715060; gDNA_ID_2213635; Annot_ID_181020

SEQ ID NO: 26621 - DNA, 3003 bp, Unknown
  misc_feature (1)..( 3003): 2750-1469P.txt file - cDNA_ID_2715067; gDNA_ID_2213635; Annot_ID_132148
ttaatgaccataaggaggatcgagcttagctaagcgtagtttgtcgttaatttaaattattgatcaaataattagaaaaccagatattgacaaaacaaaaaataagaagaacaaatattgaaaaccagataatagccacccatacgtggtttatttgtcgttgtatatttagtattagggatcattgtgtttatttactctattcaattacaaatacctttagaccaaaacagaatatacaatgtgatatgcttagataaataattgctagaactatatgtttatttttaggtgcctagatcgttgtagtgtgtgaaactctgaatgattcttcaaacaagtagttttttcagtaataaaaaatgtctccaactccacatttgaataagttattagaacgaatagtttctcctttaatataatgtatatgacccagttattgggtttgcaactttgcatgtatatgttctatatatgtgtgaatatttttaacaaaaactaaaattaaattgacagatactgcagagtttacgactaataagttaacatcgtcatttggtgaaatcttcaagtgaccaaggcaaaagcatcactggaaaaaaaatcgatttcctacgcgattacgggaaacttttccgcaacagtgcaaccatttctcattcatccacagtgatcgtgaaatatagcacacgtcaccttcgaatcttacaaatgtgggtccatgttcatccagcacagcaccaacaataattaaggccttgagaaagaaattacgagcatcacacttccattaattttcttaacaaattattaaacttaattatagataaagtgtgttccccaaacggagggaaaaggagattttctcttctttttttttcccttctgtttttgtctttccttaattatttctcctttgttttgtttctttgaacccaaatcttgttattttgtttactgagtatgatgaacttaacaattaatttagtgacggtctaagaagatgtcaagtgccgtaattaccagctaattaagtactcaattccatatttgaaatgttatgttactcaccatttcctctttgtcgtttttatgattgggtcaaatgttgcggccaacaccagtacaagtatcacagatttaaatttagcttatgggatctttcaactagtgcctcacttctacttgggtgtgacttttttcgatgtattttttggagtgaataattcgatatttgagtttaaaatgttcattattgttagagtgtgaaacagtgaaaggtgtctctcggtcaatgatttttttttttttagtcggggaccaaatttttattttctatttcttatgaataatgtacttgatatttctatttattatacttgctattttgggtcaaggtttgaaaaaagccggttcgattgatccaaaatttggagacaatcatgtcacggaccgtccggtatggagaaattgcccatatcgtcggttcggcgggattgggggaccgctttcataatattccgtccggttccgttaaaatgtttattcggcgtgcttagctggcaactgtagcgaaacagctggcatggtcactctcgcacgtggccagcgtcgtcctatatttactattttacccctatatagcgctttcctaatatttctgttttcttcgttctacatccatttattttagtaagctacggaaccatagagtatatatagaaatggtaaatatatcagaacactgattaaattttgataaatgaatatttgtgttattaatccaagaaagaagataaaaattagcaggctttttcgagtgaaatgccagctatgcatcagtaaatgagccttcacttctcttttgctttattttccctatttttctgcttttcttttctgttcttttgccctactctacatataaaaatatgttgtattttcccattttcatgtgcaaacgaatataatttttaacttagatcaatgtaagtgtatatatatataataatttctatgagcacataaattgatagtcgtatgtagtgggaaaaaaaacacacgcaaacttcaaaatccaaatttattttatggcctaaaagttgactttacccttttgaggtctctgactctaatacgaggggtcaaaatccgaggtggcattttcgtttcaagctgcatatactcattacacattacaacagtattaatttaaaattttgtaataaatacatatgacgatccatttattttctatgcgttacataatttgattcgttttccatcatttgctttcacaaaaagaaaagaaaaaaaagagtgattcttaatggaagttgtccttatgtagtatttacaccgaacatattatatggttgcatagtaattgtttgaacctagatacaacaacaagaagaagacacttctgagttttttttttcctttttctttcctgactgtgcttcataaacatgtaagatctcgtatttaccgcaaaaaaaaaattcaagataacattttattttgacttttatgaattccggatttttttgtggtcggcaaatacaagtttcaatctagattctgttcaaacataaacaaactctaaagtcaaccattacatacagacacagacacagtcagtctctatagtacatgatatctaaaatgattatattttttttaataaaaattttgcataaaattaccgaatttttagcagacaagcagccgtgaaacacacggaagtcggggaagataagagaagctcgtgatgaacactaagaaagatcaatgtcttaatctgacaattagtcgttttacttaaactaataatatttttttaacggtaatctaaaattatttttgatttcaacatcttcattctcattcttctgcttcctttttatatatatcacaacaatctctcttctctctcttcaccaattcttcttcttgattctctgtgtttattgattctgaggctttggtttcgagaagatg

SEQ ID NO: 26622 - DNA, 3000 bp, Unknown; identical to SEQ ID NO: 10205
  misc_feature (1)..( 3000): 2750-1469P.txt file - cDNA_ID_2715075; gDNA_ID_2213635; Annot_ID_132146

SEQ ID NO: 26623 - DNA, 3000 bp, Unknown; identical to SEQ ID NO: 10209
  misc_feature (1)..( 3000): 2750-1469P.txt file - cDNA_ID_2715082; gDNA_ID_2213635; Annot_ID_132144

SEQ ID NO: 26624 - DNA, 3000 bp, Unknown; identical to SEQ ID NO: 10200
  misc_feature (1)..( 3000): 2750-1469P.txt file - cDNA_ID_2715086; gDNA_ID_2213635; Annot_ID_132142

SEQ ID NO: 26625 - DNA, 3000 bp, Unknown; identical to SEQ ID NO: 10185
  misc_feature (1)..( 3000): 2750-1469P.txt file - cDNA_ID_2715090; gDNA_ID_2213635; Annot_ID_132141

SEQ ID NO: 26626 - DNA, 3000 bp, Unknown; identical to SEQ ID NO: 10185
  misc_feature (1)..( 3000): 2750-1469P.txt file - cDNA_ID_2715090; gDNA_ID_2213635; Annot_ID_181010

SEQ ID NO: 26627 - DNA, 3003 bp, Unknown; identical to SEQ ID NO: 16316
  misc_feature (1)..( 3003): 2750-1469P.txt file - cDNA_ID_2715094; gDNA_ID_2213635; Annot_ID_132139

SEQ ID NO: 26628 - DNA, 3000 bp, Unknown; identical to SEQ ID NO: 10197
  misc_feature (1)..( 3000): 2750-1469P.txt file - cDNA_ID_2715102; gDNA_ID_2213635; Annot_ID_132136

SEQ ID NO: 26629 - DNA, 3003 bp, Unknown
  misc_feature (1)..( 3003): 2750-1469P.txt file - cDNA_ID_2715106; gDNA_ID_2213635; Annot_ID_132135
taatgatttgaccatttttatccctaaggttggtaaaggcttatcaaaggacgagaaagctaggaagttggctttgcagcactggcttgaggcagtaagaatattcttttacaatttgtctttctctgtggctataagttttgtgtaaagccatgtgatcttaattttctagcttaacagattgatcctcgacatcgatatggccacaatctgcaattctattatcatgcttggctccactgtgacagtaaacaaccctttttctactggtaagattgctattacacaatcaaaagtatgatagtatcaagcgtacaaatttacgagctaacgtccaactttggacatgtaggcttgacataggacaaggaaaagaattgaaccacgaaagatgtccaagatcaaaactttaccaacaaagcatcaagtatcttggtccggtgagttttaccctctagtttctgtgcttggttgaccaattctgtagaaccttagatctattttcagaaaaacttggtagaccaatattattgacatgcttgttagatacctttttgtaatccttcattctttcttacaaacagacagaaagggaggcatatgaagttataatcgaggatgggaaactaatgtataagcaaagtgggatagttctcgacacaaaagaaggtcctcctgacgcaaagtggatctttgtcctaagcgtatctaagatattgtatgttggaatgaagaaaaagggtaactttcaacactcgagttttctagccgggggagctacattatctgctggaagaattgtggttgacgatggtgttcttaaggttaaagaaagaaatttactcgcttatacttatgcaaaagaagagatgttataagacactgcaaaaacgttttgtgttgagtttgagttcgttggatgatattttcaggcagtttggcctcacagtggacattatcttccaacagaagagaattttcaggcgttcatgtcgtttcttagggagaacaatgtagacctcgccaatgtaaaggtaagtccattctggtctgagttttaagtcaccaacatctcataggtttggctctggtttgtttttaggctatgattacatactttattttttatattctgtagaagaatccagatgaagaagatggagaagctcctgctaaggtcaagaggatgccttcaagaatcaaagagaccgaagaagaacattgtgactttgtggatgctgagaccggttttagtcccaacactaagcccaacaatcatgcagagctacaaacattatcaaggttccattcaaaactttcaagactggatgagattccagacgaagacgacaacatgatcgaggaggaacaggatgatgaagaagaacctgaaaccccttcagaacaagggtatgagacagcagaggagacattcatagctgaggaagagttcacatatccaaaatcaaacctgttcgatgaagacattgaagattacgagaagcctgtcctgaaggagaagataatgagacggatagattcacacaaaggaattaaatcttaccagttagctgagcggctacattcgagatggagtacaggtgcagggcctagaatcagttgtatgagagattacccttcagagctacaatttagggttcttgagcaagctcatttatctccaagagcttcttcaaattcttctaagatatctccttttgccccggttagaacacgaggaacaagtcttgggagaagtcctttggccgaagaacttgaaaatctttaggtcgatttatatacatgtgacgcgaatgcccatgtcatgaagtaatcggcttgattcttttttgttacgcaagataaaaaaactagggcttcatggaagaatggttttcttatgtgtgttccttattcttcaagtcacatattcattgttcttttgttggtgtagtaatttctgcaactctgcatatttggaaaaacagaaaatcaagttttttttggttcatatttttgtcatataattattttataatccactgaatcatataatcttcactaatttaattgtcgtctaaaaaatattcatccgaatgtaaatccaatctgaagctaataactactgtaattaggtttaaattagttcaaaatttaaacctaaagaaggagatatcgtaagacttggttgttctctgtttctgactgctctaagaacaaggaaaccttttttttgttctgttttgcttttccggattccttattgacgcttgtagttgactctcattctttctgaggtctgcttcttcttgaccctttgtattttttatttcttctccttaaatacacaagttaatctcgttcttttagggtcaatgttacatggttcttggatactaatagctggtttcgtttagttctcgtttacactaaacgttagttactttttttttttcctgttagcacacacgaattgtttgtttaatatgtgtcttctacgtttcattttaatttcttaaaagtgaaacttttggtagcacaaaatcaataaattggcagcaatcacaaaatcacaatcagaaagaaaaagatagtaattagactaaaattgtgcgttgagtcaaattaagtcacgcaaatcacacgtagacttcactttcaaaaagcgctgaatcaaaactggtggctatgaatttttcccatctctcaaaatctttataacttggtctcaaaatttaacaaatactaatttattaataaatcaatctctgtctctctctctctctttctctctgccagcgaacatccattggagctcctcactatacggcccaagagatagagggagagagaagacatcataattcccaaacaaaagactttgggtataaaattgggtttattgactttgtgaaacctacccagaaaatctaccaactgtctcgaagtctctctcctctttcttgaaacgggaaagagggagggaagaacaataagaagatg

SEQ ID NO: 26630 - DNA, 3003 bp, Unknown; identical to SEQ ID NO: 26629
  misc_feature (1)..( 3003): 2750-1469P.txt file - cDNA_ID_2715106; gDNA_ID_2213635; Annot_ID_181004

SEQ ID NO: 26631 - DNA, 3000 bp, Unknown; identical to SEQ ID NO: 10191
  misc_feature (1)..( 3000): 2750-1469P.txt file - cDNA_ID_2715114; gDNA_ID_2213635; Annot_ID_132133

SEQ ID NO: 26632 - DNA, 3000 bp, Unknown; identical to SEQ ID NO: 10184
  misc_feature (1)..( 3000): 2750-1469P.txt file - cDNA_ID_2715116; gDNA_ID_2213635; Annot_ID_132132

SEQ ID NO: 26633 - DNA, 3003 bp, Unknown
  misc_feature (1)..( 3003): 2750-1469P.txt file - cDNA_ID_2715135; gDNA_ID_2213636; Annot_ID_132178
aaaccaccagatccagagctcgacttcccagcggaggagtctccgccacctccaccaagtcgtcgactgccgctttctgtcagtcgcggtgtagcaagttttctcatattcacaactttctcgaccttttgattccccttagccgcatgacttatcaatctaccatcatcgttgttagtctttgctcgttgtccacgtaacgaaggaacagcaccatttacgtttccattaggagctcggcttctagaaggcgaacacgattgcctctttgcaacatcgcgttctgtggacgctgatcttgaactacttgacgcatcaaaggctctggttctgctacttgaagcggtttgtggcctatctggtaacgtagttctgagattcgatggcgcttctactgagaatccaggcatctcgtaaggttcccatggccttgatctcacgatcggagaagcttctaaagacagagccggtttactcaaaggcttagttggtttacttctcagtacagtcgatgaaccgttcggagttgatggacggcgagttggagtacttgacctcgatcccggttttgaattaggagccgacatcggcctgttattggatcgagtagaggtggctgaaccggtagtttgttggtctgttgaggtggtgggcctggttgcacgtgcagcggttaaggtaacacgtgaggttccagttccggagctagaggaaggtctgctccatgatcttgttgagctagtagtagaggacgaggttaatgtcgcacgtgtagttgttgaggtggcacgtgaggtcggcgttgatggccttttggctggagttttagactttctggttggcgtgggaggtctactcgttgatcttgagctactagaggacgatggtcttctgattccagaaacagaggaggaactgtgtaacgacgtcgtttggtgctcggactcttctttgctatagttctctaactgcacataaaaaaaaaaaaaaaaaaacagagatgagcaagagtgtgacgtatatgcagacacttaaaaacaaagagattgacgagattagaccacgagatatactgagtccgtacccgagatataagagtcatcaggttatcatcgggtgcgttgaggtggttcgttacgtttctactcggtgagcctggtggcgtgaccagcctgaacaataagaacaatcaataaagatcgatggcaacaaatatataaatcgattatgttgaaacattggcaaaaggtccaattttgaaaaatatatatttgagatatgtaacatcaataaaagtgattgaaaagtacaaccataactagttaacaaaaacaaataaaaatccatagctagtgaattgttttttagaatgctttaccaactcaaattctgatgaacaagatcagacatcaaactactgtctagcaagaagaataaccgagaaaattgatcaaatttactctctttttgttcggtggaatgtgtgctacgttctatacgaacacaaatatttttaatgcaaaaatgtaacaaaacataataaaaaggggggaaatgtttcaaggcaagatttttaaatcatgatcagacttttagagagcatgatcaaattaattaaaagggggaaatgattaccattcgtaatcggacttctcgccatcggagtacaataagttctccccggcagttctccggacagggtattgttgagacgacatcgccgtcgtactactagtattatcagattctgccaaaaagataaatcagaacaaaaaagaagataatttttcgacaacatatattaacacatatacgaacacggacccattaaaagcgtaggtcggtgacgtttctcgcaacgacgcatctccaggaacaaaagaagctcttcatctttgttttgggtcaacattttaagacattttttaaattaaattgctgatgctggaagaaagtggtgaagatgttcttttacgtgttttttcttcttcttattatttgaaaatgtcagattatcattcacacccctactaatgatatatgtataagcaagtaatatttattattaaaaagtaaggaaagtaattattgttgttttttacttatatcatattaatgtattttggctactactaagagaatttttattattttctccagcaaaaatttaagagattttttttctcaatgatattattagtttatatctttactttaaaaaagaaatacaagattatttctcaatctccactaaatttctggaaatggtattattaaatttcattagattttcttaaagcattcaattttattatatctttagaaaaaaaaaatgccatgctggaaataaaactaaaaatttacaatacattaatccaaggtgccgaaaaaattctcacgagtaaaatcaatgcatctgtgtgaaatatatgtgaatctcgcgtatagatgagtttgtcttacattgaatccttccaatgttgtgatatatttttaagtttagcatgttaatgcaaaaatgacttatcgatctcccccatgtcacaactacaagcctcaactctgctaataagaaataaacgaaggattccatggaggatcaatatgtcgttatgtgtccaattcccgattctacttaaatgaagttggtttgagagacattattcttatttaagtggatttaaagctcaaggcccaatacccattttcaaaggcccaaacattaactaggttctaggtatccccccccttatgtttttattcagcaacagtttcgaatatgtttcgtctagacgagcgagactctctctgctaggtttcgatttcaatttcgatatcagggaccattttcctgattcttcgaattctgcatagagaagcgaaattgggatagatctcgtttactttgatttgtcaatttcctgcattctattatacgggttttgtgtttcctcgcaaattgatacagactgttgctttgccattgaattatttgctgcgatg

SEQ ID NO: 26634 - DNA, 3003 bp, Unknown
  misc_feature (1)..( 3003): 2750-1469P.txt file - cDNA_ID_2715147; gDNA_ID_2213636; Annot_ID_132175
agactatgatgatacagaactaatttcacagattatgcaatgctctgaaaccagtttccacatggcacttccttgttcaatttcgtatttcctgctaaacttattccacagatgcaaaccataaccattcctctgcatatgaagaagcttggttttgacccatttcgaatctttctctgttttaggcactttgaacaacttcttaatctcgagccagtttaccgaatagaacacagatggtcgcatgacggtgaagttatagccacttgatccttctacagctctagccactcgtgaaacaaggtatggtccgttgtatccccatatgtttccgttgaaagttttagcgaactcttccatgaatttgagtaacagaggatggttcttgtcgaatattagtaccgcgttgtttagtcttgtccaattcgttgatgaaggatcaagtgtttgtgcaccaatcacgtttctcagacctttgaagctttttagaacaatcatgtctgtgtctaagtacacacctccatatttgtacaagtaagcaagcctcatgagatttgagagattctgagctaaagaaatctttccgggatctcttttaccgctctttatttcgtcgagccacaactctcccgcggttcctttgagcagaaaaggcaaatctggtgtgactgcaagaactttgtaaccacgatcaataaacggcttcaaagttgcataaccttgaggagaatccatggttgcggataagatcatcaagcaaccatacggatgagacttaaagacactttcaatagctaaaacctctctattgccaaagaaatctgctggtgatatccatgtcatgacgaagttgacttcgcatccatcaccgacaaactcatttaccctcttttgaaacttgtcagacaagttatctccactgaaaacttcgataacttggagcttctcgtttacttgtgtctgttgtttgagcagatcacttctttcaccttctctctcagaactcagaggtaagtgtggaatcactctcttgatctctatcttcactcctgagaaatctctatgcggttgcatcgagaaattagaaattagagtaaacgtggtaaccacgatcagagttacaaagctgatagcgaaggcggtgaaaagtgatgatgatcctgattggtttagtcgtctgttatcaatcaccaccgtgaatctcttttctatatcatgacgatccataataaacacagaactgaaatgttctgaagttggaaaccagaaaagaaaaggagatttagattgataagaaagaaaccacttttgagtttctctgtgtctgttttatttcttgtttaacttgttttgaccacgttcttgtctttgggggctgtctagttttgaaaagttaaagaactcagacatagacatttttgacgtattaccgaaataattaatattgatgaaacgaataatgggaaaataagtaatttcaaatttctaacaacacatatatttaaagttttaaaaggattctttttcattcatcctaaatggaaatgttctaaatatatatttttttggtttaatgtgaatctaaatgttctaaacagctaataatatttttgttcttttcaattatttggggttatcatcacatattttgtagaattctctagtcatacccttaatagtactacactaaccaaaaactgtttcatatgaaaacttgtacatactttatttgtcattctttattactaacattttctattattgccttattggtcaactttttggctaacacggaacataataactaaagttcgatgtgtattcttcttacgaaaatactgatttatatcgtattgatatttctgtttgaactcttaatcaatgataagtgttaatatattgttatttggttgatgcaaaatgatatttggaaaaagacgtgtgtgtattaaaatccaaattatcaatgactcattgtatttcaatctctaggctttctagtttctagctttgataaggttcttattttattataatactatttaaacaatgttagttggattttaatattattttgaatgaaaaaccctgctattttacggttgactaattaagaaatataaaatattaagacatttgaactatgcaataacgacaaaaatatgtaaactcgaatagatagaattggttggctggattttggtttagctccaaattcagttttcactattagatccttaatgtttactataggttagaataagatgaattgtgaattagtaaatgaatgtatagaatataatatatgtattttattggttctataaggcatgattagggttatctttgtttatctttatattggaaacttgattggtccatgcataatcagtttcctccacacgacttgtcaaagctatgtaagcattttgaccgtaacaactgaaagcaccttatagaattaaattatatatgtatcacattactttaaatctcattactgtagattgataatatcagctcaacaacaactagagaaatgcaacttatgcagcagtataagtttgttgtattgttcctccgatccttccaagttccaagcctattcattgacatagacaacgtttctaaagctaatgaaagattgcatataaactttgtgtaagatccaccaaagtcaaaattaatggcaatggatcataatttggcccatgggctttaagtgaattatatggaatgatctaatgacatttatgcccctaaggttttgaccgtcacgcagaaaccaaggagttagttccaatcacgtgggaaacaatcgcgtaaatcggacggtagaaattaaatgcgggtgagcaccgagctgtgagtataagagaattccaatgttcagacaattgccacgtggacttatgctttgctttcgtttccacacagtacattgctcccttcccactcacacaaaccaaaaaccaaaaactcttcttcttctgatgaaagatg

SEQ ID NO: 26635 - DNA, 3003 bp, Unknown; identical to SEQ ID NO: 26634
  misc_feature (1)..( 3003): 2750-1469P.txt file - cDNA_ID_2715147; gDNA_ID_2213636; Annot_ID_181066

SEQ ID NO: 26636 - DNA, 3000 bp, Unknown
  misc_feature (1)..( 3000): 2750-1469P.txt file - cDNA_ID_2715159; gDNA_ID_2213636; Annot_ID_132171
ccagagtttggacccgattcaacctccgatcgcaccgccttataaacgagctcttgagctcaagaaagcttcagcacaaagcttcaactcttgaagaaggtgataccaaaaaagaaaaaggaacaaacttttcattggattctgtagcctgtcgtaatgatatattcagggacctacaatttctataacgcttaatgtttttgttatgatgaggttatattttttatagaataagagattatattattacttttgtttaatactgctaggaagaaatcaaatattgggtcaacaaaagaagaagctttttcagtcttatggtcctttgatttcgacccttctttttgaattctaaattggcccacttcgtttttcgtttttagtttgtaacgaaacttgaaaaaaaaaaatggattaagatttgaggaattataacttttagtagtcactagctagttgaataattgaatcgataaacataagactttaatcaactgatcacctatgcaactctcagtgtcaactcttttacattacaaaggaaacaataaaaatcgtttagcgagaccaggtagagatcgagtttgatctcgacaaagaagagcaagagtttaagaactcaatgcagtcctcaatggcttctgcacggtgagactctgatccgtttagagactttgacttcatcaaataaagagacgaagaaacgttactggaagatgacggtgtcgttttggtgttcatcctgccgaatgatatataacgaaacgttttgccaactctgtctccaatactgcggagtaatctcttcgtcgttgccggcgagtcactgaagctgaaactgaatattccaacaacgaccctcctgcgaccatgccgtgatgagctgtgtgttgggaagatcagttcgtcgtttgcttctgggtccggactaaagcgtactcttttggatgctcttcgagacatattcttgtctgaaactttatcgagagagagacagagagaaaaagagaaacaaaatggagacgtgagggattttgaagatttatttatgggggcaagtcatgtataatgtttggggaggaattttattaaggaaggaaatttgaacaagttacttgtttatacatgtacaactacacgtaagttatttaaccaattgatatgaaatggtttccaatatctagatttgtttaattgattcttgatttttttccattatagcttgtagaatttctacgaagatgatgcgatttgtaaaaccaaaattatagtcaaaagaaaagacaaggaaaaaggtttgaagtaaaagagtaaattgagtacttggaataaatctaggtttgaagtcgaagattcaacaataacaatataagtaattaggtagataaattctcatatgtatgatgaaataaatcaataagacaaaaaaaaaaaaaaggttgattctcttcttgtcactgttgtgagagctttgtttttttaggtgaaatattaggggtcctacccccaatgttccccattcattataatactttatgtgtaaacataggcatatatatagagaagttttgagatatatatcaggcccggctcttgggaggtgctgagtgtgctagtgcaccgggtttcacttctttattcagttttttctttatattttagggtccaaattttcaaataattgcaaaataggatttagtttttaaatatttagagttttaggtaaagaaatttggagcatagcacaaggtccaataatttattgggccggctctgatatatactaagacactatatagaagtttgattatgtcaaacaagaaaatttgaatgagaagtttgaatatagagagacttatcaatatcactttagttcaacattagatgtaataacagttaaacaattttctaaccaatccaaataactcaggttaagttcatctcaattatttgtttggaagtttcatttgaagtacattaatctcaattgagacgaatgtcatagtccatatattttgtgtacctcgtcatctttgggccgaaggaacaaagaaaacttagcccgattaggatccattcatatatgggcccatataaggcatttagtgtaatagatttttgcatcatcatgtcttgagattttctattagaaaagtcgaaacaatcaaataaaccaagagaaatattgaaagcaatcatgttggcattgagtaaattatgtaagatttgaattctccgaggaacacactacgtttgtatgttgcgttctaactttagaaagattaaaaaccataaaatattggtaatcgagaaaatgaagttagatctttcacatgcaatgatatgcatatgggacagccaagcagtttatatgttgtgttgtgttgtataatataagacaagatgctttataattatgtgaagcgaatattcattggaatagatttccgattccacatttctttctctttttttggttgtatttataagcaatataaaaaaaattattatataaatatatataaagaatatatataaggttgtcttggcgtaattatttgagttttatgttatatcgatctacaagtaattagcgcggctaatgatatgatacgtaacgaaaagtattttgaccaaataattacaaagtcaatttttttttgtcaggagtacgttattgtgattgtgttttttttttttttgtagtaattgttttctcaagtgtttaaacccctaatgtatgcataaaccattataacaacaacgatttttctataacttctgtaatattaataaaagataaattttagcatatgctaaaacgagtattaggatgcttatctgtctctgcctcacaaagaggatatacctctctttcgtcttcttcagattctctctgacggttgttaaaaatccgattataacgacgacgacacccaaatcctcacaaatatataattattaatttaagcttctctgtcaaaataaaaaggagtcatg

SEQ ID NO: 26637 - DNA, 3003 bp, Unknown
  misc_feature (1)..( 3003): 2750-1469P.txt file - cDNA_ID_2715166; gDNA_ID_2213636; Annot_ID_132169
aaagctttacaagcttccatataattcgacggtgcaagttgttttgcaagacaccggaaatgtagcgccggagaatcatccgattcatctacatggatttaatttctttgtggttggtttaggaactggaaactataattccaagaaagattctaacaagtttaatcttgttgatccggtggagagaaataccgtcggtgtaccttccggtggttgggcggcgatcagattccgagcagataatccaggtttttatcttattatactagtacataatatctacaacttttgtatagtaatatatatttttcaatttgtaacaatgactatttgaaataatatatatgtatatttgtgtggtttcaggggtttggtttatgcattgccatttagaggtacatacaacatggggactaaaaatggctttcttggtggagaatggtaaaggccctaaccaatcaattcgtcctcctccaagtgatcttcccaaatgttgaaaactccattattattttttgaatcgattaattcgtttcttgacattttaaaattttgatatgtgtatgctcatgtaaattgtcaataaagtcattgtatgatttgttacgctttaatgaaaggttgaaaagaagcatccttttaattaaactcaccaacttttttttgagctgaaatttttttcggacttctgattgatccatagtttgtcctaatttgtttttatcacttgtttaatacatgtggtagataataaaaaatgttcaaaacgcaataccatacttgaaaaaaaaaaatgttagacctagttataagacaagactgaactaattaagtgatcggttagttggtaaaacaaaatagtatttcgaacttaattttcacctaaagtttaaacgtgtctactaatgactcgataaactaaaaaaaacagtcttttttttcttccaaaaagtcgttatcaaagcagaattcatctgtcgtcgaattttgaatgagtaggtgcaatgtcacatttccaatattaaaagaaaacgagaaagaaaaaaacaaaatactcctcataaaacgatagaaatgaaataaaacgaagcaagagtaataaattcgacagaaaaaggagtaatttactaattatagtaagagaatcttgctaaatatagaatccaagaagaagtcactctctgtggaacagaaaccttgtgtctgctacaaatcagcagatgacacttacagtttacgtttcatcatgcatgtgagcgacactatagggagaattcggtattggcttcctttgttgtccctaccttatttaattactcctgataactatttttctgtgtatttcatcgtatcgaaatatccaaatttcattcttcatggctgatttaactagtgtttaattataattatactttatacttttttttggttcttaatcacacatgctttcgggatcttgaatacgaaattttaaaccgtctatcatttgtttcctgaaccgggtattgcaaatagttaaatcttagtcaactattttttcgagttttttttaaaaatagttctgaaagacaaaaatacatgagtttgtgaaaatgtttgacagttggctataataattggttgcaatgctttatacttttaccaaatttaaattattcaattggctagaagtggagctgtggtaccgtccacatgaggtggtgtcgtggtgagacattaatatatgaacttttgttacgatatgaaagcacccgacacatacattcttcgtattatcttgccttatatgaataaacataaaataaccaatactaaatttgaaactgtgatacactaaagaaaatatctttggttacatccagctctggcttctgttcaaagtttttcttttgaatttatttaaaggttaattaagatcaccacctaacccacttgtacaacggttctgcagtttttgccatcgaatcccattgtttaattcgcatatttgtatgatctctactttttttttaaagttaaatagattaattaacaaaatgaagtttatttacaacaaaataaatgaaaagtacaaatacgttaaaaaacaaattgtttgccagccaaaaattaattaaatacgtaattttcgaaggtgtaatattccaacttgtttttgtatatttgtttagcttatggagttatggttgtgttattatatattgaatgggctatttcgtgttgacaaataagctctttagttaaatattattatgttcttgattaaacaacaaattaagaaccggccaaaccattgaacagtcgttttctggtctttttcattttattggttacaccttctttgtcataaaatagaaattatgttatactttctttcatgtatcgacacgtgcatttggttagtcttaatcccatttcaattttatatgatttatcatattagcagaaaacaaatatgctaattatcacatagataagccatactaaaagtatttatctgaccttaggttaaaaaaaatattaaaatatagcttataagaaacattcactactgagttgtcatatttctactggccgacttagattgcaacaactaaaatatattttttataaatcatttgacataggcaaaacaaaaacaaatatctctgtaactttttcctcaattttttcttttaaaaaaacacttttttatacaccttttcctgttgaatgtattattattcctattgatcatcacgtgaaatatagaaaaataaaataaaaaagcaaaatccacttttgtgttttccttttcgtttacgaccaaagagatccactttatgctctcttcattttctccatgtaataatttttctcgagagatttctgaaaataaagtcgtttctttttttttttgccttggtcactcaagactctcttcttcactctctgttttttgtcctcttctaaaatttagagaaaaaaacgaaagttttcaccaaaaacagaggaggagctatg

SEQ ID NO: 26638 - DNA, 3003 bp, Unknown; identical to SEQ ID NO: 26637
  misc_feature (1)..( 3003): 2750-1469P.txt file - cDNA_ID_2715166; gDNA_ID_2213636; Annot_ID_181058

SEQ ID NO: 26639 - DNA, 3000 bp, Unknown
  misc_feature (1)..( 3000): 2750-1469P.txt file - cDNA_ID_2715173; gDNA_ID_2213636; Annot_ID_132167
tctggggaaatcgcccaaacagtcgaatatctaaagaaagaattcgaaatgaaagacttaggcaagacaaagttctgtttgggattgcagcttgagtatgtagataaaggaatccttgtgcatcaaagggcatatacagagacaatactcaagagatttaatatggacaaggctcacccattgaccagcccaatgcaggtgaggagcctaggattggatagtgatccattcggtccaaagaaggacgatgaagaaattctcggtcctgaaatgccatatctcagtgccataggagcgttgatgtacctgtctagccacactagaccggacatatgttttgccgtgaacctcctctctagattcagttcttgtccgaccaagaggcactgggaaggaatcaagcatttgcttcgatacctacaagggacaattgattttggtttatattatactaaccataacaaagaaggtttagttggttttgctgatgcaggatatctttcagatccgcacaatggaaagtcacaaacgggttatgtgtttactcatggtggaaccgcgatatcctggagatcaatgaagcagaccatcacggccacttcctctaaccacgcggagatattggcaatgcacgaggccagccgcgagtgtgtgtggttgaggtcaatgactcaacacatacgagccgattgtggaatggtcgaagacaaggagccgaccatcatatacgaggacaacgcggcatgcattgctcagctcaaggaaggatacatcaagggagatcggacgaagcacattctgcccaagttcttcttcacgcatgacttacagaaggatggtgaagttaaggtggtgcaagtacgttcaagcgacaattcagccgatctattcaccaaggcattaccagcaacgacattgaggaagctcgcgcatcaggttgggatgcggaggcttaaggacttatagagatgaccaattcagggggagtaatgcgtgctgtactctttttcctcactatggttttgtcccgaaaagggttttcctagtaaggttttaatgaggcagcattcccctagcgtattactgagatcccgttggcatctacacggttatgtcatccaagggggagtgttgtaaaccacttgttggatggactccataaccgtggcccatgtctttggaggataggtccgtcagcccattggtgtgacggcccatcgaccagtcggcccatcagtccatcggtccatcggcccgtcggcctgtcggcccggtccatggagagaagccacagtcagtccggcccgtaggtccggcccatggagactatacttaggtcggtcatatacttaagtagttatgggcttttgtaacctagcccattagacatgtaacctcctcaagtatgtatatatatgtgatgtaacctcattatgaatcaataagaaacaagttagttcttcacagcatcaatcgtagaaaacaatctgagaaaacataacagaaaattatatcaattttttttcttaagtactattaaacttattttcatagttctatagtctctcaacttttgttttttgttttttcgtggttatattaacatctattacaacttgtttacgcattttgtttattccatatataggtcacagataatgcgtgtgcattaagttttcaaacaagtttattagttctactaatcaggatattaacaattcttttgcgtggtaggtttgtttaacctcttgtgagtttatggttaaaaaagttaatctttctctaccacttaacacttcttttgtgtggtaggtttgttttgactagaagttgtagaaatagaaaagttgtacagagattctcaatctgctattctcttgagtcgttgaaataaatttcaattctatgatcgatgtgtcatgtaaccgttccatgaatctggacacaatcacaaaaagaatccataagttatttggtgtattaattatccgttttttttttgttcacaatattgattatccgtttatagatatgtttccttttgatcaaaaacaaaaagatatgtttccataactatttcaattttttgttaggaattaggtaattttgttataatttttgattctttaacatataaatgaaagggattcaaacctacacaaccacaatctttaatgatacattactatgaataggatttagcatccccacatcttctcaaagattcaagaaagttattcaaaattcaacaaaataacaaagagaaagataataaatgcgaggacgtaactggtaaaatcacgaaactgcctgattcaccttcactattcagagtgtttccttataaatatctatcacacggcgcaaaacgaaacgctcaagccctcaagtttatcttcctcagccgtgtagttcaaatcccggcacaaaactctgtcgtcgcttccccgagaaaaggtaaacgaatctttcaccaacgattaaccgtttctaaatattaaatctggttatctttgatctgtcttttttttgattctatgaacaatttctgttactagtaatcacacattttcgggaggagtgttcttagatttattttcattttcaaacgaaatttgcgattgtgtgttttcgagttttcagatccgtagctttcttcgacgaaattatatatgtatgtatggcttccgattttgtcagtttgtgtctagaaaacgcgttatgtttttgtcatgatgcatgtaatggacattactttggctattgctcataaaataaatcgatgtttttcaattctgtttcttcgtggagtcacacatatatatatatggaggcttatctgtctaaatccgataattagtcgtagaaatatcgttgtgtagattttacttggcaaagaagtcatcttttgtcctttttctcagtaaatcaggtcaaaaattctcacattgttgaaaactcaggggtcacacttaaacttgtcgaaaccaaacaacaatg

SEQ ID NO: 26640 - DNA, 3000 bp, Unknown; identical to SEQ ID NO: 26639
  misc_feature (1)..( 3000): 2750-1469P.txt file - cDNA_ID_2715173; gDNA_ID_2213636; Annot_ID_181054

SEQ ID NO: 26641 - DNA, 3003 bp, Unknown
  misc_feature (1)..( 3003): 2750-1469P.txt file - cDNA_ID_2715181; gDNA_ID_2213636; Annot_ID_132165
tctttgtacttcaatatcaggctttgaatctgttgggagcttcattggtgacatcctctgctttgagctctgcttttgggaatttgattgtgaagaaaccgaaggaagagaatgtttcatggaacccggtttcaaagaaaccaaaggttgagacttgaagaaacacaaagtggagagaatcctgagctactattgattggtcaacccaaaatttcaattgcttgctagaattgttaattttttttatcatatgttcttgacttgagttgcctacttggtttatttgaaacttaaaacacatttcaagcaaaatcataaacttttgtccccatctagttttcttcttgtcctctttctcagtcaacgtgaaagggaagctctaagggttgtctttgtctgtgtctattgggttttgatgacccatcaatattgttcattcatggggaagctcaaaaggtagttttgttgtttgtttagagttaagtaaaaagtttgtaaatttaagtgcaggctacagtcctggggaagctcaaagggtagggtttttgtttatgactcgttattattgttcattcaatgtcagactttagaccctcttaaaatgagagttgatgcttcagtttcttaacgtgtcgcttctgtttctgagtgttttagaaaagttttctcatctatcttgctttcgtctttctttcatctattacgctaatggctaaaagtagtgaggagcctaagttttctttgagacttattgttgatgaagagaaaaacaaggttgttttggctgaagcttgtagggattttgttgatgtactcttcagccttctgacacttccaatgggaaccattgtcagattgcttgagaatcatcgaaaatctgagccagtaactctgggctgttttaacaatctctatagaagtgttgtggacatgggcagtgattgttttgagactgaagcttgtaagcagatgcttgtgtatccgaagagtgtgaaagacctccagtgcaaaaggcttaagctcaacataaaccctactgaggacatcaagtgttttaagtgctcaagttactgcggcttgtacagtaatttcagcacctctaaatgtcgttgcggaaaatttatgaacgaggagattcagttagaaaacgaggaacaagatttaggccggtttcaagatgatgataatggagtatttgtcagcggtaggtgttcattcgtcttaaccgatgacttggaagtgtcagtcaagtccactgaacttgtcttgaataagctcaaatccttaggttgtgctgatgttggtaagctcggtgaaaggcttcttgatattggtgtgaaagaggtatgttagttagtttattcttcaagcgtttgtgttatcattactttattagttctctcttactatatctgaatcttggactaggtactgactctgctgggatgtatattctcctcaaatgctcccttaaaggacattttcttgaacaagaagattacacaaggtgcgacgaagttttacaaatcgcaaagtccatgtttggagaaaaaagaagatgaagcagaacctgaaaaggtagtaactttgaaagcatttgtgaggaagcaggacatgaagattttatttgttgaatgcggagaggaatttgttgagcttcttttctcttttattgctgtcccgcttgaatctgcatgggaaatctctggcagcagtatctccttaggttgcataggaaacatgtgtagaaccttcagggacttaaatgaggagactcaaatgtcaacttccacatgcgcacttccgtctttctataatttccagatgcaactgcctggtattatcactcaacaacctccggtgtactaccgttacaggctctacgattacaggcaaatgaactatggtttgactacaaacggtaatcgaactacttattaccgcaaagacagaatcgttcgggtggatttgaaggatcccaaatcccgtggcagcgataagtctgctcaggggttcttgaagaaagcgacaaagtgtactgtattagatgatctgaccattacatctatgaactcctgctccacagtttgtttactaaagaagttgcagagtcacgcagacgatctagaggtgcaagtaattagtatcagcaatgcagaggtatgtttctgtataccctttttgatcctgtattcttgaaaggaacttgactgacacttgattttgaattaggctttggatttgttgagagcttccttggtgacatcctctgctttgagcacgacattatggaatttgattgctaagaaactgaaggaggagactgatttatgggacacggtttcaaagaaagtgaaggaagagacttgaagaaatagaaagctagtgagaatgaactctaagtcgattgttgattatgtttttagaattccgcaaaatctacattacattcctcatgttttcttccaagccttatctttctttgtaagactaatcaaattattgttttatggaaattcatcttaatagggttttttaaatgcaggcaaaaacttgcacatctttttgagtttataaagcaacaagcctaaaatctggaatttcctagtacgataagactgaaatatacaaccattaccaaaaaaaatgcatccatatacaaaagtttataataagatccagttggtatatagtaattgggaatgttgaagacatatgaagtgttgatcagaaaaaaataagacttgaagttaattaatggaaaccctctttctcagccagaagacttgaaggcttctattctcctccgttgcccacaaaaacaaaatttgcttcgccgttttcggctccggcgtgattcttgagaagaactgaagtagagagagagatctgaaatctcaatctccgatttaacttggtaactagagaagcttttgattcctattctttcttttgatttgtatttcttagggttccgttcatgtaacttttacagcgacaatg

SEQ ID NO: 26642 - DNA, 3003 bp, Unknown; identical to SEQ ID NO: 26641
  misc_feature (1)..( 3003): 2750-1469P.txt file - cDNA_ID_2715181; gDNA_ID_2213636; Annot_ID_181052

SEQ ID NO: 26643 - DNA, 3000 bp, Unknown
  misc_feature (1)..( 3000): 2750-1469P.txt file - cDNA_ID_2715213; gDNA_ID_2213636; Annot_ID_132157
ttggcagcatcttattttatcttattagaaatcaagtttacagtgagttggctcaggaaacaattctagattttcgatattttaatggtaaaaatattgaaccatggtttatttaaaagtatatccatatatcgtcacatgcagcctaataattaaataagcccaataatgtgagtggaggaaggaaggaaatcaatgtttcatgatcactggtaagagttttagtatcgtccaaacataattaaataagcacaatctattgttatgaattttaacgagattttaaattttaactttatgagagatcatttttgtttgggttacaaactttatgagagttcatataaaggatgtttacgagagatgcatgtagtgtaaatgaaatactgtagtttctcactcttggtaatggttacgtgtgaaatgtggcaaaacaaaccggcgaatataattaaatgcttggtttgggcaaatgaaaatatataaggataaaaaacgagagactcaatcaatactcaaagataaatagaaataaatttgggggtgcatttatttcaaagactgacaaaagtactcgctgacactttgtgcgttcaatttaatgtttttaaaccatggaccattaatgctctgtcccgactcttgttacattatgtcttccacaaataatctaatccataaaatctataccgaccacacaaaaacaacaacataaacttttagttctcccaaaagattcttaatttaacacttcgattgatttcagttcaattctaccagattttttttaattgaaatagtatagtttgaacttttaagatgttctgtaggattaatttttgaatttaagtttgactttgaagctacgggcttcagttcgaattgttcaggaatgatgctacgggcttacaattttgatagatacgataaaagcccatactgcggccaattcgggtccatcaagtataactatatattaatgagtatctatcgaaattgtaagtccataatgctgccaatttgacaaccgaacgttgggcgccgaaagaaaatatgaacgtgtttagaaacaattaagattttcttaccgttatgaatatgaatttgaattttgtttctaaattaaaaaatgtggatcatgaccccttacatcttcgttcaaagttcaaaattctttccattcattttttccttttctttcacatgtctaaaactctgctttttgtttcttaatatgttattccacttgaatatccaactcaaaactctttttagttctctcactttctcagagacaaacataaaggcatcatcatcgtagaaggtaagactctggttccatcattttttttttctgtttagctatggtgtttggcttaattaatagtatagtttttggaaccatgaccatgttttagtcttttagatactgctcttatataagtgtgttaaaaaaaagtgttcataagatgagggcttgaaatgttgttgtcttcataaatgttgtatgcgatgtgttaagatggagtagaaaagtaaacaaattggtttgatatataatgtcctctatttatgcctaagaaaacatttatgttatgatagtagaacaattgttagttttaattggaaaaaatttatcaaactgatatctgaaatgttttgttttttgtttgtgttgtagaggctggagaaaaaaggaggaaaatggattgtcacggaaattgaaattcgttccatttggaagatggcggtggaacgagagaacgttgattcgtttatgtatagtaagtacgtgtcttagtctagaatttccatctcttgctaaactggtgcaagagactagattactacgtatatagatagagggtatgaatgatgcgtagatgtatgtatagggttatcatgtgtgtataaggttattatgtgtgtatagatgtatgtataaggtatggaagagatcatgaatgacgtgtagatgtatgtatagggttatattgtgtgtgtattagatgtatgtgtaggttacaaaacgtagcgacaaattggaaaatagatatagccccctaatgcaaacagcaaaacaaaaacaagtaacaagatacctacacatataaacgaataactcaaacgtaaaaacccgtgaactctcccaagcacgaaaatcgaagacatcctcatgaatctattttccgacgccggtggagcttttgctcgccggcgtcgggatgtacttaagctcctccaattctcttgtctcagttccgcatctcgcaaactctttgtccccttttgtcactctcccgaccaccacagcgcttcctttttgctttcggttttggtggtcagagatccacttttcaggctgcccagaacctcttctcccatttggtcctctaatctgctggatactcttgatgaaacctatcccgttgtgctattggcgagatgcttgaagctaaatctgcgaaaatggttgatctcgagcttaacctgtcacctgcgcctagatccatgaagcctagctgctccgctaccctcatcgaccaacgttctcattgggttttagaatcgttggtcccagtgacgaagttgtcgacgaatggatcaaccctaatccatcaaaccaattggtaccgttgtctctcgcctttatctcctccagtgccacatccctcggcgataactctttcaactccgatcttctgctcgccgtcgtctagccgccacactcaaagtctcatcgcccacgccaaaagaaaactagggttttcgattttgggcctattccagttcggcccatcaagttccttgtcttggcaaattcatttatttgggcctttaaggtgtttgaagcccaactccaataggtgtgatcctaatcaatttctgcaaaaatccaggtttgatcaaaaatcttatttgtccattattagccaacgttggtgtcgatatttgaaaccagtttttcatggacaacaattggaacatattcggtcaatg

SEQ ID NO: 26644 - DNA, 3000 bp, Unknown
  misc_feature (1)..( 3000): 2750-1469P.txt file - cDNA_ID_2715222; gDNA_ID_2213636; Annot_ID_132154
agtccaaaatgcaactaaaaatttgccactattgttacatggtttggaggaatatgtctgccgctcataagatccaataacaaggttccaaagctaaatgtgacgctctccgctatcacagtaccaaggcgcaaatactcgggaggagcaaaagctaagttggtgctataaatcttcccttcatggctattcttcatgagaccaaagcaagaaagcttaggaatccctgtctatcattcaacaacttgaagattaataaagatttgctaaaaattaagagaaacacacaaatcaaaacagagtttagctttcattaccttatcaaacataatcctgtaaggattaagatcatggtataaatcaattcctttatcattacaatactccaaagctcttgcagtatgcagagcaactttcaacctcatttcccatttcatgggtcttttctcccctgaaacacacattaaactcttaatcatcaaaccaaaagatatcatcaatcatcaataagagaaaaaaggacaaagagatattttacagtgaaaaagatgttttgctaatgttccattaggcatatactcagcaacaagtaatctctcgttgtcatcacaacaacaaccgatcaaattcgccatatgttcactcctcaatctcccaacagcttgtgcttcattctgaaaaaaggtccaccattgatagatatcaaaaacttgttagcaaaaccaaaaacattataaagatcaaaaaagactaacgatgaattcgaaaggatcaggccaagaaagtctttgaaaccgtttgacggcgatgcgacgaccatcgccgagttttcctttgtagacgatgtttggtaccgaatcgttgtgctccgatacgatgtttccggcggagaaaccgtcggtggcgattctcagctgttctaaactgaactcacggaaaatcaacggataatgtcctccgtcgtcgtcggcatcgtactctctgacgttttcgagatcatctatgaccgttgacgtaatcgacggtgaagaagatgatcggcgccaagacttgaagcaaatgcatcccattatcgccggcgatataatgctcagtcccccgcgccttcaaaatttcctttttttttttttttatgaaacaaaattcaaattatcaaatatttattagcatcttttataatggtatgtaaatttaataaaataatttaatgctatactatattttaacaatggcaaaagatgtcaaaccggagaaattttagttacttgtgtcgtttggtcatgaatcatgctttcgtaaaagctttaaccaaatgctatagtttctactttctagtattattattgatttagtgtggttaattagttaatgggacgctcgtttcgggaatatatatgattttttctttcttaaaaaaagagagtaaatgggctataagcctagaagtacgtttttggacctaaatgggctaaacagctggaatataaaataattttattcttgtttaatattttcctatttataattgaaagagtattataatttttgaaaattccgtattaaattacaaaaagtatgtttttcacaaaacaaaaaataaagtcatacaatgcataaaatggaggtagtagtactaatactagttttaacatgtgacataataaagaaaaatatatattgacattgtaatacgagatctcgactttacgactttgccaagcaacataaatagaatctaaaataggagactaaaagaggaacatcagatattttataatccaataggaaagtttgctagaatacgtggttggggttgtattcaatttcaaccttgtttattatatggtgaacctgacgaaactcgatcgtgattatatgttctttacatgctcttatgtatgtatacacggtctggttggaggttagtggcgatttacttggggcttcagcaaattcgacattattacctttatactcactagattagcattatattcaaaacaacaataggagaccgagacaccaaaatgattctagtcatctagtctgtaccattgacaccaagacagtccgtacgtaatcgggttatttttactataccgaaacttgcagctctcctccaacgatatggttcaaggttcttgcttgaaattatggttgcatttgtaaataacttttctttacgatccaatttgtaaagatgagaaccttatgttcaagtaaacaagagatgttaactagagttaaatgtaattcatctcttgttaagttaaacatcttttggaagcacaagaaactggccaaagaaagacaatttgtctcgatgtgaattcaaattaaaactggagcgttttggagaagccctagagctatgttgtgagcgcagctaagaggggagtaaaaaagagagagatacaatgtagaaagtaagctagagaaagaaatagccactaaaaagtgtaaacttttatgtttctcttgagagtgtaacagaggggatacggagaagagatctcaagtgtgagactctttctctgagggattatgtcttgtaacttacttattctaatggatccccagctgtgacttggcccagacatagtatctattgatgtgaactggggtaacaaatgttatgtgttctctcttcccttctcacatttctctcttatcttaaagtctctgttcttttctctgttttattaaaaagagttggtgttaatcacaaagcataaaacttgaggtgttgtagaggttaacgacatctcaacacaattcatttaatatttcaattgacagaaaaaagatattttttttgtcaacgtgtgcaaacgcgtttgagattgccatatctggctgattaataatttaatatttttattataatataaaagttttgcaaacttcatcaaaactttgccacatctctacaaatacgcgtacgagtctctgacgaaatcaacaagtagaggaaattatcatatcctgacatcaacaatg

SEQ ID NO: 26645 - DNA, 3000 bp, Unknown; identical to SEQ ID NO: 26644
  misc_feature (1)..( 3000): 2750-1469P.txt file - cDNA_ID_2715222; gDNA_ID_2213636; Annot_ID_181041

SEQ ID NO: 26646 - DNA, 3000 bp, Unknown
  misc_feature (1)..( 3000): 2750-1469P.txt file - cDNA_ID_2715226; gDNA_ID_2213636; Annot_ID_132153
tgctacgtcatcatcatcgccaacaaagccgtggatgcctccggcgaatgacatacccaccgctcataggttctcctcgaacatcactagcctcgtgggtggacctcactggacgccggtgcctcgtcacgtggacgagaagatgttcataacgatggggcttggcttagacccatgtccttcgaacgccaagtgtgttggaccgttagatcaaaggttagctggatctctaaacaaccgcacttttatgattccggagagaatctctatgcaagaggcttatttttacaacattactggagtctacactgacgattttcccgaccaaccaccgcttaaatttgatttcacaaaatttgaacagcatcccaccaattctgacatggagatgatgtttccggaaagaaagactagcgtcaagacaattagatttaattctacagtggagatcgttttgcagaacacgggaatactaaccccggagagccaccccatgcaccttcacggtttcaacttctatgtgttaggttatggatttggtaactatgatcctattcgtgatgcaagaaagcttaatctatttaacccgcaaatgcacaataccgttggtgtaccaccaggtggatgggttgtcctcagatttatcgctaataatcctggttagtaacatttctatatgtttagtatttacaccaattagatattaatcgatggattaataagaatatgaaattgtttttttgcaggtatatggctgttccattgtcacatggatgcacatttaccattaggaattatgatggctttcatagttcaaaatgggccaacccgggaaacgagtttgccatctccaccgtcgaatcttccgcaatgcactcgggatcctacgatctatgactctcggacgactaatgttgatatgtcttactaaaagtagcaaagttcgtttaagaaaataaattacatttactgttgactatcaatcgtagtcattgtatccacatttttcgaaatcattgtttcttaaaattcagtatatttcttgtgtttatttacgaccatgcttccatttctctacacgttcccaatccaagactccgagtctccgacattcaaaacattactctgaacgctctcttcacctctatccatacggagataacctgccaacttggacatatatttcactggctatgatacgaaaattaataagattattatttatatatttaacaatggcaaaaaaaaaaatgtcaaacggatataatatctgttggttacttgtgtcgttaggtcatgaatcatacttgctataattttattgttaatttaacactattttcgaaatatatcgtagtaataattgttcacaaaaaataataataataataattgttcacaaaaaaaaaatcgtaggtaatagttaacccctttttttgtttgttcgcgattcaatgtatggaagtttttttcattatattctatagtggttaatgcattaatggaacgatcggttcagagatttatgtataaggttttttttttcataacaataaaaaaaaaggataaatgggctacaaatacgctttagacctaatgggttaaactttatcatctagcccaataatcttcaatcgaagcaactgtggcgaaaaatgtcgttatagaaaagaaaagtaattattttcttatcattagctaatccattgttttcgcctggcaagtcatacaatataattgactgattcttttgattaataaagctaatgagtaatgacaagtccatcaatatttacatgaaaaaatcaagtttttattctttacatttatttataaattaatatgtaaggggtgggtaaagatgtgttggagtcagtaatcaaatgcaactggcattaagtatattagttttcctgatttatattgatctcttaagtcctgagtcttactaagcacgcacaacggtacacatgacaatttcgccttttaaattaaatcgatctcgtgattcacatggcagagttacttagctgtataatgtttatgtgtgccgctgactcgagaagatttttttttaaaaaaatatagaatatggtaatgttaattactaaatgtaagcttcaaatgttttcatgtaagaacgggaatataaggttgaattagttcgaaaacaaagaaatttggattaaatttgtagttatatatttgttcgtgatcagaaaaacaataaattagattttagaagcaatcattaggggtggacatttgattatttggttccgttcgggcataaatgattacacttttgttatataaaaagggatgatcctttatcaaaaaagggatgatcaaagtactttttcatatataacctcttttcagatggagtatattttttacaacactgaaagtgcaatcaaatttgtatataaactaaaaacatagttgttacaatataattataaatctaacagcttcttttgcaacgaattaccttatttttggggtgtttcataaaaaaggtgtttaactttatattatatcatctatttaaacacttatgatgagtttaattgttcaattcataagttttgtccaattaactagttttcttttttgataacctccaatttataagttgaaagagagaattacaaattttgttgaaaattctgcattaaaaatacaaaagcaaattttataaaacaaaactaaataaatttgaggtagtattaatactagttttaacatgtgacataaccctaaagaaaattacagtatataatgactaatccctgagggaagtttgctattttttttttttggttggtcaacgacgtgttcaatcgtgtctagattgccatttctggcaaattaataattgaataataatatagtattttagttttgccatctctctctattagttcgttctataaatacgcgtacgagtctctcacaaaatcacaagtggggcaaattatccttacattaacaatg

SEQ ID NO: 26647 - DNA, 3000 bp, Unknown; identical to SEQ ID NO: 26646
  misc_feature (1)..( 3000): 2750-1469P.txt file - cDNA_ID_2715226; gDNA_ID_2213636; Annot_ID_181040

SEQ ID NO: 26648 - DNA, 2309 bp, Unknown
  misc_feature (1)..( 2309): 2750-1469P.txt file - cDNA_ID_2715230; gDNA_ID_2213636; Annot_ID_132152
gaattcgattacccgttttgaaaaccctaattgcaatggggaagacaacgaagctctcctcaccgcaccactgagactggggagtgctcttctctctgtctttacagttttacaggcaggaaattcacagtccactccatgttgccggaaccaattgggccattttataatatgggcctttttagtggatactaggcccattatatccataaagtttataacccaatggaacgcagcttgaagaataaataccatcatgtggggatcatggcgacaagaagaaagagtagccgaaagagagatgaaagggtttgtttagggtccctacgggatcttggtgagatgatatagaaaaggaacggtaggtaggtacttcttgctatgttgtttggtaagctcgtctacttgatctctctttcgacagcaactcaaacacgcatcataaagaatatatagcatcaaggaaatggccaaggttcatcccaagtcactagaaacgggcggggacgcgtctgtgttaccagtttggaagaagttatttatagcgatggtgagattgaagatcgagagagaaaagtttgttagacaatttctcatcttatttgataaaacaatctgtacacagtatagtatatatacaattggtataatgttaaccggtctgttgaaataaataatattctgcataaccaattaaactggtgaatactcaaataaagtttacgtgtgatatcataatagtaagagaaaagaaaacaaaagtagagtccttttgctttattgagattattgacaatatctaattggatcacagctcaaagtgctcttttttttttttttgctaaaaggttaatatcatataaatgaaagatagttttggatttacattttgattaccataagaaatagacccttgccaaaaaaaggtaaaaaacaaggaaatataaagatggaaaagcagaggagtgaagcttcaaacaagccaaagtcccatgagatttctgaactttttccggtgccgcctcgccgtgatgctgtttagtcaaacaaattacaagctcctcgtgcagaaaaaaaaaacatgatttgtttatccatcaacaattagacatgtaaaattgtggtggcatacatgtgcaaatagcaacagaaagttatatatatacttcataatcaagtaaagattagcatctatgatctaacacagattatttttttctcgtcgtcgacatagaaaaaaacttaaatacagattaatattgtgtttatttttgtcatcacatattaccgaaaaaattattgaagtttctaaagccgtaacggacaaaataacaaaagtagaaaaagtgaggaaaagataagaaacttattactgctgatgtcagcactaatttgtgtatggggattcgtaacgaagagagaaacaaaacggaagtctcctaataggccccacctctttcaacaaataaatatcaaccacacgattaatcttacgtcctcaacaactattaacgtagaccgtacgattctcacacgaaggcctctctttctctttctttcttcctctaataagcggcgaaagagattctctgcaacttgttcgattccttactaaggctttctcgatttacgttaatctgagaagagattgggtttagtgaatcttgatttccgtggttgtgtttttcgattttgcttctactccacgttcttgttgttgttcccttttagctccagattatgcttttctttttgttttcttctcttcgacgatatctgccaccaactcgagtctcagtttaatgaaatgtttgtggatttttggtaaatagtactaatgggtatgtttcttttctcctctatattcgttttcttttccgagaacacaagtagtgtctagtgaggcttgctttgatttggtgaataagaaaggttaggattagagcagcttaaatttagggtttttcgagcttgaatgctgtttcctctattactttatcggttgtgaaactgtacgacatttgtttcgaaatctttgctaataaaggtttcatttttcattttttttgtcaagagttggaattgaattagtcttttctacattgtggtcaataatatccgagtctctcgtgatttagtttatgcataaatctgagagtgtgtacgtaatcatagtgaaagtttctttatttattgctatatttgtttaatggagataagtttcattgcttcttctttgtagatcaataatggctacaagaattgagtttagagatattctgtagcagggctaaagaacatcagagatg

SEQ ID NO: 26649 - DNA, 2309 bp, Unknown; identical to SEQ ID NO: 26648
  misc_feature (1)..( 2309): 2750-1469P.txt file - cDNA_ID_2715230; gDNA_ID_2213636; Annot_ID_181039

SEQ ID NO: 26650 - DNA, 3000 bp, Unknown; identical to SEQ ID NO: 10214
  misc_feature (1)..( 3000): 2750-1469P.txt file - cDNA_ID_2715238; gDNA_ID_2213637; Annot_ID_132184

SEQ ID NO: 26651 - DNA, 3000 bp, Unknown; identical to SEQ ID NO: 10214
  misc_feature (1)..( 3000): 2750-1469P.txt file - cDNA_ID_2715238; gDNA_ID_2213637; Annot_ID_181083

SEQ ID NO: 26652 - DNA, 2528 bp, Unknown; identical to SEQ ID NO: 10252
  misc_feature (1)..( 2528): 2750-1469P.txt file - cDNA_ID_2715249; gDNA_ID_2213639; Annot_ID_132236

SEQ ID NO: 26653 - DNA, 3000 bp, Unknown
  misc_feature (1)..( 3000): 2750-1469P.txt file - cDNA_ID_2715253; gDNA_ID_2213639; Annot_ID_132233
catagatgtgttaattttaaaattttgccataattaggtttaggtgttctgatcgttggttaaaatttggtgtttaaaaagagttttgttttgttggacacattaattagcctatagtttataggatgacactcaccataacaaaaacaccttcaaactctaataatcaccaaactcgaaatgattgatgattttggttgtttactggtgaaagaactcaagaggtttgtttggttcagctaaatccaaaccgggatagaaataaaaccaaaaccttaaaccggcttggaatttctctatccatgcatttgcatgatcataacatatacaatattaaaataaataaataaacatttggggtcaagaacgtacaaaattagatagaatatgggactcaataatatattcataaattttcaagattaaacaaattccatccacaataatgtcccaagtaagtccataagatggtggctgaataccaactaagcaaattcccaaaacctcttattcaattatacaaaaacatgcatctaagcacgtagatggtgtaatctcttgattatttaattaacaatactgaccaaacacaacctcaactgcttcaacattattccaatctgtcatctctgtttgtcttcacatgtttttaataacttcttctcttccttcttcattcctttaatccatttttctcgatcttggctaatccatcatgactgtcaaggtaaacatcctagtactagttccttttcaaatccgacaccgaatgtttgagtttttgttgtggttgtgagcagaaagttgagatcaaggtggatataaactgtggaaaatgcaacagcgcaatcatggaagcagtcacagagatagaaggtaatgaacgaaaaaagactcaagaaatatgtgctcttaagtcttaacatatcatcttgaacatgagatttggtgcaggtgtgaatcatatttcattagatgaaggaaatagtatacttaccgtggtggggacaatggatccggtctgcgtagcaacaaggctgaaaaagattaaacagaaacctgtgatcattagcgttggaccaccaccaaaacctcctgagccaccaaagcctccagagcctgaaaaaccaaagcctccaccagcacctgaaccaccaaagcatgtatgcaagccaccttactgcaacagttgtgatgttgtgtctgttactacctatgaaagtggaagcggctgcaccattctttgagtcatatatcgcgtaccatagccttcatgttaagtcctgtatttagccaatactaattcatcatgttctcatgcttttttgtttatttctttttctcaaatatgaatctctgttgtttgtccctcccctgtttataattagtcgcttctttgacacaagaagtctcatgagttcatgctaaagaaaataaaagttcaaattaaaacaccaaatgtttgattaatttccataaacctgtgaagcagaaagttagtcatgttgacctgaacagagcttaggaagtccttgaaggacatatcttcaagtgctattgggtcgtagcactcttaggcccattaacttcattgagcccattaaattatgcaaaacaagaaatgagacatatggaaacattagggttcttacaggaaaaaataggaaaaagcagggacaactaaacaaaaattcagaaacaagaggcaagtggacgaccacggcgtaagatcaacatgtggtgatgtgcatgagaccaagaccattttttctcgttcttcaacgcacacttggtcttttcttatgtttgttgcatttctttattaggcagaccctctctcttttttaataggatagtaaaaaatatatgattttattttgttgaaacattttgagttaaaacctaaacttatagtaagcatttgtagagtgaatttcctatacgacatctatcaacatgacctctaaccaaaaaaatattgatgaaactactttaagtagtaaaacctaaagcaattaaaatttcctttaaattagtagtttgtgtaaattaattgacatgattgcgtcgaaagaaatcaaaacagttatatcgtgaacttaggagaatgttttatatcgtgtttcaacacatgattgctagcatatgtgtaggtgtcgtagacgttacataacaatcatcactcgtaaatatcaaagtggtttctgagagaaacaaagggttatgattttcccaactgcactagttgtgtattgtttctttcacacgtatgcttctgagttctgcccaaagtggaaattaaagcagagttgggagagatcataatttattagggttcgttatgctcaagtcatgacgtaaaatgaaaatttgtttttattctttcaccaacacaaagaatagctagttatctctttttttatatataacaattcatgaagttgatcagctttatacacatcatccaatcgaattgctaatctagagatggaaatatcaggatagagccaataagatatcaaatccaatggacccattttctccatgtgctaattcatacaatctgtttttgtctgctttatttgatgatgatgctgagcgtttttaagtgtgaactaagatctagctaaccaaacaaaagatggtctcttctgtctttgtcgtataagagcaagagagtggtttgattcaatttttaaaattctaaataaaactccaaccgtgaatccagccatgaaactctttttagaaaatccttttttataacaaataattcctctgcttcttcttcttcttcgtttatttcaccttttttggtttctttagctcagaaaaagcccattctttttttctattcttgtttattttaatcatactgtgcgtttctacaaagtttgttcctttcttcttcaactctctcactcacagtcacagagatctgtttcttttctttttttgctttcactcttctcttccagtgagagagagtgagagaaaatg

SEQ ID NO: 26654 - DNA, 3000 bp, Unknown; identical to SEQ ID NO: 10250
  misc_feature (1)..( 3000): 2750-1469P.txt file - cDNA_ID_2715260; gDNA_ID_2213639; Annot_ID_132227

SEQ ID NO: 26655 - DNA, 3000 bp, Unknown; identical to SEQ ID NO: 10250
  misc_feature (1)..( 3000): 2750-1469P.txt file - cDNA_ID_2715260; gDNA_ID_2213639; Annot_ID_181155

SEQ ID NO: 26656 - DNA, 3003 bp, Unknown
  misc_feature (1)..( 3003): 2750-1469P.txt file - cDNA_ID_2715264; gDNA_ID_2213639; Annot_ID_132226
tcagcttgatgatctacagagaggtctgagcttgagagagtgctcagaaaagcagcttagagaagaagttaggagaatcgagcgtgaggttactgaggccattgcaaaagcgggaataggtggcatggacagcgagctccagaaacttctagaagatgtgtctccaatgaaatttgagaggatgaataggctagttgaagtaaaagacgaagagattacaaaactgaaagatgagataaggttaatgtcaggtcaatggaaacataagactaaggaactcgaatctcaggtacatccatctttttccatttgaacaaaggccattgcacgtttgtgtttgatttgtctaaattctgagtgaaagtttcattctttatgaaacaacaataacagctggagaaacagagaagaactgatcaagatttgaagaagaaggtattgaagctagagttctgtttacaagaagctcgaagccagacaagaaagctgcagagggtaagtatacaagtccataactctaacattcgtgtagcttcttgtttgtgaatcaatagtgttcttatcagttttattgttgttgctgttttgttatgaatggagcacagaaaggggaaagaagggacatggagatcaaagagataagagatcttatatcggagaagcaaaaccttaacaatgagtcttgggataaacagaagttctgggacaattcagggttcaagattgttgtatcaatgtctatgttgatgttagtggtagtctccaagagatgatgaattttgtaatgtataaatttagttgcagatagttgatgaggataatctaactcatgtatgtgtcgtcttcaggtctaatataacagccatgtacttaacataccattagtatatgagttactctgttgacataacagccatgtactttaaatactctgtgacgttatatgtttcgtattcaattctagtataattacataaacggcggacgtatatcaaacagctcccgtagctcagttggttagagcgttggtcttatgagccgaaggtcgcgggttcgagccccgccggaagcatttttgttttgttttccacaaggcccattttgaagctcaatttcaatttaacaaagcctaactctaacatgtaaacgttttcttctcggtagatatgtttcgcattcttataaatggtcggcgaaaattttcaaaatgtttactttttttctttccttgcatctcgacacgtggccccggttcatcctgtaatctttttggaatattccgatatcatatatgtgtatgcatgtatgtatgtatatttgatttctctaattacaaaactacccctactttgtcgtgtttcttactgtccccacttcacagctttgtccaaatattcaaaatgacccatccttctttaattattaatattcggttctttctttcgattaatttaagaactaattataaactatatatatatatataaatatttggctggaaatgtgattatatttatggctgttggttgttgaactagatactcataattttatagcagacaattgtatgacatttaggaagtaattattggacctatgtaagaagttgttcatttaacaaaagcacagattagaaaaaaactgccaaaatgtgatgtaatcaataaaaaataaagttcaatttagtccatttagctaagcaactttgacattgcgagtattgacttctttatttaaaaagttaggaagaaaatggttctgcgaatgtagctactaaaaagaatcaataattcccactaaaataaatgaaaaattctttagattagagtggcataattgctaaattatttatggttaatacataatatgtcagtccaacctataacaacttagtagataaaaaaaaagcagagaagaaaaacgtttaagtaggtataaaaatacgaataaagtgggagggggggggggcaaaagaagtttgaatggtcaaaactcgaaaaagaggaaaaaccaaacccaatgtactttcaaactccaatttactaactcccaagccaacactatctaatctatccccttttttattttattttatttttagatttaattttacgatatgactgtcaacagcgcattatagcaaacgccactcttctcatcaaaaagcagagccacatacattaacattacattagcttcctcatttttattcttattattattattcatcagaccaacaacaaaaaggagataaagagaagaggattcatcatcatcaatcaatccttcattttatggatctactcatatcttgattcttccttctatctctcccttttcttccatctctttttctctgggtttccccggtatgtttcagcaatctcttttttgggtcttcttttaaattctgggtccttcaaagttttgcatacaaaaaaattgtttctttttggtattttagtctcaaatccgatttcatgttagatttttcctctgtttagatcggcctagatttgtttattggccaatatgagatagatagatttctcaatgctctgtgtttttaacatctcttatcttttgttgtttgtgttgaaatttgctatcctctatggattgttccatgatttttttcttatttaggatgctataattttaaattttttggctgtctcctgctttttttttcgtgataattgttttaaatgtctcgttaaaatccaaacttttgcatgttgatagcttcaatatgagttctgggatcacctttattgagtttcaaatctgtgtaattgcctcagttaaactgattgtcttgtaacaaccaagtaattgtaattacatatgtatggtttatgaatcaagagctaacgcttactttgcttatggttaatgttgctgcaggattgagttttttaatctctgattgacagatttgaagagcgtgacaaaggaagaatcttttattaaaacaaattcttctgttttaatcttgggatg

SEQ ID NO: 26657 - DNA, 3003 bp, Unknown; identical to SEQ ID NO: 26656
  misc_feature (1)..( 3003): 2750-1469P.txt file - cDNA_ID_2715264; gDNA_ID_2213639; Annot_ID_181154

SEQ ID NO: 26658 - DNA, 3000 bp, Unknown; identical to SEQ ID NO: 10245
  misc_feature (1)..( 3000): 2750-1469P.txt file - cDNA_ID_2715276; gDNA_ID_2213639; Annot_ID_132223

SEQ ID NO: 26659 - DNA, 3003 bp, Unknown
  misc_feature (1)..( 3003): 2750-1469P.txt file - cDNA_ID_2715292; gDNA_ID_2213639; Annot_ID_132218
ctttttatcgactttgggttcttgttcaatagactcaaactcttgtcttctttgtttgtatcagaaggatcaaagcaagagaaacaaaatgctcaaaacccctcaaagtcatggccctctctggtaaggcttctcaatgatttcagtgagtgacaggatccaattgtgttttatctgatcttttgtttaacagattgagggagatgagattggaaagaattcaacttacaatcccagaagtgactcgagttgttcaacatccactcccactagtgatgatggacaaggttccaaagctccaagtgttgttgcgaggctcatgggtttagagtctatacctgtaccaaatgccttggagccccggcgtaatcctgattttgatccatacttcctcagatcctcacgcaaggcaagcacatgggatgcatatgagaatttgggttatgtaaatctccgcagtgactatgatggtatttcttgggaccatttggattcaagaatgaacaaggagtgtaaccggcctatcgaccgctttcaaaccgaaacgttacctccaaggtcggctaaaccaatccctgtcacccacaataggctcttgtctcctatccggagtcctgggtttgttcagtccaggaaccctgcttctgtaatggaagaagcttcgagaatgattgaaccaagtcctcgggtagttgctaaaacacggttttcatcatctgattcctcttcatcacttccaatgaaaatcagagatttgaaagagaaactagaagcttcacagaaaggacaaagccctcaaatctcaaatggcacttgcaataataagtgcttcagaggaaagcaagatgaaaagagaactacattaccactcaagacacaagagcgaaataatttattgggagaaagcaggtttggtggttcgaagggtaaagtgaagccgccctctgtatctgcacatgcaaaggccaatactattcacaagcgagacagttcaatgctctcaaatggctacagagaccaaaagaagaaggtggaaactaagaaccgcatagtaaaaagtggtcttaaagaatcttctgctagcactaggaaaaccgttgataagccaaataaccagaaacagaaccaatttgctgaaacgtctgtttcaaatcagagaggcagaaaagtgatgaagaaagtaaacaaagttttggtggaaaacggaactacaactaagaagcctggttttacagcaacatcagcgaaaaagagcacttcttcatctttgtcccgcaaaaagaatctttcccgcagcaaaaaaccggcaaatggggtgcaagaagctggagttaacagtgataaacggatcaaaaagggtgagaaggtgataaaatgtaacatcaccgtcgatggcgggttgaagacaggggacgatgatcgaaagaaggacatggatgtgatttcgttcactttctcatccccgatcaaaggtttatcatcagattcgcaatactttttaaaaaagaatgatcaagatgcagagtcagcactttgtttcaataagatagatagtgattctctaaattttctgttggagaaaaagctcagagaactaacctctaagatggagtcatcttgcagtagtctgacccaagaagaagagtcttcgggttccattacaaaggattgggtgaatgggacaagatcattgccgtcagatgatcaggataacggtttatcagaaagcgaatctgattctgactatagtagttcattctacaaaaagaaaatattccaggttagttagtcatatggcaaattcctttctccgcacaaggatatgtctacttttagtagcttatcaatgttctataattcgctatatatgtttccgtaaggttttctgactccactgacctttgaaaatttcatattttctatgacgcaggcagaagatgatgaggaagttaacagtttcagcactgccgaaaatctccaaatctcctgcagcacgagtttctcaagttcacgcaatgattatcaccataacattgaagaaaccgaactctcagaatctgttgctttatcagaagctgaagaaggtcatgactgggagctcgagtacataacggagatcattgcctctggccaactgatgattaaagaattctccttggggatggctactgatatattacctctgagcttattcgatgaaaccgaaggcaagagagatgctcggggaaagatcgagagaaaaacactgtttgacttggtgaatcagtggttaacactcaaatgcgagcagatgttcatgggaacctgcaaaggagtgttggggaaacaagacatttttcttgaaaggagagagattttggcagaccaagtgttgaaagaggctcagggattgaagaagatgagagagatgatgatggatgagctagttgacaatgacatgagtagttgtgaagggaaatggcttgattacatgagagagacttacgaagaaggaattgagattgaagaagagattgtgtccgaattagttgatgacttaattaatgatcttatcatgtgttgttgacaccaatcctttggtcttcttctctccaacatgagagtgaaattgttttctataggataaaaacaagattaggctgaactaaattctgtcacaggctgaactaaatttttatctctgaaatcgaaaatacttaaaagtcttctgatagcacatgaacataaaagtgtcttatactaaaaataaaaaaagatggggtgttccgagaatcgaactcgggacctcgcgcacccgaagcgcgaatcataccactagaccaaacacccgatttgttaaatcgatagaggtaaacatatttatacggataacatatcaccaccgtctttatagggagagactctagttgtttgttcatcggagacggaagaaaattcgaatcatcagtgtttgtttcctcctctcttaaagcttagcccttctcaggtcattgttcttcaatg

SEQ ID NO: 26660 - DNA, 3000 bp, Unknown; identical to SEQ ID NO: 10267
  misc_feature (1)..( 3000): 2750-1469P.txt file - cDNA_ID_2715304; gDNA_ID_2213640; Annot_ID_132263

SEQ ID NO: 26661 - DNA, 3003 bp, Unknown
  misc_feature (1)..( 3003): 2750-1469P.txt file - cDNA_ID_2715312; gDNA_ID_2213640; Annot_ID_132261
ggtaaagaaacttcttctctttaaatagattccttacatagaactaaactataactttggaagaacaatgtttaacgagagattccccacatagctcgcatacatcttgctagttccttcttatcttctggttttccgggagagattattgaacttttgaggtcttaactcacttggtattgtttgcaggagctgttaggagctggaatactgttctgtgcatttggagtgatatgtgtcgtgtctctcttcttcatatactacattgtgccagagacaaagggtctcactcttgaagaaattgaagccaaatgtctctaaaaggttactcatcttagctccactttctgtgctgcttcattgcttgaggatctaaatcgcaaacgcaccagccgcatgtgtagtcactagtcagccatttatcgcggaattttcactgtttggatatcttttaaagaatggttgtatctagcggcaaaatttggtgcgttggaaaagttttaaaattcgaaagtttgcttaatttgtattttaaaacacgcattcaaaattttgtgattgtatgaaaataatgtgagattcaaaattttatgaaacaatattgtaacgtcgtcagtgattattattacacgaaacatattatgacgtcataacaagaaacataaataaggtcataaggaaatcaaatcattgtacgattcacaaaagcctataaatacaatcacgtcctcaacgtaggaagaacacaaagatcatcttttgtggtaaaggaacctaaaccggagagaaaaatggcaacctcaggcaatgcgacggtggccaataagcaggtcatactgcgagattacgtcaccggtttccccaaggaatcagacctcatcttcaccgattccaccatcgatttaaagattccggagggatccaagacggttctggtgaagaatctctacttgtcttgcgatccttacatgcgcattcgcatggggaagcccgatcccggcactgctgcgctcgctccacattacattcctggcgaggtacaaaaacgacgtccatagttcacgcatgttctagattgttacggatcaacacgattttgttacgtttcgagcttgtttgttacccacgttttgtgcaaaacaatatcactattaaaacagagatgaatttggaaacgttgttttcaaatttagaaacattgcaatgtttcttttgaatactgtgtgatctaagaaattgtacctttatgattagaagtgattttctcttacttacagtctctggtgctaaaggttttgatgttttgtttgcagccaatttatgggttttcagtgtcaaaagtgatagattctgggcatccagattacaaaaagggagacttactttggggattagttggatggggggagtacagtcttatcactccagatttttcacattacaagatccaacacaccgatgttcccttatcctactacactggacttctcggtatgttatctctgcttctcttttgttcatgtatgtaattcacttgatagtgagaaagctggctatatacaatgcttgatgtacctctctctatgattattggcatgatagaatggtcttagaagctcctaatcatgtagaatagttgttttggttgctaacatatctaataacttggtcaaaactctacaagtttcagtagtttactggtagtcttagaagcatcgctctgtttctgacaggtatgcccggtatgactgcctatgctggattttatgaaatatgttctcctaagaaaggagaaaccgtattcgtgtcagctgcgtctggtgcagttggtcagctcgtgggacaatttgcaaagattatgggctgctatgttgttggaagtgcaggcagtaatgaaaaggtaaccagaattttcttggactctagctattgatccatttccttatcaagagattcacttgtccccttttttctttctccgttgagttttgttataggttgatcttctcaagaacaaattcgggtttgatgatgcattcaattacaaagcagagccagaccttaatgctgccctgaagaggtcagtatactttgagaatgtaggagacaaaatgtgatatagagatctgattcaaaactatgatatctttcttctcacaaggtgtttcccggaaggaatcgacatatactttgagaatgtaggaggcaaaatgctagacgcagtgctcctaaacatgaaactacacggccgtatcgcagtatgtggtatgatctcacagtacaaccttgaggaccaagaaggtgtacacaacctagcaaacgtgatctacaagcggattcggattaaagggttcgtggtctctgattacttcgacaaacacttgaagttcctggattttgtgcttccgtatataagagaagggaagataacgtatgttgaggatgtagttgaaggacttgagaacggaccttcagctttgcttggactattccatggtaagaacgtcggcaaacaactcatagcggttgctcgtgaatgaatcagacgtctttagttggagaatgagttacaagaatttgtttagttgtgtcggaagtttattcttacaacttgaaaataaagcctcttttcataggcgtaactacaattgcatttttggttgtttattttgattctttcattggtctattctacaattttgtacctatagtaaataatataaactcacaatttttatacggatattctgagggatgtttttttttttgaaaaacaagttcaaaatatttcattattttcgatcagaatcaaaaatattttcaaaaatgttcgtttttttttgcattttccaagaaattaaaaaatcgaagaatatgtgcttcaaataagtgggcttatatgtactaaagcccaaataaatgcgttgtttggtacagcttcacgaacaatctctctctcgatagattcttcttacctctgaatttctcgttgttggaacaatg

SEQ ID NO: 26662 - DNA, 3003 bp, Unknown; identical to SEQ ID NO: 26661
  misc_feature (1)..( 3003): 2750-1469P.txt file - cDNA_ID_2715312; gDNA_ID_2213640; Annot_ID_181209

SEQ ID NO: 26663 - DNA, 3000 bp, Unknown; identical to SEQ ID NO: 10277
  misc_feature (1)..( 3000): 2750-1469P.txt file - cDNA_ID_2715324; gDNA_ID_2213640; Annot_ID_132257

SEQ ID NO: 26664 - DNA, 3003 bp, Unknown
  misc_feature (1)..( 3003): 2750-1469P.txt file - cDNA_ID_2715332; gDNA_ID_2213640; Annot_ID_132255
tcctggtaagttgtttcattaccaaagtaatcaattgtctgaatatatgactcggaggaaccatctgctaagacttcgacttcgaccggatgcccaatgattgctctgccatttaacttactcataagggagacaattgggacaggccctttctgatagcttcctcgcacttctaaatccacatccatcaatgaagaatacgtttttctgccaaaatgtcgttcagaaacatcaaactcctgacctaaaccttcgagtttttcctcccctcgcttcttcataccaatccggccttcccaagggtcatcatcccagtccagcatatcatggctgtagatgttcttacatctagatgcaaccacatttgagagctgataatcatcacctggtacaatcattctgtcaccgaactgcctttcgttgggatcagtgtcatcagttccatcgctcatatcatttatcccattaaaatctaacccataacccataggcttttggccaaatgcccttctcttatattcacaatatcttccatcttctagacgattacggtgcaattttctcttccgtgcagatcttcttggaagagtccggaagtttctttttcccttgtgctgccagttggaaaccgtactagcctcattattaggattttgggaataaaggtaggaagagtcgccagaaatagatgactcataatgatcttcctcactgcttgtactttcatcttctcctgacgtatgtctactaaaagtattgcgtcgctcggaatgacgcccagctcctgaaaggagaaatttcaaactctagttagggaataactaatacctatgcgacacatagaaaattgtggtctacgtaatcaaaaacattaattggttttagtgcagaggcatgatacaaattccagtcaaagaagaatcaaatatgaatatagtgttgacacaactgaaaaccaattttcgcaaaagtagaaaacatttagatgataagaaaaactagcttttagctgtccagaaatactttacctgacagcaagggaatgtcatcatcagtatcctcctccatatcagaagaatcagtttcagattcagaataatctgattccatatcttccaaaaaattaggagggtcataatctgaataacgagtatcaccaccggcaaaggaggaatgcattgcgtccctgtggcttagcaaattctcatgtaggtctgaaacatcattagattcacttggtgtaaacatatatttagtccttttagcctccgccctactcttagttttctcctttcctgaaacagagccaaaaatgcatatgaatttcatgtcaaaaagagccagaagccttaagtatccaaccatctaggaacaaaaacttggaagtttaaaagtacatcttaccgagggtataaatgggcctctccatgctatgatccccactggaagaagctgaagaattgcttctggcaagatacttaaaggaagtatcaggaccattggaacatgaaatctttcgctttgaagaggcggttctaagtccaaagtcctgcaagcctctcattcgaggcacagcctcatcctcacaacttggttgatcttcctctttatctctcagcaaatgcataacatcaccaacatggttggtccttagataatctgtggattcccgtgtcccattagaggtatcctgaaccctaactatagccattctctccttggttgcatcaagagagtcatctctagccttttcagggactagtttcccttctcttttcagcatttccttttccagttcaagggcatggagaatggcatcttctctccgagcatacttctctctcttttttattatcatcgcttgcgaagattctaccctctcaatgcattcatcaaaatcgccacaccgaaatggcttgacccgcttggatttctctaaattgtaccaatccctaagcacattaaaatacgaatgctttcagtaatcaatccaaaagaaaagagagaagttcacacagataaagaagagacttacacacttgcatcttctctcccgaggagcttcaccggagttccagatcgtggcgacgtgatatgcgtagagtcaagatcttcttgtccaagtatcctccccggccaccacgagccattcctcctcctcacccacacaatcgatcccacagtccaatcaaccgcacctgatcctggacttgccatccttgtctctccctctctacactcaagatcacactttctctacgggtttcttctacgtcactaaccacacacaagcctcaaaagtccaccattctccaagaaaaatctttctacggttgtgtattgatctacctgaaaatcagctccgccgccggtaatacagacgaatcccggcggatccaaaaccacaactgaaacagacggaagagaaggaagtgaatccggcgagaactaagctttccattcagatttggaaaactcccataaccctacgctctttaacgccggttaggttaaaacctttcctctctactttttccaccgtccctctataagctagctacgtaagcgagttctcgtcgtcctcgtctctctcgttctctctgaaacctccgcgtcctcgtctctctctcgttctctctgaaacctccgtgactctttcgccttctctctctctctctcctccggatgatggtgattgcgagcttcgcagttcaattaatttacacgcgctcctcaagagcgcgtgctttctacgttaccgaatcataggcccatcttacgatccaaaatatgggcttttatattttaggcccattaaattcaaaatttacgctgcaacggtcacttgtgcgcaagggagttagggtttatgttcgcctaatggtataaatatccttcatcttcggatctttagagacatagcagaaacgtcttgtttttcaactgtcattttctcaaccagatcaaactttttgttttcattttctctaattcgtcgccatg

SEQ ID NO: 26665 - DNA, 3003 bp, Unknown; identical to SEQ ID NO: 26664
  misc_feature (1)..( 3003): 2750-1469P.txt file - cDNA_ID_2715332; gDNA_ID_2213640; Annot_ID_181201

SEQ ID NO: 26666 - DNA, 3003 bp, Unknown
  misc_feature (1)..( 3003): 2750-1469P.txt file - cDNA_ID_2715340; gDNA_ID_2213640; Annot_ID_132253
cttcttctctttccttattcctgcgtaaattaaatgaactaattttctactgcttcaactggtaagacacagagttagaataacctgttctttactctaataatattcctctaatcagggccacccaatcatataccctaagggtagattgcaaagccagatttgtgggctaggaatattcctatttcgttaacttaatacatagatgctaacatattgttcatgttccaaaaacaaccagatattataatttgtaaatcaaaatcacctttgatcactgctcagctaagtatggctatgtatctcctcccactaagatactggacatcaatctcaatctctacttcaagtccatacatttcgaaagtaagagtggccgaagttcaaacattttaaaagccaactacgagaactcagaatatgtgaaagccaaagaaaagaaaagaaaagaagtgtttcacaacaaggttcatggagaagcaaatacatgatcatcagtattctttccctaatctatctaaagcaacttaggatgtaccccacgcttaaactcaattatctagaacctcaaggacgattgattactctattctacgctaatcgatcatttagtaaacaaatgccgattgcttggtatgggtcaatctatggttcatgatcggttcttgtgtctaacaaagcatatcaaaagcacatactactagttcagatttcagatgcatcagtatatttgtataaaaagggaaatgcacctatgagacaatttggatttcacccggaaatcaataaccagacattgaacacaactaaacaaaagggttccctgattaccaaatctgtatccacaagctctaattcatagaatgcataagagaaatcacagtgggtgtggcacagaatcaattcaataaaaccatcaatcatgtgtgtgtcattaatgcataatgcctatcctgaagagaagattatagagtcaatcaaaattcaacaagaaacaatcacaatctggttacaaataagaatccaaacatagaaaagtaggataaaatccttcaatctccacaagataaaagacacatatcagaaacgttgaaaaagagaaaacctagccaaatgggaaagataaccaaaaaaggcattacactaattgaacctgagacgagacgatcaatccttgttcctgagcctctcgatcctctggttaagatgctcgatcttgacaaccaaattggtgactgagtaaaggatccagtagaacacaagtgcagccgcaatgagaagcgcgtttcgctgggatttcatcatggacttctggtgacgaagatgctctgacggtgtgcaggaatcgccatcgcacgaaggcatagtttcgtatttccagtagatgtccattaagaggaagagacagaaaggaactatggagagaaacggtttgaggagattacgcgtgacggcgactaatcccttgcggagtccgtcgagtcctggcatcgtcaatagcaccaccataatcgcttcagccgccgccgcgtaacctaaaaccacccactcgagcgccattatcaccggatcaagctagatctgaagtctcttctcttcctcgcaatcgcagcttgaattttctattttgcagactcattttttgctggggaagaaaagagaagatgtaaggaacgtgatacacgtggcggtcaacgcgtgtcgcacgtcgattaagagggaaaatgggcttaaatgggctgaatttgctaaaactcggcccaaaagaaaagtatagatatattaagtagtccgtttctttaaagtcggctttagattcacacagtgtcgatttgtcaagtaacggcgtcaaaagcgaaacggcaacgtttggtaggtgagacacgtggatcagatagtgttttgtctcctaatccaatctctttcaaagcatacataataaatgcatatatataagcacacattaaacggagttaaactcatcatacattactgactaaaagaagcaaaatcttgagtagaaacaaattttcctgtatctctctctcttgtaatctccgacgaagaaacacagttttatggcaaccaccagatcgaagagctttcagttgatcaccagcttaaggaaacacctagttaacacacgcgcttccacacgcgccaccgcctctgctctcttcccttcacggtatcaaacactatttctctttctactttccttcttccaaattatttgatgtttcttaacctaagtaagcaacaaataaagagagaaaatactcatttttctgtggaaacaataattaattcccatgaaatggattagcctatagtaggaccttgattataatgaaactgatatgaacatatatatctgaaatttttaactatcactggctcgttggtaaaacaattttgtattttccacttgattaagtacaagatgatattattcccagatctagaaagttcagaaatcagggtttcttctaggactacggattcagatcagttaagttatataatagttgtgtattttatgtattcaatgtcatatatttgctgaattcaaacgcaatggatctgaaaagaaccctttgatgtttgcaaaagtgtattttagttttaagtctgaaaaaacttgtttttgaaaatattaatatagtttattgaagataaatatattcgtacagaaagcataagcaatgtactagtgtacagtgcacaaaaaggcatatgccattaggcgtaaatggataataccaaaacaaatccagttcaggttttgacacgtggtagtttagtaagtttacatacatacccctgtcgaaaactcgcaggtaagagtgttattagcttgacccaaaactcaaatctcaaaactgtaaccaaatcatgatttttcatcttcaatatgaagccacatttagttacatgctgtgtagtccatcttttcgtaacagtgtaacacattatttttcatttatgatatgagtagacatg

SEQ ID NO: 26667 - DNA, 3000 bp, Unknown; identical to SEQ ID NO: 10265
  misc_feature (1)..( 3000): 2750-1469P.txt file - cDNA_ID_2715342; gDNA_ID_2213640; Annot_ID_132250

SEQ ID NO: 26668 - DNA, 3000 bp, Unknown
  misc_feature (1)..( 3000): 2750-1469P.txt file - cDNA_ID_2715346; gDNA_ID_2213640; Annot_ID_132249
tcaagaacagatggagtctcttatgttgggtgaagaacgcagacgcggaaactacaccagagacgtagacgcggacgcagatgaaggtgttaactctccctcttcttttccaaactcccctgatgattcggaccgtcgcagttcttcttcttcttcaaggtaatgagaatcagaaagttccgcttttaacccctggctttagtaattgtcagaacaaaccccaatcattagggtgtattcttaaacaatcttatagtttaggggtataattaatttctgagatctttttcgttgtaaagaaactttttaatcttcctaccacgaatttatgtttgggaaattttgataacaggagaggattgtcgaaacattacaaaggtaaatcacaatcgttcacaacgttggcagaagcgctaactgtggaagatctcgcgaagcctgagaatccattcaacgcaaagctgaagcagcgacgagagagccctcactgtcgtagattatcaggatgcggcggcgcatcggagcgaaatttaagtgtccacgacgtttttctcgctgggaacgatagaccgccgcgactttccggtaacagaccgcctccgagagcccagacgctctcggcggctcatatttcggctttgctcactcgaacctaaaccggaagagaaccgggtttcgtttgggacgatgtttttcaaatcttttgttttctaatcttgtacaagttgttgttactttaaagtgttttgactcttttgataattttgtaagtttcagtttaatttagagagcacttaacagtatatatacaagtaactgaccaattgaaaatgttctgtatttttagatgtgatgaactaagaaaattaaaataatgttctgtatttttagatgtgatgaactaagaaaattaaaattgatgaattaagaaaatgaaaaatctaaattcttagagattgatgggctggactagaggagtcgcagttatctatattgggcctacaatgggctttcttaatttacagcctcttttttttgcggcaaatttacatgtctcttagctttcatatttacaaattttacccacttatactaactagtacaaattccatcatgtattttctttgtcattaaaatacaccttactttttgttttatccaattcatggcagaaattatatgtagaatgctaaagtctagaaatgttttggggtgtattccgaaataattaatagttaggtggttcttttgaaatttcttaatgattattgtataatgctgtcaagatgacgtggagacccatgggatgacgaagttttcactggcacgatccattcttcatcgattcaaactcttggattgatttcagagatcaaaagataacactttctcagatcttaaatttgtttgaattcctgctcttaaaggtttttgattgtgcaattttttcggtaacaatggcttccttggagatgaatgacctaaaaagtaagtgttccaatcataaactctttgaatagggatgtgataatgaactagtatccattgatcttgaattgctgaatcgttaaggaatttgattgatgtggcagagatagggctaggtttgactggatttggtgtgttctttacattcctgggagtgatatttgtgtttgacaagggactcatagccatggggaacgtaggtctatttataccatctttggtgtgtgttctttacgattttagcaaggctttttaagggtctctgtggtctctttggacagatcctcttcttagctggtgtgactctaaccattggaatcaacccagcaatccaattctttactaaacggcagaattttaaggttctttcatgaatcccttgtgcttccaatttgatgactattattaatacaataatacatcttcttgatatacatacagggtactatatcatttggattgggtttcttgttggttgtgtttggatggcctattttcggtttgcttcttgaatcatatgggttccttgtgctcttcaggtgggttttcttctcctcaacaacatttaatggttttactaattcatttctagttttgatttgctgactcatgtctttcctttattcttctgtaattttaaagtggtttctggcctacacttgccgtcttccttcaaaggatacctctattaggctggcttttgcagcaaccatacatcagatcggtacattcattgcaacttctctctgttttactatttagacttatttgccttatccaatcaaacttttaccaactatatatattggtcactgaatcagttgctggatcgctaccgtggaaggcgtgtccctgtctaaaccttctttgcctttctttctttctttttgtgtgcgaattgaccactatccaattatgaagcttaacatggcatttagagttcttaacactctctagtctcttgtatcatatttgacataattggactgtacaaaaacaaataccttttgtattttattttaaatttacaaaattttacatatatgtaattagaaacctgatttagcaaattagagcaatcagaaacattcatgaatgccaaaatatatacgcaaagtaaccttcaaagtttgtttcacatcgacacttattataagttaactgtaattaaatgttggttcgtctactgtacacatctccagtactatagtgaaaaataattcacagctcttgtaaacgttattattcacaattttaattagaacaacaacaaaaaacattttaaaaatcaagaattccatgctaaaagcacgtttcatgatctcacctactcaaaggtccaacggatttgaaaaaaaaaaaaaaaatgaccactgattaatatccacagcagacaaaggcactcataaacattttataacttttgtggcctataaatgcatacatccacattcatgtcggtatttacaatttcatatcaatagttacgtataaacatataatcagaaaatg

SEQ ID NO: 26669 - DNA, 3000 bp, Unknown; identical to SEQ ID NO: 26668
  misc_feature (1)..( 3000): 2750-1469P.txt file - cDNA_ID_2715346; gDNA_ID_2213640; Annot_ID_181195

SEQ ID NO: 26670 - DNA, 3003 bp, Unknown
  misc_feature (1)..( 3003): 2750-1469P.txt file - cDNA_ID_2715356; gDNA_ID_2213640; Annot_ID_132246
ccattttcagatgataacaaagggtcagttcacatttggtgtgcactcgaagacaaacaaatttcgcatgaggttttactctacttatgtgataagcttccatggataaagcttcatgaagtccctgatgctggacatcttattatccatgagaagcagcattttgaagacattattaaagccgcttgtagttgaaggttaaaaaaaaaaacttaattcaatagtttgtgtgtggactggatttgaaagttgatattatataaaatatatgttcaatgtcacatatatatattttgttacaattaaattcattttactactaaatccagattttatatctgagtgtttttaatgtgtaattaataatgatatattatcaggtgttatagtttgtgtcaataaattttacttagcgctggagatatatacaatcatggttgacaaatgtgggtcaccgtgcaagaaagtctataatcttttgctttgaaactgctaccaccgtgccacgacacttggatcaaagttacaaagcagtttcttaaaatctatgaagataagtttgtttttctttctcttacagattctaaaaatgaaaatgtctaataaatccaaaaaatattcaatatgcaatataaataataaaggggagttacacaattgatataaatgcaaaaggacaaccaattcaataatagtaatgcaagataagttatcaagacatgtgtaacaaagagagaaggacaaaaagaaatttgtaaacaaaagtggtcatgctttacttgccaacaaaaataaatagtactacattattaagttgcttggaccaaagataccattacatcagcgcatttttctctctaataattgttgaaattgttaaacatatattagttcctgagtttcttcttctttcattttctttaaatcaattctagtcttttggttccaagacttataggctaaataatggtgcttctacttgtgattgtgggattaataagctattatgtctacaagtccataacaccgccgccaccgattccactgccggaaaatgtttccgagatatctccaagaatcaagctcaatgatggaaggcatttagcgtacaaggaattagggtttccaaaggacaaagccaaaaacaaaataataatcgtccacggaaatggaaattccaaagacgtcgatttatacatcacacaggtacacaaggattgaattaagaacgaaataaagaaagagaccgcaactattttaatactttttggtggtttatttgtacaattaatgattgttatgtataatgaataatactatttgcaatgataacgctcctctggctttcaggaaatgattgatgaattcaagatatactttttgttcttcgatagagctggttatggagaaagcgatcctaatccaacacgaacgctgaaaacagatacatacgatatcgaagaacttgctgacaaattgcaagtcggtccaaagttccacgttataggcatgtcacttggagcttaccctgtttacggttgcctcaaatacattcctaataggtaaatatatcaatcggttatctcttaagaacattatcaaaaaattgaaatattatttgtgatggtcacttctcaatacttatcaaaacaagttcttacgtaaaagacatttgctttatccatttgtgataagaattctcttgtttcatcctcatcgtttaattaccataagtccataagtgacgttatactataagaccaagtgaccgacttagatatttcacttatacaaataagattataatgtagtggtttgtatattagccttaattgtttttcttataacatcgataggctcagtggagcttcgttggttgttccgttagtgaatttttggtggagccgtgtgcctcaaaacttattgaatgcagcgatgaagaaattgccaattggatttcaattgacacttcgagtcgcacactactctccatggttgttatattggtggatgactcagaaatggttcccgaatagtcgaaatcccaaagatactatgaccgagcgcgacctagaactcgcggaaaagcataccaaacactcttatatcaaggtatatatattacgaactttatgatccactctcttttttttttttttttgaaagaagtaaacattcatgcatgaatgctattattactataggagtctgctttacgacaaggtggatatgtgaccacacaacaagacatcatagcgggttacgggaattgggaatttgatccaaccgaattgaagaatccgttttcggatagtaacaaagggtcggttcatatgtggtgtgcactcgaagacaaacaaatttcacgcgatgttttactctatatatgcgataaactgccatggataaagctccatgaggtccctgatggtggacattatattatccatgagaagcggcattttgaagccattatcaaagccgcttgtagtgactagtggaagatacattataacaaaaaaaaactctaaaagatttgtatctaaaatcagtttaagaaaaattatggctatgtaagtttcatgtgacaaagaacattatctaacctatttacaataatttatataaatctggtatgtcagatagtacagtttacaaaaaaaaaatcaaatgtcaaattgatccaaatgaaaaatatcatgacatacttttttgagcatgggagagagtcggatggagacacatgaacgaaaggtaaagttgacccaaaattgttactgaagtcctcactttgatcacgagatttgggttttgtgatttgggccttaccctaacccatttcgattgagggcattttagtcattttatataaaccgacaaaccggtaaaagcaaaatgttttcccactaaaagactgaaaaaaacactaaaccaaaattaaatcatcaaaaatcaaaatctctaaaatcaaaaattcgcattttctctctcgccggagagatg

SEQ ID NO: 26671 - DNA, 3003 bp, Unknown
  misc_feature (1)..( 3003): 2750-1469P.txt file - cDNA_ID_2715363; gDNA_ID_2213640; Annot_ID_132244
ggagtatagtaaatgccaaatttgttaaagaacaatagaatgtgaactgtagacttttgtttgtgtcgtctttctgtttgcttcaacttgtatcatctgcttaaaagagttgttgcattcgtgttttgatccttgtggtaggtcaatgagttcaaatcaattgagaagttcaagatattcaacacaaacaacctgtaagtagatcacgtccctaatgatagtaaaacaaaataaacttatttgatacacactaactgtgtaagtttacagatgggttaacttgaaggccatcaaaaagcttgtggaagctgatgcacttaaaatggagatcattccaaacccaaaggtgcctgcgtggctaatgcacagttttttatttctgcaattttttcattcattattatctaaccaaagaaaaactgcaaattctattcaggaagttgatggagtcaaagttcttcaactggaaactgcagccggtgctgcgataagggtatacatgcctgtcctagtggcacgttttgaaatatagaatgcaaactctaatcttttcttaactcctttttcgtgtgattctgtctcaaaacagttctttgacaacgctatcggtgttaatgtacctcgctcacggttcttgccagtgaaggcaagttcagacttgctgctcgtccaggtaaactctatacaccacgtttaacaacgcaacagagtaacaaatatcttttgaaacatttgattaatgatttaagttttctttcttccacagtctgatctctacaccttagttgatggctttgtcactcgaaacaaagctagaactaacccctcgaacccgtcaattgaattgggacccgagttcaagaaggtaaatgaagaaaatgatttcctgacaagtcccatttgtcatttctatcttgactcttgagcctcacttagtgtgtctgtctaacaggtggctactttcttgagccggtttaagtccattcctagtatagtcgagctcgacagccttaaggtgtctggtgatgtctggtttggctcttccattgttctcaaggtatatatgtaaattgttcattagttcacaaggtggtgttgatatttatatatgctcagaatggtttcttttggatttaaagggcaaggtgactgtggcggcaaaatccggtgtgaagcttgaaattccggacagggccgtggtcgagaacaaggtaatgtaacgaatcatggttatgttcaaactccggatgttttctttttcgccacaattatggttgaccgtttgattatgtgttgaaaaactaataaatttatcactcaaacttgaaatttggttttaggcggttatgatcttggttcaggattttcagagtaatcaccaaaatgaaaattaggattgaatttgaggttttatcttttcggctaaaccgaattggcattctacatctttagtttaaacctaaattattttgaattaaaacttaccattgtgttttttttacagaacatcaatggtccagaagacctctgaataaaacaaattcaagtcttcttccctctctcatggaagacacatcttgatactcctttaattggtgtgaaaagatcacaagtggcacagcaaagcaagtttatgaagaaagaataaataatgtttctttttctttttgcagcttagcaaagtcttttcctctttggactttattttaattttgctctttgaattttcccaaaacatcacatttatatgttcgattatatttgggttctatccacaatcatttttctttttgataatccactctttctttccacatgctctttgcttggaaactgatggagtactagtttattacatttatgtcgtctactaatttagattatgtcactgatattcatacagtgtgacatgtttattttcggttttcgtccgtttgatttgtagaattaagttggggactaattcgtatactaatgaagggaactaacacaactactacttatgaaggaaaatgcaagaatgaatactaataaataagacgaatacaactttaattagagttctcattggctaatttgtagaataatcgcaaattcaagttacttgtgtagaattactacatcaccaagattcttattcaaattaattgtcgcgctcccgtgtaaaattattctacaagattcttatgacttctagtatgtaataatttttgcttacgagttttggaaacaaatagatttaattacaaaggtatcattcaaatgaaatagaaaaccacatagtagcctaccaaaaaaaaaaaaaaaacatagtaagatgttcacatgcatacactacacatacgtgtattgaatcttattggtaatctaacatcgtagattcttaattgcactttttaattattgtttttaaaattttcctacttttgtttaaacatgtcacgatctaaagcatgagatagctgtcggttacttgaaaaagtggaataaaaatattatgtgtcattgagataatgagatgttacgtacgcgtccaatttattatgatctaatacatcttatcagataagctcttctttattttccatctttattcaaatcttgacaccaaaaggaaagaatattttttattcaaatctataactcatagattgcatctccttcttactttgtttgattagattgtattagcctctgtcttgtcttttggttagtataagtattgataaattcctttgaccagcaagatatcatcactaaaagattttacattaccaagccatctccaatatcatcaggtcggttttctctcgatatcaattggttacgcatgcatctatcatatcttaaagtttattcttctttcattattcttaacccaaattttaatttttatggaacttactaaaacgttgacgatgatccctactgctagtttgttttgaggcatgcattgaaagtactctttgcggtgttccctcatatattacaggtcaagtgatg

SEQ ID NO: 26672 - DNA, 3003 bp, Unknown
  misc_feature (1)..( 3003): 2750-1469P.txt file - cDNA_ID_2715367; gDNA_ID_2213640; Annot_ID_132243
tttttgtatcacttgagttgagtggtatgattgtatcattttgaatttacgagtcaaaaattgaatttacaaacaaattttttctgtttaactaaaaaaaataaaactaaacactagtcaatgttttcttcgatttctataaaatggattaggaaaaaattgcgagtcaaaatttggttgacaaataaacggaagtattttttccccaaaataagtgaatgtactggcacaagaaacataaaaaaaatcttttctcgtatatatctaaattatttctcgatattcaagatttctaattttaaattttagaaacaaaattttcgttctatttctttttgtagttgcttattttttttttaatcaaaagtatgacttatttacaaaatgttcacaaaaatgttgctttttttttgtcaaaacacaaaaatgttgcttatttaagattatttggtcttatcctgattttggtttttggagtttgaaaaaaatataaaaataaatgaattaaggtcacaggtcatatataatttaactcatctactatgatgctagtctaatcagctaaaaatatgttaagctggtcggataatttttattttatctctaggttctaaccctatgacatgcaacattattttactacagtaaattgtttgatattggttgtatcacgtatagtttttacaataatgtgacgtttgatcaagttatatattatattttggcagtcataacgacaggagaagcaagaaggagtgtaatgaaattaggtgagagaatggtgaagaatttcaacgaaatgctgaccatgtccggaaaaattgactttccgcagcagtcgaaaaatggagtgagagtctcgattcggatgaacattgaggccggtcaaccacccggtatagttgtcagtgcttcgtcttctctcgcaatccctctcactcctttgcaagtcttcgctttccttcaaaacctcgacactcgtcaacaggttctttcttgatctgcatgatcatcaaaatttctcaacttaaatcacgtattaacaacaaaaacgtttacgtgtaacagtgggacattctttcctatggaaccgtagtcaatgagatcgctcgcattgtcaccgggtcaagtgaaaccaactgcgttaccattctccgggtacatgtatatctctctctcttcaacggtcttttaactattaatcgtttgttggcaaattatataactctaataacctataatcgtcgtacatgtgtatatatacattagccaacgcacgaagagaataatgacaagatggtggttcaagactcatgcaaggatgatatgttgatgctgcaagactgctacatggacgccttgggaggcatgatcgtgtacgctcctatggacatggctacaatgcatttcgctgtctccggcgaagtagacccttcccatatcccaatccttccatctggtttcgtcatctcaagcgacggcaggcgatccacggtggaggacggtggaaccttactcacggtggcctttcagatccttgtctctggaaaggccaataggtcgagagaggtgaatgagaagtcggtggacacagtgagtgctttgatcagctccactattcaaaggatcaaaggtttgctcaattgtcctgaatgttgagtgagggaatatgctgtggaagattctcttttgtttttgttttgttttgagatatttctgtcgggggattttatgacctcgattggttatgatggttttatggacatgctttaagtcttaagatatttccgatcggtaagattacagaccgattgatgaaagtaataaaacaacccatcctatcatgggtttttcttattggttttggttggtttattctattggttataataatttactcacagtttgaagataaatgcttgataataatgacgaaatcgtaaatgtgattgaacatttgataaagaagaatattcataaaaatacactaattatttagttatatatttcacgaaaaattcataagtttatgaatgtttcagaaaataaataaactaatttagctttcagaaagtaagatcagctaacttttttgcaaatacaaaaacagacaatctgtatattcttgaaactcaacattcttaaaattcttaataaactcttacaatattccaaaaaaaatcttaaatttttcaaatttcagattcataaatattttatttttatttttatatattaactttgataatttggaataagatataagaataacatacataaagtatgtattttgaaactactttttttagtaaaactagaaaatgttatacacacaataataaatatgttcatgagtgtctttttttttggtgtaatgctatgagcttttacatgtgaacatatagcgtttctgaaatcaaacttttacctccttttttttttaaaaccacttttacctccttataaattgatctttatatgtattctcttagaaattagtttgcagtttgtatgcatggtcttataaaaaatactattatttaatcaattttataaataacattatttataaatctcttaatagtttaaagttaatttggttctgtttatgtaatatgttgggctattaagctgtgtaccatttatttctaacacaatcaatagagaaatattttatataaaaaaatcaaattctattattattatttatttaaaagaactgaaaaaaggaaacaatatattgacggtaataagaagaagccggacggacatggaaaggtgacacgtgtatattgacaattggctcagataagacgacagagatatatatatttgcggtaacaccacgcatcgtcacttcatcaccactactcccttggcctataaatatttctctgcttttaatttccaatttgctctgattcattcacaaataacaatcctctcttcgtttttgtttttcttttggatccaaagctctcttaaatctgtaaatcaacaatg

SEQ ID NO: 26673 - DNA, 3003 bp, Unknown
  misc_feature (1)..( 3003): 2750-1469P.txt file - cDNA_ID_2715371; gDNA_ID_2213640; Annot_ID_132242
gttgttgttgtaggatcttgctgggtagtgtgagcaatcatgtggtgacaaatgcaacatgtcctgtcacagttgttaaggctaattaaagtgtctcttgttctttaattggacccagttaataacattagtagttacgtgtgtcactcatgcattgttttgacatttatacgtttgttgccttctacaaatttgtgtgaaactgattggtactgtttcattaataaatttcagttaaatgatatttactctctttttgtttgtgatttgtgaacgttacgtaaaaatcacaaaaaaaaataattagtttttctaattcattcatgaaaaatcttcgtggactaaacaaaaaagatgtgaaaaaacaatccccatgtttgatccagattaattcgatccgttaatcaaaagatggtcttaatgagcataattcggggataaagtcgaatatagaaatagttgttgaaaagagaaatgtttggattgaatcttgtcagcttgatgtgtggttgatcacatgaccaatctatgtatggaatatggatgtcgtgtgtgctgattcattcagatatgacaagtggtggatgggataattcacgatatgggccagattatgagtttgttttaacttgaatggcaggccgaatcataatggattcatgatcattatgtttgatcatagcctagttggacttgtatccctagatcatgatcaaagtgggcttataaacatggccgagatgggtagttctaaatcaatttgttggatcagaagaaatcaagaaagagacagtcgttggagcttttctgatctgcttttggatgatcacccattagattgaaaattaaatttttcattctccgctcgatggctgatttgtaaacttgttccttcatgatagaaatttatgggctaaatacagaaagtgaacgttagaatttggttttgggtagaagaacaactatcatatgattaaagattaatcagatgatctaaagatagttttggtgagtacagttcggaaatatagccgttgatgcatgatgtgtgactttcaaaaatagaaatagccgttggatttaaatttaaggtcaatgaacaactgtcagatatgcttaaaattaatctaatgatccaagaatggttttggtcaatacttcgagtatatatagttgctggtacgtgatatgtgaccttgcttcaaatataaaacgagccgttgaattttaaatttgggtggatgaacaacgtactgtcaggtatgatgattaagattaattcaatgatccaaaatccaaatattgtttcggtagacggtggtacttaattagtgagactttcaaatattaaaaagagatgttgaatttaaattttagtttgctcaaaagaaaaagtttctagtaaaaacaaaacaaattatgtttaattaaggtatgtaatatggttatgcataagactagtgttgatgagatgattcacgatgtcgtatggattggattatgagtattcttaaactcgaatgggttgccaaatcataatggcctcattaatttattgtactaaactgaattataatatatgttcttgagcgaaaaaaatccataatttataatttcctatctagctatattggattgatccggctgttgacaatctggtcctgatttgaatcggtttctcgaatcatgcaccgtaatcgtagtctagccatttaggattgtatcactaacagtagtgtcactttaaaatgttggagatttagactatgaatagtaatataaaccgcacccaaaaccgcactgcaacaggtaacagtatcaaaatctctctctatatatatgtattttcgttactatttgaaccgcaccgcacttctcccacaccgcaaaacgcagtcatcattcggacccttaagacaaaaataataataacaatttatatagaattttaccaaaattgatgtcaaaaagagaattttttattattattttaaaacctaaaaactaatacaatatagagacgtaagaaaaatgccatcttttttctttcctcatgctacacacctttagatcaatgtttcctatagattttacaatttttctttccacattactaatttgagtatttgcaatctgttgaataagttgtcattgttcttaaaaaggtacttttcaataaattgtcatttctatctatataatcagtgatatctttccattctcttattttataaataagttagcataagaaaatatataggactaaaaccatttaattaatatttaaaacactaattatgaatttgtttaattttttactaaaaatttatctgattagcacaagctttttgtaataaagtttacaaacctttttgtttgtacaatagacatttagctagatatcaaaatttaacatataaacaatagaaaacatttatgacaaaaaacaatttagaaaacatatcaaaaagcctaattgacacttgacattgttgaaactattgatttaacacattgtattttcatattatatataaatttatattcacctttcaaaaatacatttaataattataaactaaataaaaaatgtttgtttgacttgttttatttcagccttaaaaataaatcgaccaataatatttagaaagaaaatcttatctcaataatttaagttttgcttagatttaatttatttgttcacctcaatgcattttatacaaaacaaatattttatatttaatacatatgtgaattaaatattaccttttaacaaataatgtaattaatatcttttaacaaataattttacccactcaaatagtaatatctatatttccccccttcttccctttttatgaattaatgtatattttaaaaaaatatccttaagaccaccctttttcccctataaatactgattaacttgtgccttaacaaaaacaaaaaattattcgcaaacacaaaaaaaattgttagtgaagaacaaaatggataataatg

SEQ ID NO: 26674 - DNA, 2487 bp, Unknown; identical to SEQ ID NO: 10260
  misc_feature (1)..( 2487): 2750-1469P.txt file - cDNA_ID_2715382; gDNA_ID_2213640; Annot_ID_132238

SEQ ID NO: 26675 - DNA, 3003 bp, Unknown
  misc_feature (1)..( 3003): 2750-1469P.txt file - cDNA_ID_2715393; gDNA_ID_2936581; Annot_ID_194896
tctctttgtggtgatgatgaaaaaatattgtggctttttggttttgatgatttgggtttgagtcgtattgcacgattggggttaaaaagatgagatttgtaattgggggcaaatttgtgttgattagggttcctctttttttcttaatgtcgaaacgtgtgtttgaagattttagcatctgggtgatctaaaaagttttgattttgatggatttatgttaaagtttctgcaaattgtttctaaatctgctgatgctttgttttatgaggtactaatggtttccgttttgatctctaattcaggtgatatccatggacagtaccaagatcttctgaggctattcgaatacggaggctatcctccttcagcgaactatctcttcctcggcgattacgttgatagaggcaagcaaagtcttgaaacaatatgtttactcttggcttacaaaatccggtacccatccaagatatttctcttgagaggaaaccatgaagatgctaagatcaacaggatttacgggttctatgacgaatgcaaacggaggtttaatgtacggctttggaagatattcaccgattgcttcaactgtttgccggtagctgctctcattgacgagaagatcctatgtatgcatggtggattgtcaccggaattggaaaacttggggcagattcgggagattcaaaggcctacagagattccagacaatggtcttctttgtgatttactttggtctgatcctgatcagaagaatgaagggtggactgatagcgatcgaggtatctcctgcacgtttggagccgatgtagtcgctgactttttggataagaatgatctcgatctcatttgcagaggccatcaggtaaatagacttccatagtgatcaaaactagaaccaaatggtccaactctgtagaaatgtttgacatttgttgtatcttgtgaatatgggcataaaggaaaagacttttatgagaaccttccaagatattgacttgtgagggacgtgtttgcaggtagtggaagatgggtatgagtttttcgcaaaacggaggttagtcacaatattctcagctccaaactatggaggagagtttgacaatgccggtgcattattgagcgtggatcaatctctcgtttgctcctttgagattctgaaaccggctccagcttctagcactaatcctctcaagaaggtttgtttccaccaagaactttcaaaagaccaagtagtccttcttttgataataatattggttagctcggatataccaaaatctgaatccaacaagaccaagccttttggacttgatgagtcatgacaagttttgttcttttggaaacttcacgtcataatgtaacacatgtttctctctatattttctctttttgatcaggtaccgaaaatggggaagtcttgaaacttaatacagcttattcccttgagagatttggtttcacaagctcaagctagcgctctgtgcatttcttcagatgtaggcaaactgcaatggagaagagaacctcaaaaggctactttacttagtcatcaaagaagaagcatcagtagaaaaaacaaaagagagagagagagagagaaaacaaaaggtgttgtccaaatattctgtgtatagttgcagaaacatctcttttctgcttctctagattttcatctccttttggtctgttttcttttatttggttattcttttaacaccttagtttaacttagagtgcctctcctcttttgcttttttctttctttcctgtatcatcaaattaccacatttcttaatcttttccatatttgaattgacttccatggtttggctcttacttttgtgaatcatctgcacagtaaaaacaatttccttttgatttagcagtacatgtctctctgtgttttttctcttccagcagtaatacatatactttttacagagcttacttttacacaatggcacgacttgttctctctgtttcggaattggttcttcttgaaactgattctccctctctcgtcgagttttcatagtagcacattttattctcaggcttttggtttaatttcataggaagatggttcaatccggtttactattaaaccgaaaaatctaaaaactagatttttcggtttatgaaatccacaaaccaaataatatagctgcataccaacccaaaatctcggcaaatcaatgttttccgtaaataaccttttctttatcgatgttgtcaggaacattaagggtaacttagtaatataacaattgcagacgttttagcgagcagaggatccccaaagccagacaaatcctcttccgtcgccgccgccgccgccgcaagtctcgtcggttagtttctgaatctctcgtttctaaatctctgatctttcgttggattcctgtgtttgaatctcagcttctctacctgggtttatgtctcagctcttgaacttgcttgatttctgcatttcttgttattttcgtttgtctttgtctctcgatccgtgtgttaccattactgtatatgatcgcataattcatctgtgttttgctttgggtttattgatctaacttaatctctatttccttggattgatatgtaatggtggaatttctaaagatatataggaaggaagttggagagtttctagcaatgtttatgtttgattccaatgttgtggttctcaatggagaaaaacattatagaatctctgagaaattttatattgaatagccaattgctacaggattcttggttcggatctttcagtttcagaatctatatgtgttttagagttgttttttctttgagctgaataggtttagagagccaatctttcacttgattttcgaagcctatatctagttcattggttcgtagctaaagagtgtttctgaatccttgctgtaccatctgtgttaatagggtttgaagtctatgtttgattctatctttattctagagagcttagatgttactttttaggataagccttaaatg

SEQ ID NO: 26676 - DNA, 3003 bp, Unknown; identical to SEQ ID NO: 26675
  misc_feature (1)..( 3003): 2750-1469P.txt file - cDNA_ID_2715393; gDNA_ID_2213641; Annot_ID_132280

SEQ ID NO: 26677 - DNA, 3003 bp, Unknown; identical to SEQ ID NO: 26675
  misc_feature (1)..( 3003): 2750-1469P.txt file - cDNA_ID_2715393; gDNA_ID_2213641; Annot_ID_181253

SEQ ID NO: 26678 - DNA, 995 bp, Unknown
  misc_feature (1)..( 995): 2750-1469P.txt file - cDNA_ID_2715397; gDNA_ID_2936581; Annot_ID_194895
gaattctaagtattaccctcacacgtatacaaatataaccataaaacgaacttttcaaaagacgcggtttctcgcccgacaacaattacttgaataatttatttaactacaaaggaaattagtgtatgtaaggagctttgaccagttccaatgagaatcatccacgtctcattctttttaggctggatcttcttcttccatcaccgtccgtccactaccccataattcttgccttagaaggtttcactaattacttcgtcttcgtttttctattttgagatttgacaacttccccttttaatcatgtttttagttctgttggacaataccaaatcaattgcactggttttgctttctttatccaatcattttttcttttgtagttcattggatccatttttacatcatgtagagtagccattgttacaataccaaacaaagttagaaattgctaaatataattgttaattgatataataatcgtatatagttaaaactcaacttgttccatttctaatcttaattatgtttttttggaccgacatcattctcttaatgtaatgaatagccatttaaaacagagttgaaatataaattccaaaaatttctggcagcaaaagagagagaagagaaggagctattatctgcgccatctgtttctccaattaataatctccttaaatccggatttgttattaattctaatcttttccaattgatccactttcctcctctgagtttttaagactaatagagagatatatagagagagattgcttctggttttgccttccccctttgtttgacctctcttttctttcttcccccctttgtgtttcccgcattttctcgggaaaatctaaaggaacaaaaacattaaaagtttgtgattttctgattatttctttatttaatcgagacccattgtttctcgcctgatttggcgcaaacccttttggattctggtgaaaaaggttgggatcagaggaagaatg

SEQ ID NO: 26679 - DNA, 3003 bp, Unknown
  misc_feature (1)..( 3003): 2750-1469P.txt file - cDNA_ID_2715397; gDNA_ID_2213641; Annot_ID_132279
acaaaaatccgattacaaaagcaaccaagaagcaacagtactccagaatcaagtccaatggcggcaacaactttcttaaaccttgaatccacgactcttcctctttcctctggccttctcgaacttccttcccttggcccgaacatatggcttggagtgactgtgtggcacaccaggagcaggtccgaaatgcttcactgcttcacgtgaattcttaggtcctctaagaagaacctataacacaagaacacacaactatcaaattaaatatagtatccttaacaacttgaaaatggagaatagcagattggataagagaaataccgtgttctggcccaatggagctctgagagcgagctggtcaaaggttaagcattcacctccagctttctcaatgcgagcccttgctctctctgtgaacctcaaggcagtcactttcatggctggaatctcgtgtaccctcaaatcatcagttatagttccaaccaagacggcaatcttatcttcctataatatcagaacaagaggcaaaattcaaaatccaaagcatagacaatgtagagaattttgaatcaattatcgaacaccgccatgttacagactaagttcacattagcagattcataaactggacactgtatctaggaaatgtaacagattcaacatgacctaaaactaatttaaccataaagatacagtagagagagagggtttcaacgaattagtaccttgccagtcatgaactccacaagcctagatagagaaagaggagctttgttgactttgctcatgaaaagcctcttcaatatcacaccattgaacttgctattagttctccttaccagaaaccggtaaagctgcaaaatttcacaaacaaaattcagaacaattcactaaaataaaattaaaaaacctcttcaattggataatataaggcaaaggacaaagattgatgtttaaaattctgaccttgacagtaagcttgaggtagacatcatcagactttggagctgtccttttggtcttcttactcttacctccggcgatcagatcaataccctgcaataacacaaccaatcaatctcacaaacaagcatgaaagcaagatccaatctcaaaaaaactaagagagatagatcgttcacactctaacccgagactcaaatgtcagaaaaacaaacctaatacactatacaacatttaaaatgacaggaaacacccacaatctcttaacaacaagatttctgaacctttgatatcaaactaacaacagaaaatacttgtagaggaaagacagagagaaatgaagattgaacgacagaggaggagagaagtaccattgtcgtccggcgttgtggtgatggaaccgccgaccttctacatgaaaatactgatgctagggtttttataccaactcaattttagggttctcttacttcctccacgaaatgggcttagttattttcttccttcacgagatgggccttgaatataagaccacaataagtttggacttaaattctgtaatatattggcccatttatataatttttatttgtcaccatagaaagcctttccttttctttttctgaccaacatgaaaaaaaagcatttctgatgtattttcttacaaaccttttatatacgtaactataaaagattagttatattgatacaagaaatagtttaatcattgatgcatgccgtctagaagaaaagaaatattttattttgcttagaaaaaagaatgaaccacatattaggtgtagtatacttcatacttgttatcatgtatgtaaactactaatacataggtaagtatacttgtttacgcaattttaacctattattgttgatttcttgtcacagaaagtgttatgaatcaactttcaaataagttaaaatttactcgcccaaaaagaaagaaaaagtatcaattaatgttactaatcactgtctgtttatataattaggatggtgtagtggaacatgatgggaacccatttacgaattctaagtattaccctcacacgtatacaaatataaccataaaacgaacttttcaaaagacgcggtttctcgcccgacaacaattacttgaataatttatttaactacaaaggaaattagtgtatgtaaggagctttgaccagttccaatgagaatcatccacgtctcattctttttaggctggatcttcttcttccatcaccgtccgtccactaccccataattcttgccttagaaggtttcactaattacttcgtcttcgtttttctattttgagatttgacaacttccccttttaatcatgtttttagttctgttggacaataccaaatcaattgcactggttttgctttctttatccaatcattttttcttttgtagttcattggatccatttttacatcatgtagagtagccattgttacaataccaaacaaagttagaaattgctaaatataattgttaattgatataataatcgtatatagttaaaactcaacttgttccatttctaatcttaattatgtttttttggaccgacatcattctcttaatgtaatgaatagccatttaaaacagagttgaaatataaattccaaaaatttctggcagcaaaagagagagaagagaaggagctattatctgcgccatctgtttctccaattaataatctccttaaatccggatttgttattaattctaatcttttccaattgatccactttcctcctctgagtttttaagactaatagagagatatatagagagagattgcttctggttttgccttccccctttgtttgacctctcttttctttcttcccccctttgtgtttcccgcattttctcgggaaaatctaaaggaacaaaaacattaaaagtttgtgattttctgattatttctttatttaatcgagacccattgtttctcgcctgatttggcgcaaacccttttggattctggtgaaaaaggttgggatcagaggaagaatg

SEQ ID NO: 26680 - DNA, 3003 bp, Unknown; identical to SEQ ID NO: 26679
  misc_feature (1)..( 3003): 2750-1469P.txt file - cDNA_ID_2715397; gDNA_ID_2213641; Annot_ID_181252

SEQ ID NO: 26681 - DNA, 3003 bp, Unknown
  misc_feature (1)..( 3003): 2750-1469P.txt file - cDNA_ID_2715401; gDNA_ID_2213641; Annot_ID_132277
tgcgtttaatgttacgatgaagcagatcacggacgcagctaagaagtcgcagacgattatggagcttcagaaggattcaaggactaggatggcgcttgatcaatgcaaggagcttatggattacgcgttggacgaactaagtaactctttcgaggagcttggaaaatttgagttccacctgctcgacgaggctttgatcaatctgaggatttggcttagcgcagcgatcagccacgaggagacttgtcttgaagggtttcaaggaacacaagggaatgctggagagacaatgaagaaagcgttgaagactgcaatcgagttgacccacaacgggctagcgatcatcagcgaaatgtcgaattttgttggccaaatgcagattccggggctgaacagtcgtcgacttttggctgaaggattcccttcgtgggtagaccagcgtgggcgtaaactcctacaagctgctgccgcatattccgatgtgaagcctgatattgtggtggcacaggacgggagcggtcaatacaagacgatcaatgaagcgttgcagtttgtccccaagaagaggaacacaactttcgtggttcacattaaggctggactctacaaggagtatgttcaggtgaacaagaccatgtcgcatcttgtgttcatcggtgatggtcccgacaaaactatcatttccggcaacaaaaattacaaggatggtatcaccacctaccgtaccgccactgtcggtaagatatatattttggggatttttactcgttagattacaaagtcttagaagtcatctatgtaaaatgatgaatgtaatgtttattgcagccattgttggaaactacttcattgccaagaacattgggttcgaaaacaccgctggggcaataaaacatcaagcggttgcagttagggttcaatcagatgagtccatatttttcaactgtagattcgatggctaccaagacacgctctacactcactcccaccgtcagttcttccgtgattgtaccatttcaggcaccattgatttcctctttggagatgcggctgctgtattccaaaactgtacgttgttggtgaggaagccactcccaaaccaagcatgccctatcacagcccacggtcgaaaagacccaagggaatccactggatttgtgttccaagggtgcaccattgccggtgaaccagattacttggctgtcaaggaaaccagcaaagcctatctcggtaggccatggaaggaatattcaaggactatcatcatgaacactttcatcccagattttgttcagcctcaaggatggcaaccatggctcggggacttcggcctcaagacattgttctactctgaggtccaaaacacaggaccgggatccgcccttgcaaaccgggttacttgggctggaatcaagacattgagcgaagaagatatcctcaagttcacaccggctcagtacatccaaggtgacgactggattccaggcaaaggtgttccgtacactacaggccttttggctgggaacccggccgctgcaaccaccaccccaagcgtctcagctgctgctccaggtttctccaccttcacggatacaagtggcgctgactcaattgctccaacagcttccccagcagcttccccggaaagttcaattagcatggcttacacggggacagcttctccggaaagttcgattaaggtgtcttcttcaacggagacggcttccccggaaagttcatttacggaggcttcaacggcttccccagaaagttcaattatggtggcttcaacggagagctctggttcgtttttttcaatgtttacctaaaagattgattaagatggcataaaatgtgttttttctttactctaattcaagcaaaacctgaaaggaacaaaaatatttgcacaaccttgaggacttcaggattattggtattccaaattgttgacattaatgtttagctttgtaaactcatgtttaatatatcagtatattaaaatgctgtttataaatctattattattaactagtgcatcttgtaaactcatttatatgtagaaattagttcattactatgcgcgagctgttccaaagaatttcatgtgtcatctagtactaacaatttcctatacgaaattaatattcttatataaattattgacacaaccctcaatatataatatttatatatgaattgggacaagtttatgaaaagagaaagttggaaatagaagaagcagatcaatagtgaaaggtagtaaaagaaagtagttacaactaacctcatttacttctctgcattcattttagctccaccctctcatcttttaagctatagccaaatcatcttattctatacgtccattggaaaagttagagattcttttaccccaagttcgaatccgaaatctagccattaaatttgcatatgtactttcgaaatccgttgctattaagttttatatttcttagaaaaagttgatcagaaacaagttctttttaactctaaataaatatctgaagatctaaaattctaaatatatactcctatttgttatcataaagtttgaggcaataaaagaaaggtggttcccaatatatgcatgcacacaatcgcaactacccactagactacatttacttctctttacctccaaatggttactcgtcttcaccaattggcaagctcaacattatagatatacatccatctgtttattagttttgaaaactaaataaaagcagcgttataattgtcttttacatattgtgtttgatatttatttttgtgctgggtttcaatcaattttccaccaacttatcttaccatttaaaactagtattcatgctatctaaaaagataggtaaatagaagtaatattaaaagtaacttccctttggattctctatttatatcacttccaaattgattccatcacacatcttaaaaagtaaaaacacattcatctatccaacaaaaaaaaagaaaggagaaatg

SEQ ID NO: 26682 - DNA, 3003 bp, Unknown
  misc_feature (1)..( 3003): 2750-1469P.txt file - cDNA_ID_2715405; gDNA_ID_2213641; Annot_ID_132276
atagcacaaagcgatatgttatatatgttaagaaaggtgtgtataaagaaaatattgatttgaagaagaagaagacgaacattatgcttgttggtgacggaataggacagacgattattaccggtgaccggaatttcatgcagggtcttacgacattccgaactgcaaccgttggttagtattgatattttagttaattaaatcagtagttaattaattgattgattaaccttttttgtacttttcttcctttttggtttttgtcaaatttttatatatattagtgtgtctgaaaattagaaaagcatatatgctttctgcaatccgcaggctttcaagctttaagttatagtttttttcttctcataattcattcttttcttgtgctacaatatctaatccattacttaattgattgatcaatcttttcattaccttttaatattgttttggtcaaattttgtttactattgtctctgcaaatcatggaatattatatgcttttgctttctggaatctacaaactttcaagatttttacttttcttataaattatccctttcttatgttacaaataactactttttcaatatgtttttgttacttatgtatctaattaacatgattgaccattaattttggtttgatcagctgtttccggaagaggattcattgcaaaggacataacattcagaaacacggctggtccgcaaaaccgtcaagctgtcgcattgagggttgattctgaccaatccgccttctatcgatgtagcgtggaaggttatcaagacactctttacgcccattccctccgtcagttctatagagattgtgaaatttatggtacgattgatttcatattcggaaacggcgccgcggttttacaaaactgtaaaatctacactcgggtcccgctaccgctccagaaggtaacgataaccgcgcaaggaagaaaaagtccaaatcaaaatacagggttcgtaatccagaacagttacgtgctggctacacaacctacttatcttggccggccatggaaactttactcaagaacggtttacatgaacacttacatgagccagttggtccaacccagaggatggcttgagtggtttggtaattttgctttggacactttgtggtatggagaatacaataatattgggccaggttggcgatcatcaggtcgggttaaatggcctggttatcatatcatggacaaacggactgcattatcgttcaccgttggatcgttcattgacggtaggagatggcttccggcaacaggtgtcacattcaccgctggtctagctaactaattcaaaaaattttattttaccagaattattttagaattatgttattaatttaatcggttgtcatctatataatattcttgtttgagtagaaaacaaaaatcatgaatgtatagtgtatgtcagtatgtgtgtttaaatttataactttataaaaataaatggaaattatagactgcctgattatgcatctctgtaaatcatttaattttattcgtatctgatttaatttcattgattaatttcgcagtgatcgaaaaatatctccaaaaattccctgtcattttatccgtagatcttgtttgaaattttgagctgatttgaatcggacggatgaagaattataatatatgggctattggtctgccactaacttaaacgacttatttaattacgagtatccacgtacatcaatgtatttgtcattttcacacaaattaattcaaaccttacgtccggttaccaaaaaaaatatatatcaatttgaaacgaaaaaccaaagatcatgtataaatacacatacaattatacaaacatctcgaagtaaacttgtaaacatcaaccctgattaggacttagaggtcattcattacactttcctttttttgtccactctttctcatttttttatttttttattttgaatggatgggtgattttgctttgaagacattgtattatgcggagttcaaaaataccggacctggttcagaattatcatgtgattaatgaaactgaacctgtttggttcactgtctcgaactttatagttggagatagcttgttgccgaatatgggaactttttgtgtgtttatgtctctacctctgtgatctatatgaatgtggttgtgatcaaaattagaaagaatggtacatattgcataaaaataaatatatctcttctaaattgactagttaggtcatactatttgtcaagattcgtcaagaattaaatttactattcagtgcggtgaaaacggacaatattttcagtgtatacaaatgatttattttattttattttaagaccagagattgtttttaatcataatctaccaaaaaatcattataaattcgcacattgatgtatctagaattttaatatcgagaaaagggttttgataataagcaatgggaaaatcactatctttcaaaatcacaactgtaccgaatggtatgttaattagtagttaaaaaaacaaacacacaattaagacactgattaatccggtggagaaaagaacaaacaaacaaacaaacaaacatttattgaatccctaaaataagattaattattttccctaattagaaactcataaggaaacagagaagaccataaaaccacaagcctattttttgtcttttcaacagtttctcactagccggatttcccgccaagccttagaaaacagagcaaccaaaataacgaactcttaatttgtcataaccgttataaataagccatctagacaattatgaaaattgcacactcccaaggaggctacgtaaccttcgacggaggagtccataaaactcacattctcatttttttctcaaaagaacaacgaacagctcttatatttttttacaataattcttcagagctgtttaagttcaacaacaatttgattaagagaaaaccacataaatattaattagtgtaacgaaaaacacaaaacaaatatg

SEQ ID NO: 26683 - DNA, 3003 bp, Unknown; identical to SEQ ID NO: 26682
  misc_feature (1)..( 3003): 2750-1469P.txt file - cDNA_ID_2715405; gDNA_ID_2213641; Annot_ID_181249

SEQ ID NO: 26684 - DNA, 3000 bp, Unknown; identical to SEQ ID NO: 10287
  misc_feature (1)..( 3000): 2750-1469P.txt file - cDNA_ID_2715413; gDNA_ID_2213641; Annot_ID_132274

SEQ ID NO: 26685 - DNA, 3000 bp, Unknown; identical to SEQ ID NO: 10285
  misc_feature (1)..( 3000): 2750-1469P.txt file - cDNA_ID_2715425; gDNA_ID_2213641; Annot_ID_132270

SEQ ID NO: 26686 - DNA, 3000 bp, Unknown; identical to SEQ ID NO: 10285
  misc_feature (1)..( 3000): 2750-1469P.txt file - cDNA_ID_2715425; gDNA_ID_2213641; Annot_ID_181240

SEQ ID NO: 26687 - DNA, 3003 bp, Unknown
  misc_feature (1)..( 3003): 2750-1469P.txt file - cDNA_ID_2715429; gDNA_ID_2213641; Annot_ID_132269
ttacaagtgtatttatctaataaatctggttcgttttctgattgtttcaagggtttcgatgtggagtttgtggaagtggtgcgaggtatattttcagcaggatcaaggtcaaagtcgttcatcacattcatggctagggagaaacctgatggacctcctgttgagtatcaagctaaggtttggtgtacggttgttcgaaaccagaactatcccatcctctgtagacgggctctcacaacaaagcctccaagccaaaactagtaaaggtatggtttttgacccagactttcttttgctgttgatactttatatagcctgaattgttgtgcgtatttggatatattaagttttagatttagaaagataggcagattaataaccatctcagcgaattgtcttggctcatcatttctgtcactacaattatctaacttggaggatagctgaagtgcattgtcttattactatttgtttccatgctagtgagtatagggattaagggtgagaagtatcttctgactgtttagatctatttgaaactgtaaactgtctgtgcatgacttcagaataagatatctctgtaggtagacaaggagatattttcctcttctaaagtgattctagaaggccatttttattagagtcttaagttgctgacttgtttttatcactgttctctttcgtctgggactggaaattagactagcagctgatcgagaagatggaattcgctggctgatgcagaggctggagttcgcaccaggtcatctaatatgaagttgtttgtattcgacttagtcgtactaaatcacttctattgtgttgtgccaatatttatgttttaggtacttatctctatgttagctaaataactggtctaagagacttcaaattaaatgtttgtgttttataactttggaagcatggcatgtgtctcctttgatgcagtatcctcgcttttgggatttctttcttttattatgttttcatattatgtatgacacatgagtaaaaatcaaacatatccatccatatactaatatcaattacaaggatctaacaaaatgtaaaatcatggtagatagaaaacaataactttaacatattcaagtgatcaatgtagcaacctttctttcttcgatcacgctctgtacgaagtcaagggcgaatggaacaatttaattggccactctggcaatgatgtagcaatttcactgcgtggtgtttgaacacttgcaacattgtgtttactctcactttcattttgctaatacatttgctcagctaaaaataaataatttttgaatttttcttgcgttatatatattgttatttttatgttaaattaagatcaaaataaataaatttagagagcaatttttatttaatttaaagataaacacttatggtcgcacaaatatttgtgatattggtttaaatcgataagaaccgtttttgttaatcaaaaccgggccaaccctaaaaagctaaacgccggttagactaaaagagccaaccgccggataaaccaaaaaaacaacggcgtttgttttttcttctccttcttcttcaccctgcgtcgtgctctctcgaattcccaggtcagctacttggattcgtactctcaaaaaaatattgctttcgcattcctcttgtggtttcgtttctaaacgcgagtttctcccttttctaaggtctgtgttgatcccacccaaagtagagagaattaaacctaactgttcccgttttattgtagaattactgtacatatagatttaagtcgtgatctagttgtcgagaggctctgtgcagttgcgtagttcgcttaccctcagaaacgggctttgctgagtgatgtcaattagtagctagttgtgagctctatatgcgaaagttgtgtatttgtctctgattgctctatttctgatttgataaatctcagattttagcaaccagtctgaatcaattttatgaagacctaagagacctagcaattcaagaagaccaccaatcaatcctggaggcatggtacgatctgagccttgtgttctgttcgctcagacctttgttcatcctcaattggacgaatatgttgacgaggtaaccttaatttttagttaatgatacacttcaaatactgccctgttcttttggctagggagtgcctatgttggattagggttctgttttactagagtctcttaaacctggttaggaaatgcttgggtgaattactgactacttttacgggattgtcggaacaacaagtattatatgtggtggttttgtcattcaatggcagaagttacttgtttggtttcacgcttctgcggatttattttatgtttcctttaattcttataggtgatatttgctgagccagtaatcatcacagcttgcgaatttttggagcagaatgcttcctcatcttctcaagctgtttctcttgtcgggtatgttctttttttgactgtgtgttcttatatttctttctatattttaaccattgaggatcttgaagtagtaatatccaccattagaagtcttgttgaaatgcatggtcccatactctgtagctgtgatctctattgactcttaatgttaagccttttttttggatgtaaaagttcacgattggctattttcttgtcactggaaggtgaatgataagaaacctaaatttgtgtagaaaatctgaataacccaaacttgaaactgtaacaaaaaactgaactttgcagacatgatatttcgatccagtggtttcgatgaaatgtccagagtccagactctaaagttcagcttctttatcattaataaactttagtcactttcagagaaatctagattttgagtcaattcgtcttctagaaacaaaaatagtgaagcaatattgttagctgaaccacttgtagttagattttcagctaaaatgccagctttatattctttgtgagtgacttaatgtctgacaacatttcttgagcgtgggtgatgtctatg

SEQ ID NO: 26688 - DNA, 3000 bp, Unknown
  misc_feature (1)..( 3000): 2750-1469P.txt file - cDNA_ID_2715441; gDNA_ID_2213641; Annot_ID_132266
aagcaattggggcgttaaccgcagaagctaatgtgttcttaggttacactcattcataatctctctcctttatttgctccccacaaacaataatttcgtactttgtcctgctgagacagaacatggagtttcctcattgctgacaagttaccagaagcgatactccattataagctgtcatcaagaatcgtagagctcaatagctctcgaacaaactcactgcgtttcaacttctgcttgtgatcctcagctgaaagagaagtttttttcgcattcctatcatccacaaaaccttcatcagtgatccatacatgtcctatatgggtataagaactcaacttgatcaaagagtttcagtttggctcataaatcccaagtgtgcccaaaagtaaaacattgaagcaaatgttccaatggaaagttatagaccaaacacttaaaataacctagaatcatctaggttcaatcagtcttgaaataccagatttttactaacaagaggttaggcaaagtaaaatgattgagaagaagtaagcatactgttcgggtaaacactgaatagttgttttcttgacaggacccgtttctgcagatatgcatgactccgtggtgaagaacccatcagcaataggagaaatgaacgacgataacaatgggtcagcagctacattggatgatgaggaagacgatactatacacgaagatcctccaaagaggctctgaaagtttccatcaggaaactctctccttaagatcgataatgtggaatatgacccgcctcttcttggttttctcttgcggtgcatgtaatattttgtcaagaacacaacttaataacagactatagaaacactgatagaaaagattgattgttatatatgacttgggagaaagaaaaaaaggatatcttgaaaatattagcgtgctgaagggttatatgagcaaccatgtcaacacccaccctaaccgcacaaactggacatacctgcaataacaatgttcactagattaaacgctaagttttcatagaatccaaacaaaatcccccaaatatcagatgcaatagatacagctgatcctactattccttcgtgaatcggctataaacatgctattattctcagttttctttgtcatatcatccaagtaacaacagaggaggaaccaacaccgctcagtctaaacttttgagaatcatgtgatgaatcagaaatgtataaacgcatctttatgcttcaaatggttgttttaaaaaagaaataagaaagttaccccatttttggcttccataggatgatcttcatctatgtggcagcagagagagacaatatcaaaatagtcagaacagaaagggcaagcaaactcttccctgaactcttcttctccatctatctcttcaaaccctaagaatgtatctgcaatcccaaaaacacatcaaccaaatatttatacagcaaagctataagaaaacaaagagagtaatcagatatactaaacccctactctacctctgaggttacagtatatgaaacatattctcctcttctgaggagaacaatatcttcactttctcatgttcataaacactgagcatagtagcatcacaggagtaattaaaatgctaacaaagactgcaactttggataattttcatccattttctcaggaatcgagcaaaaccagaatcaaaccatatttcatcagtcaataaaaatcaattacaaaagccccctttccttcatttttgctagtatcaagcaaagcctaaggcgatgaaaaaatgacaaaatacgaaatctttcaaaacaagatcgaagatttctcatatatttcttaatcttcaaaacagagattctaaatcggaaagaaaacacaagtctatcacctaaactaccttcgcccatcaattttcagacgaaaaaaaagatcagataacaatcatttagaacagagggagaaaaaattcatatcatttaaactaaccagatcgtgatggaaaagctagctggtatctcctcgtagctgaagcgagacgatcactccatgaatcggaatccattattgacaaaacccggaaaacaaaagtcgaaagttttgtacttttttccttaacaaataaaacgttttgaagaaaatgaatctgtatacgaaagtaaatgattctgattactgtctgaagaaatccaacgaaaatggtaaagacagattatgaagaccacgattctgggtcggtttattaacaaagttttgtctttctttttttcttcttctcctcgttttaattaattttggatagagagtgagagacagaggagacaagttctataaattatttctttaaatttatgttttttatctaaaagaaattaaaacgtttgctttcagtgatgaatcaaatatttcgcggaaaaatagaaaaacaagaaagtgttgggccactctataaactctttttgtaaagtctacgaaaatgcatgccgtttttattattttacccgacgtataattgcattcagaaacatgacgtttccaaataaaacgtcatgctgttgtcttttagacacgtggcgtgttttcagtggttttatttataagatttcgcagttaaagatgcacgcaatagcaggagatttttagccccgttcttatgttttttctgacttgtgacttttttttttttttttttttttgggtcaactgtttatttatttatcgattggatgttttaattaattttcgaaattatagttaaatttccaatttgtgaatctgggcgctgtttttctccgtcggagaatttgatcccgccggagatcggccggtttccgcagtcgcattcgtttctttcgcgcgattttcgatgctttgtctatgatgaaaccgcgatcctgtttagatctatagctttcgatcggaagggaagctaaaatccatctagacgccgagatcttggttagctatcactgagattcttatagggtttatatttgagctgttatg

SEQ ID NO: 26689 - DNA, 3000 bp, Unknown; identical to SEQ ID NO: 26688
  misc_feature (1)..( 3000): 2750-1469P.txt file - cDNA_ID_2715441; gDNA_ID_2213641; Annot_ID_181236

SEQ ID NO: 26690 - DNA, 1709 bp, Unknown; identical to SEQ ID NO: 10316
  misc_feature (1)..( 1709): 2750-1469P.txt file - cDNA_ID_2715453; gDNA_ID_2213642; Annot_ID_132312

SEQ ID NO: 26691 - DNA, 1712 bp, Unknown; identical to SEQ ID NO: 10318
  misc_feature (1)..( 1712): 2750-1469P.txt file - cDNA_ID_2715453; gDNA_ID_2213642; Annot_ID_181316

SEQ ID NO: 26692 - DNA, 3003 bp, Unknown
  misc_feature (1)..( 3003): 2750-1469P.txt file - cDNA_ID_2715467; gDNA_ID_2213642; Annot_ID_132308
acactaaaaggataaacgtgttcccaaacatccttttgtctttgatgtcaagtggcaatgcgacaaaattgcaacttattattatatcacctatacatgacaaaacttcaattattgtttagttactttctcattctacgtatattttgttttaatacaaaaaggtatcggagctcatttctcttacatccattatctaaagaccgttatctgataagtatcttgatatttttgatcggtgtatataccattttcgtaaaaatgtaactaaggtactttagtttggattcgaatctagcggaataaaactaccattttccagctgattagaaatttagaaaacgatcagctgtttggactttgggttagatttcttttttgagtttttttataaaaaaattaatttgtgtggtgtgagctaatattttttttttggtatttgttttgttgacagcgcaaagcgagcaaattcttatagtaagtgataaatatagtcaaatgttctaaagcaaatactaaaatgaacgtggaaatttgatcaactgatgaaacaagtcaaatgctctaacattcctttttcacacgtttatatcataaaaatctataaccatacaaaaaatgtgtgttcaagaattagtaagattttgttttattcaaagtgttaaatgatcgttcggataaattttgtagttattcaagggaaacatcagattactgtacatacagtgtcggtaccactggccaaagtcatctgtatttgcatttattaatttttgaaaaacaaaatacatatttttgtcaacaatcaaaacatacagtacatacatatcatcgatatggacaagtaccatttatgggtccacgatgaaaaggatatctaacttacaaatcgaagcccaagtttgtttgtttttttggtcggtcgaagcccaatacataggcctaataaagttttacaagattgttcagttgttttttcaacacatgatttttccccctaacaaaagcaaaagcatgaacaaacaaattacaactacaaaaaaaatcgaagcccaatacataggcccaaaaaagtttttaaagattgttcaaacaaattatattacaattgtttatttcgacaaatgattccccccctgaacaaaagcaaaagcatgaacaatctccaaagacacacacacacacccgagtgtagaatgactagagaaagatccaagaacccaacataataaaagagtaacactaaaactacaaaagagcttcactttgcgaagatatcaatcgaatcggatttcaccgataacaatcgttttctctttaaagattgttaccacaacctcagtaccgtgtcccaactgctgcgaaaacagctactggaataagaaactgataggcaaaaccggagaccgagaaggttcttcttgcactgttcttgttaggtgctgcagctggtggaggaggcggtttctcaactaaaacagcgagcttcatacctccgtaacatccaccaccattaccactaatcagatagtaatgccttgtcacattgagatgaaccaagtcccttccagctccacgactccaatttgcgatcgggttattgggattgcagcttatgtagttcgtctcgttcacttctataacgttgtattggtttctctcatatacaaaatctgaccagacacaatgagaatgaaacactatataagtcaacaagattcatgatttgagatcttactgaagtacagaaccagaacctaatctatttccaattacaaaggatgctgtgaaagaagcatccttttttttaataagaaaacagagctagtgaagaaactagtggtcctttttcaaagttgtaaaatttgaaaccattcatttgccaactgatgtaaaacgtatattaagtccgaaagcctgtgataacaagtatcaataagagttagagagcgtacagagccaatcgtcgaggtagaaatgtttgtcctgagcccaaatggtatagttgatattaggattccagaacttgttatcacccaccgtccacctcttcgccgtcacattcgtcgccgccagcagaaaagccagcaccgcccctgcaaccaaaaccgcaactctcgccatcgatcagtactctaaaaaaaaaaggatgagtcgtcgtttgtggggggggatgggtttatcgaagttcaatctgagagataaatatgtctctttttcagggaaaagatctctctagatccgtaattccttcgactaaccttcgaaattttaattaaacctcgaggttgacgaaaagtacaagataagcgttatgtaattaaccaaaagtaatattttccttttcattttggtcatatttcttaccttttttccggatattaatttcctttttttagtcatccagttggtctcaattgcttaatcataaagtcaggatttatttacttaaataacatagtattgaaataaaacgaatcttataaaaatgtgtttaatcgatgatacttttaaaagttgtaactatatacagtatactgttgatagccgttggggaatttcacattttgaatgccatgtcacatatgacaagtagcttttcgtgttctattattttccatcatagcttccacgcgcaagcttgaccaccgccattaaacttggtaatttagtataattcacatgaatgaattagtaattttgttaaaatgtgtaaattaaaaaaaagaaattgagaaagttctctaatgttcctttcagtttgaccaagaatatattcttaatttgtttcctttcttttgacgtttcaaaatgatataaacggagtaacattttatgtccacacaatatttcttgtaatatccacgtaggatgaaatatccatttaaaccggtccacgtgtccagacatcagcttctagttccattgtacaataataataaaaaaaccttacctgaactaaaaaaaaaaaaaaaaacgaactgagaagcgaagaagaaaatg

SEQ ID NO: 26693 - DNA, 3003 bp, Unknown
  misc_feature (1)..( 3003): 2750-1469P.txt file - cDNA_ID_2715477; gDNA_ID_2213642; Annot_ID_132305
attgaaacagtctttattagcaggagaggtgagaatttgtctttttgtgactacttgcattcttcaacatattcattcctttttttttggcaaacccttttaggaagttccagctgcttttgtttcctttaggacaagacatggtgctgcaatagcaacaaacattcagcaaggaatagatccaacacaatggctaactgaggcagccccggagcccgaagatgttcattggccatttttcactgcatcgtttgtgagaagatggatctccaatgtagtggtgcttgtggctttcgtagctcttttgatcctatacattgtccccgttgtattggttcaaggtcttgctaatcttcaccagttggagacttggttcccttttctaaaaggaatattaaatatgtaagtaaagccctatttagataaagatggttcttcgtttcaattgaacaattacaaaatcttcttttttttcttatgattgcaggaaaatcgtgagtcaagtgattacgggatatcttccgagtctcattttccagcttttccttcttatagtaccacccattatgcttctactttcctcaatgcaaggattcatttctcatagccagattgagaaatctgcatgtatcaagcttctaatctttactgtatggaacagtttctttgcaaatgtactgtccggatctgccctttatcgtgttaatgtgttccttgaacctaagactattcctcgtgtgcttgctgcagctgtgccagcacaggtaaagaacacaaaattcagtattgaggtttccggaattcccttttcgtaccacgagtcatgtttattgtttaatctttggtgtaggcatcgttctttgtatcttatgttgtgacctctggatggactggtttatcatcagagatcctccgtttggttcctcttctttggagtttcataacgaaacttttcggcaaggaagatgacaaagaatttgaggttccttcaactcctttctgccaagaaatcccaaggattctattttttggactcctcggtataacttacttcttcctttcgccattgatactgcctttcttgttggtctactattgtcttggatatatcatctaccgcaaccaggtaacggaaccaatctcactcctaagtataattctctgttgatctctgataaaatcatataggaatcagctacacatattttcgttatatggaatctcacttttatcttctctttatatgtgatcccttttctaaattctcgaatagcatctttaaaccgaaagtattttttggagcttcagtcatgacataaacgttacatcaagaatccattttctcgtcacataattctttttcttcttaatgaatccattgcaacttgttgatagaaataacatcacctttttgtgctgcagctcctaaacgtatatgcggccaagtatgaaactggtggaaagttttggccaatagttcacagctatactatcttctctttggtactaatgcacattattgcagtcggattattcgggcttaaagagcttccagtggcatcttctttaacaattccccttccggttctcacggtccttttcagcatttactgccaaagacggtttttaccaaatttcaaatcttatcctacccaggtaaaggctttagagaaatagttactcatatttttgatccaatggaagaaaaatatggctagataatcttttattcctaacctaaacaaaacaaacagaacatgatgcatagtcctttattacattacagcatctactctaaacctttatatggtgatgatggatgttttacttttgcagtgtctggtaaacaaagataaagcagacgagagagagcaaaacatgtctgaattctattcggaactcgttgttgcttaccgagatcctgcactttcggcatcacaggactcgagagatatctcaccttgagatcacctttttacttgagctattgaagtttgcttatgttgaagctgttggtttactatacctggtgcaatccatgaaagaacacactaaaccggttgtcttgtacattgggtcttaaccgagaatcaagcggtttttgtcttgtacatttgcttacacttggcttgtgtaaaaaagaaaaaaagtttatgtcaatgtatctctctaaaccggtttaagacggtacaaactttttgaaagatgccaaaacaaaacggtggttaataattttaccacagagaatatttagcaaaaagatgatgactagatgccacgtccgcatgggggtatatattgtaattagtcgtaactctgggggtaatttagttaaagattgatccgtttatggaaccaaaaatcaaataatttcgtctttgatacttgcttgcgccttataggctacaggagcgagagcaatgaaagcgagaggaagaatctatcaataatttctgggtttaagctgatctctggatcttcctcaattttactttttcagctcagaaaattttgggacttttttttgctgcattttttggttccgaattttctcctccgccttttttaatttttggtaagtttcgatatctctcaattttcttatttcggaaataaaaaaaattctcgcccttttgcaaatcaatggattgatcttgaaatcgtcatttctgaatcgggtacgagagatccagtaatcctctgcgattgaattattattagggttcatattccgaattggggatagtctgaaaattgctattttaagctctcttcttagtgttggttggtttattctggataataaaagggatcctaattctcgctaaattctcatgttcaaacgagtagatgagtttaatttagtttcttcaacgatcgatcacagaatcttcaaaagtgtaaaaattacttgctttttgttcctattactcttttgcagtttgttttgtgtgttgtgtactagtagatctaatatctctctctctttttttgtagagaatg

SEQ ID NO: 26694 - DNA, 3003 bp, Unknown; identical to SEQ ID NO: 26693
  misc_feature (1)..( 3003): 2750-1469P.txt file - cDNA_ID_2715477; gDNA_ID_2213642; Annot_ID_181309

SEQ ID NO: 26695 - DNA, 3003 bp, Unknown
  misc_feature (1)..( 3003): 2750-1469P.txt file - cDNA_ID_2715488; gDNA_ID_2213642; Annot_ID_132302
tcccaatccttattcattcagattgtggaatctaattttctactatgatgtgatttgctaataagttatgatgataccaacaaatgcttcttcttcatatgcagataaagaagaattcgcagattaaggccgaagcaaaggctcatcactaaaccaactcttcttctccttctcaataagattatgaagccaagtgattgttatctctaaatgtagttcttttcctccttaagctatatctccctcggtgacattttttccatctttctgtttttttaatcaaaatcttctgtctgacaaagcaatcgtatacccgttttggtttaaacctgagttcttctttggtactttcctgctattcaataaacaccatatttttatcatcttaaccagataaataatttataaaaaaaaaaaaaaaaaaaaaagaatttttattgttttcaattaaaataaataaatatccgccgtggcgcagagttaaaagtaagcagttggctattcaggacgaccaatgtggtcactgcttggtggcaagaacaagttgtgttcgagctatacaaggtcgtggcttcgaacattggtcacactcacacattcgctgtctctctttctcacgtaatagaggcattcttaaatgcctttttctgttctctttcattctctacaatttattaagttatttgaacttattgtagaaacctaaatgtttgcacccaaaattaaaggttacaagatgagtatcttctttgagattttgagaagagtttctctatatggcgttctatgtctagtttgaataatcaaatcatcatttatattcccatcttgaaactttaaaatcactatccatagaatattcaaaaccataccatgaacactacaataatacaatactatataatatattcatcattatacttttaatgggagtcatgggacacgcagtaatcggttaatttcattgtgttggtgctttcttcattggacggatgagaacttaaagaataaattagtatgattttcaacatttaaatataaataccacttgaagtgtttttgtggtccattggctaccatcaacttgaggtatattaagtccctatatataataactaactaacataagttttggatttaaattactaaaagggtaaagaaaatataatctttactattaatagaaaataaataaatatttttatacaatgaggatattatataagtctaaatcctgagttaaaacctcaaatcctatgtttttttgttgtcattgcttggacataacatattgtttcgaccaaaaacaaaaaagaacataaaatgttcttaagattcaagttctttttcatatcaattaagaaataacttacggcatctttaatttatgtttgttttgatcaatcacataattatagtgaatagtatatttttagtgctattacctatccttacaaatccataatcgaatttcaaagcaacgcgacctaccctcaggtctcaaaacgcacgttcaccaatacaaagtggcattttcgtaaataacattaagaaaaaaacaaattaaaacagttttgtaataagatcaataattatatattattagatgactcggataagccattcggctttggtctttttgttattgccaacaattaagctcaggcttacgaaagtgattgtctgattgacgttttctttttcatttccttttttggtccctgaatacaccttttgagtttgaggtatatctgtcctctttcgaatctttttcttagtgattcctgattattaagaccatctccatcaatggtttctcattaaaaaactgttcaatataaaaataaaatataatcaaaaagtatgagagagagtagaattagtctttcaagtgagaaactctgagaaacccataaaaacacttgtatatcatctatttgtcaaatattattttattgttaaaatttaattatataactaatatttattaaaatacttatatcttttattttttagaaactaagaaagtatctcactgatggagatgcccttaatacaattcggtttgtatttatttctatttttcccgtaattttatgaccctgtaaaaaagttaccgtgtttttttttcacttttcttacatgacataattaattacaaagtatccatcaccacacaaatcaatacaaagctttttgaagtgtgatggtgtgtttatttaaagactttgaagtttggacccagaccattatcacacaagtggaccttattttatatttcgggtccagttgttagaaatttctttttacactgaattcattaattaaaaaaacaattatttaattagtacattttgatcgttcgttttcatgctacatttgagttttaaatagagaaggtctcaaactcacaactatttttttgactttaaatgtataaattagctgcaactttaacaaattgtgagtagttgtagttgcctagattctatttgaagactacagaccttaaaaaaaaaaaaaaaaagaggtcatagtcaaaaacaaaaaaacaccacatttggtaaatttatgatgtgttctctttttaaaaataaaataaatttcatgtaaaaaatctgtacgttcaaaatatctcaggtgattaatctgtaagtacaaattttaattttcaacatgaaattgaatgtttaacaataatgagtagttggaacttggattgaaaactcaacaacaactcattgtttggataagtaagtagaaatctggcaataaacgtattctatttttgtaacgtagaaaattagaaaaataatagtaagaggaaaaggcatggtttagtctggtcaagttaatgtaaaccagagtggttaaaaacaaaacgacaaagcaatttggcttcttaaaaacccgcccatggagaaagccctcacgcacctctaaaccacaaacaaaaagagagagaagagaacgagagaatcattgagaaacgaaacaacaatg

SEQ ID NO: 26696 - DNA, 3003 bp, Unknown; identical to SEQ ID NO: 26695
  misc_feature (1)..( 3003): 2750-1469P.txt file - cDNA_ID_2715488; gDNA_ID_2213642; Annot_ID_181307

SEQ ID NO: 26697 - DNA, 3003 bp, Unknown
  misc_feature (1)..( 3003): 2750-1469P.txt file - cDNA_ID_2715504; gDNA_ID_2213642; Annot_ID_132298
aaaaaaaagaaaattactaatgaaattaggatatggttagtaaattgtagattaatgatttggttttgtatattattgatgttggtcatctagatataaaagtaaagacttacttagtccatagcttctatcgcggctgaggatgtcataccatctcattctttcgcaatatttcttgtatacatggtcatcttcaactccttgtgtttgaatattctctatcgtaaccgaatcttggagcgctgaatccaagcttgcaatagataaaggcgagggatgatctcttttgctagaaactagaaaagatagatcattctccacgtctgagtttacaatttcttcttcttcgtcatcgttggttaaagaagcttcatcttcttgatgtattggcatagtttgaatttcgaactcaagattcttctccatgtttacaccatcaaaaatgtcaacgtcgtgttcctcctcaacctccttagcatcaagaagctcaacaacatcttcttgatcatattcatagaaaaaatcatccacatcttcttcttcttcaagaatcttgcctttttgcatagatatacgaacttttaaatgactatccacttgatatttaaacgaaaagctaaatgcaggaaccgggttatgagtacttgtagagagttccaagttatcaagggtattcttgatctcttgcctagactcaatatgacaagtaacctcctttttaaacataatgactcggaaagaactactaactagcttagagaacgtgaacaagaccgatgaaaaggcgttgtaaagagcttgaaagggtgggagaagccataaaaagaagagataaagccatataagaagttgacaaagaaagagaacaagagggtgcatgtataatttcatgtaagacgatttcaagaaaccatcttgaatcactatggattctatcattagccaacatgctgagagtaaagccatcaaatgtctgagagagagatgagagaggggggagagagagagagagactcaagagagtgtctttataaagaagaagaagaagctgctgagaaagagccttgttgaaatatttcccccaagactaatcattaataaataaagttggtaaaaggtcaaattgattatcttgagtgttctttcctatcagttccaagactttggttttaaacatgtttggaactatccggatattgaattaaacttgttcaatttgtaacagaaaatattcgtctttagtgaattaactaaacctataaggccatgtattggctataatcatcttttttaattaaaagagccaacttgaccctccatagttgtaactgttaatcacttctcaagctccatcacaacgcacatatgaagaacatagaaaactaacaaacacacatgatgatgttcttcaatgtaagtaacatctctttcgcaaccttcacaattgaaaacctaaccagatcataccatattcaacatcaatatctatttcgatagggctcgatcccgaatgcgaaaaaaagcaagcaaatcagagagtataaccaaaatgttcttcactataacctggttcccacaatatccttacaatgcttattccaattgtacattatttaaacacatggactataacatatataagtttttgtaaaagagtgtgtatgagagaataaaactaaccgaagaaaagtgtagtgatccaatctcatttccaaagattgaacctttttttatatatataataactttgttcgcttattcatttcttgatcttcctctgctgcttctttggcccggaaacgactaatctccttacagaacaaccacacctcgctctgaaaacaagcacggctcgcccattaggcggagccatcttcttcagctcagcttccaattcacggtgatgaacacgaggcaactcaaacattcccctcttgttgctggagctcttgacgcattcctcagtctcaagctgaatatcaaactcaacagctttcctaaggcctttacaattcggtttgccgcatctctgcatagtacacaagagtataacaagccaagtagagatggcagcacagaagatactcaaagctaatgatccatacacaatcgggttctgcaaaatctcttgtttgactaaaagagagagatctgaaaagacctcaatcgatttgagggtgatgagtttgacgtaagggaagaagaggaagccgcaggcggtgatgaccgcgataaggatcacgacgtcgatagcagcggactgagatccgtcgcagacagggaatttggaacaggttggtgatgatgaagatttattacgggtgtttctggatttaggtgaggagtgagacatgatcattgggtcgacggaattgcagaccgagattgagctatgcaaatataccatctcactcacaaacacagagaggccttgaagataacaaacaacaatccaatcgaactagtgatagagattggatctccacgagtttaatcagaatcgatctatgagactagatttgaatcccaattcttcagatcgagcataacgtagagaaatatccaagtcacctgattgaaaagctcggtttcaatctgatcgacgaaatccagcagatgaaaaatcttcggaacttgtcggttactacaaactgatcgaatttcgatccgcacgaggttgaaggttcgtgaagccgattgaaattcaacgtgtagagagaggagactgaatcgtcgtcgtcgtcgtcatgatgaagaattcaaaattttaatctctttagtgttttaggttccaaatccaatcggaatcaatgtgaatagtagtaagtttattcgtctagtgacacgcaggcttttttagataactcttttttacacatgacgtcatgtttttttttttttttttgagcagacatataaaaaccctaattttccgattcttcttcgtctaccagagtcctaaaaccctagaagctccgttgttcctgaatcagtctaacgatg

SEQ ID NO: 26698 - DNA, 3003 bp, Unknown; identical to SEQ ID NO: 26697
  misc_feature (1)..( 3003): 2750-1469P.txt file - cDNA_ID_2715504; gDNA_ID_2213642; Annot_ID_181302

SEQ ID NO: 26699 - DNA, 3000 bp, Unknown; identical to SEQ ID NO: 10308
  misc_feature (1)..( 3000): 2750-1469P.txt file - cDNA_ID_2715508; gDNA_ID_2213642; Annot_ID_132297

SEQ ID NO: 26700 - DNA, 3003 bp, Unknown
  misc_feature (1)..( 3003): 2750-1469P.txt file - cDNA_ID_2715512; gDNA_ID_2213642; Annot_ID_132296
caccgcagaccaatgatagtcaactacattttgatgttaattaatctcaatcttctaaccacaaactcttataatattgcaagttagtttaaactacttacataattgagtataaaatagcttcaaccttcatcaacaattcattatcaatcgagcaaaaaacaaaagctaagagcaacaaactaaagattttttaagaaaatggcagcttctaagcgactagttgtctcttgcttgttcttagttttgttgtttgctcaagccaattcgcaaggtttgaaagtaggtttctacagcaaaacatgcccacaactcgagggtatagttaaaaaggtcgtgttcgatgcgatgaacaaagcaccaacacttggtgctcctttgcttagaatgttcttccacgactgcttcgttcgggtatgtttctgtaataagtgaaatgaataatgattttaatatatttcatgatgtcacgttcttaataatgtgagtgaatcgtgtatgatcaacagggatgtgacggatcagttttgttagataaaccaaacaatcaaggtgagaagagtgcagttcctaacctaagtcttcgagggtttggcatcatagacgattccaaggcggctctagaaaaagtgtgtccgggaattgtttcttgctctgatatcttggcacttgtcgctagagacgcaatggttgcagtaagtaattttcacataatacaaaatttctacatatatacaaatataatagagctctcttttaatttattatatatcctgaatatgttaatttctagcttgaaggaccatcatgggaagttgaaacgggaagaagagacggtagggtttctaacatcaacgaagtcaacttgccatcaccttttgataacatcaccaagcttatcagcgattttcgctcaaagggcctcaacgagaaggatctagtcattctctcgggtacgcaaaagtgaattaatgatatttactatagtctgaaaaatgaataattaatgatggagaatatacatgtttttctaaaggtggtcacacaattggaatgggacattgtcctttattgacaaaccggctttacaacttcaccggaaaaggagacagcgacccaagtttggactcggagtacgccgctaagctcaggaagaaatgcaagcccaccgatacgacgacggctctagagatggatccggggagtttcaaaacatttgacttgagctacttcacgctagtggctaagagaagaggacttttccagtcggatgctgctctactcgacaactccaagactagggcttatgtcttgcaacagataagaactcatgggtcaatgttctttaacgactttggtgtctctatggtgaaaatgggtcggactggagttcttacgggtaaggccggggagatccgtaagacgtgtcggtctgctaattaagagatatagaaatgaaaatatctcaatatatgtgagtttgattattattgtttgcttcttttattttgttgtcatccctatattaaatgtgattgttttcttgggtattgtttcttgggaataagctgtatctaaaatttataaaagtcttgaaagttcagaatgttattattaagttataacgtttagtcattttgaaaagccaaaaaaaaaaaaaactgaatcaccatggatttgaatattgagaccataattaagttaaacaatgtattttttattattaattaataataaaagttaagatttgaaggaaaatggttaaaaaccaccaacttcagcagaacatctgttccaaactttaagaatcctgggacgacctttagaggcaaatggtttgtaataataagtctgaaacaaaagattcctcagcaccatgtgacattcttggccatatatgatcattttcagacaacaatacctcgaagttggtatgttttgaagaatctcagacatgacttgatcgctacatttttctccccccatcaagccagcgcaagtcccggcaaactgaacaagttctgttgactgtttattaagcatgtctatattgtattcactcgtactcggagatcttgcaaacgtggaatctaaatcaatattgggatctatcaacggtttctcatcatctgccaaacttggataagcaaacagtaccaacgtggtgattagaacaaaagccatgtaaacgtgattatttttcttcatttttttattttataacttagcctcctctttcacctatttactccttgtaaataaaatttgtatgtgtatagagattatataccctaaacacacagtagtcaactgaatgttattaacttatccgttatattgtaattaataaaactacgttttgtttctttgtttgttttctattaacaaaaaaaatgatttactctataaaatttgacgtttttttttgtaataaaaaatatgttcagttacgttattactattttatgtattaaatgtaaaattgaaaaaatgctttatggaattctgaatttcttgaaaacaatttggagggtggcccaaatcatcaattttcttttaaggtatttattattcaataaagttttattccggagttatgctaaagaaaagagtgtcgatatctgtattttgtggacgatttagattacgaagaaaatctcgaggaataaaaatttatgtggcgagagatcaattgcatcataatattatgctcatgaatcacgcgagagtttatggtgatttcgctcattgtgtccccattctctcttcttttgtttgattcctcctccctcttggttaacaacaacttcactcacaaagcattcccttttttatttttatcgctactctccgacaaagccttcttctttggatcatctagtctaggttcggttttctcaattagctctgttcgatttcgcggatgaaacttgttcaagtttgtgtctgatctgctctgctctgctcatacttaaaaaaggaaactttatttttctgtaaatg

SEQ ID NO: 26701 - DNA, 3003 bp, Unknown; identical to SEQ ID NO: 26700
  misc_feature (1)..( 3003): 2750-1469P.txt file - cDNA_ID_2715512; gDNA_ID_2213642; Annot_ID_181299

SEQ ID NO: 26702 - DNA, 3003 bp, Unknown
  misc_feature (1)..( 3003): 2750-1469P.txt file - cDNA_ID_2715516; gDNA_ID_2213642; Annot_ID_132295
tgttttcaagcccaagtaattagtgaggacattttcgtcaatttttcatcggaacgcaatttagcggttaacgccttaaccgtcgctcagaaaaaaaaaaaaaaaaaagttatcataaactttggcgatatgaatttacacggcgtctcgggccatcacgagcctaattccgaacctccaattccgacaggttcgtcgagtccgaagctgaagattagtcccaaattgaatcggtggtctaggggccgagctttaagatctggtgttaagcttgaccgtccaattccccgttccgataactcacctcgccgtcaagtaacggaagcccaaccgaccgatgaggctgataagaagacgacggcgatcgacgtggaggtaacggcgggaaagtctatatatttggtttccgacggaactgggtggacggcagagcattccgttaacgccgctttgggacaattcgaagatttttcgttgaatcgtggctcttctgtgaatacccatctcttctcctgggtaaatgaaaatcaaatcttcttactttcaggaaaaaatatgtcctttcttagaattctctgtgaatgttgctagtagaattgctcataggatagataaaattggatcattacatggaaactgattatatcttagtgaatgctagttgcaattagtgatcatctgagcaagaaaaaacttgacttttaaaccgaaagtgttaggttttgagaattgtcattactttggttttgggttggggattgatcaggttgaggatgaggagaggcttatcgagattattaagcaagcggcaaaggaaggggcaatgtgtttctacactttagcaaatccttctatggcaaaatccgcaaagcaagcttgtgatcagttgggtgtgctttcggttgatattctaggaccaatcatcgaagggattgcgtctcacttaggtgtttctccgtcaggtcttacacgtggagcacctggtagggtcaagactctcaatgatgcatatttcaaaaggattgaagccattgagtttaccattaagcaagatgatgggactttacctgagaacttaagcaaggctgatatagttcttgtcggggtttcccggacagggaagacgcccttgtccacttacattgctcaaaaagggtacaaagttgctaatgtgccgtttgtgatgggcgtggaaccacccaggacgctctttcaggttgaaccgagaaaagtttttggtttgaagatccagctcgttgtactgcaagcgattagaagaacaagggttaaaacgctaggcgtagatacagaggcagagaacaattactcggggattgatcttgttcggaaagaactagatttcgcgtcaaggatctatgagcgaaaccccggatgggcagtgataggtaaacaaaacttaaacaccattctcatttgctactcaaaatgctgtttttttctttccttttaatgctagtaagaaaaaaagttaacaagtaggcagagtattctcatgtgttattcttggggttgtggcgcttgcagatgtgacgaataaggcgattgaagaaaccgcggctgtgattctgcggctgtaccatgacggtagagacactagtactacggtaccgcgtatctcaaaacgctactaagcacactcctttgaccgtagagaggatgaaacaccagtgtcgataaagtatcaagtgaataaagtaatatatgtctataataataagttgaataacaaatccaaccgaggcatgatgaatcatatgttttagtcaacgaatgtaagaggatgaaggataacgaaaactaataattgtggctactctgaattcttttattactagtctataaaacaaaagaatatctgtcattagcatttagttgcaacgttgcaatttgggtgtgtttagcaagttcaagaaaagtcatccaaaacttaatgtcattttagttaatctattttgactctttctattcgtttatgaatgaatatttcggtaattaccaaaaaatcttctgattatccaaagtagatgatcagagatttgtgtccatcttcgatttatataactaattagtgatattttcttcctgtaagtaaacgatgaacctggaaacatgcaaggttttttcgactgtcaatttatgtggatgattattgctattcaatctgttcatccacatgattaataagatgctaattggtaacacatggcgtagtttagaaaaggttaaaacgttgcggtcaaatgattgacgtaattggaagaacatgcacgaaacattacaggaaacctataatgcatggatgcatgtgggatcaaataattgttatcgataacgtccaagtatcaattgatatgcatatatgtagatattttaatctacttgataagataaaaacttaattttaatttaagttattcttccaactgttgttggcaaagtattgtcccactctataaggcaagtaatacaaaatacattgttttaactatatccgaactctatatgtctttttcttgttaagtagaggaactagaggtgtcttagtgacgtgagacacacgaaattttcaattcttaaaaccccatttgtatttaatttgggcttaaagaaatttaggcagccattttttttggtggtagcaatatacaccatgcataagacaacatcgacacaaatattatatacacatatatatagtacgacttgtatcaatttgcctcttcttatttctacaaacaatgattggtcttaagaacaacaaaaatacaacaagcattccaccgcagaccaatgatagtcaactacattttgatgttaattaatctcaatcttctaaccacaaactcttataatattgcaagttagtttaaactacttacataattgagtataaaatagcttcaaccttcatcaacaattcattatcaatcgagcaaaaaacaaaagctaagagcaacaaactaaagattttttaagaaaatg

SEQ ID NO: 26703 - DNA, 3003 bp, Unknown; identical to SEQ ID NO: 26702
  misc_feature (1)..( 3003): 2750-1469P.txt file - cDNA_ID_2715516; gDNA_ID_2213642; Annot_ID_181297

SEQ ID NO: 26704 - DNA, 3003 bp, Unknown
  misc_feature (1)..( 3003): 2750-1469P.txt file - cDNA_ID_2715520; gDNA_ID_2213642; Annot_ID_132294
ttttacgttggttattactattagtgcaaaaccaaaaataaaaaaaccaaagaaaaaaacaaacacaatcaaattagaaatgaaagttgaattaaacaccttatttactatataaacacacatatatacttacttatatagatacatacctcagcaaggagtttcttgttataggcaagtagagaagcattgtcggatttaagagactcaaactgtttcttgagtgaatcataatctctctcgagctgtctagtcttccacctagctctcctgttttgaaaccaaatcgcgatctgtcttggttgcatccctaatgctttagctagttgtatcttcctctctggctccagcttgttaccaagctcaaagctcttctctaatgccttaacttgctctaattgcagcctcttcttcttctctcccagcatagtatgtgccccatcgtctgatagattctcctcatccaaggtttgattatgatcttcttgcacgttcattaaagacatagatctgttcatcatgtagtttcctcctcctatatacaccaacagaattcatgactcaaatctatttatgtggagaaatagtgagagaaagagagagtatagtaccattgaagagatgaggaggacaagaagggagctgatcttgactgttgtcttcatgaagttgttggaacataaaaccatgttgaggaaacgccatctctaatctcaatccagcttctgttgttggatcaaacacatacatgtatgtattccaccaaaaacctatcagtgattaatggattgtgaaatcagtatagtgatgatcaaatatactttgttgtttgcagatttggaaatcactatcaaatgagttaggtgtttcttgtggatctcatcaacctctcatataagagaaagagagagaaagaatgaggaaaggatcaagctagggaggtttctaggacccatccttaatattttaaaagctttaggcttattattatatttcatatatattctccagttcatgtaataaagttattttatagtttctgcctcaaatattttcgatcatgtaacgttactaatcatatcttcatgatggttttttttttctttttcttttcacaacaccttttatgctttaaaacctcacatatcatttatttatgttttccaaggaagcccaaagactttttacatcaattgcttcctcctccaccgatatgggccgctgcttttgcagcccggcccaaagcatctgagaaccataaagccccattagcaaagtaacgactgttgaccacactagtcgctgcagctgcagccactttccctgtaatggtggctgcggctacagcagctgtgcccgtgacaagaaccgcggatttagtgaaatccgagaaatgatacttctcgtccgctgatctcacgagttccatactcgactgaatgttctgtgtgaggccaaggtaatggctgatctctgccaatttggtcgctaccaagcttgaaaatctctgagactcatccaaagctttggctttaccaatcgcgtctttgcttaaaacgtagcctttagctaacatcgtctgcacaacttgttgagccacggttatggcctctccaggcgatgaagcaaacgcgtctgaacgagtcacctacaaagaaacattttcgagaatctttggcttataacctaaagtaacctagtaagtattgtttttaatgttaccgtaacactatagtcttcttcttgtctgagattgttagattcatgtaaatagacaccgtagaccgatatccaaacggtttgatcaacgatcgtagctccctgaagatcaacattaaaatcaatgccaagaagatcatactggaaatttctagctaattaagggacttacgctaagtaacacagccatatccagagcatacgcatctctgaaggttacataagccgttaatgcatccccttggcacctgaaatccatggagacatgaaacaaaatataaacagattcaagaatgattaataatttactgaacaatgaacgttgttgttacccggtgatttcaacgagctcgacgataccacagtgagagaagaacctatgaacatctttctcagtggcttgaggagacaagttggtgacttgagcaacgtaaccacaaggatacattatattgttctgttttctcacacgaacctagatacctaaatcaaagaacaaacataaacaagattcttgaatcacattccgtgaaccgttgagcgattttctagagatttatacagcaagaaatctacaaagctacgattactataatgattcaaataaaaaaaataaaaaaggtgtccaggccaaatagttagcggagagggaagaaagaagaagtaagaaccctagattataattgaatgagataagagatgaaagtaacagtaacaaagataatcaatgagatatgtatcaaccaaccacacaatcggaaacttcgagaagcagggcacgaaaaaaaactgatagtgtatgttctgttttagattacccgattaaggcacaatagaacaggacgtcacaggattgaagccaagtatcgaaagagacggagagaaaagaagacaagattcgtgtgattgtgagagagaaagaggattcttcaaatttaaacaaaaaaagaaagaagaggaatgttaacatttaaaccaaaaaagaaagaagaggaatgttcacataattttttttcttttgtcggctcgatcgatatcgatgttgtggtcgacgatacgcgtcaaacgtaagctctagcgatgcgcgtgttattattgtttccacgagtcttttgggcactttttacttaggctttttaaagcccaaatatctgttttcaagcccaagtaattagtgaggacattttcgtcaatttttcatcggaacgcaatttagcggttaacgccttaaccgtcgctcagaaaaaaaaaaaaaaaaaagttatcataaactttggcgatatg

SEQ ID NO: 26705 - DNA, 3003 bp, Unknown; identical to SEQ ID NO: 26704
  misc_feature (1)..( 3003): 2750-1469P.txt file - cDNA_ID_2715520; gDNA_ID_2213642; Annot_ID_181296

SEQ ID NO: 26706 - DNA, 3000 bp, Unknown; identical to SEQ ID NO: 10305
  misc_feature (1)..( 3000): 2750-1469P.txt file - cDNA_ID_2715524; gDNA_ID_2213642; Annot_ID_132293

SEQ ID NO: 26707 - DNA, 3000 bp, Unknown; identical to SEQ ID NO: 10305
  misc_feature (1)..( 3000): 2750-1469P.txt file - cDNA_ID_2715524; gDNA_ID_2213642; Annot_ID_181295

SEQ ID NO: 26708 - DNA, 91 bp, Unknown
  misc_feature (1)..( 91): 2750-1469P.txt file - cDNA_ID_2715539; gDNA_ID_2213642; Annot_ID_132284
aagctttactactcctcactgtttgcaccaaaatatgtgaaagagctcatcgcatagaaaaatgtaaactgatttgcactgttgacagatg

SEQ ID NO: 26709 - DNA, 91 bp, Unknown; identical to SEQ ID NO: 26708
  misc_feature (1)..( 91): 2750-1469P.txt file - cDNA_ID_2715539; gDNA_ID_2213642; Annot_ID_181285

SEQ ID NO: 26710 - DNA, 3003 bp, Unknown
  misc_feature (1)..( 3003): 2750-1469P.txt file - cDNA_ID_2715543; gDNA_ID_2213643; Annot_ID_132317
attaaactgacaatttcaataaaccaaaattgaaattctcggttcggttcgaatgaaaccttttgtaggtcgtggtcgtatatagttggacacttgacaaatctgagcatttcctttttgcttacagcggaaatatctgaaccaacgcgatgccgtcgacgcagtccttgaccgtcgcagcgaagacgctacgaaatcggatcttctctaggtctggatctacatccgccggtccgagtcggtgggcgacgccaggtcacgaggagcgacctaagggttactttatgaaccgtactcctccggcaccaggacagtcgcgaaaatgggaagattgggagcttccttgttacatcaccagcttccttacaattgttatcctcggcgttggactcaatgccaaacctgatctttcaatcgagacttgggctcatcagaaagctttagagcgtcttgagatggagaagctcgcgaccgctggagattcatctgattaagcatcaccgttggatctccggttgcttgatttggtatgtccttattctccgggagttgaggagtttttttaccgtttaatgatgatgataacgaagactggagagttagggtttcgtttggcccttgaactttgtttcaattctcctttgttttgtcgataatgatgatgttcatgaaataagtgttcttttaactgtttagacgcaattgccttcactctctacttcttattacaattctcaaatttggtcacttttgatttactcatttctcaaatgattcaatttcgactattgattgctgcattactaattggagaaagagattaaacgagagttgtatgctgatgttgtgtgcttctcttccttagttcatggcttgtttatgttctctgtgaatctcaggtttgcttgtttcactcagtgcagtgcatattgattagattaatagctactttatgttagtcgattcttatctctttagatcatcttttttatacttgtcatttgttgtagtagtagtgataagctgatagtgtagctctaactagggcatggattgttcctttgtgttgtagacatgttcgtgattataggttattgcagcgtgcacaataagttttgtaggctttcaagtggttggaatggcatcagccattgttagatgcaacactctagatttcagttttgtcatttgctgtattttattaggctagcgtttggagttttcatggtgtcagctattggtagatttgacacactagatttcagtttctttgacggtggtgtttattaggtttctacttagctgagaatagcagatgagaatgttgatttcgatcttatacttggacaagtctggagttgaaagtaacttcactagatttgggtagataatgttttagaaatcatgactgcttacctctatctctatagattttggtcgattaatactatactgcctttgagtactactattgctcatagtttcccaaatcctttgtttagtttcctaaagtgtggcttcatattcttctcttttaagtacaagtactttatgctggtgttggctttttagcaagcttgtgatcttcatctcatcctctggtttcatacatgatgattaaacaaaagaagagactagcgattaaacaatagaagagactagagtagtagcttaatttgttgtttgccttagttgagcaatctcgtgtcatcaaattgcatcacatagagagggatcttgtggtaattacttctctctgtgtagttgtgtttcccgagagtacaattctgtaacactgtctggaaccattaggctaggtctaagaagagacattatcacgacactcttcacatgctttttttttttatctctggagacccaagaagagtctagtgtaaagccatgtgaagaccatttgtcatctatccatttcctctgtacatcaatcagatgttttcagtttaagaaggaaaaaaaaaaaaactcggtagtcgtatgtaaatgtaagtcggtgtcggtcggtggagttgaagccaaataatcaataatgtttaggacgaaagtgaaaaggtcaataacggtcaattaaaagtaaagtttatttttctggtaatgtgaccggttattcccggtaaacacacgagccaccgacacatacttccatgggtcacgaccacgattgcagtccgtacacgatccatgtttttatttatttaaacgcaccataacttcccgcattcggatctcccatagcaaagacagagagagaagtaaagtagctttattatggattacagataaaagacaggtaatctcaatgacgcaaagataaagacaggcaatttcacttcagtgatgcaaatctgacagtagacttcactcttgtgtatattaaagtaaccgtcttgaagaggaaggaagataaccaagtgaatttcgtgatggtttcattgtaaaacaccactttttcaaattctctccttctcttggtgctctgtttctgttggagatttcagtcattggtaatctcttcttctcttctctagtcctcatggttgtttcatgctctgtttcttttctttgaaactgatagatagatcgttggatactttagaaaatgcattttattggttttatcaaatcaagttaatttactcgttcttgtaaaatccctatgtgaatgcacccatttttctattttagcaactatggacaagtagctggggcctcaactgctactgtaggatcagacaaaaacatagcaagtgccaattatgtcattttcctcctccattatttgctgtcgttttcaggaacaggaatatatcttagctgtgttttatcctttcgctcatcttgcaaaatggaaatctaaaaatctttacttcttgaagattgattatcacagaattttggtttctttcttgtctttgtagggttacacaaatcttcttggattgttttctcacgttgctttggctgtattgagagagtttcacgatg

SEQ ID NO: 26711 - DNA, 3000 bp, Unknown
  misc_feature (1)..( 3000): 2750-1469P.txt file - cDNA_ID_2715553; gDNA_ID_2213644; Annot_ID_132353
gcttctagattgtgatttacaatcttcgaactctcggtgagtttctaggtttagggttttatctctctttacacgacaattgttatggccaatcgagaaagagatcgagagcttctgattcccgtcgctgatttcggcgacaaagacgatggttcttcttcgaagccttcttcttcttcctctgcttcttcttcgcatcaatccggccacgaggtctagtttttgtcacctgatctaaaaacgtgttcttcgttttctcatttcaagattcatgcgaaactaacagtagaattggatgatagttattcatagatttggtcgattctgtctccccttagttcaaaatcttggaacttgttttgccctagattcagtatatcacaagaacacttgcttagataagtttggtagttgtgattgagtagagtatgaatttgcattccaagttgttgtggttggaatcattcagattcttgagtctttgtattatgctcattcatgttttcaagcatgtataacttatagagcattgtggcctgatgctttagctcttttctgcagactttaagcttgttcattaggggttgggcgtcaaagaagttcatgacaggctggtaaggaagagttgaaattttggcatttgatgaaaacttccacagattagttttaagtctccattgctttttgcagtgttatcctacttcctattgcagttactttctatacaacatggtggtttattcactttgtcgatggattcttctctccaatatatgcactacttggaatcaacatatttggtaagaatttgaatggcccctctttatcctattaacaacttgatatcggtttcccacaatgagtttgattattgttttgtaggtttcggttttttgacttccattgcattcatcttcttggttggggtgttcatgtcttcgtggttgggggcatcggttctgaacttgggagagtggtttatcaagcggatgccatttgttcgtcacatctacaacgcctccaagcaaatcagcactgccatatcgcctggtctagcttgcttataaaaatcttgttttgcttctcaacattaagttgatctcctatctcatcttgttcttatccatttctcatcacagatcaaaatacacaagctttcaaggaagttgcaatcatcaggcatccccgtgtaggtgaatatgcatttggcttcattacatcaactgttgttctccaggtgagtgaaaatactttgctcaaggattttgttattctttccagaacgtctccttgaggatacaaacaatttcgagttatatggtttaccataatttcgtaatctttttacccaatgtaataatgctattcgttcttgcagaactacccaaccgaggaggaactttgctgtgtatacgttcccacgaaccacctttacattggagatatactacttgtcaacagtaatgacgttatcaggccaaacctctctgtccgggaaggaattggtgagatttcagaatctaattgtctatactagatacatttatcgtttgttatatagcattcaaattattttgtggaaagatactgaacactgtatactcattcttcatctgcagagattgttgtttccgggggaatgtcaatgccgcagattctatcgactcttgataaacctttggcctcgattggaaatgaatcttaaagtgactattcaaaaacctttggccgatcgataggaaaaaataaaaaatcagaagagacgtttcacaaaatctgagcgaatagagaaaccaaaaaacacagaaaaatttgtcgagaagtgtaatttgtcaatattatttgaataaccttgttttcttttagcccttttaaaaataattttttttcttttcttatagattataatttgtatccgcgtccttgtgtctttcatattactgtcgcattgactttataacaaaaagataatcaaagataatcccaccctaataataatcacatgacaaatggcaatatcgttttacatattagggaatagtataaaatgtggtatatatagagagacattgttgatcgaagaaaaaaatggtctaacatttctctgtctagctcttcttttgatctcaggtacgttttgtttccaacatgttactaattcttatggtgaaataaaatactgcagctaaaaatgtatcgaccaaaattttcttagaggaggattgtgcttagcacctgacctaattatgaatcttcatttctctgcctttgtaaactttaatttattttagaactttatctcatatagaaatctcaaatatatatatattatagtttttgcttaacttttatatttaaaataaatctgaaagttgtaagaaaattattttccatatcagatttaacattgggtgcagtcttgggaaaatatataatcgttagaataattttctcttttaatgtgataattcgaagacgtatgtaacaaacaaaaatgacaataataaatattacagtataaatcatttaaaacatatactataattagttattttttgcttaaatatgatggaattgttttgatattgcttaagaatcaaaaatgttttactctagataataaaatatttattgtaaagtttatttttacgatgaatgtatatgatttcaagtagaacaaataaatttttgatatattaattcacaacaataaaattaatcttttcatcttttgaaaataatttgtatacagtaatttgaaacaaaaattaatcatgttataattaagaaaaggataaataaaagaagacagatataaaaagaaaaatccaaaaacgacagagagctcaagttggagttagctaagcttagctacaaaagaacagtcgccggcaaaagtctcagcctttttcctctccgccgttcacagttcaccggcatttctctcttctttctttttctccgactagatttccttgtctctttggtttcttggcgatg

SEQ ID NO: 26712 - DNA, 3000 bp, Unknown; identical to SEQ ID NO: 26711
  misc_feature (1)..( 3000): 2750-1469P.txt file - cDNA_ID_2715553; gDNA_ID_2213644; Annot_ID_181389

SEQ ID NO: 26713 - DNA, 3000 bp, Unknown; identical to SEQ ID NO: 10372
  misc_feature (1)..( 3000): 2750-1469P.txt file - cDNA_ID_2715566; gDNA_ID_2213645; Annot_ID_132368

SEQ ID NO: 26714 - DNA, 3000 bp, Unknown; identical to SEQ ID NO: 10372
  misc_feature (1)..( 3000): 2750-1469P.txt file - cDNA_ID_2715566; gDNA_ID_2213645; Annot_ID_181410

SEQ ID NO: 26715 - DNA, 3003 bp, Unknown
  misc_feature (1)..( 3003): 2750-1469P.txt file - cDNA_ID_2715580; gDNA_ID_2213646; Annot_ID_132392
tgccaatatgttccgaggatagcgagaatctatccgcttttcaaggaagtaacaagaacttctggtttggtaactgaaactgcttgggctggtgctgctttaaacctattcctctacatgttagctagccatgtaagaaaagattattttatttgattctttgctccacttgattaggttatgtttgggcaaagataacggttttaaccattgcgaaaaatggacaggtttttgggtctttttggtacttgatttcgatagaaaggaaagatagatgttggcgtgaggcgtgtgctaagatacagaattgcactcatgcatacttatactgttcaccaacaggggaagacaataggttatttttaaacggttcttgtccgttgatcgatcccgaagaaatcacaaactcgacggttttcaactttggtatattcgctgatgcattgcagtctggagttgtggagtctagagatttccctaagaagtttttctactgtttctggtggggtctccgcaatcttaggtttgtaacatctaaaactcttacttattacggttcggttactttttgttatctaatcgatgaaatcttatctttctgtgtgtagtgctttgggccaaaacttgaagacgagtgcctttgaaggagagatcatttttgcaatagtcatttgtatttctggactagtcttgtttgctctcctcattggaaatatgcaggtaatcatttctcttctcctttgagctcttaaaacaaggaatatccatatatatagtcttaaagagttctgtgatttgtagaaatatttgcaatcaactactgtaagagttgaggaaatgagagtgaaaaggagagatgcagagcaatggatgtctcatcggatgttgccagacgatctgagaaaacgtatccgtaaatacgaacagtataaatggcaagaaaccaaaggagttgaggaagaagctcttctctctagtcttccaaaagatctcagaaaggacattaaacgccatctttgtctcaagttgctcaaaaaggtaaccttttattttgtcccatcataacttcttgaattcactgttttgttttgtttcaggtgccttggttccaagctatggatgatcggttactagatgctctatgtgctcgtctcaaaacggttctttatacagagaagagttacattgtgcgtgaaggtgaaccagtggaggatatgttgtttataatgagaggaaatttaatcagcaccactacttatggtggcagaactggtttcttcaattctgttgacttagttgctggtgatttctgtggagatcttctcacttgggcattagatcctctcagttcccaattccctatctctagtagaaccgttcaagctttgacagaagtcgaaggctttcttctctcagctgatgatctcaagtttgtcgctactcagtatcgtcgcctccatagcaagcaactccgacacatgttcaggtaatactttcaattgaaaaaatgcatgttgagttaattataaaagttaacatattggataatgaggacatatcgtatacctatctcgtttctcaagtttccttcaacataataaccctaaatctttttattacctaccttgtatcttgtttctcaagttacctttaatattataacctaaacaactttttgtctccaggttttattcagtgcaatggcagacatgggcagcatgttttatacaagcagcatggaagagacattgtagaaggaagctctcaaaggctttacgtgaagaagaaggcaaactacataacactcttcagaacgatgattcaggaggcaataaacttaacttaggtgctgcgatttatgcgtcgaggtttgcttctcatgctctgaggaatctaagagcaaatgcagcagcccgaaattctagattcccgcacatgttaactttgttgcctcagaaaccagccgatcctgagtttcctatggatgaaacctagttgtgtatatagttgttgactctatctctatgtaatgtgatcgctagtattttttgcaaatgattatgtaaccagtaaagagctttatgtgaaataatcaataggaaaaattcttatagagtttagttaaaaaataataattaatggagacattaattttagcgagaatctcaccaccacaaccactgtaaatgttttgctatccaaaaacactttctaagtcctaagctttaaaagcatctctcattaaacaatttttccacatagttaggagagtttactagctagagacggtagacttatctctctattggtggtccagcttggcttcactctctcgaattgacgagtttagtcttattacgacgactttcaattgggtctgtattgactaaaagatggccaactaaaataatgatttaagtatatatttgaagatggtacgaaatgggcatgttgtgaaaagaagacaggtagagaaattggattttgtgaatattattgtaagttgtagggcaaagagagtgagactgcagagcccccaccgtagacgactttactgtctcttcaagtccatttagcttaccactctgcatccacatacatgagtctgtgttaaagctggagaacatcgatttgcccaccatttctcactgccaaagccatacccatatttattctctctcggtctctcttctcggtctctcttctcagtctctcactcccacagcctttagttcgagaagaccgaaggggacttcattttcttgtacgggaattaaaatattgaagattgacagataaaaacatgaatcttcagaggagaaaatttgttaggtagcttcttggaatttttatgaacaagtttaacatagcttcaatctagtatttttatatttacttttggcagtagtgatcatatcttgttgatacaggcttgatagtacgggagttgatggaaaattgaaaagtgttagaggacgcttgaagaaggtttacgggaagatg

SEQ ID NO: 26716 - DNA, 3003 bp, Unknown
  misc_feature (1)..( 3003): 2750-1469P.txt file - cDNA_ID_2715584; gDNA_ID_2213646; Annot_ID_132390
agtgtattactcagctttgtaacaacattattagagagaataattcactttcattgtataaatgacaaaaacaattaataccaacttgttttgataattacaaagtaacaaaatagaagcattcagagttttgaagttatatattcatttgaaatgtcttgaaaaaagttatatgtctttctttgacaaaacaaaattcagtaaatttcaatcaattatatatttttaaaagtactatacgcacacaattctttatacaacgacaaaaagaaattttacatctaaaaatttcgtatatagataaattaacacgtttgtaaaatattgaataaatattattttgtcactatatacacagtaatcacatgtaataaattaaaatcaatcgatatgtttcgttagatctctcaatagataattattgatataaactagtacgaaaataacataacatacacagttacacatacataaacatataatatttgtaccaaaattattaagaaaaagaaatttaaagctctcaatcaagagattttgtatgatatgaaatattcttctgatttttgaaccattttgcattagagaaaagtaaataaaactaaagtggtcctggaaacataaaaaaataaaataaaaatagagaaagaaagagatgctattcctggagactgagagtacagtggaggtccatgacatctcgtaacacccaacaacactcaacaacttgccaaattagctttcactagctgttgttatacattcatttcttaatttaaattggaatatcataaataacaccttataacattataaccaaagcataaactacatgcatatattcttagaagacattaactttttaattaatttccgattatagtgtgattacgctccttgcaaatactctacaagctatgaaagtaaaaaggtattggctactttcaccgccgctactatatctcgtgagtcgtgagtgaagccaagccaggctattattaagttgtgtactactcattccgtaaaaaccaaactgaaacagaactattccttttatagttaaacaccgaatttaattctaaactcaatcgtattaaatgagaaacgtaccattactttaaaactcaaactgaaactaaactaaaaatccggtaaaagttcttttactcatatcattggaaatagtttttgaagcaaagtaaaaaacactagaatagtgtaactagaaggaactactaatataaattttggttgctggtgagattctttttcctccttccccagcggacgtctccgtctcttcttctgcttctaacttgctccaaattttcatttcaatttttttgataggacttaaaaattccaagctcgcttatgagagtaatggcgtagcaaaatctttatctaactcttggctcttgtctttttttgtttgtttctcaacctacgccggatcttgcttcttcgaacttctccgacgcatcttcttcagattccgcagaagtttgcgtcgttttcttgaatccactcaaaattttattggaagtttgtgttgtttttactagctctgaatctttagagggctcaaaaattcgtcgagaaaaccagtctttggaagtgtagcattttggattcgcttgtgacttgaatcttgaatattaggtgaaaccgccttggatcttctcgttgatctttgtcgtggacatttttttttgtaaagcttagtagattctctaatatttaattagagagtatctgttcgtgttattctttattgttagataatgattaatcactgcacacaatcttattgaattttcctgttgcttttctcggcttgaattctgaagaagtagttagagagatggctttgctatatactcttgctagatctgtttgatttcttagattcctgatttaacgatttccttctaatttgattatccaaaatctagaaatggtaaaagtttcttgagttaaggttcatttattttacatttgactgtagtttttttgtgtgatttagatgcagacaggaccatgttgtgttttggattacttgagagatttactatctcaatagttcatttcatcgtacataatttttttttgtgaacttgtttaataggaatgatgatgaactattcttgttttgtgtgtatagtttgaagatggtaactttatgaattaattatttattacttattagattctgcagttgcgtcttcttgattcctaataaacaatgttaaagaacacacttttcatgcttcctatcattagaagtgtcaaagatgctgctcttttttaatcatttttcttcttacctgctgtattaacaatttacgtatatccaggtttctatttggtcaacaacatcagaaacatgtgtgctcagatgttgagctctttagattcaattgttgtgaacattgtcaaggagaatagtgattattgaaggatgcaagatttttatattcagctctaatgaagaacggacaggtttgtccctaacacatcctcaccaactttttccttattgttataatcttgctttcgtatacttagataagaagttgagccatgatagaaacttcattattaagaatacgtgatcctttagttattggtatgcttgattggaaagaaagttgtagctactttagcattgatatacttagatttaccaagaagtgaagaagtaaaagagagtttgtataacaggagttgcagtcttctacccaagtttcacatgagtcccaaggtgaacagaaagttaatttatcagtagaagctccaatacaagattctggttctgtatctgcctcaagtaatgacggtaggaaagtgtcaagacaagatattgaacttgtaagaacactttgccaccttcctatctttatagactttcttgtaagtttccaatcatctgataaaaaaacatattctaaatgactgatgcaggtccaaaatttgatagaaagatgtctccagttgtacatg

SEQ ID NO: 26717 - DNA, 3003 bp, Unknown
  misc_feature (1)..( 3003): 2750-1469P.txt file - cDNA_ID_2715600; gDNA_ID_2213647; Annot_ID_132424
ggaagaagaaaaagtgatggtcgagtgagttctgtatccattgaggatgtgagggatgtcgaggagctacaagctgttgatgcgtttcgacagtcgttgttaatggacgagttgcttcctgatagacacgatgattatcatatgatgttgaggttcttgaaagcgaggaaatttgatgttgagaaagctaaacaaatgtgggctgatatgattcaatggaggaaagagtttggtactgacactattattcaggtatgctattaaatagaagatagtagtttaaaccattgttgtctgtttttgtaacgttttatttctctcgttaggattttgatttcgaagagattaatgaagttttgaaacattacccacaatgttatcacggtgttgacaaagaaggtagacctatttacattgaaaggctagggaaagttgatcctaacagactcatgcaagttacaagcatggatcgatatgtaagatatcatgtaaaggagtttgagaggagctttatgatcaagtttccttcctgcactatttctgcaaagaggcatattgattcaagtacaactattcttgatgttcaaggagtggtaagtattttctacagttcatgatattagttgtgaaatgagtttttttctcatgtgtttatataacttcatattcagggattgaaaaactttaacaagtctgctcgagatcttatcacacgattacaaaagattgatggagacaattatcctgaggtattagttaattggagcttctaatacttgatctcaggtatcaaatgctaatcttggctttgtggtatttcatgcagactctccaccaaatgtttattatcaatgcagggcctggatttaggctactctggaacactgtcaagagctttcttgaccctaagacatctgctaaaattcatgtatgagagatctaagttatatctctatttaaaagtcttgtctttgattatatagaattcaatatggactattctattgtttatgtaggtactcggatacaagtatctaagcaaattgcttgaagtcattgatgtcaagtatgtgaaccttgacccacccttatttgatctgttctatcgaaagctgcacgtttttttgtttttgcttatgttcaaaatggtctgcacttttttatagcgagttgcctgagttcttgggaggtgcatgtacttgcgcagatcaaggcggttgcatgctttctgacaagggaccttggaaaaacccggaaattgtgaaggtcatttacttagactaatctctttttggattctatttgtatcatccaagttggaatctgagacatttggttttcttctcattatttcagatggtgcttcatggaggagcacatcgagcgaggcaggtggtgaaagtgttgaacagcgaagggaaagtcattgcttatgcaaaaccttcatatacatgggtacgtagttattaaatcctataactagtcaatctttaacttgtggctgaccatattgtgcctaaactctgctctgtcataaacatagataaagggaagtgacacatccactgcagagtcaggatctgacgctgaagatatcggttctccgaaggctataaagagtttctctcatctccgcttgacacctgttcgtgaggaggtaacttttttctctttctttctatcttctagttggggaagtagtagatgtttatcctgaggctttgcaggcaaagatagctggtgaaacaagcttggctggtagttttccgggttatgacgagtatgtacctatggtggacaaagccgttgacgccacctggaaggtgaaacccgccatccagagagttgcctcaagaggttagttagttagctgctatatgctttacgtaccagtaggctccggtttagaaccaaatactgaaggaaaagaatttaacctaatccttgtttacataggatttattttcttattaggattgttttggagttggttataaaaacagagtttttttggtctttctttgtttggtgatcttaactcttatctgtttccttcaggagctttaatgtctcccaccgttccaaaagatcatgaaggcatcaaggctcgagtcctagtaatgttcatggcattcttgatggcggttttcacattcttccgcactgtaacaaagaaacttccagcgactactacttcttccccagcagaaacccaaggaaacgcaatagaacttggttctaacggtgaaggagttaaagaggagtgtcgtcctccttctcctgtaccagacctcacggaaactgatctactaaactgtgtgacgaagaaactgacagagctggaaggtaaaatcggaacgctccaatcaaagccaaatgagatgccatacgagaaagaagaactgttaaacgcagccgtctgcagagtagacgcacttgaagcagagctcatagctactaaaaaggccctttacgaagctttgatgagacaggaagagttacttgcttacattgatcgtcaagaagaagctcagttccagaagatgaagaagaagaagaagaaacatctcttttgcttctgaagcaaagccaagaaaaaccagcaccaggcatcaaaatctccctctttcgtaattcgctgttcttaagtataaacaacaaaacaaaacaaaaactcttatatctgatttgatgttaaagctaatacagagagctctgtttccttctgtgattatgagccactttatattatatgttttatttttataatcataaaaaaatctgtaactgtaaacttgttaatgcaaaacgaaaaaagagtatcgaaattattaatcaggattctgtttttttttaggattttgtttttatccagatacaagatattgtagccacatatcccatatagtgattatctcttaacgtatctcaaaagtttttgcatttttctttacttcatattttgtttttgtaagatcaatcagtttttatgaagagaaaatg

SEQ ID NO: 26718 - DNA, 3003 bp, Unknown
  misc_feature (1)..( 3003): 2750-1469P.txt file - cDNA_ID_2715603; gDNA_ID_2213647; Annot_ID_132423
gttctagtcttctagatgttttatattgttcttcatttactcaattttttcacgcagtgcaaacattattctcaagatgacacagagaacttcgagtcagatgagtacagagaaaaccaagaaagtagcagagttaaaccagactcaccggttaactatcaaacctacttgcagtattgtttgtttgaaaagctgcatgcgatcattcatcttaattgttcggtttcttactcctctgcaaatcatacttattaccataacgtgatctagaagtttcaacaagaggctgatgcatagaaagctgatgaagaagctgaaactgcgggtaatgtaagaagtcactgctttgctcattttatcatatgctttagtgatgaacctcctttttgtaaaatcatatttgtttgtccggttctgtttgtgcatgtatattcagcaactacgatttgtcgatttaacctgaaaatttgattttttggcctggttttgtttcaaccaactggattagtttactcaaaattcatttcagaaaatgatcatttaaatgttgtggttcttgcaggcgaaatgcgaggaaacgcaggtgcgaggtgtgttgctcaagtagaaaccgagaacggtccaagatcagaccgtacagagttccaacggtggattatttagcaagacaaattctgggcttctttttgattatttagcaagacaaattctgattttcaagacttgatctagaatgtaattactattttttgtccaactggatgcattttgtgggttacattattgtattgaaataaaatatagtgtggttatgttgaaaaatgattagagcaatgattgattaaaaattctactaccagaacgaacgtactaaccaatcataacacaactgatcattacgaagtctaaaccgaaagtcaatatttcgtgctgttcagattcaattaatgaaacttgtctaattttcttttgtcaaaattcactatctgttgatttctgtaatataaaaatggatatatattgtgaaagtaaaacaaattaagtaataaatatattcgaactagaaatgggaaggcctaacgaccgttgaccctccctttaattgctccgtatttaattgatttttcttctaatcttgttatcatcctccgctatccgccacgtgttgtatgggtcccacggtacgggcaatgagagaaactacactttgctccctattttaattaataattcacattttgctacacaacatcttctaattgtcaaaactcaaaactaacaatcatggtcatttaaaacaagctatatacatttttcaaatctgtatttcaaaaaatcaaataaaaatcatcttaagtcactaacctatgtgattaatcaaagtggagtaaaattttccgaaataacatttgcaaaaaattgttgaaatctaaattgacaatagttataataaaatatccaaaattaagtggggtcatattgtaaagaatatttcattttccacctcctgttttgacgtttctcttcttttttttccaacaaaaaaaacaaaagcaattaaatagtgtttgtcgtttagttggcggaattctctcagttgaattttgttataaaaatcttacaggtatacaggtctactgtccatagatccgttaaaagttttacctacggccattaatgaccgtccgatcttcctttgttgatgatgacgaggaccaactatctctgcactttctcggtttctccttatttaactacttttaatattactccaaattcacaccccataattatgcttctttttgcatatttgatcaaaaactagttctagtgacagaattaacctcaatttccgtaaaccaagttttaatatatatcaaatgcaatactcgatatcacacattattcactaaatgtgggagactttcatattttttgttttgtcacacactataatatgaagaatgaaagtaacatgatatttttgttctaggtgtaatttaatttccaaaacattaaaaattcctgacacaaaatactgtaccaccgtcaatttggggggtagattgaaagaaaataaagtgtggggctcacagataaaaacgaatgtaacagttggggtctcattaaatagcggtgcaaatacaaacttctctataacaaaaatctactactattaaaaaataattaaattcgagaggcagtttaggtgagaagaaactgagaaagttcggtccgaattctaatcccacttttgtctctcaatttgtttcccctttctctctctctctctccttcaaatttttttagcgatttttctgggtttcatgtaaatgtgagaagtagatagattctcaacaagaaaaaaaggttttttttttttttttttttggattcgtggatcagccatcttctcgaaagatttgggaaagatccaaagaatcacaatattttttcgatatttagtcgaaaggaatttaacatgtcaggtccacttgatcgatttgcaagaccatgtaagagatctcaatcttctttgtaatgttcttgcttctgggttagcttttttctaggtttactgtagcttaaacttggaattgtgtctaatataataatgagaatctaaaaattgtgtctctttgctttctcgtgtcttcaatatatgttgttgagctggttaaataatgtgtattgctttagataatttttaatgtgtctcatcaaatcaaaacagctttcactacaggttttgagggattcttgagcagtgatgagaaaaaggaaagaaagtcagattttgagaattcagaggatgagaggagaacaagaatcggttccttgaaaaagaaagccattaatgcctctactaagttcaagcattctcttaagaaaaagagcggaagaagaaaaagtgatggtcgagtgagttctgtatccattgaggatgtgagggatgtcgaggagctacaagctgttgatgcgtttcgacagtcgttgttaatg

SEQ ID NO: 26719 - DNA, 3003 bp, Unknown
  misc_feature (1)..( 3003): 2750-1469P.txt file - cDNA_ID_2715611; gDNA_ID_2213647; Annot_ID_132418
ggcttgaattccagatatattcaccaacagcgtgcctataaaatgcaaacatataccacattttatttagtctcttagattgatttaatcaatatatatatagagagagagagagaagctaacatgaaagacaaagaacgaaaacgatgaagattgtagtttttgatgcggccatgtctttagcttgaaatatttggatatgaggattatttatggtttagagtttataaaacacgttatgatatctgtatgtggtggtttggatgcttatatattgtgccttggagcatgaaattggtaatttaattaatacataatagaactttgacaaataagattttggcaattaatttattagtgaagactgaagactacgaaggagaaagttaggaataatttactttcctatgatcttatactatttaaaataatattttatgtaattccttctcattcataatttgttataccatttggaagtaatatttgatatatatgagatttacataatttatccacctcatttggaatcatatcacaaaaatatttttcaccaaatttgacaaggaacaaaaagaaacaatattctttccttttataaaaaatgtaatattaatttatttaacaaaatggattatttacaagaaaatatacaaatttcacgaaataaaagaaatatttcttataaattccatgaaatttgtttttttttgtaaataaaccattttgtaaaattaattaatattacattttttaaaaagtaacaaaggttttattccctgtagtttgttctatttcatttctcttcattctttcttctttttgttcctattattttaggagttattattaaaaataggcatttgttgggttggaaattagagattaggaaattttgtaatgctttacagaattaaacatttctggttttgtgtcttgacaattttacccttcattccactagagcgaataatgaaaatttaacttagctttctaatgactgaagtgaatgccaataattgtagatcgattatgtgctaggatttgttgctgttgggattagtggacaagattaattttcatttacaatggatatgtttaagctacgaagttgttgtgtacaattgtagatttttgaaactgtaaaacaagattagaaaagaagaacatcacaggagaaacctgattgaggtcacaatattacaaaatttacaacttttgcagaaacgaatattggtttgggtgtatacaccaccgagacattagtagtatttggttcatgaaatgaaatcatttttttttttttttgaataccagagattctgggtcaaagtccgtaatcctcccaaatctgaaaccacagcatataatattagtttagtctcaagcgtcactcgaaccggcaacctctaagcttcacctagggtttttaccaattaagctaacgatatttggtataaatgaattcttttttagttacactcagatggatactaggctttacagacaaagaagtcgagagtgcacaagcaccaatcctactaaatccattttgatcacttcacaacatgatatcaagtgaaatggatattatttatgaggaagtgtaatttaataatctaggttacacctatgtgtatataatgcaacaaacaatcaattagtaaaactacaccccaaagcgaattacaagatcaacacaaagagtcacataaatgtgcattcaagaaatgacaataaacactaaggtcttgaatatgggagaacccaattagacgagataaaatgcaagccaataacaggtaattaggactacaaaacaaagagataaaatgcataacatgattcaaaattggaaactaaattgaacaatcaatgagctaactagggctattagagtaatcaacacaagagaatgcatcaaggtaaagaaggagaatcaagcacatacattagtcgtatgtgactaacgaccaatgaattagtgaaactaaaccctaaagtcaattacaagtatcatcccgagggaattacataaacacctattgaagaaaggaaatactaaagaccagagaacccaatgggcatgataaaacacaaggcaaagagctctaagtatcatgacagagaagaagaggtaacacaccgaattcaacacacaatgaagaaagaacattacaccatgagagacgtacgatgcttccattcagtatccattgtaggaattcatcaaaccagagaaagcattacttgaatatacattccatcaaccaagcaaaaagtcgtgactgaaataaactacaaattcaacaaaacaaacgtgttttgtttttatcaaaacgtcattgtctagatttattgaattaagctttaactcttagcaaatgattgagatagtttaaacaaatatcaagaacttaacctaacgtaagctataaactctatataaaaaaatccatcagtagagatagtttataaaatttgaaaagaaaaaaattaaaaggcttgagtccgatcaaactactaattaaaagccatcactaaattgagcaagaaggtgtaaagacatttatatgaaaaaaaatatatatctttttaattaatgtttttcaaacataagtttacataaaaaataaaaattcactcgaatcaaaattttgttttgactcgaatcgaattgaattaaaaaagtcaactacactaaatattcgaaagaggaaactaacaagtttacacacaaaaaagcccacgtgactcttttttctccaagagacgtctcttttcctcttctctcctttgttctttcttccaaatttcccaaatccctccacaataaaccctagaaaatcaaaattcgctactatttctctgttccctaatttctttcgatttcaattcattagtcctaaaaagctttaatttttctaatcccccagttctccttcttctgcttctgaatcgtcgtttaacgtattgctccgtcttttcactttctccgccatg

SEQ ID NO: 26720 - DNA, 3000 bp, Unknown; identical to SEQ ID NO: 10424
  misc_feature (1)..( 3000): 2750-1469P.txt file - cDNA_ID_2715619; gDNA_ID_2213647; Annot_ID_132416

SEQ ID NO: 26721 - DNA, 3000 bp, Unknown; identical to SEQ ID NO: 10423
  misc_feature (1)..( 3000): 2750-1469P.txt file - cDNA_ID_2715623; gDNA_ID_2213647; Annot_ID_132415

SEQ ID NO: 26722 - DNA, 3003 bp, Unknown
  misc_feature (1)..( 3003): 2750-1469P.txt file - cDNA_ID_2715631; gDNA_ID_2213647; Annot_ID_132412
cttctctttggaaacactactcatcccaagaaagatcaagataggggtacaatggaagtaacttcaagtgctaaccactaacctaccacacttttgtaaggatcgagctacaaaaatagagaagtagtacatataaagagtttagtattagtttatggatggtgatgataaatttagagcatctttcaaagtctgaactatatgatttaatttgtgtccataatattatagacaaatgagtatgtttaacaggtggcccatgagggtatcggattaactttcgtctttacctactagcctactttatttactcaatttcattattgtcctaactatagatatatagttaagtatttttgtttttaatggttacataatcaaattaaactgatctacatgttaataatctaactagctatcaccaataactaacatatccaaaataacaaaacaattcataatcgtaccacgtaccgtgaagaatcataagttttcagctaaaattaagtatgagtaaatagattaacaaaatgtatacacatctttggtaaagtatcttatgttttttttaactcgtcttatgtcaatttcataagtgagatttctaacacgtttagtcgataataattttccttactgttagtcagtcacaattttcattttgactttaaacatttattgtaatattcttttcttatgattaagtacatctctatttattatactttgctataaaatttaaaataagaaagaagattatcattaatcatgtaatgttaaaataaaaagtacatatgttcgtcttgttaaatgtgatatttaaaaaacagtcgtgttaattatgtgatatttatcatcaagagtttccaaaggcaaaagtggagaaaaaacattcaatcttgttttgcataaaaaggctacgtacgtatatgtttgtttgcaagtaaagttaggtgtgtctttagtctttacttatattagtgtcttagtgaatcattctttagcaaatcttaattaagtttccttaaacaggtgtcgagatcgtacattatgtggtgcgatttccatttagcattagctttttggaattattccctcccataaaaaaaagtgttgtattattgtagcaacaaaacttttaaggtttttaaatttggcttagttaaaggcgttaatgggaatcacaccctatatgatgtagcctatgcatgtaaagctaagctatagattaatatatataacccacaagtttaatagattactacttcttggttatttttaaaaagacagattaagaataggaattaaaaccaaaaatatccaccccggatgtgtatgcttgagatatagatgacatccaataacaaaaagagaggggttctctataatgttgaaagtcaaaaatgaaatttgtgactgactaattgtggttaattcgatatttagtgaggttagaatggatcggagttttgtaggagactagtgcggttgggagattgtttcccaccatagtttttttgtaagaaacgaacgtaatctccgacttcatttttgatacatattttctatgtaacgagagaacgttctattaacggggttaatcggcgagttaacattttgggattttggccaggtcaacgtttaaaggaaattctttacttcttctttacttgcagttttgtagtgaccacctcttctttacttgcagtttcacttctgcaatttgggtagatttagcgagaggaattttcaaaacacagtacacttcacactgacaatcgataattgaagccattacaaactctcagcatcaccgtgtggaatggtttctccgccgctatgttttccaagccacaatctacattgtgtggagggagcggaatggtaggcgtcacggcgagcctccgaacacagcatctcaactcgttggttggatagataaacaaattagaaatcagctgtcctctatctgtctcaagggggacaagcgttatgatggaagtctccaagtttggtttcagtcaagaagttaatctcttagctctgtttctttcttttgttcaaaactattctcagctctaattctcaaaaccaagctgcacttgttgtaaaaacgtttttctttggaatataatttaacattatttttaaaaaaaaaaacaaaatggctgatcaacgtttttatcatgtttaatttggccgacctcagaattcacgtatggaatgagcactttttgaaagttcacgtataaaacaacatttttcccgatctttatgatatcatttttattgatatgtttctttttttctttttgttaaaggatttgttcttattttgtgacaataatatataataagagttcttgattatgatcaaagtaaactttttttgtagaacccatgacataacatacatgatacaaccaattattcccactttgaggttcctttcactaatattcaactaatattagattattattttattagcttctatacttttaaaaagtttacaataaaaaagtgaacataatctttaaaacagttatttatcgtgaattattttgaaaatagcatttattaacacacattttctcttaaatatctttaatttcgtatttatttcatcaaaataacaatatttaatcgtaattacgaaaattcaaaattggaataaattgttttgctaatcgttatttattgggccataaccagtagagaaagcccgaactaaatatgggccgatacagagagaccctaactcaaatctggaaacaaggacaaaatggtaattcagacaactagtaatgatttatcataattgattcatgatgaatcatcatcatatgtgtaatggtatggtcaaaactgtgttaaaaagatacattaaacaaatacgtggcagtaacaacaacaaagttacctctggctcaaaattgtcccttcttagctcatcattgatccactgagagagaggattacgaatacgagatcggagacatg

SEQ ID NO: 26723 - DNA, 3003 bp, Unknown
  misc_feature (1)..( 3003): 2750-1469P.txt file - cDNA_ID_2715639; gDNA_ID_2213647; Annot_ID_132410
acttatattgtaatttttaattttaataataatttttacttagttatatctatgctaaattcttatttttttttaagaaatttaatacataccgaatttaatacaccaataacacatgtaaatatttttggatcagagtggttgttacggcccaatggatctagtgagcctaaatgatacgaccatatattgtttttttttcggttttcgccaacgaggatttggttaccgagagtttgtttgaacggtcctcagaaattcggagcttgtagcttctcggtgcggtgccttcactttaatggcggcaatatcccctgttcaatgcttattctcttgcaattctcatcatcatcatcaacaacgcgagcaggtgaatctctctgttcttatttcttcataattagcgagaactaccttcttcttgttatgacttcattcctccgtttttttcaagtagagtgggtcgctttggagattgggttctagggttttagtatcttcgagtctatggaagctttctctgttctctggactccatttgaaccgaaggtgattatgttctagttaacgatttcagtaggatttggcccttgaagcgatgattctgtgtaatgcagttggatatgagataattgattgcaatcttttgggtctaataaaacaggagaactttgatctgtgcagtcaagggagatccagaagatgcctttaagaagactgtcgaaatcgatcggatgattgatgctcttagagatgcaaaccctagacaagtaaggaaacatgtcatatgcatcgtataaatgttgtgtttttgctctattatcttgagtaaattgagttttgttttgttgttgttgccattttcattgaacaggttgagaagattgttgttgaaaatatccttgcttttgatgaggttttttggataagactagcagctaggtcggatacttgtaaatcagaagatgacaaggcatgagtttatattgtttatgtcaatgatagagcagacttttgatctcttttgtttccgctaatgctttgaatacggtttgtttcttacagaaggactatgaggagttagctacaactgtgatgactatagttgactgtgttgtgaataagactcgggtttctctttcttctgtggttttattgtctcttcttcttcagcgtttacttaaacagggataactgagagttcattatatccctttaggaaaagatagagacgtctactgatattctgaaagggattttaagacctgctatagatggagtggaagagatttcatggccgccaagagatcctgaagccatcaatctaatgaaaaaggtttatactagttgttcttcactttctactacatctacacattttttatatatacaacctatattcagaagggttatctggtcttagattctgtgatttgatatcgtcatggttactgagatcagtgtattaacaggaaattatacaacgggaaaaagaagggcaattagatgaaggatttctttcagaagttaatgctcagctccggcaggtaagtgctacaatttgttttgtttcacttctgaggtctttcctttacagtgaatagatgtattcttttgaatgtttgaggctgacgattgttttcaggcaaaagaagataaagacaaaccagggttattggctatgctgcaaaaagttcttcaactctattctgctactatcctctccaagcgtagctacgcaaagaaaggtgatttgcccaattttgaaaactatgccaagtcactctaaaccattttctacgaacataatctcatccactatagctattgtcacagggaacgaagttgtaaaagccgagcattttcttgaaactctgatcaaaggtctgttctgcaaccacttttccatgtactatagaccccagccagacttcacatcggtttattatgtgtgtttcagctcctgaggaacaatggaacaagcttttcgtagacgggttaacaatcggaaaaggagatatcacacctgatgagctatctgctgttatcaagaaacgaatcgagcgcacactgattcgaactgtaagtaacataccatgacacatttgcttgcattgttattattctcttcaggagtgaatgcgaggctaaccgggttttgggttggggttttaaccagatattgttttctaaaattcatcattctaaccacaactattctgatcataccaggaagggggttcataccagcagcgaattttgaccgagtatctcaaaggaatcgagtccagggctaatgaaattatgaaattactccagggttaatgtcgtaaatcatgtatttatctatacatttttgtgtaatatcagttcaataaccccaattaatatattgttttctctcatgtaataattttttgattgagcatttgaagtgttatctgatttaaaaatatgaagctctgtagtcaaaattttacagattttaattatcttggaataaaaaatgtaaagttgatgcttccatataaaataaaagtaaaaatgagtaattcatgccaattaaattagcgagacgcaaattggagacagagataactgagcggagggattcagatctatacgacgaaactgaatctcaccgtcttcttcttcttcttcttcttctagacgatccttgtgtttctcttgctctcgcatccacgcttctctggtaatgctactgatcgtcaccgtgaagctgagcttgatcgcttccccttgtgaactgatctgatctgaggtgaatctctatttcttctccttcttcattgtacgaatctcgatttctcggatcttgctgcttcttatcgttagatctgttttcaatttcacgtggattacgttttttttcttccttttgcgggtttttcgatttctttgaactgatctttctccatgattttcattctctgttgatctggtttttgtagagttgtttctgtttcgtaatctgtgaatatg

SEQ ID NO: 26724 - DNA, 3003 bp, Unknown
  misc_feature (1)..( 3003): 2750-1469P.txt file - cDNA_ID_2715643; gDNA_ID_2213647; Annot_ID_132409
accttcaaggcattgttgtaatctgacactccgagtctaccgtgaagtaaccacaacaaccagtctgcctgatgcagcaataccgctgattctctgtttggcacctcagtgttccaccatgagacaagtttgcacaaggtagaagtaccagagcagactgtatggtttgctggcgctatagacttgacctctggcagagcatcagggcagctctggttgtagagataaggttgacacagaacttctccactctcactgcaacacataattgaataagcaaaggagatttaaacaacacattactgaaacatcaaatcctctaatgtaaatggaatacagaaacagaaaagagaagtgatccggtgaattacatgcctgtttaagatgagagtagttgcagaagttccatcaagcgaaatggatgagacgagggagcgaactgtgacgggaatgtcctctagcaacgaaaaaagagttgctttccatgagcttgcccaacccatgctttcttctttctatctagatttcaaaacaaatgtctcagtccatagctttctcttgattttgttcataaagcagctcagaaattgtatatgatatatatacaaggatacttaatgcaaaagttttaccatgaaaggaggatattctcttttgccttgtgctttaatctctccttgctcatcaataactgtaaatcgacctccagaagtaccaaaatccatacccagataaagtttttcatagttcgttcctttattgccactcataactctgaaatcggagtaaaatctagttctgggtagaggaacactccttgaactagagtaaaaccctgagattaacattatcataaatgattcagctcctaaaacccctaataaacgccattatatcgaaaaatcttcatgtttacctgtttgttttggagattggaagagctcaaatgaagatatctgaaattgacgaagaatcagcatctctcttttccttctgaggctgctttcttctaaactccatagataagggagctagcaagttcgtgaccgttggatttctcgattttttcctcttgatttgaatttaccattttagccttccatattatttttatttattttactccactcaacaccaagcagttgggctgcacgttctctggtcatctaacggctcagattatgggtgcggatcttcatatttggacccttgtaggcccacgaccaataatgatgacaacaatccctctctcctggcaccatattttgttccacacaagttttctttaaaaaatttacatgtaaatgctatatataccaagcaatttttgtctaattaaaaatttacagaatattgaaatcatagcactaagacgcaaaactaaaaataacaacattccatttgcatatgaaccaaatgggtcgtggtctagtggtaattcatgaagatgaaggttggttttggtgtgtcccaagtactgttgatatccttattcattaaatcggaacgtctaaaaatctgtctttggatacttgggaaaactacaaatgattttttgctgaaaacatgacttggatttcattgtgaaaagcatgcacgtgtgagccagatgtgcggtggagctcaagaagtgggagatatgacaacttctttgccactgctactttaccttcgagaagcaatcacactctatatacgtaaactacttggtattagggaataaggacccacatattcaatgtgtgtgtaacataagtgtttaatattatagaagcaagatatacgtgctcgtaataactccattttattggattactttctattttatttttatttaggttataattttgtcttttgcaatttgcaggatttattagtacaccatctatttaaggataatgtttcctttcatttagccattattaaattcagtactgaatctattcgacatgttgcagttaagtagaatctaacataatgtcgcaaatcatgttccattggaattgacgttttttaacattttgagtgacccttaagagaaattactttaaatctgttcattatttttagatttggtgttggatacaattcctaatttattttttaactgattcggttaaaaacttaaaattgaacatatttcactaggatttcattttctttggtttaggttgaaccggaacaaaaacattgaacgaattaaagggcagaaaggacaaaaacattgaaatcctccatttttactaacccatcgttcttcccgctcgttcggttcattcaatttgtttcgaaaaccttttaacccggttcgcggttattttattttaatcctcaaccacgttcgaatctattagcgacacagtaaaaacaaatatattttattaatcaaaaattcaaaatctgaaaaaaagacgctttcaccaaaaaaaaatatctccaatcgatttctctctatctctctcttcaccaccgtcgcgtgaagaagacgaaacaatcgctctctccttgtgtggtctcactatctttttctcaccttcgcgtagcttaaccatggaaaagtagagaagaagaagaaagagagaagtgagagaaagacgaagaagatgaagagcatattgctttttctgtccccagccatgtgagtttccactgacacattctctccatcttcacatttggtgtttttttcttttgcttgattctttctatcttcattttcagatttttaccgagtccgtaaccgagtttgaacgagttagtggatggcttcatcgtcgtctagaactaggagtcgttctcctttctcgcaccgtagacctccgagtccttactcttcggcttcgtctacttcttcgtctcttataaataatcgtctattacctcgttcttcttccacacctacttctaccgtttacaattccggcggtgtaaccgggtcccgatctatgtcgattactcgcaccatttccgattccggtcccatcggcggctccgggacttatg

SEQ ID NO: 26725 - DNA, 3003 bp, Unknown
  misc_feature (1)..( 3003): 2750-1469P.txt file - cDNA_ID_2715659; gDNA_ID_2213647; Annot_ID_132404
cgaatgcagacaatcaagaagttgacaacgagtggataatggacacagggtgctcatttcatatgacaccaagaagggactggtttgttgagtttgatgagtcacaaaccggaagagtgaagatggcaaatcaaacatattctgagatcaaaggcattggaagcataaggattcagaatgatgataatacaaccgttcttctcaagaatgtgagatatgtcccaagtatgtccaagaacttgatctcgatgggaacattagaagatcaaggttgctggttccagtctaaggctgggacattaaaggttgtcaaaggctgcatgacactacttaaaggaaagaaagttggtactttgtacctcttgcaaggagttgttgtaacaggaaatgcaaacgcagttacaagctcaaaagatgaatcaaagatatggcacagcagattatgccatatgagtcagagaaatattgatgtgttgatcaagaaaggatgccttcaagctgaaaagataaatggtctcgagttttgtgaagactgtgtgtacgggaaaacacatagagttggttttgggtctgcaaaacatgtcacaagagagaaacttgagtacattcactcggatctttggggagcgccatcagtaccaaactcactaggtaattgtcagtactttatcacgtttattgatgaccttacaagaaaagtatggatttattttctgaagaagaaagaacatttcttctcttgtatgttgatgatatgttgatcatatcaaagaacaaggaaacagtcaaggaattaaaggaaagactgagttcagagtttgaaatgaaggatttggggcctgcaaggaaaattctgggaatggagataacaagaaaccgagaagaaaatattttggagttatctcagagaagttatctgcaaaaggtgttaaagacattcagaatggatgaatgcaagcctgttaaaacaccattggcaccacatatgaagtttgtagcagcaacagagactgaagcagaggagcaagctgatcaaatgaagtctataccttatgcaaatgcagtgggaagcataatgtattctatgatcgggtcaaggcctgaccttgctcatcctgttggagtcataagtaggtttatgagtaaaccattgatgaatcattggctaggtgtgaaatgggttctccgttacattaaggggtctattgattcaaggctgcagtacaagagagaaggtgattttgtggtgacagggtactgtgattcagatcactctggagatcgtgatcgaagtagatcgaccacagggtacacattcactgtaggagggaacatagtaagctggaggtcatgcttgcagccagttgttgcactgtcatcaacagaggctgagtatatagccttaacagaggctgcaaaagaagcatattggctaaaagacttgatgaatgagctgggatttaaacaaggagcggtagatatccattgtgattctcagagtgctatagctttagcaaagaatgcagttcatcatgaaaggacaaagcatatccagagaaggtttcattacatcagagatgcaatcactgatggagaagtgaaagtgctgaaaatatccacagttcataatccatcggatattttcacaaaggtggtaccggttaacaagttcctgagcgcgttgaagaagctcagggttacaagtgcctgataagggatcatggtccgagatggaaatcaagttacactagaagggaagcaaaggaaaggttgacactaaggcaaggtgaagttttgtggaagtattgcctaaagtgtcataaagactctaatccaaagagaaggtctcagcttgtgaaagaaacgaagtcacgagaggcgcacgtgctttgtcatacagctcatcaaggctagagacgtaattaacctcttgccaatggttcaaccattttgtctctttgtctctgcatttgaaacagagtacggaagaagagagaggagcgtggcggtgagtagagttgtataaaggagaagataagtgagacattagggttaagagagtaagtgcaagagaggcagctgaaagtttattcagtcttgtttctaagggtttgtgtaaccaaggctttctagtggatttccgggtaatctcggtccagacgtagcgttcatcactgaacgtgaactgggttaacatttgcttgtgtctgttttactttctttgtctaaacacacgagtgatcgaacaaagagagatttagtgagagcttccgcataaaacagttaaagattcaagctttttttttttacatcaacatttactaataaaaatgtatagttgaattttcaatattatatgctccaattgatacttcagaatgtgttaagattttcagcttagcaaaagtacacaaaaactatagtagaatagttcaaaaaaaattacaataacaattaatgataaattttgagaccatttttgacactgcaatttccttttaaaataattaataacaaattaacaatcaaaatggtgtatacactcacctaccattcaaacccataatttcatatagaacatattcctaaaaatgtgaaaaaattttaaaagattaaaaaatatttgacaaagagtcaaatacaaaaaaaaaaaaaaaaaatcctatctatgtttaattttggccatcagaagggaaatcaaataaaggggagatagagcgagtatacatatacaagctactcgcagcgtctgcaaattcatctatccatcatatttctctgctgctctctgctttcttcttcttcttcttcttcttcttcttcttcttcttcttcttcttagtttgattcaaaaaatctccttcctcttcttactttatctcgtattatccattaatcctaaaccctttagtctctccatcttccgcttcaacaatcagaatttgggtttggcgaaagatgctaactttgaaagtgagactaatcgtttgagtaaaaaacatg

SEQ ID NO: 26726 - DNA, 3000 bp, Unknown
  misc_feature (1)..( 3000): 2750-1469P.txt file - cDNA_ID_2715665; gDNA_ID_2213647; Annot_ID_132398
acatagcatctttctcatctatgttctttggtcattggttcattggtaaagagctacagagcatggcttgctattcatgaacacattatgttagtgaggtgctcagaatcttatatcctacagtaagaatataaaagagcagagaattgtagaaagttgcattgaatctgataaagaaaacaagccgcgtcaagaggagccagagatttattcacttatttgttttccttgtatttttagtacacaacatgagaggtcataaatagactgagtagacccattgtgtgagttgatcaacccctcaatgaatacttcttcccagagaaagcttgaaacttgggctcgtctttcttctcttgttcctctttctttgtctcttttgcagctccaacctgaaaaaaaaaattaagagatgaacaatcatatgcatttgtctctcaattccattacagtttttgttttgtcaattatcaataaactctgaatgcgtactttcggagcagcttcttttggagcacggtttccgttagccccaaatacaagctttccctgagctcgtgtagctttctctgagctacttgctacagatgactgtccattaccattagcgacaacaggttgtttgccttttgagctagaggctggcgctggctcataggcaagaggtctcccatctaaccgtcttccagatccggtgaaagggttgaactttggttcaggttcatccacaacctcctcagctgtgaaatttggaaagaaaagaacacatgagaatctaacaacttgaagctgatagtaagtccatctgatgatttcatgtccatggatagataccttttgccggacccttagctgcagaaggtgctgtgggacgttcaggctccttgtaatcgaggggaggtgcgaaatcaacctcacagtctgtttctatgatgctgattgcgttagcaggctttgtttcaactatatctatgaagtacttcttattgttgtatggaaccataatgctatccccactagttaggcatgaataatttctcaaagcagtctccaagctgcaacgttcactcaattatcagtaaagaatattgggaacaagataaaaagagtgacatcaaacaactacgagccagaaaacgggaagaacttagatataataatacattctctaagcaataaacaacatgatgtgggaaagtatatgagggctcaaatacaagagggtagaaataagtcggactcacatggctttcgggttggatatatccaggaagtctgttgtgtggggctgtagtttaacgtaagttccctttggaagagtgacatttctaactctcacaatgtctccttcttgcagcagcagattctgcatcatctggattatatcaaagaagcaaacaatcagtctggtaagtccacatgatccagagtacttcgattcacaaacaaagaggaaactgattcttacccaatatggcatgtaaatcatgccttcttctgcaatgaactcaaggactccacagtgtgtaacacgttcaattccagcattacgaagctcaaacagcatcggatagtcaatatgcaaagaggctgtaaagtccccaatattagcgatttgatatgtttctaagttaaacaaatattagaccaaatccaaaagagaaaaccagtaggagcatacctagacgatcaagggctgatggtggcattataactgaaatagaattaacacaaattaaaacctcaggcttgaacaatacagatggaaacaaacattggtgtctagatagaagacttactcttgtcaccactttcaagttgtggctgcagggaagagaaaaggaaatagaaattagatactagatctcagctttcttatagaacttacttagtagaacatgacaacgactaagattctaacattacaaaagagcactctcagattcacttatcagggaattaaactaaaagtagagagatgaaatcaaaccttgtcgataaaagatgccggataacaccggtaactctgctcaaaggttgttccatgataatggtatccatcgaaaaactgcatcgagtttaaattccaaaggtttagacaaacaaaccaagggtgcgagatataaaagctagagtgaagactaacggttaaaaaggaaagctttgaatacacttaccatagttattggtggtagtagactaacagagtaagttaacaaatggcaacctacagaaaaagaaacctcacacaagtcaattacaagagatccaaatcataaaagagaaaaagagggcactctttaatttaagggtttcaataatcaattgtggccaacaattccgaccggaaggaacatcaaagttagtgactttaacagataactaaacaagctattatcaaaaacctaagacctcaatttcgaatctcagcagaagaatagaaacctacaaaatcgaagaaccatctacaacttgcaaaatcccaccttttgaaacaaacccaagtaagatccttggaaacctattcctaaacaattcaccggaaatccccagaacagaagattccgatcaaaagttgagagtgggatcgatacaaacaataccaaagctaaaaactttacaaaattaaaagctcgtcttgagattatcagagaagaataagaactcagaaaccaccgattgagctgcccgaccaataaaattacctttaggaagtaattgattccagacacaacccaagtaaagatgcaaactttgaggacctgtgataacgttgcttgtatatatatatacccatacggtgcgtattgattcatgtctttgtaaaacagtttgggcttcacaaaaaacggtactagcccattgggcctcgaatagtgaggaatcatgaccactttatattgacgtgtgcgttaccaacttaccatactgggaaactctcaattctgagcagatatctacccaatcacggattgaggagagaagcaagaagaagaaatg

SEQ ID NO: 26727 - DNA, 3000 bp, Unknown; identical to SEQ ID NO: 26726
  misc_feature (1)..( 3000): 2750-1469P.txt file - cDNA_ID_2715665; gDNA_ID_2213647; Annot_ID_181465

SEQ ID NO: 26728 - DNA, 3000 bp, Unknown
  misc_feature (1)..( 3000): 2750-1469P.txt file - cDNA_ID_2715669; gDNA_ID_2213647; Annot_ID_132397
tagtagactaacagagtaagttaacaaatggcaacctacagaaaaagaaacctcacacaagtcaattacaagagatccaaatcataaaagagaaaaagagggcactctttaatttaagggtttcaataatcaattgtggccaacaattccgaccggaaggaacatcaaagttagtgactttaacagataactaaacaagctattatcaaaaacctaagacctcaatttcgaatctcagcagaagaatagaaacctacaaaatcgaagaaccatctacaacttgcaaaatcccaccttttgaaacaaacccaagtaagatccttggaaacctattcctaaacaattcaccggaaatccccagaacagaagattccgatcaaaagttgagagtgggatcgatacaaacaataccaaagctaaaaactttacaaaattaaaagctcgtcttgagattatcagagaagaataagaactcagaaaccaccgattgagctgcccgaccaataaaattacctttaggaagtaattgattccagacacaacccaagtaaagatgcaaactttgaggacctgtgataacgttgcttgtatatatatatacccatacggtgcgtattgattcatgtctttgtaaaacagtttgggcttcacaaaaaacggtactagcccattgggcctcgaatagtgaggaatcatgaccactttatattgacgtgtgcgttaccaacttaccatactgggaaactctcaattctgagcagatatctacccaatcacggattgaggagagaagcaagaagaagaaatggagattacactgaacagtggcttcaaaatgccgatcatcggcttaggagtttggagaatggagaaagaagagcttcgagaccttatcatcgatgccatcaagatcggttatcgtcatctcgactgtgctggtataacttaacactgcttaaaaccttttctttctgatctttgttgcttcgggtttgtcaggatatgtgaataaaatattaggttttgttttaatttgttgaaagttggaatcttacttggaaattatgtcttaagatttgggtttttaagtatttggaaatttggaatcgtagaatgatcttaagtctttgctgtatcacagacaattgtttttgtttctttgcatgtgagtgagttgctttgttctgtatcctgatttatgagtatcttttggggttacttggttcagctaattataagaacgaagctgaagttggtgaggctcttacagaagcattcacgacaggtcttgtcaagagggaggatctcttcattacgactaaggtccaaacggctttaagttaaactactacatacctttgatatcagttcatttcagatcgaatgctctctgtcttggttttgcagctatggagttcagaccatggccatgttattgaggcatgcaaagacagtctcaagaaacttcaacttgattacctcgaccttttcctcgttcatatacccatagctacaaaacacacgggttaggcttcagccttgttcatgaatattatcagtttcgagtagagaccattgcatttcagccttgttactggctggaaaattaagttttctcaagtctctagcaattggcacacagagtaataagctgtaacatgtaagccttgtgcaggaataggaacaaccgatagtgctttgggggatgatggggtattggacatagatacaacaatctctctggaaactacatggcacgacatggaaaagcttgtttctatgggtttagtccgcagcattggaatcaggttcaacttctctcactatcattacaagttctcttgtttagtcgccaatatatgaattatttgaccattaggttttttgcagtaactatgatgtctttctaacgagagattgcttggcttactccaagatcaaacctgctgtgaatcagatcgagacacatccttacttccaacgcgattctctagtcaaattctgccagaaacatggtatctgtgtcactgctcatactcctctgggaggtgccacagccaatgccgaatggtttggcaccgtgtcatgtctggatgacccagttctcaaagtaagccccatcctctaaaccttaaaagtttggactgaaacagttaaataattaaaccttttgtctgtctgaattcataggatgtggccgagaagtacaaacagacagtggcacagattgtcctgaggtggggaattcagaggaacacggtggtgataccaaagacatcgaagcctgaaagattggaagagaattttcaggttttcgacttccaactatcgaaagaggacatggaagtgatcaaaagcatggagaggaattaccgcacgcaccaaacagccaagttttggggcattgagctctacgcttgatcacacacacactctctctctctatctatctatatgaataaatgaagcttaagaatataatatcagataacttcaacttttttaagaaaacctaagactccaatttcgaatctgagcagaagaaaagaaacctagaaatacgaagaaccatctccaagtttcaatatcacaccttttgaaacaagcccattaagatcctaggaaacctgttccaataccactcaccggaattccacagaataaaagattccgatcataaattctacaatcatcgaattataatagtgatatcgatacaaacataccaaagcttagaactttacaaaattgaaaactcgccggaaaaaaagatgcaaaggggacctctgattaaacgacgtttcttcttgtttgtcctctcgcatcaactgtactgggcctaataaataaacggttctggattattgggcctaaagtagtgaggaatcatggcccctttatataacgtgtgcgttactaaaaacacacactgagaaactctcaatctgagcagatatttacccaatcagggattcaggaagagaagcagagaaagaaatg

SEQ ID NO: 26729 - DNA, 3000 bp, Unknown; identical to SEQ ID NO: 26728
  misc_feature (1)..( 3000): 2750-1469P.txt file - cDNA_ID_2715669; gDNA_ID_2213647; Annot_ID_181464

SEQ ID NO: 26730 - DNA, 3000 bp, Unknown; identical to SEQ ID NO: 10429
  misc_feature (1)..( 3000): 2750-1469P.txt file - cDNA_ID_2715686; gDNA_ID_2213648; Annot_ID_132425

SEQ ID NO: 26731 - DNA, 3003 bp, Unknown
  misc_feature (1)..( 3003): 2750-1469P.txt file - cDNA_ID_2715690; gDNA_ID_2213649; Annot_ID_132453
ataggagcagacttgtgtttttcgagaggaggaaacagtttgagcttgatgatttgttgaaagcatctgcggagatgcttgggaaagggagtttagggacggtgtacaaggcggtgttagacgacggctcaacgactgtggcggtgaagcggcttaaagacgcgaatccatgtccgaggaaagagtttgagcagtatatggagattattggtaggcttaaacaccaaaacgttgttaagctaagagcttattactatgctaaagaagagaagctcttggtttatgagtatcttcctaatggaagcttgcactctcttcttcatggtaaaactctcttctctaagctttgattatcaaactgaaaatgctctgttttgcttagtgacaaaagtgttgatttttactacattatcggccaaagttatgatttttttattggtggttttagggaatcgaggaccaggacggattccattggattggacgacgaggattagtctaatgttaggagcagcgagaggattagcgaagattcacgacgagtatagcatctcaaagataccacacggcaatatcaaatcctctaatgttctattggacagaaacggcgtcgcgctaatagctgatttcggtttatcacttttgctaaacccggttcacgctatcgctcggttaggaggataccgtgcgccggaacagtcggagatcaaacgtctctctcagaaagctgacgtgtacagttttggtgtgttgcttctcgaggttttaacaggaaaagcaccctcgatattcccgtctccgtctagacctagatcagcggcgtcggtggctgtggaggaagaggaagaagcggtggttgatttaccgaagtgggttagatcggtggtgaaggaggaatggacggcagaggtttttgatccggagcttttgaggtataagaacatagaggaggagatggtggcaatgcttcatatcggtttagcttgcgttgtgcctcagccggagaagaggccgacgatggcggaagttgttaagatggttgaggagattagagttgagcaatctccggtcggtgaggattttgatgagtcacgaaactcaatgtctccgtcgttggctaccaccgacggctaagtttggtttctgtctgtcgatgttgtagaatacgtatcgtttggaccttgtcgatttttaaggttcttgcttagaatccctgatttgcgaacttgtcggagtttttttagccatgttttgtgttttcactgtttgtgatcgtaacggggttgtgtggttttgtggatttatgaagccgtttcaataataaaaccccatttgttactctttaaagcccattaggcccatatgttttagatgaattattttgcaattgctgctatttaattatagaacctaaaactcgaacgcccattgattagtgcttctagaacggtggatgcttctgtgtccactggtaattgtctttttggttgaagagtcagcccttcggatttgacctttcgtgtaccttttaagcccattgattatgattggcagattaagtaaattaacgaatggtcaagcacatgattagccaaatcatgacaaataaatggattcctttttcatttctggaagcggaatcttgtctaacaatttttttaattgatagtaatattttatgttatgggtttctgatagttgaagacttgaaatgttgaacttaaaagtgaaattacgctttcataatttcattaagccatgatggcaagttttttttttgggttgaggtcaacaagagcaagtttaatggtatcgaatagtgcgtaactgaaataaaacttgttgaaaaatcattcattcactattcctcggcgcgtgaggccaatttgaccccttcccccacgaaattaaacttggggagtactaaaagtctaaaccagcaacgtcgcttttcatgtgccttaatcacacccttttctgccacgtgtacgatctgggaccgtcgttgtgctcattgacatttgtagatccctttctagatgttcattaaaattacttaatttatatccagtccttctacttttagttttttgatactttaatccctgttgttttaatgatacttcattcagtatccatccaaaatcaaattaaatccatagattaagatgtacatttttgaaaataataaatggtttattataatatgttactaaatttatggtatttttcgctcttgtattgacttttacatggatacattaattttaatcttctttgatttctgttaattttctttgaattcattttatacatttattagtgaactattctaaaaattaacaaaatcatttaaaccgacaaaaaaaactttaaaagatcagcgtattataaaccaacgggggatagtttgcattaggtattggacatctggggggtaaatagagcgaaacaaaagttgaggcttgtttttcaacattttcattttattgtgtgctatttaaactgcgtcgtatttggaggcatattcgccggtcaagcgtatcaaatacccaatcacgcgaacttttctccgcctcttctccactccaaaattcttctccgtctttctcccgtcaccgtcgaataaagcctgagatctccgaattctgatcagcaactatgcattcaagtcatctccttctcgaggaaccgatcaggatgacttcaatcctcgaaccttctaaatcagtgagctatttatttctccttctctcgctctgtgtgttttctgtggttgttttgatttccttagctcgttgttgattatcgattacgtttggatctgttgcgatatttcatccattttgaagcagtgagagatttgtttcgtttgtcgtggtttttgatccgcttgatgttatttcgcagagtttcttcccggctttgactaagattgttgggactctaggtccgaaatctcgatccgtcgaggtgattgctggttgtctcaaagctggaatg

SEQ ID NO: 26732 - DNA, 3000 bp, Unknown; identical to SEQ ID NO: 10441
  misc_feature (1)..( 3000): 2750-1469P.txt file - cDNA_ID_2715700; gDNA_ID_2213649; Annot_ID_132446

SEQ ID NO: 26733 - DNA, 3000 bp, Unknown; identical to SEQ ID NO: 10436
  misc_feature (1)..( 3000): 2750-1469P.txt file - cDNA_ID_2715704; gDNA_ID_2213649; Annot_ID_132445

SEQ ID NO: 26734 - DNA, 1855 bp, Unknown; identical to SEQ ID NO: 10488
  misc_feature (1)..( 1855): 2750-1469P.txt file - cDNA_ID_2715726; gDNA_ID_2213653; Annot_ID_132495

SEQ ID NO: 26735 - DNA, 3003 bp, Unknown
  misc_feature (1)..( 3003): 2750-1469P.txt file - cDNA_ID_2715730; gDNA_ID_2213653; Annot_ID_132494
ccctgctaacaacatcactaccgaacagatccaaaaggttccttctttctcaccctatatctctccctctctcttaatttgttcaacactacttaggaggctcttagagcttttttgtactgacaaaatcattggcttctgagtgcaagtaatactcttttgactgtaattggtggcaattagggttttcatttgaatctttctcgttaattccacaacacttgagagtctgttgttggtgatgatgagaagagacagtttctaggactaggaaattagtagatgcttggtgggtcaggaaactttgaatccggttttcaagaatggacattgaagttagatgcttgcttgatgttgttgttttgtactttctcttggcttgatgtcttccatggtaagatgataggctgcatcgtcatttccttgtcattctctttcctttgcttaaacgcagtaccttgatgagaacaagaagctgattatggccatcatggaaaaccagaatctcggtaaacttgctgagtgcgcccagtaagtctcaccttttctatccatcttcttatgtctcttagatagtaatggaagcttagaattactattattaatggtgaggtttatatagttattctatcttttgctctgttatattttcaggtaccaagctcttctccagaagaacttgatgtatcttgctgcaattgctgatgctcaacccccaccacctacgccaggaccttcaccatctacagctgtcgctgcccaggttgtttgtgatgataaaactcaattgcgatctatcacagaaatttaatgttgtttgggggtttgcttactgttgggtatgatttctgttagatggcaacaccgcattctgggatgcaaccacctagctacttcatgcaacacccacaagcatcccctgcagggattttcgctccaaggggtcctttacagtttggtagcccactccagtttcaggatccgcaacagcagcagcagatacatcagcaagctatgcaaggacacatggggattagaccaatgggtatgaccaacaacgggatgcagcatgcgatgcaacaaccagaaaccggtcttggaggaaacggtaactctctttacattattaagacaatactcaatctcataaattgtaacttgtatccattacttctttctttgctaacagtggggcttagaggaggaaagcaagatggagcagatggacaaggaaaagatgatggcaagtgaaaaggatccaaagaagctttgttttgttgatatttaggacttgtgagtctcgtaagggctttttgcaatagcttgtttgagttttttaacagaagatagactgtggagtagttccgcaaaccgtgttgtaatgtattgttatttagtacaagctcggatttagaaaacatcgtcatcgttcatcttattctgaaaatcaaagcattgaacttattattttctcattccggacgagtcttgacgatgaaattctgacggctaatgggattcataacaacgggaggaccagcggttcttggccatgcttggaatttctcatccgttgctgcccaccattctttgttagagacagttcctggagtagtccctgaaattttcacaagaagataaccattaagatcgtccctaacttgaaaacacacacaaaactagataaatcttgagcagaacttgcctccaaagatcttattatcagagataactttgtcgaagatgtatgagattccgaaagaaccgatgagagcaccgattatgtacttggctttacctcctgatgccattttcttctaaagctgaaagtgaaccattattacaacttaacactcaactcacaagaggagaagcaacaaagcttatgtaaggatttagtattaaggccaaaaaaacacagatcaaattcaattattgaagctttacttatcaagttatcatataaccaatgaagacggtaattcaaaagaaaaataaaagggtttgtagaataattgatacgtttacctttgccgattcagagacagtgaagcttaaacagtggactccagttccagaagaattcaacggtggaagacggtcgtccaactctatcgtcttatctctttaaaaactttggataaatctctgtgaaattaccaaaatgggcattgttttctgaaacgttaattactagttttattaagagacaaaactacaatcatcacaagggaagatataatagcaaatctactagtttgctgaatttcatcatacgtctagctcgagtaattgttataaccaaaacctgtaatatgctaatttgctagttgatatgaatttatttatttatcagtaaggaaaggtccaagtgtccaacattgttttcggcgtatgacacatactctattataagatgatctcggcgaatgccacatatattaaacactacactttaattcttgcagaattacgattcaaaactctttttttctttattctttcgaatcagtgctgcatttgacatgttcaaaacatgattctacttattattgactattgaggtcgtgtcgtgttataacatatgatttcgttggaaaactgtaaatacactaaagattagagattcgtagtttcatttattaataggtctaggggagttaaataagtttttgttttatatggtttttctaaactcataaaacccgaaatacagaatgaattaagtcaaggattaaagcaaatgattttgattgtaaatgactacatcacatgtagctttctagacacgtaaagtcaaataaatacaaataaattagatcacgacgtgagcaatttccttatccgactgtatttaaacgtctcaacaaactgacccgccaaaataatcataaataaatttccataattcgaattatataaacttaataacaaaaacaattatccttccttaatcctattttgtttttacttgattcttcattctcagaaatcttgaccatg

SEQ ID NO: 26736 - DNA, 3003 bp, Unknown; identical to SEQ ID NO: 26735
  misc_feature (1)..( 3003): 2750-1469P.txt file - cDNA_ID_2715730; gDNA_ID_2213653; Annot_ID_181662

SEQ ID NO: 26737 - DNA, 3000 bp, Unknown; identical to SEQ ID NO: 10476
  misc_feature (1)..( 3000): 2750-1469P.txt file - cDNA_ID_2715738; gDNA_ID_2213653; Annot_ID_132490

SEQ ID NO: 26738 - DNA, 3000 bp, Unknown; identical to SEQ ID NO: 10474
  misc_feature (1)..( 3000): 2750-1469P.txt file - cDNA_ID_2715750; gDNA_ID_2213653; Annot_ID_132485

SEQ ID NO: 26739 - DNA, 3000 bp, Unknown; identical to SEQ ID NO: 10473
  misc_feature (1)..( 3000): 2750-1469P.txt file - cDNA_ID_2715754; gDNA_ID_2213653; Annot_ID_132484

SEQ ID NO: 26740 - DNA, 3000 bp, Unknown; identical to SEQ ID NO: 10470
  misc_feature (1)..( 3000): 2750-1469P.txt file - cDNA_ID_2715762; gDNA_ID_2213653; Annot_ID_132482

SEQ ID NO: 26741 - DNA, 3003 bp, Unknown
  misc_feature (1)..( 3003): 2750-1469P.txt file - cDNA_ID_2715765; gDNA_ID_2213653; Annot_ID_132481
tatatatatatattttttaagtatagaaaatagaaatatgacgtgctaaattgagctatggacaaaatcatatatgagaaaatgaatgtagatggatagagtcgtcccacacttaaggttggtccacaatgaataccgttggaggcttcgcaggcttttgttctgtccttgtctctctctcccctaaaaaaaatttgttacgaaaaattcatttgaattaattttggtcggtatgtgtataatattatacaattataatatatttctaggtttagacatttttttattttatttttcatgaagtaaagaacacaaacaaaaacccataaaataatgtaagatagataaaacaagaggatgtcgtcataaataaattggaatttggcatttaatgaaaaagggtgaaaggtgcttgacatacacgcgccgtagtttcttacccggaaagggattggtattgatgttaactagaccgggcccggtttaggctggggcggcggccgaaccgaccacctggctactattcttgtttgtattcgctgattctgcaaatctaaactcggatcttttatggacttggattttcgggtgggtggggttctgctaaagagacggcgctcttgtcattttaagtcggtcactgcaaaacgtgaaccctgtgactgtatttagagtctcgttacgttggatctctctccatgaaccgtccaaagtaggtcaatttttgtgggttcactcacgtatacaacgaagtacggcgctatttaattttccgaaaattttgaaagagacttttataccagaaaagtttgtaatccaaatttttaatatattgcagatttggttcgttttgggcttaaagagcttttattggtgtggtggctcaaatcgtttttgtaggcgtcaggtcaggcccattttcaatgtcgcttgctcatttgatacgctaatatagggctttgcttaagatttgaatgggccgtacccccattttgcttcatgagaatgggatggtaataaagaaaaaaatgacaggaaacaatgaattggtcacgaaaaaatgttgtattactttttccaaaatgcacctttgagaatcttaagattcaatcatacagtgaggtccatgtccacaataagaaatcaaataccaaacaaagtataaacgtgaattgtaagctaggcagtgtatgaagatgcatttgtcttaaagttacgaatctgataaataatattattcgatcgactttagatcgctttccatgcagatttatgcaattatctggaagaagaacaaaacaatatcttagtttcttcggcctcactattcgacttctatcttcaatatattttcgcgtatttttttatttgaattatttggtttttggttagttaactaaacgagcaacagaaccaagatcgaattgcgtttgccgtttggattcaattattgtagaaaattcgacttttcagacatttgttacgttctttctagtagttatattagttattatatgtggagtggaaagagatgaaagtagatgtaaaacataagtgatttcttcatagtgattttaaaactttttgttgattttcaaaattatataatatccataaaaaatagcctatgcgtgttggatgcttacaaagaagaatttgttttcggcgttagccaaaagtcgatggcatttgctaaaggtgttatttgagtggaaatgatctagaacaaaaacgcattgatataccaccactataatgatttggagacgtatctagttctcatcaacttttcaatagtaaacgcattatcaaggtaaacgaagagttttgctttatcagtgtaccatacacacattaatagattgatggacgttagtgactttggtattgactttaacgccaaatggacatcaattctgcaaggcaatgcctagtttcaaagcagcgttacttaacatttaactaaaggtagtgcaaactggttaatactttttaacggctttgcaggaagagtctcgactaaaaggagaggaagagatgagatcgacgaagattttcatatcataaaaagtaatataggtttttgaaaatagttagaataattatttttatttttatttttatgggaaagaagttgcacgagtcggtccacagaatgacagaacaaaagcattttagaagtttagaaccaaccaatcactatagttttccacttgtccgtatctcattggttcatcgaatattaacttacatggaaacagtaaaaagcgtggaataagtcgtaaaactgaaatctaaaaatgaaaagatttcgatttcgatataaatacttaatctttataaaataatatcgaaatcttttcatttttagttttcagttttacacttttacttgataaatttaatacatctgttaattttttttcttctaaaattaacatatgatatctattcgggagataaccctaagaaaactgataaaataaataagttactttttacaaagtcgaataaattatttacccttctgctttaatggcaattatcttaatattgcaaaaaaaaaaagagagaaatattactacaaaacagaagcaagcaagtggaaaacagaccagaagagagaggaagacgaagagagaaacagaacagagtagggatcgatagaccgtggaatctcagaatcacaaacactttgcaaaagggttttcaattcctatttatttacaaagaaatcatcaatagtagtggtctctagggttttgcttgctcttcttcgtgacccctttttacctgcaaacaacaacttcaaaattggcgtgtttcgtacggtctatctaaccctaatctgtcacaaaacactcttcttctctcacccctttttctgggtttattcaattctcgtgcttttggttctgttttcttctctggggatttggttttcttgagtgagtttttctcctctttcttatgttcttgatttgattattatatagaattatg

SEQ ID NO: 26742 - DNA, 3003 bp, Unknown
  misc_feature (1)..( 3003): 2750-1469P.txt file - cDNA_ID_2715777; gDNA_ID_2213653; Annot_ID_132478
ttagagtgatttggatgattcaagacttctcggtactgcaaagttcttccgcctgattaattatccattttacctttgtcgtagatattaggtaatctgtaagtcaactcatatacaactcataatttaaaataaaattatgatcgacacacgtttacacataaaatctgtaaatcaactcatatacccgttattcccacaatcatatgctttctaaaagcaaaagtatatgtcaacaattggttataaattattagaagttttccacttatgacttaagaacttgtgaagcagaaagtggcaacaccccccacctcccccccccccccccaccccccaaattgagaagtcaattttatataatttaatcaaataaataagtttatggttaagagttttttactctctttatttttctttttctttttgagacatactgaaaaaagttgtaattattaatgatagttctgtgattcctccatgaatcacatctgcttgatttttctttcataaatttataagtaatacattcttataaaatggtcagagaaacaccaaagatcccgagatttcttctcacttactttttttctatctatctagattatataaatgagatgttgaattagaggaacctttgattcaatgatcatagaaaaattaggtaaagagtcagtgtcgttatgttatggaagatgtgaatgaagtttgacttctcattgtatatgagtaaaatcttttcttacaagggaagtccccaattggtcaacatgtgaaagcacgtgtcatgttcttacttttgtttgggtaatcttctaattactgtatatggaagatgtgaatgaagttttggtcctgaatgtggccaaggttccgtcatttggagatacgaaatcaaatctcctttaagattttgtttttataatgtgttcttccatccacatctatctccatatgatatggaccatatcatacatcatcatttgtccaaatgcatgaatgaatttggaaataggtacgagaatgccaacaatgacaagaagggatcaaagacagtttttaaaacaatattttacagggttttaatctaattctaagttttggtcactcactttgttaaaagaataattcagtgtctggacactaaaatcttccaaaaaccccatatacatatatgctatttcgatacttatatttatttactcagcataaaaaatattaaccatgtattcatagtaaaatgtttcatgtgatatcaaaccagcgacaacaaaagtattattcccctcattatgtttgactcctattatatttttattttaatttttttcactatcatctttcttgcaatgaaagtcccatatattggtcaacatttcaaaccacttgttctcttttatgttttggtaagagctatcttctaaatttataatacgcataaattcaaaagtaaaagaaaattttggtcatgaatgttgtttaagtcatttggagatacgaaatcaaatctccttgtagattttgtttttagaatgtcgttcctttttcatcatcttagctatatctacagctatatatcctatctttaaacctatattattttttcctctcttcaccaaagccatgttttttagttgtggcgaaaaataagaaatccatacatcaacatatcgctttcgttaccttaaattttggcttgttatgaaggcatgtcataacgtttctagtcacaactcacaagcataccaacgaccatgataaatccaaaaagtagaaacaatctattatctaaacccccaaaagacaaaagaaaaaagtagaaagaaaaggtaggcagagatataatgctggttttatttgtttgttaaaagatattgctatttctgccaatattaaaacttcacttaggaagacttgaacctaccacacgttagtgactaatgagagccactagataattgcatgcatcccacactagtactaattttctagggatattagagttttctaatcacctacttcctactatgtgtatgttatctactggcgtggatgcttttaaagatgttacgttattattttgttcggtttggaaaacggctcaatcgttatgagttcgtaagacacatacattgttccatgataaaatgcaaccccacgaaccatttgcgacaagcaaaacaacatggtcaaaattaaaagctaacaattagccagcgattcaaaaagtcaaccttctagatggatttaacaacatatcgataggattcaagattaaaaataagcacactcttattaatgttaaaaaacgaatgagatgaaaatatttggcgtgttcacacacataatctagaagacagattcgagttgctctcctttgttttgctttgggagggacccattattaccgcccagcagcttcccagccttcctttataaggcttaatttatatttatttaaattttatatgttcttctattataatactaaaaggggaatacaaatttctacagaggatgatattcaatccacggttcacccaaaccgattttataaaatttattattaaatcttttttaattgttaaattggtttaaatctgaactctgtttacttacattgattaaaattctaaaccatcataagtaaaaaataatatgattaagactaataaatcttaatagttaatactactcggtttactacatgaaatttcataccatcaattgttttaataatctttaaaattgttaggaccggtaaaaccataccaattaaaccggagatccatattaatttaattaagaaaataaaaataaaaggaataaattgtcttatttaaacgctgacttcactgtcttcctccctccaaattattagatataccaaaccagagaaaacaaatacataatcggagaaatacagattacagagagcgagagagatcgacggcgaagctctttacccggaaaccattgaaatcggacggtttagtgaaaatg

SEQ ID NO: 26743 - DNA, 3003 bp, Unknown; identical to SEQ ID NO: 26742
  misc_feature (1)..( 3003): 2750-1469P.txt file - cDNA_ID_2715777; gDNA_ID_2213653; Annot_ID_181641

SEQ ID NO: 26744 - DNA, 3000 bp, Unknown; identical to SEQ ID NO: 10725
  misc_feature (1)..( 3000): 2750-1469P.txt file - cDNA_ID_2715781; gDNA_ID_2213670; Annot_ID_132765

SEQ ID NO: 26745 - DNA, 3000 bp, Unknown; identical to SEQ ID NO: 10725
  misc_feature (1)..( 3000): 2750-1469P.txt file - cDNA_ID_2715781; gDNA_ID_2213670; Annot_ID_182272

SEQ ID NO: 26746 - DNA, 3000 bp, Unknown; identical to SEQ ID NO: 10722
  misc_feature (1)..( 3000): 2750-1469P.txt file - cDNA_ID_2715784; gDNA_ID_2213670; Annot_ID_132764

SEQ ID NO: 26747 - DNA, 3003 bp, Unknown
  misc_feature (1)..( 3003): 2750-1469P.txt file - cDNA_ID_2715786; gDNA_ID_2213670; Annot_ID_132759
aaatactaaatacataaataccataagaactcttgtctaattcataaaaggacattattggggtcgcataaacatatgtaaatcagatcgagaaatcagaatatatatacattttagcttgatcaatttaattaatgttttagttgggaatatatttagccttgctttgggtccacccacctccatcaattatcattcttttatctttttgttttgacaatccaacagtggttgtgaatcatgtggtagcttcgcacctatacatgatccccacaaattgaatttataaattacgttaatctcgtaagaaacagacaaaactatgaaatgtcatataactaaggttccattcttcgatcagataaaataaccaaaaaaaaacaaaaaaaaaactacactcgatcacgcaagtaacaaaaaaaaatgtgaagttaaaggtttttttttactcaacataatactttactacttatcactttactcgttaatcaaacactcatactaacgactattttaaacttaagccatcttcaaattttagaaatggagaaacggcaattttgcttcgcattttggtctacactatatacggttttaagtcattttgctgtatttttatgtactcaagattaaactgcattcttctacactataattgtaaatgattatgaaactctgaatcagtgactgtctttttgatataactgtaagaaaacgatagaaagtgctttggagacttttttttgttttgttaaagggtttaagtgctttggagacttgtagtaacatttatacgtgattacaaattgtgatcatgatatagactttatggattataaaatttcgtgcccacacaatacaaatcactaaagatcccatgtgcccttgtctgcattcacttaagtctttttcgtttttattggatatcttttccatctagaaagatatatttagatgtgttgcaatttcacttttcatgataggcacagtctttatgtatatttggataaaaactgggacatatctaaaagtaatgttttacgataaatactatcacaatttaaatcgaaaattatccttcaaaacgaatatcaatatgtattcattgagagattttaaaacttagggattcatttgttggtactagcgtttaagttttcataattaagaactacggatgtatacatagatatatgataattttattttcgtagtaattgttatgataatctttgttcttttgaagtcaacaacatatattatgcgaatttttaaactacattatatgtttagctcactattttattttgaatatctcataagtatgtatatatacttacacattgttatagtgagtgtaaaaaagagagagacagtttagtaatgattgagtatgcagctcgtgggcacattattaaattgaatggtatgatggatatgcgcagacactgtcttgtgtgaactcaagaatcgatacagaacgacggcattaaaaaaaaagaaaaaattcaatataagacgaaaatgatgatggaaaaaaattcttttatttttaccaacgaaatgtatgcgatatgaactagtagtatttaattcactgtgtgaattagtagtaatatttaagcatgtgaatatgtttgtgtacgtattgtattgccacaacaaaacagcatgtcgcagcattgatttcattatcacctaaccgttaaatacgtcatggccctagacttaatgtattttagacttaatgtattttataccttattttgatatgtgtacggtcgaccccctcacaaaattgaaatattacgactatgcattgaaaaactatacacaactacattgtcaaatactgataagatcttaacacagaaacacatattatcactaataatgtaacgtgacaacattacattgctttacacacattttttttaatctatttaagatgattggatgatattgtcatttttctctataaatctaagatttttattgtctttataatctaaattcgcaattattacaacaaaaaattatcaaatctaaatttatttttaaaatccacgataattattctcattctatttcattggaaacaccaaccaattattttaaaaaacagaaaacatattaattaaaaaattgaattcaaattctatttaccattctaaaaaaaaaattatgcactgattctgtaaacgttgacaccgttaacgtagtcgtagatatgcactgattctgtaaacgttgacaccgttaatgtaatcacatcgaataaaagacatatgttgatcgtgtaaaggtataagatactcgatctataacatcgttgtcaaattccatgttgcatatacattatattgctttacacacatttttttatctatttgatcgtctgtgaattaatatgataatttgatggtattattgttatctttataatataaattcgtaattattataacaaaaaataaacagttttatcttaatatccacaataattattttcattctcgttgatttattggaaaagccagccaattatattaaaataaataaaaacaacatattaattcaaaaaaatttgaattcaaaaaaatttatcattctaaagtaactagatatgcactaattgcactgattttgtaaactttgaaactattaatgtaatcgtaacgaataaaagacacgtatcaatcgtgtaaggtataaaatactcgatttttaacggcgccgtcaaattctccgttacatattaaaagaattactattcctacttcacacgaggctttatatgaaaatgacaagagttaatcgtggccgttaacaaattacgatcaaaacgaagatcgtcaccatcttataacagaataacccaaatggtacgcgagctagagactctctagtagagagaaagagagagaaacacaaacacgcacacataacgagtgattttagagagagatagagatctggaaggtgacgtcgtaggagattatg

SEQ ID NO: 26748 - DNA, 3003 bp, Unknown; identical to SEQ ID NO: 26747
  misc_feature (1)..( 3003): 2750-1469P.txt file - cDNA_ID_2715786; gDNA_ID_2213670; Annot_ID_182263

SEQ ID NO: 26749 - DNA, 3000 bp, Unknown; identical to SEQ ID NO: 10526
  misc_feature (1)..( 3000): 2750-1469P.txt file - cDNA_ID_2715789; gDNA_ID_2213659; Annot_ID_132517

SEQ ID NO: 26750 - DNA, 3000 bp, Unknown; identical to SEQ ID NO: 10526
  misc_feature (1)..( 3000): 2750-1469P.txt file - cDNA_ID_2715789; gDNA_ID_2213659; Annot_ID_181816

SEQ ID NO: 26751 - DNA, 3000 bp, Unknown; identical to SEQ ID NO: 10525
  misc_feature (1)..( 3000): 2750-1469P.txt file - cDNA_ID_2715797; gDNA_ID_2213659; Annot_ID_132515

SEQ ID NO: 26752 - DNA, 3000 bp, Unknown; identical to SEQ ID NO: 10524
  misc_feature (1)..( 3000): 2750-1469P.txt file - cDNA_ID_2715803; gDNA_ID_2213659; Annot_ID_132513

SEQ ID NO: 26753 - DNA, 3000 bp, Unknown; identical to SEQ ID NO: 10521
  misc_feature (1)..( 3000): 2750-1469P.txt file - cDNA_ID_2715815; gDNA_ID_2213659; Annot_ID_132509

SEQ ID NO: 26754 - DNA, 3000 bp, Unknown; identical to SEQ ID NO: 10520
  misc_feature (1)..( 3000): 2750-1469P.txt file - cDNA_ID_2715838; gDNA_ID_2213659; Annot_ID_132503

SEQ ID NO: 26755 - DNA, 3000 bp, Unknown; identical to SEQ ID NO: 10520
  misc_feature (1)..( 3000): 2750-1469P.txt file - cDNA_ID_2715838; gDNA_ID_2213659; Annot_ID_181802

SEQ ID NO: 26756 - DNA, 3000 bp, Unknown; identical to SEQ ID NO: 10553
  misc_feature (1)..( 3000): 2750-1469P.txt file - cDNA_ID_2715858; gDNA_ID_2213660; Annot_ID_132534

SEQ ID NO: 26757 - DNA, 3003 bp, Unknown
  misc_feature (1)..( 3003): 2750-1469P.txt file - cDNA_ID_2715864; gDNA_ID_2213660; Annot_ID_132532
tgcaggactacaaagcgatatggttctcggatgcaactccgaagtatgcgtttgtcacttggttggtggtgaagaatagaattgcaacagggagagaatgctgaaatggaacaaaaacgtgggtactagctgtcttctctgcaactatcctttggagacaagagaacatttatttttccaatgcccttattcgagaacggtgtggagtgaactggcgggaagactactagctagcaaatatacggacaattggctagatatcatgaaggagttagtgagtaaagatcttgacgccactacaaggattgtgcttcggtatgtgtttcaaaacacgatacattctatatggagagagagaaatgagagaagacatggagagacgcgccatcgaggacggagaagataatcaggctaatcgacaaaaacataaggaatcgattaagcacgctaagggtgagaggtgaagagaagtacccaagaggaatccaagtgtggtttgcttcaaggcaagatcaaaatcaaggatagataagatacacatttgatctattttttttaaaaaagtttgcatttatatgtataaacagtttatttttctttgaatataatttaacattaaattttttaaaaaaaaatgcctatgttgcctactcttagagaagcgcataatgtatctttggactttcgacaagaccaaaagttcgactcacacgatgtttttataacaaattttaaccaaaacgacgttgttttataatatatatgatgttatatagtctgttaaagttgagtcttatattgcagcctttgcaggtggagaataaatttaccaaaaaaattaaaagttgtgaatatttatttgcaatttttcttcgctttagaagtttttaaaaattagtattattaaaccgtagtattattgaaaaataatactttttagtttttaaaaaatgtttcacacatgcaagaatttgaagaaaaatccgactgctaaccaaaatactaaaatagcgaattaaacatgggactcataacttttgtattaaatgactaaactaaaaaagatgcaattgaaagaaaatgaattgcatgtttaattggttgcaccaaaaagtttgtttggtgataggaaataactgatgatataaattttcacaaaatgacgaccgctccaccatagtaactactcaaaatttgtcagtgataatgagcatgacaaacatgatttataaagacacggcgagtccccaacacctgcagctcaactaatcaagtttcttgatatatgatacgcaacaaattatcttcagtccgtcgtcgggatccacacaaatacgaggatggacttcggttatggttcgcctctaggaactagttgtttcaatctctttacaaatcttttctcaaaataacatttaaaataaggttgcattcattgtacaaaggttttttggttgaataaattttaaattcattcaaaaaaaaacatgatttataatcatggaactatagttactattttaaaaagtaataaagaactacatggttatccaaagacgtgcgtcccttaatcattgcatgttttttcaatttttatcttttgtctcaaaagttattttgttaaaaatgtaatgaaattgttatcctagatatactcatgttacagaccacacgatcgtaagcttgttagttaaaaaaaaaaacactattatgcctactttattaaaaaaaatctaagagtccactcaaaagtcaaaacactccaaactcgcctaccaaaaaaaaaaaaaatcactccaaacttaaaatccactaaaatgaaccaaaatgcttagtacaagatatcatcttaattgcaatcgaactacctaatgcatttgattcaatatcttgtttcttttaagttttaactatccacaaagccatgacttgggaatgtgattgatcgataaaactttttcatttgattcaatatcattttactaactattcggttattttaaaaagttcggttcggatgcggttttgtttttacggttcggttcattcggttatttgcttaccgatttttctgcaagagagcgcgtttcgtttgtctccgcaaacgatgggacaaagtgggttaagtctgaggttgtttcttcgacttgtctctctagtctctataccaacaacactcaacgagacaagaccatcatcatcactcacttccttccttccttcaaatctcaactaaatcaatagacattcctctctttgtctctctctatccaaatttgaactgtaactgtcttcaaaatcttcatttttctcagacaaattggatctctccttggagcagaaacacccattaaaggaacaatagagagagttttggattgaataatcacagttccacaggtttccttccactctcattatcttaaatttcacttaaaggtcgaaacttttggtccactggtttcattatcttcttttaaacacatcaatttgtttaggatttaacttgtgattttgaattggttttactacttctcctctctcgatttagcaagttaaaagcttttttttttttagtgttcttgagggttttagggtacaattttgtttcctcaggactgggttttgctttcttgtttcatatgtgttttattgttcttgatgaattcattgtacattataaaatattgtctcagctattggtacacagttttctttctccctgggaattgtttgttaatttttaatagagtactaataaaagattagaaaatctgtggttactttagagagctgtggattctacttgtttgtttgtttcttcttattggattagttatggagcaaagtaaaagccttgttcattttctttgttcatatgtaataaaaacaactagtgatatacaagtgttcttggaaaatcttgaatgaaacagctttgaagaagactgaggtttatcttcctctctgttgaaaaaatagaagactgcagtggctacaatg

SEQ ID NO: 26758 - DNA, 3003 bp, Unknown; identical to SEQ ID NO: 26757
  misc_feature (1)..( 3003): 2750-1469P.txt file - cDNA_ID_2715864; gDNA_ID_2213660; Annot_ID_181848

SEQ ID NO: 26759 - DNA, 3003 bp, Unknown; identical to SEQ ID NO: 16663
  misc_feature (1)..( 3003): 2750-1469P.txt file - cDNA_ID_2715876; gDNA_ID_2213660; Annot_ID_132529

SEQ ID NO: 26760 - DNA, 3000 bp, Unknown; identical to SEQ ID NO: 10536
  misc_feature (1)..( 3000): 2750-1469P.txt file - cDNA_ID_2715890; gDNA_ID_2213660; Annot_ID_132524

SEQ ID NO: 26761 - DNA, 3000 bp, Unknown; identical to SEQ ID NO: 10536
  misc_feature (1)..( 3000): 2750-1469P.txt file - cDNA_ID_2715890; gDNA_ID_2213660; Annot_ID_181839

SEQ ID NO: 26762 - DNA, 3000 bp, Unknown; identical to SEQ ID NO: 10535
  misc_feature (1)..( 3000): 2750-1469P.txt file - cDNA_ID_2715902; gDNA_ID_2213660; Annot_ID_132520

SEQ ID NO: 26763 - DNA, 3000 bp, Unknown; identical to SEQ ID NO: 10544
  misc_feature (1)..( 3000): 2750-1469P.txt file - cDNA_ID_2715902; gDNA_ID_2213660; Annot_ID_181834

SEQ ID NO: 26764 - DNA, 3000 bp, Unknown; identical to SEQ ID NO: 10534
  misc_feature (1)..( 3000): 2750-1469P.txt file - cDNA_ID_2715906; gDNA_ID_2213660; Annot_ID_132519

SEQ ID NO: 26765 - DNA, 3000 bp, Unknown; identical to SEQ ID NO: 10534
  misc_feature (1)..( 3000): 2750-1469P.txt file - cDNA_ID_2715906; gDNA_ID_2213660; Annot_ID_181833

SEQ ID NO: 26766 - DNA, 3003 bp, Unknown
  misc_feature (1)..( 3003): 2750-1469P.txt file - cDNA_ID_2715910; gDNA_ID_2213663; Annot_ID_132623
caggcaatcacttgggctccgttggtgattttgacgtcgttgattttcgtctacgtctcgatcttcaccgttatcttcggtagcgctagcttcaatcctaccggaagcgctgccttttatgtcgccggtgtccccggagatactcttttctccttggcgattagattacctgctcaggttttctaaagatccaaacttttttctgaatttttaaacttttttcagcttactgttttgggtttacttggtttctatcaatatttgtgatctgtgatagtttctttcaaatgggtataggcttgtgtttgtctgcgaattagaatctagttttgtctgcgaattagaatctagttttgcatgaatcattgaatccaaagctatgtagtatatgcttttcccgtgatttgtccccacttgtatgccccattttagattagttgagtagaattcgacttttttggtacatatgagtctgatcttctgtttttcgtatattctcacctttgatctgtttagtatagttatactcaggtttgatatttcttggaaagaagaacacacagaatcagattctcttttgtttttgatgtttgtttttttgttgatgtatgtgtttcccacttaatttaaagtaggaaaacgaaaccttatctttctcgtcgatatgtctttgtgttttctttagccttttctagagtttcttgcgtgtccatgtgtttctgtgtactacaataacataaatagatagaaagactgttaaatttggtaacctgatttagcaaggagtaatttgtactctttttgagagttgaatcaagccagatgactttattgcctttggtaggaatagtcttcatgatcccttttttgccactgtttcttgatttcgacgggataatgtttgaaaggagatgtgatatattatatctgttattccaggcaattggtgctgcaggaggtgcattggcgatcatggagttcataccagagaaatacaagcatatgattggaggtccttctcttcaggttgatgtgcacactggagctattgctgaaacgatcttaagttttggtattacctttgcggttttgctaattatcctcaggggtccacggagattgcttgctaagacgttcttgcttgctcttgcaaccatctcatttgttgtcgccggatctaaatacactggaccagccatgaatcctgccattgtaagtatacatttcttgcttgctctttcagatgttctatactaagaagagattgaccccgaataagtcacctgataaattacagaagcaactttatgtttttgggccatatattcacatcattccaacactcttaaacccgagaattatgattgtatcttcaaagatagatgattaatcaatatctctcttgtgtttgcaatgcaggcgtttggatgggcatacatgtacagctcccacaacacatgggaccatatctacgtctactggatcagttctttcgtaggagcattatctgctgcattgcttttccgttctatcttcccgccacctcggccccagaagaagaaacaaaagaaagcctgaggaaaataaaacaattgggagaataccggtcagattcttcaccggtttgggctgtagaaagattcacaaagctgttccattctaaaataaggagaccaacaacaacaaaaagtcaaaagtctccttgtcattgtttagatccacacgcttattttacagatttgtgcgacgtaacttttctcttttatgttcataaatcattcagactctcttccggtttagaaacatttatgattacatggctggtttagtttggtttattatcggttcactctctattctggttctgatttctgacaacaaatcaaaggcaaaagttgtggatttccatccacaaaatttgggaattgggcctcaaaatttctttccaagggtggaagaaatctcaagcgagatctttcgacatttggtagtgttactgcgaaaaggaattgggcctggctaaggcccaactgtatactcttgctgaggcctgaccataaaagaagaagttatttacaaattaaatcagccaaacatgttggaccaggactcaccaactgtatataaagcctaacaacattttctccaaactgtaaatagatcaagactctgctgtgttgcaattttgttcccagtttcggtctacagttaaaaactactgattccctttgccataagagtgatcctaattaaactgattgagtaactcttaaaatggtggtggtgtgttttcagggatgtgaagacaactgatagtggaaatgcttcaagctgcgaagtctgttgtttccaactaagattaagaaaatggttccattctcaaataaggagaacaaaaaaggaataaaaaataatgtctgttacctctatcacactcttctctgctagtttcggtttagtaacgtctagattatcaatgtctggtttagtttggttctttccggtatgttcctaattttggtaggatttgtttggcttggttttatagcaagtatttaattaacattagctcaaattgcccttaatttattgaattttgttaaaaagttttgtctaaactttacactaaaatcagcttttcgtggatgttacccatttctcttccgtaatcgttaaattatgacataacgtctttgttttggtcgtatcgttcacgcaaaacttcacgattcagatctgtgtgtggcagaatttgaatcgaagcataggatcaatccggtaagcagccgtaacttgcaatcgatcgccgatctggatccgttaaaggatccctcgcagtccttgaagatatcggcgtcctccgccaccgggaacaggatccgttaccgttcaccttccgcttctgagctattggagtctggactagccaccggattatccggtaaccattctcctacttccgactctcatcagggacttgtgtctatcgacggaggaaaaatg

SEQ ID NO: 26767 - DNA, 3003 bp, Unknown
  misc_feature (1)..( 3003): 2750-1469P.txt file - cDNA_ID_2715914; gDNA_ID_2213663; Annot_ID_132622
gttaaatacaatgtaaaatacatatgcaggggaaaccataatactagatatattagcttatttcgcaaagtcaattcgtagaagtaaatattcgagttcaagtgataggacaaccaagtgatatataataaaatctaccacaacccgagaagctaaaaaaaatcacaagctggttagttcaactcgtcgaggaaaaatcaaatcaagagattaaaactctagtctaggatgatcccacagtcatctccttctacaatcattaaattattactctatcgaaaccacacgctcgcgaatacttatagagtacatgtggaatgagataacgttaccagggagattaggagacttggcttatagaatacttatggaatacatctccctcgcgacttacctgcgcaatgaaaactttttctcgtcttgttcaatagttgtacttcgcacaaaggataatacgatcataaaaagactcataatacgatcttcgatatacccgcgcaacgatggatcacataaacggtcgcatggttggaaaatttagggctcatctctgattgttttattttcttcacaaaggggcaaaaatatatatatacactgtatatatatatggggttttttttatggtcaaatgttattgcccttcgaataagagacctttgattcgtaagaagagattattattttataagagaaggttatgaccgaaaggtttctgaagaaaatgaaaaattacttttaaaaggaattttatctttaaaaggaaacaaaaggaatggttaagttttacatgattggacgcaaaaatggaaaattcttttgattacttcaaaaaaggaaaccctcatttcttattaataatacatcaaataaaaaactaacatgatttttcgcaaaatatccaatttgtgaagaccctaacgctcgaatttgtcatcacttggctcagtctttcaacttttgaaaactgaaactccttttttctcaatactgttagataatagagatatactcgagacgattgagcttcgtcaaatggatacatgcagtattaaaatcagcagttcaaatacaaagaaatttaaatcatcaagtatgaatatgtatgatcatgcttcacgatcgaacagacgaacaccaccagaaactcgacgtcccacacgaacagaagatgaaccaccacagtcttttcccaatcgtaagtgagccatattgtcgcataagttatcacgtaactcgagcatcgcttggtacctttgctgcagctccttcgcgctcaaaccttccgaaggaaagttccaccacattttatctaacttcttttcatttctcgattccttcaacagtttcaacttctctagatccatcgcaagctcctcttcgagcgcctccattttttttacgaggtcgtggagccttcgtttcttataagcttcgacgaggggtctggtatcgtctctctctaatggttcttgtctcgaagggttctttaaccggtcagccactttcttcatagacggatgtgcgaatgtatagggcttcttgggttgagagaaaatcaagaaagccacttcaacgtcacacattgctacgagctcgttcattttcttaaaaattccggttttacgttttgagaacgtaatcatcctatctccatagttctccaccttcttcatctcgatcttttgcttcccctttgtttttcttccctttgcttgcttcgtagatgacatgtttgcagaaaccagaactagtgtttgatttcttgtaggtttgttattttgtatgtaatgataaaaccatgcgcaaaacacaatctatttatagaccaaagaaagagataggattacaaagtttggagacattaaatttaaatcttagttatgaagaaagtgtattgactaatttacaaaaaaaaaaaaaaaatgttgactaaacacatttggcaaccactttaacatcttcattaatcagtcaagaaactattatggtaacccaattggtgtaatagctggtgtaaaggctaattgaccattcaaggaggaatgttcttttaggtaattacgagtttgtgtatcccttacagggaacatacctcagatccaaaattcttttgttacaaaaaaaataggaaaaatttgatataaaagatatctactacaaaatttgtccataatattcttatttttttgtagattagtcatataatttttttaaaaaacttcaaaatccaaatttatcttatttttctatcaaatttcatttaaaaaataaaacttttttgtattagtataagtccgttcatttgattagtcataacttttgctataatattttgtttgacttgaaatcactatcgttggaaagctaattgaaactaatagaattgctataatattccgtttgacttgaaattactaccgttggaaagctagttaaagctaatagaattgaagtcaatatataaacataaaaaaaaaatttaaaaatttaattttaggttaaaataactttaatctattttctctaaaataacaataacttaagggatgcaatttatacttataaatttccaaatttatataacatgaaacacatgaaaaatatttcctctcataggctacagctagctaatataaaataaaatccacgctttttatatgcttaatttaaactctaattattaactctaataaaacctagtttaagtccacgtataatttcaactgatattcaataactaataatttatatatttgttgcaatctctgtaagactatcggttaggttaatcattcaaagatatcttcgtttcataaaacaagaaaaaaacaaaaaaaaacaaattttcaaaaagaaaaaaatctatttgaggagaaaaatagctgtgagagagaaagctaaagaggcgacgtaccacccacctaaccacaaccagatccccaaaagacagagaactttctcgatacgaacgccaaagagaagaagacgaagacgaagatg

SEQ ID NO: 26768 - DNA, 3003 bp, Unknown
  misc_feature (1)..( 3003): 2750-1469P.txt file - cDNA_ID_2715914; gDNA_ID_2213663; Annot_ID_181912
aaatacaatgtaaaatacatatgcaggggaaaccataatactagatatattagcttatttcgcaaagtcaattcgtagaagtaaatattcgagttcaagtgataggacaaccaagtgatatataataaaatctaccacaacccgagaagctaaaaaaaatcacaagctggttagttcaactcgtcgaggaaaaatcaaatcaagagattaaaactctagtctaggatgatcccacagtcatctccttctacaatcattaaattattactctatcgaaaccacacgctcgcgaatacttatagagtacatgtggaatgagataacgttaccagggagattaggagacttggcttatagaatacttatggaatacatctccctcgcgacttacctgcgcaatgaaaactttttctcgtcttgttcaatagttgtacttcgcacaaaggataatacgatcataaaaagactcataatacgatcttcgatatacccgcgcaacgatggatcacataaacggtcgcatggttggaaaatttagggctcatctctgattgttttattttcttcacaaaggggcaaaaatatatatatacactgtatatatatatggggttttttttatggtcaaatgttattgcccttcgaataagagacctttgattcgtaagaagagattattattttataagagaaggttatgaccgaaaggtttctgaagaaaatgaaaaattacttttaaaaggaattttatctttaaaaggaaacaaaaggaatggttaagttttacatgattggacgcaaaaatggaaaattcttttgattacttcaaaaaaggaaaccctcatttcttattaataatacatcaaataaaaaactaacatgatttttcgcaaaatatccaatttgtgaagaccctaacgctcgaatttgtcatcacttggctcagtctttcaacttttgaaaactgaaactccttttttctcaatactgttagataatagagatatactcgagacgattgagcttcgtcaaatggatacatgcagtattaaaatcagcagttcaaatacaaagaaatttaaatcatcaagtatgaatatgtatgatcatgcttcacgatcgaacagacgaacaccaccagaaactcgacgtcccacacgaacagaagatgaaccaccacagtcttttcccaatcgtaagtgagccatattgtcgcataagttatcacgtaactcgagcatcgcttggtacctttgctgcagctccttcgcgctcaaaccttccgaaggaaagttccaccacattttatctaacttcttttcatttctcgattccttcaacagtttcaacttctctagatccatcgcaagctcctcttcgagcgcctccattttttttacgaggtcgtggagccttcgtttcttataagcttcgacgaggggtctggtatcgtctctctctaatggttcttgtctcgaagggttctttaaccggtcagccactttcttcatagacggatgtgcgaatgtatagggcttcttgggttgagagaaaatcaagaaagccacttcaacgtcacacattgctacgagctcgttcattttcttaaaaattccggttttacgttttgagaacgtaatcatcctatctccatagttctccaccttcttcatctcgatcttttgcttcccctttgtttttcttccctttgcttgcttcgtagatgacatgtttgcagaaaccagaactagtgtttgatttcttgtaggtttgttattttgtatgtaatgataaaaccatgcgcaaaacacaatctatttatagaccaaagaaagagataggattacaaagtttggagacattaaatttaaatcttagttatgaagaaagtgtattgactaatttacaaaaaaaaaaaaaaaatgttgactaaacacatttggcaaccactttaacatcttcattaatcagtcaagaaactattatggtaacccaattggtgtaatagctggtgtaaaggctaattgaccattcaaggaggaatgttcttttaggtaattacgagtttgtgtatcccttacagggaacatacctcagatccaaaattcttttgttacaaaaaaaataggaaaaatttgatataaaagatatctactacaaaatttgtccataatattcttatttttttgtagattagtcatataatttttttaaaaaacttcaaaatccaaatttatcttatttttctatcaaatttcatttaaaaaataaaacttttttgtattagtataagtccgttcatttgattagtcataacttttgctataatattttgtttgacttgaaatcactatcgttggaaagctaattgaaactaatagaattgctataatattccgtttgacttgaaattactaccgttggaaagctagttaaagctaatagaattgaagtcaatatataaacataaaaaaaaaatttaaaaatttaattttaggttaaaataactttaatctattttctctaaaataacaataacttaagggatgcaatttatacttataaatttccaaatttatataacatgaaacacatgaaaaatatttcctctcataggctacagctagctaatataaaataaaatccacgctttttatatgcttaatttaaactctaattattaactctaataaaacctagtttaagtccacgtataatttcaactgatattcaataactaataatttatatatttgttgcaatctctgtaagactatcggttaggttaatcattcaaagatatcttcgtttcataaaacaagaaaaaaacaaaaaaaaacaaattttcaaaaagaaaaaaatctatttgaggagaaaaatagctgtgagagagaaagctaaagaggcgacgtaccacccacctaaccacaaccagatccccaaaagacagagaactttctcgatacgaacgccaaagagaagaagacgaagacgaagatgatg

SEQ ID NO: 26769 - DNA, 3000 bp, Unknown; identical to SEQ ID NO: 10562
  misc_feature (1)..( 3000): 2750-1469P.txt file - cDNA_ID_2715930; gDNA_ID_2213663; Annot_ID_132618

SEQ ID NO: 26770 - DNA, 3000 bp, Unknown; identical to SEQ ID NO: 10562
  misc_feature (1)..( 3000): 2750-1469P.txt file - cDNA_ID_2715930; gDNA_ID_2213663; Annot_ID_181909

SEQ ID NO: 26771 - DNA, 3003 bp, Unknown
  misc_feature (1)..( 3003): 2750-1469P.txt file - cDNA_ID_2715966; gDNA_ID_2213663; Annot_ID_132607
tgatccttcatgttaataataatgataaatttgtgtaggtgattgaattgggtggaattccaacgattggtgattgtgcagtgatattacgagctgctttaagagctcccatgccttcagccttcttgaagatcttgcagacgacacacagtcttggctactcatttggcaggtaactcagttacaacctctctttgggtttagtctgttagagaagctagtctaaggcgttcgatatgactaaacttgactataaacaatgacatttgaatacacgtggtaaaaatctgttgcagcccgttgtacgatgagatcatcacattgtgtttggaccttggagaacttgatgcagccatcgccatagttgcagatatggaaaccacagggatcactgtccctgatcaaacccttgacaaggtcatatctgctagacaatctaatgagagtccgcggtctgagcctgaagagccagcatcaacagtaagctcttagttatcatatcctcttctgcttgttgtgaagtctctataagaaacagaaatcggtagaaggagctgaatctgtcttagttatgaaagttttgttcattataagtacaagtcatgtagttccgagtgtagaacagtttttactagtgttgcaccaggtccctccagtctgatacttaattctttagtgttggatctttctatataagaaacgcaaatagcaagacgcagctgaattggtcttactaacaaacgttttgttcacgaaaaagataggaagaaacaaatgaacgatagtaacaaaagttagaaaatcctcatcatattgcataagataggaagaaacaaaataaggatagtaatcttattcaatgagaaaaagagtgagtaaacgaaggaggctaaattaggctttaaaattcgtttgcttcttcagaccctcgaggactcgttttttccatttattatcctcctgcttggttcgctttataaaggcggcaactctcaacatgttttggtcatatcgacgctgttctagaatgggttttcgtttccttttgcctcccggaggttgtttgatttgcattgaatttggaacgtaagggcacaaatgtggcctacactttatgccggctacatgtactcggagatccaattctctaaaatatccagtttttccaatgatgttgactctgtggtgatcaaaaaccatggagactttcttctcctcgtcaatgaagaaactcccatgtatatatgcaatcggcatgtcagccaatggtcctgtatccatttccaagatcttgctccacgacactttatcatactcgatcttagtcgtgatccatatctcaaactcatatggattccagtcgttgtgcgtaagtaaagccgcaagcttctcttctctaacacaagataaagtcacatagtcatcatggccagcgctaaacggtagacgcaaaagtggcccaaatctctcacttgtgaaatcaaaacagattatgtgatcgtcgattttgtttattgcgttactttttgtagcacaaaagtaggtatttcccttgagagaaacaccacgctgataacacgatactatccaatatggagggacatcaagagttgtccataaatcggtttcaatatcgtagatttcataccatgaaaaccggttttcgggtgcgtggttcacggccgaagagatgtaatgatctataaacctcaagactttgtggctacgacaagagttgttcttgttcacgtaccctagagcgtacctgtacatgtccatatcctgttctacgcggtgctgcttctttactaatgtgcagcttcataaagctctgactttgggataaagcgtacaacgttttgcaagttaatttcaatgtcctcatatacttcatgggaagtctagatacaatatcctctatcaaatcccttggaagatttaagatcatcgttgtcgttttctcaagttgcaacaaggtttttttttttttaaccttaaaaaagtgttcttcttttcctctgatttttttcccgcagaagactatacataggaatttgaagttgggcccaatcgtgggcttcagaatcttctcttgttttctttttggtaatcacattcataacatccaagttctttaccaacaatgaccatttgtatggggagagcatcaagtttgtatgaagctgggctaactatgggcttattggaatttaaaacagtatcttaaattccatctttaattgaaacatttgataagtggaagctgccaaaacacgcgtccatctttaattaaaatcaaatgtgaattgttttcatttttgtgacatttaatatttacttctagaaaaagaagatcaagtaaacatgcagttaagttcaaataagattagaattgtgatacccttgaattcgatttagtatgcaatttttttgtatttaaagaaaatatattggagtagacaaagagaggaagatattgtaaattttttgttattttcttttctcaatatatttaaggtaattaatcaggattacgttttattgttggcacatttaatgcctttgcggcactatttgggaaagattaaagattgtttttgggtggattgtaaattacaacctttgagaagaaaacactgttgcgtcttagacacgtgttaactaaagacaaaagaatttggttttgtccagatttttgttgactctttgaccccgatacgtaaaatcaacggcgttgaaatttacacgtgtcaaatattaagtctaattatatgtgtgaaatcttgattggtcggaaagaggaaattgaaaaaaaggcaaataaaagctaaagaggaaagacgaagctacagcttctgaggtcggaaaaaacgaattttgataatttagggttttgcccttttcttctctcttgcgttatcatcggtgttttgattctccggccaagtcccggagacttgtgatctgggggaatttggtgttcaatttcattaagacgcgatg

SEQ ID NO: 26772 - DNA, 3003 bp, Unknown
  misc_feature (1)..( 3003): 2750-1469P.txt file - cDNA_ID_2715972; gDNA_ID_2213663; Annot_ID_132605
atcctccaccgtgacggcgaagcatctttcgaccttattctaatggataaggaaatgcctgagagggatggagtttcggtacttaatgatcttgaatcttaatctgcttaccaaatagacaatttaagtgggtcgatcatcactatacttaaaaacctcctctttaatatagtttttatgttctttgttgatttaatttagacaactaagaagctaagagaaatgaaagtgacgtcaatgatcgttggggtaacgtcagtagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataaggttttctcttgttgaatgagctaatttacttcatatggctcatgcaaatctccatatcagttaactttaaaaaaattatacatagtttcgcgataaattctaaattttaaataactatcacatttactaaaaataaaataatgtatgtatgtaaatatgtaatgtaactggctaatttaattgaataattataatacttacaaaaataatatatatcgcgaatctgactatatttatgttttgtttatcttattcaaaaagatgaaaatataaacactttactagctatatctattttcttttctctatttttcaaaaacataatttacataatatttcatattatttcaattccagtttacgttccatatttttaatgtatatatattttattcttgttcttcgcatatatacgtcatattattttgtccaatactatatgtcattaagaagatagggtactactactgggtacatcatatcttactttggatttgataaggtttgtgtaaataagagtaaattctattttcaacggcgtgtatcatcttagccaaatttgattaagcattgtgtgctatacactcagaaagtacctatactaatgttgcactataaataataattattacaaatttttaatcaagaaactagctatgggtctaaagatcagaacataaaatgtaatttttttttcttctaattttgactttataacacaatttttttggacatctttttatttatttatttagaaacgttaaatttttatttgatatctgttttgaattaaatcagaaaaagaacatcaaacaaaaatttaacgtttctgaatttctttggttgtgaccacatttcttgcagccgtataactcgtgactctaaatcttaaaagctttggttgtgtaagtgtttgaagtggagttatattctacactttaattttgagttgttttgtttgaactctatatctgtacttcacttttcaaagcatctactatgtctctctggaaagttcaaatttgttatatataggcaaaccaattcttcacttggcttttcaggtgtattggtttgattcggaaatgcttgggaggttgaaccgaagaacaaaggattgatgagttcgaatattttctatatataccatagctttttgagattatgatttgtttagataaacaagatcgtgttgtgttatttgtctctgcttctttatttaacatacgtatggcatcgtaacatcttcatatgtttgtaaatacaattattttcacttttgttttgatattactttcgaaaatatatgaaagtgttatctataaactatatcaggaatcagtggttcaacaattaatgatatccaagaaaaacgctgtgtattataatgtggattacgaaagttctgacaaaatttgtgtgaaattttgtatgtccgctttttctgttttctttcttatgcattttcgatcattttatctgaaatgtgttacaattaaactaaatattcctctactacataactcaagctcacattttttttttttgttacttcggcgcaaagtcttcaaacactaattaacaagatttcccgtgtggatgcttagcatttttctccaccctaactaagatggaaaaattactcataccagtaaacgaaactattcgtaaaaactgatttcctttttgtaagtgtagaacaaataatttttttcaccgacaacttccatttttttactatctctaaaattttcaacacgtattccaagtatttccttttattttgagtaatactcttgtttccaaaaataagagttaacatgattagcttatatacttgatcttttgggttcttgttgtgattatatgaatgatgaagacaaagaagaaagaatcgagaggagaaattgggaagaacatgtcgttgatatataagaagaaactaacggtgttggtcgttgacgatgatccatcttgtcgtacactccacatgggaatcattcaaatggctggaggattcccttacatggtgaaaaacggcgagaaataagaagctacgtgacatgaatgtgacgtcaatgatcgtggggatgacgtcacatgaggacgagactagggcattcatggaagctggagttgaccactgcttgtcaaagcccttaacctttggaaagatcgcatccatcattgaccatctcaaaaccgcataatctaccgattaacaaaatattacttggtttagttcggttatgtgactactgatataaatcttgttcaatgcaatttggtctagttcggttctgtctggttcaatccaattaactcacgtgatctgcacatgatcatcgtctacattttaattaaataaaaatctaaatttcaaatcactttatccattccccagtaaaaaaaaagtttcagactttggcaaaaaaaaaatg

SEQ ID NO: 26773 - DNA, 3003 bp, Unknown
  misc_feature (1)..( 3003): 2750-1469P.txt file - cDNA_ID_2715994; gDNA_ID_2213663; Annot_ID_132597
ttactggaaattgctaatttatctataatttcaaattgaagttgcaagattctgtatatggaattgagtttttcagctaggcttggtctaatcaaataattgagctgacaagttataatatcgatactttatctttcatgcgtacataagataaggttaattatttatggatccttccttggttaatgacaatcttatctaattgtttggcttaattttatataattgtttagagagagaattaatttctggtttattgaaatttgaaagggtagactgaggaagatgctttggaatattctgcatgggttgttccgttgtctacttgtcttgttcattcttctttggttgactctgattcaagatttttgtatacacaagttaatttcaagccttaaagagactttctatttttgctataattagatatgattggttttgttaagttttattggctcaataatgtaagcaatgataatgttgtctctctgatcatagaaaaaaaggctctatcttaaatgtgttgaagagtagatggatatggtatcatgttatttaatactcttctatgggacaaaaacttaagttttgtttgatggaaataaatctcggtattggtaatgaatttgaagctgatgaatttgtacttttgaatgcatcaagctaagcgccttcttgttttactgtttcaatctatcaattgttctatatagaagtgtttttagttctttgatgctgaaagtgatgtacttttctgttactgtcaatctctttgcaggtaaaggttttgccacaggaagaattagcctaggagaaatagaagtggtgaaaatcaccaagttccatcgagtttggagctctgattcatcacacgacaaatcaaaacgtgctacattttacagagccgatgacattccagaaggattccattgccttggtcactattgccagccaaccgatcagcccttgagaggttatgtacttgcagctcggactagcaaagccgtcaatgctgatgatttcccgcccttgaaaaagcctgtgagttattctttagtttggagtgcagattcagagaaaaatggtggtggttatttctggctacctaatcctccggttggttacagagcaatgggagttattgtaacccatgaaccaggtgaacctgaaacagaggaggtcagatgtgtaagagaggatcttacagagagttgtgaaacctctgagatgatacttgaggtgggttcttcgaagaagtcgaacggctctagttctccttttagtgtatggagcacccgaccttgcgagagagggatgctgtcacaaggtgtcgctgttgggtcattcttttgctgcacgtatgatctgtcgtctgagaggacggtccctgatatcggatgcttaaagaatcttgatccgaccttacacgcgatgccaaatctcgaccaggtccatgcggttatcgaacacttcggaccaacagtctacttccacccagaagaggcttacatgccttcatctgtacaatggttctttaagaatggagctttgttgtaccggtcagggaaatcagaaggtcaaccgattaactccacgggctcgaacttgcctgctggaggatgcaatgatatggatttctggatagatcttcctgaagacgaagaagcaaagagtaatctcaagaaaggaaaccttgaaagctcggagctttacgttcatgtgaaaccagcacttggtggaactttcaccgacatcgttatgtggattttctgcccctttaatggcccagccacgctcaaaatcggcctattcacgttacctatgacccgcataggagaacatgtcggtgattgggaacatttcactttccgcatatgtaatttctctggtgagctttggcaaatgttcttttctcagcatagtggtggtggttgggttgatgcatcagatattgagtttgtgaaagataacaaaccggctgtgtactcatctaaacacggacatgcgagtttccctcatccaggaatgtacctccaaggctcgtcaaagctcgggattggagtcagaaacgatgttgcaaaaagcaagtacattgtggattcaagccaaaggtatgtgatagtagcagctgagtatttaggtaaaggagctgtgatagagccgtgctggttacagtatatgagagaatggggtccgaccattgcatatgattcagggtctgagatcaataagatcatgaatcttcttcctttggttgttaggttctctattgagaacattgttgatttgtttcccattgctctttatggagaagaaggtcccacagggccaaaggagaaagataactgggaaggagatgagatgtgctgaaagaagacaaacctctttgtgatcaagacggtttaatggaagatgaagtctcttgttgaatcggagggttttgatctctactctactagtaattgtgactaatatgtaatttacagtatactagaatagggtttgatcttggtggttgtaatttgttgatgtaagacctaaaacgctgtgtttgcggctgtaatcagctgcgacagctcatgagcaatatgaatgattgattttgttgtactgctatcttctcgtatctctctgtgttctttacgctattggttagattgaattcataaccacccccaactgttccggtttgacacatcgttccggttagtgtgtagtattggacgaaatcggttattgataattcggttccgataatcggttttaataatgtgtatattgtaaacttgaaccgttctctagtctctatctctttctctttcttctgataaacctctcggcactgcgctgtgtagtgagctttcacttccgtcgttagctgcagtttaaaatccggcgaattgcggacggagaattcaatcatatagcattattgaggagctgaaatggaggttgtgacaaagatatggtgttgattttcacttcgccgttattgctgcgatg

SEQ ID NO: 26774 - DNA, 3000 bp, Unknown
  misc_feature (1)..( 3000): 2750-1469P.txt file - cDNA_ID_2716014; gDNA_ID_2213664; Annot_ID_132653
taagacaaagtttactgatagctccagcggatatactgccaatccttctggtatttacatgcaatctcctatttcgtgggcaaaggccattaaaaatgatgctgagctaaagggaatgaagaattctcacttgaggtaaagaaagccattgcttttacgatattttcctaatccaactgcctttataggattcaacttttctctggaagattttggtttcttttgtactttcaaatgctaagtatcttaggctgaccaaatatatatggagaaatgctgctgctctagctcatttctggaaaattttggtttctttttttcctatgtatgggaaatgtctttggctgaccacttattttatgcagagatgctgctgccctagctcatttctgggcttggctggaagaagaagtgcataagaatgcgaatctaacagaggtcgatgtggctgacaggcttcttgaattccgttcaatgcaagatggttttatggatacaagctttgatacaataagtggtatggttattgtcacccttgttggtggaacttgcttcttaacacatagtcaatatacagccagtgagtgatatgtattcctttcctctaattacccatgcaggttccggtgcaaatggtgctattatacattataagcccgagcctgagagctgcagtcgtgtagaccctcaaaaactttttttgctggatagtggcgctcaatatgttgatggaacaacagacatcaccagaacagtacattttagtgaaccttctgcccgtgaaaaggaatgtttcactcgagtcttgcaggtggaatatttggctcttcttttcctcatcatttttgatgaccattgactacctatattgaacagacgaacctgtatgggttgccttgtctgattggtattttggttgtagggtcatatagctcttgatcaagccgtgttcccagaaggtactcctggttttgtattggatgggtttgcacgctcttctctatggaaaattggacttgattaccgccatggtactctattctatcttttgactcttcttcccagaacaacttttttgtaaggaactcatattactctgatattttgcctgccaaacagggacaggacacggcgtaggtgctgcactcaatgtgcatgaaggtcctcaaagtattagctttcggtatggaaacatgacccctcttcaaaatggcatgatagtaagcaatgaacctggatattatgaagaccatgcatttgggatccgaattgaggtgcgactttgtcaccagtccatgacagtttttataggatatataagatttaagtaacaattgtatggtctgcttttgcagaatctccttcatgtgagagatgctgaaacaccaaaccgctttggtggtgctacataccttggatttgagaagcttacattcttccccattcaggtacagagtgacgtatccacttataaataattcgcgtctctgaatctaactctcatttttctggtcaagggagcccttctggttttcttctagctaattgatttgccttacatttgatctcacacacttctcactcaccaaaccatgcagacaaaaatggttgatgtttctttgctgtctgatactgaggttgactggcttaatagttaccacgcggaagtctgggaaaaggttagtccacaaaactagtttgacttaccttctcaaaaagccaagtagattgagtctaagcaaagcaaagcatatcaacaaatcaacacataaaggaaacatggcttcgattatcctcttagtgtaatagatcaaagtcttttacatacagctgcagttgtttgaaccaggtattatttccttggcaggtttcaccattattggaaggttctactactcagcagtggctctggaacaacacaagacccttagccaaaccatgatcaaacccaccaagttttatttccaataaaagcttagacttgatccttcatgattagtaccaaaatgttcgcgtgtgtaaattacaaacagaaatgtgatatttttcgtttattttaaaaaaagatcctcaacttttactaatcttctcgaattaacgtaagcatctctccagaagctttaaattgcacaagcttaaattttgtatgcttcagctgcacatatttaatgagttaaagtttcttggtcttaaatcctttccttgcacttgaaagttcatctcctaaagtggagaaaacattaaaataggaaactagcaaaatgattggacaaacttgtaccaatatatttaacatgtttagaaaatattcaactcacttagtttgattctttgaatcaagttttcagttattagttccaacttgtaaaaatggttgcagaacaaaatgatgaggaagttttttagtatcacataagtccagattcaagtttttttcaattgtatctaaaacacacacaactttcagattgaataaaatctgaatttcattctcagcagaggctaatataaaaatgacaaaagaagaggaggaggataggagctatatgtctactatttttatttttttagccaatgagagagctccacttcataccccacttttaccaatcgagcgatttcacaaccagtctcacccatgtcgcgttgagcgcgtgtctacgatttctaaaggggtttgtccacagaaatcatgccttttttgatccacgcaactcactctcaaaaatccatcgcgtgtcttattttttttggttttcttctctaaaccaaattaaaccgaaccgagatcaatttgaatttcaaaaccaatgtaaacccatcaaacccatcgctgtgaaaacaaaaagctcggccactgtaacaacaaaaatggagacgacacagaggtacaacttggaagagaacttaacggtcaagtactcgattctactagagtggaaagcaaatttctattacaaaatacaaattaagtgtttagcttcggaattgtggtgaatg

SEQ ID NO: 26775 - DNA, 3000 bp, Unknown; identical to SEQ ID NO: 10588
  misc_feature (1)..( 3000): 2750-1469P.txt file - cDNA_ID_2716029; gDNA_ID_2213664; Annot_ID_132648

SEQ ID NO: 26776 - DNA, 3000 bp, Unknown; identical to SEQ ID NO: 10588
  misc_feature (1)..( 3000): 2750-1469P.txt file - cDNA_ID_2716029; gDNA_ID_2213664; Annot_ID_182032

SEQ ID NO: 26777 - DNA, 3000 bp, Unknown; identical to SEQ ID NO: 10607
  misc_feature (1)..( 3000): 2750-1469P.txt file - cDNA_ID_2716033; gDNA_ID_2213664; Annot_ID_132647

SEQ ID NO: 26778 - DNA, 3000 bp, Unknown
  misc_feature (1)..( 3000): 2750-1469P.txt file - cDNA_ID_2716035; gDNA_ID_2213664; Annot_ID_132646
tttataacattattgtatggattgttgagcttcattagtttttgatcattgtgagatatctcccaaatctttggaatcttcaactttaagcgtaacaataattagctggataaattttgcatatcaatttgttgttgtgtatcttttttgcaaacgttgaattttaacatattaccctattttaaaaataaaataagagaaaaataaaaaaataaaaacacatagtgggccgatgcttctaaatgaaaaagaaaaaagaaggttttgccatattggttcccgtcaaatctcattggaccggagtagtatagatttcttcaaggccaatatcgtttcttcagagagaatcgaacggaagatcggaacaagatgatgtccggcgggaactacacgactatagacagccagaaagtctctggatctgtacctgtaagttttttatgtctcgatctcgaatgtttacatgagtgctcgtccctacactgattcttccgatctgatctagatttgtttgtgtcaatcgtagtctgttccagatccaggccataccaccgtcaaattcgcaggtaacattctcgtttttatgatttttggttgctgaggtgaaattgatattagagcgtttagggaaagaacgattttatttggaattataggcctttttttttctctgggacgtaagactatgttgaatcttagctaagattactgcaatttgttaggtaatggctatggattttgaattaaactgtagtttgaacagatgagggtttagccaatagtagaagtgtggtttgatttgacatggttatgttcatgttaagttgtgattgagggatgcattgttttgcagagtcaaatctacaaacttttcctccatctgctactcagggcaagatctctggtggtagtaatccccctcgtgatgctgacggtaagattctctcgacttcagaatttccgaatgtttgagcaagtagattgaagaatttagatgtggaaacgtgttcatcgactggttcatgttgattgcgtggtcccaatctttgccattctgtatatcttaaggcttatagtataattttgaattgttgcagattcattttctgggcatggtaatggtagtacagatgaacctcagtctggtggctggcttcataaattcactgttggtgcttacaagcccttctttgatgtcgacacttccgatgtagttgagagactcaaagaatcccttttcccattccgtggaacatttacagagaagacagctgataaacctgacttgtaagagtttcgtctttcttatctcttttcaacttagaggtgaattctcaaatgctcaaaaaattgattatatttttcaggtatggtccattctggatctgcaccaccttgatattcgttgcagcatctatcggcacatttgtcacatacatagcacacaaatggaagaaacaagaatggaactacgatattaatctagtgacttggtctgcaggagtattctatggctatgtcacaattgttcctctcgcattatatgtcgttctcaaatacttctctgcaccatcaggcctagtccaactcttctgtctttatggctattcccttttcgtctttatcccagcattggtaccaaatctctcctataaattctgatacatatggaaacatctgaatataatgagactttgacttattaatctgtttctgacactgcagtgtctctcggtcgtgccagtggagattttcagatgggtcatcgcaggtgtagctgggttcatgtccgcaacatttgtggctttgaacctcaaagcgcatatcaattccgctggagagagatcgatcctgattatcgccagcatctttcttttgcagctcgctcttgcagttgtgctaaagctctatatcttcaatgtcaaagtatgattcaaaaagaaatttgaaacttgatctttatagaacaaaaaaggtaatgaattctgatatctgtagatgctataatgtttcttctcctctgagttacccaattttgtaccgtttggatactgttccatttatttacactccatgatttactttgtagaaaatagtgttataacaaaatcgatttgtagctgctgtgatgttcaaactttctgtctctcaaaacaatttcaagagaaaaaaaacagtagaaggatttattttaatattttttatgaaataaaaggaccccagaaacttgaattctatagggtctaacaaagatttgtacggatacggctgtcttcgctaatatatttccttacactggtacatatctgacaattctgtaaatattcttccacattacgtcaataaccaattccgaaacatcttctatttttctcttcttgttaaatatttgttgtttttcagtgtttggctgtaagatagatgtcgaattttcttcacaaaataatttataagaaaaaaaataacaagtataatagcaacacattatctatcatgtgggtctcaatcatcgagacttccacttttttaatttctttttttcctactctctttataaaaaaaaaaaaaactaatcaatctgttctttagtgaacatggccgttgaatatcgaagccagattcacacaaatcttcttccttcaattatttcaacttctcttggcgtgagatttgaggtatgtatgtggatgtggtgttaagttaggtactctgttacgtttgttcatctttttattacatctcaagcaatcaaaatcaccaaacactttctttctttttctgaaaattgattggggtatttggcaagagattttcttgttgggaaaaatattgttttttttttgtcagagagtgaattataagtgagatcaataaattttgccccatttttaaagcttcctccttttaaatattttaggtcgcaactaaattggagttaaagtctgctgttgagattgttgcagatgagtttggtctgaatgtttggtggttttggatatg

SEQ ID NO: 26779 - DNA, 3003 bp, Unknown
  misc_feature (1)..( 3003): 2750-1469P.txt file - cDNA_ID_2716051; gDNA_ID_2213664; Annot_ID_132641
caccataaatggattgatatatagatattcattttcaaaatacagaatttggaaattgagaggataaaatttttaattactgcagtggatttgtgtagagcactagatgagaacataggttaggtccaacgtctataaagcaaacaaagttcataaaacaacagtttgatttggatactcattggcatgtgcttcaaaaataccccacatcttataatggttccaaaacattcacaattttattgattagtcaaaggtgtatagtagtggcgtactaaaagcaaataaaaatatcatttttatgataaattctatggaaaccgaaccacaaaggaaaagttaaagcctagtttcctcttaaaaataaaataaactgtagaaatattttaggaacatagctatgatactttcagtatgaatattatcttttagggactaacgtgtgtcatttttcttttgtcttcaattagatttaattcaaagatacctatagctgagcttttaaaatctttataaactgagttatacgaggtaaataggacccaacgttacaatttttcttaacgaattaattctaacgttctcttataattataacagcaatgaatttgaagttttgaacaataagaataaagtaattaaagaaataaccaaactgatatgtgacaaaagaaattaaactgacagcaatgttcgtcacgaggttggttttcttgatataagacgaaaaaacaacagagaaagttaataattttatctataaaaaagaagtgtctaaaatacctccgaaaatgattgctcaaaaaccctttaaaacaatgctaatatttatcccatctttttctcttatatatttagctttcgtggttttcttttattttctttggtctagcctttgtttttagctttcgtgttttatttgacttttttcggtcggagaaaaatttgacttcttaaggttccatggaccgacaccatgtacgcggttcaattcgatgacatgtgaatctatgcaagcttagtctgtgtaatttgtaattgtaggttcgtagagtatgtgagattcgaactatgaatagttttttttttttttttttttaaacttaaatcagttgattttagttattttccagatttgtcactttttgtataatcttaccacagatcctacacgtgtattcattctatctacctaacgcttactcacttagtgtggggattattttaatcttagtaactaaactcagtcaaagtcgtataaaatttaaagctgcactatgagaattaaaataacaagcacaaaatatcagtagtctatttattttcttatggaagaaattaatcacttactattatctcagtgaagtggtgcacatgcgtcacatgcattagcaagtaaatcgattttattgctaacatataaacccacaaaatatttcaactatacaattaaatagttcattaataattgatataaatcggaactaattggtggttgaaagctggcccaagaaaactctatctatcctccacagcaaagagtggaagcgacctacctgtcttatgacccattaaaaccccattaacattattgtaccctttcctgcttatatatttcgatttaaattcaattatacgtttgttattgtttaattttctaatcgagttttctaatcgagttttcaaaagatttggtttgatactactagtaaatttaatcgaattatacaattttttaactaattgagctaaccacattatgttgacaatctaacagtttatgtgagactttttagtatatcgatggtgtatgttaagtattatacgtaagatctagatcgcataatttagcattataggagtctttaactaatgtttaaactcactaccttacaatgtttgcgtaagtgatgttgttaaacaaagtccattttggtgacaaagacggtttcttgcttgcgattggatcctaaaccctctcgtcaacgatcattaaaatcattgatcacaaatcataattaatatcatgaaaatttcatattactatcagtgtcatacgtaaattattgtagtgatcgaagtttgcaaggaaatgatatatgcaatgaccaatattacttattagagaaaattcaatgtctaaataattgttagccttaatcaaaatatctggagaattacttaacacgtctgtctattaatatatggatatagacatttgacaaaatgcgaataataaataataaatcttcaataaaaaaaaacacacgagatgataagaacatgacaaacataaattattgaccatattaattaaagttgatttacatataaaccacacattagatatacgaaattaggaataatagcaaaataaaacaaggaaaaaaaacaaaacagcaaagtatttgtagttaaggaaccttaaatattcgaattaatcgtattcgggaagatgaatacataacacagctaagtacaaaagacgaagctgaggctgtacgttaagcttcttctttccctcaactctgtatcagaaaaagaaaaaacataaaaaaaggtacgaaaatttaaaaagaagaaaaagaaaagatttgatattaaaagtgtcaattaaaaaaagatattttgcaaaatcaaagttgggagatttccttgcaagctgtgccaccgccctctctctctctctctctcttagttttttttacagacatagaaataagaaaccctgaaacagagataaaacaaaacacaagttttgagtgtgttttttcaagtctctctcttctctctctgtccttgttaaacacagcaaccgcctttattacacaaaactctcttataataatctctctcaccatttcttctcttctcttcagaagaaagaaagaaactcataaaggagaagaaataagagtttctctgtcttaaactcattcattctttctctctctataaccagagttctgtctgtgaaaacacacaaatctaagagaagttatg

SEQ ID NO: 26780 - DNA, 3003 bp, Unknown
  misc_feature (1)..( 3003): 2750-1469P.txt file - cDNA_ID_2716055; gDNA_ID_2213664; Annot_ID_132640
taaatattttagtgagtcctcatgttggccgatagccatatatataagagattctgataaaccgttgaaaactttaacccaaaaacaaaaagtcctttctgtgacatcgaagtgaaaacgataataaagaaatctagcatagttttggacccaagaaaacgttttactctctattttgacaccacacaaataaaaaaatatgtcccaaatgttagctaaacataattaactctcgttaaaacaaaaatgtgatggttacgcgtgaaaatggatgatttatgtatttgtgattatatttccaatattttgctagcctactgaaaagtttaacgaaagcaatggataatggaaagattacaaacttttatattcgacataattttaccaattaggcaacgactttcattacacaaaattgcggaaactatacaaaattagccatggataaaaatggaaaataacaaaccgaaacttggctgtaacaaaatctgttagggatgtttcataaaaatatacaccaaactaataaaattcgaaaccaaccaaatgataaaattttgcctatgaccaaaaaaacataaatgacacaatgtgaaaagaaaaacatatttgttgattggaggaaccttcctgttgccacgtggaacttgaagtttgacacaattgctgacaccactgtactacctatctcttctttatgaatcttcaaatgtctttttttacgctataaactcactttcttctcctccaagagccaaataaacacacaaaaaaaaactcaaaatcatgagaagctccgatcatatggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtttagttgacttttcttttctcatctttttcatttgtttttgtttgggattgttgataaatacgcaaatacattttcaattttttaattgaattatccttgttttgtttaaaattctctgtaacgtacatatgaagtcagatcgaaaacggattcacttttgaaaactaatgtataaaaaagcttataacaaaacaacggacaatgatgtgaggtgcgctgtggtgcaggtgggtttctcggtttttcaatattaaaaaagtcgtattcgtggacaaagaatatagctatccgatcccctgataaaatatatgctaatagaatatagttttgtgtttgtcgctaaaaatatgctaactgttcaattatgtgtttggtttataaccagagttttacttcctagtttatacacaatattacatgttctaaaaaacaccgactacgcttcacagaaagaaatccattttgcggatgcattttgagaaaaatctttagtcaaagtactactatttagaattattgcattttccaaaagaaataatataatttcatgcaaaattggttatatatgaaaattattgaccgccactaggtctccagtcaggtcacggatctcatcgtgtatgaattatcatgagtcaatttccatccagaaggattatcccttaaaataaatattagttaagggatatatgtaactctatgcatttatttcgctccgttatattacatgctgtgtaatcacatgtatgatgtaatctatgcatatatgtaactctagatactttagacaattggatgaagactgtcatagtgtgcaaaaatactggttttaatttgttttgtcgtctcgtctcgtctataatcttaagacacgtgttacgttgtatcaaatttacataattaatgggctttaggcttgaacaattaaggcccacaaaagcctgttaatcccatgggaagttgaggacgagaaacagagtccgggaaaagaaaaaagagctctcggagattcaatcactcatg

SEQ ID NO: 26781 - DNA, 3003 bp, Unknown; identical to SEQ ID NO: 26780
  misc_feature (1)..( 3003): 2750-1469P.txt file - cDNA_ID_2716055; gDNA_ID_2213664; Annot_ID_182024

SEQ ID NO: 26782 - DNA, 3003 bp, Unknown
  misc_feature (1)..( 3003): 2750-1469P.txt file - cDNA_ID_2716061; gDNA_ID_2213664; Annot_ID_132638
tggaaaaatgcctttttttggaaatgaaacagttaagtttatggaaattattcatataatcataaataaaccagttaacatacaactaaatatatatgtaatccataaagaaagtgataatgtaactttctttgttacattgctaaagattcaaagatgacgccgtctcagagtatttaccggtgagaatgtgtagtgcaacaaaccgatttgcagcttcagtgtaatgaatgccgtcccagttaacatatttggaactatcataacaaggtttggcggttatgatcgtaccatttgatcttgctgtcttaccgcaaccaacctgatcatcgtagttcagtggtggtcctccggttccacaacataccattatcgaatgatcaaaacctattaccataccaaaaaaaagtttcaagcactgttaacttgcacataagtaagttttggcattccggttaaaatgccaccactaacacaaaagtaaaaaaatgctttctaatttgagtgaactgaacattattaatacttagttacttaccatatttggaatgattcaggatgaggtcggatttgatagagaagatatctacgtatgtgaaacgggaattgggatattgttgagggagttttttgaaaagaccatgaagctgcaaattgaaaagcttagcagcttggttatggtcactgacacaaccaaactcatcaagctttgatttgtcttccccaaaaattgacacaacttgtgctaaacacccaagtggtcctgtgttgtgtatccaatagtttcttgccccctctgcatataatctctagataaagaattacaaaatgaattaatagtatgatgatatcttatactcaaatcaaattcaaatatttcccccaaaaaatgattatccgtgtaacaattaacaaagtgtcatttatagttttatttaagattgaaaaaaaaacgaggattaagattcatgtaaatactaacctttattccatcttgaaatatatctaagattataggaaccagagcaagaacttgatctactgtcttggtgtaaaatgctccggcaatatcattttgtccgatatcaaacatatacaatccattactaaaaaaatattcggacggtaagtatctttggagctcttcatctgacaaacaaaagagaaaaaaaaaaggtacattggtcagtgactaaatgattcaactaagtctaaaatgttgatgaacttttggtatcatttgctatttagttaccttgttgtatcaattgaaggactttggacttaaaggtgatgaattgagagacttgaacaccaaaaccaaaggggctataggatgcagcatttgccttctgaatcgttgacgcagccgcagcaaaattgcagcctcttcggtaagtttgtcgacttatcgaatctaaataaggcctcaaatatggtcgatcaattgcttccactacaaaaacatatataaagcccactcaaaaacttatcatgtaacgagttttatggttcataagaatctttacacccacaacgaaaattacatgagcgtgaaaatcgcgttatatcaagatcaatcagatcatcttgtaacgttttaaaagtcatgttattaactcgactagtttgttatagttcatgcaatccaacgcttccagtaaaaacaggaaaacatgacaactttgccgttgaacaatttgtaaaataatataaaatcctattattattttgctacaaaaaaagtcatgaaaactgaaaaaatagaggaaagattttaaagaataaaggaattattagaaatgaagaatgattacttagaaaatcgacgataagacgtccattgcagaatcttccggaagttggagatctaaagaaggttatttcataggaaggttgtggaaggaatccaagacccgagctaagttctccggtgtcagagttagagtctccgaagttgaaaaccgccggaaagtcattagaaatccggaaagaaccggcgagaggggacagagtatgagagatggctacgaatagtaataatctaagaagagtgtggaaaagagtttccatggctcaaaacaatataatttcagccttatcatttcttacatactatatatacattatatattatggttttaacaaaaaaataaaataaaagataaaaaaaaatatacatccttatgtggatacaaatgtatgcgtgtatacataatgtaatgaaagtagaatgtgagtttgcttggaaatatagatagaaacaaatgatgaagtcctcctctcgtgacattttttttggttttatattcacggaaaccacatcaattgcactattgtgtcgactttacgatatccgaagataaaaaagctcagtatttgggtattaataattaacggtcgtgagaccccatttatattttgtatactgatggaactaaccttttcttttataattgcatgagatgcgtattttttaggataggcccaataagcctgataggcccaaatagttttttcgaggttctctagtaaaaacatcaatatagctggtaaaatataaaatggaagaaatcagaatctcgccggggctatagcttcaccgtgtcgtgtcctaatctattgtcgggaatttgaagctaaagtaacattacaatgaggaaaccacgaacggcagagatggtgatttccggttatttaaccacgattcgatactagtaaattgatatttctcttacattattttgaaggcttcttattttaatgaaagttattttttttttaaataggtaacacaaagttggcatcttttttttgcttactaaattccaagcaaaatagagaaagaattgatatgcgtgcaagtttctgtccaaattcttgtcttttttggaggtgtggtgttgttttatcgacactccactttacacttcacaagtcacaacacttataacaaaagtgatcacagaggccagagttgagagtttgacaccgtcatcaatg

SEQ ID NO: 26783 - DNA, 3000 bp, Unknown; identical to SEQ ID NO: 10594
  misc_feature (1)..( 3000): 2750-1469P.txt file - cDNA_ID_2716072; gDNA_ID_2213664; Annot_ID_132635

SEQ ID NO: 26784 - DNA, 3003 bp, Unknown
  misc_feature (1)..( 3003): 2750-1469P.txt file - cDNA_ID_2716076; gDNA_ID_2213664; Annot_ID_132634
ctgaaattgtcagttgcaatttcgatgtcagatattgagaagttttggagagatgattggaaatcgtagatatcgtgaaggaccatgccattcatgtttggatctgcacttttgttttgtttgatgatcggtggggcggcgccacttaatggaggaaaggaagagaggcgtttcatggatctgcgtttccatagcttgaagaattttccccaattagaagatgctctgtgattcttgcactgtacgtctgtgtctgcatctgcattgtcgatagcttctctgtttggaggaggatcgtcagatgaagatgaagcggaagagattgagcaacgagttaagcaggcttcgagggctcctcttggtgatttggggtcttgcttctctttatctacctctagtaatcttagatctgggaggagaagggagagaaaacgttggaagaagctaggttttttggtgtacaagcaatgaataagaatacagaggacaagagaaaacagagcaaacatagaaacagaggaaacagaggagctaggttttaccatgagctgaagcagaattcataagaaacgcgttggttcttttatgttttgacgtatgatttatgtcgtttggatcttcttcagtgacataacttgaatatttagagttgtacctgcctcgggagattcaaaagaaaagaacagactaaacatgtcgttcttatgtaaattttgcgggaaattaagagaaaatcggtgaaaattcagggaaagttcgttaattctgcttaaacgttcgttaagtatcaatgaaaatcataacagaacagaagataaacttctagacattaatatcatgtctaccaaaaaaaaactcaaatcaaatataagaacaaacagagaaaaaagtgatttgattgaatgattacattggaagagcacaacacacgggagaagcttctttgctttggtctaccgccatgaaagagtgttggtaggacacttttaagattttctcagaaacctgaaaacctaaaaatagagaagaggatcatagaaaggaaatagaaagaagttaacatttaaaccaaaaataaataaaaatagaaagaagttttgaagttggtgttcgtctcgagacacccgaaagaaaaggttttgtctgtgtgtttaaaatttgatttactaatttaattgttttccgttgaccaatggtatatctactagtagtttttttgttaagctaatagttagactctaaaatgactaaatcctatatttggcaatatgcttttgattttctctttttggattgaactcagaggcattctcttagcttcattcatttatggcagaaagggttaagggtccttaaaaatcgcttcatctgtcggtctcgttatccaaactcatattcctaatttaggtcttttaaggttttaaaaaactactttctttatcttgttgataaggaatttataaaagatcaaacttgagtaatctaagtagttttagttttactaatttcatttactgttactaatcaattgtagatattgacattcttgtatatattgcgacctgatagtaattatctttaattttctatatgtttttattcaagtagtactctgttttgtattttctttcttgtgaatagaatattttctgtgtgtatatgatgcagaaagcctgcattaaaacctgcattggctttattgctttgcaccgtttatttatttttatgattcttatttttgtgattaacaaatattatttcaagtgactcttatataagttttggatagttaaaccacggaccacaatcatgttggaagtgattgttcaatacttcattgttgtataagagaggggacatcgatcatttatgtaaatcttgttaggtactgttctgttctatcaatctatcaatagtccctacgctaactttctgtaccctcgattaaataggtttttgctcaatgacgctgggtccaaattgtaatgactcagttcaacttccgcgacaaaatcattttcatagattttgatgatttctatagtgggcggttttttctatacatcttacattcgcaagaatttgaatgatattagcccatatgacgagaagaagaataattcattacttatgtggttaatgcggagtggaaacgaatatctcatggccaactacaaatccaaatactgtcttttgaatccctgtagttttatactatatgatctagagttttttttggattttgtctcccaaattagaaattattatagtatcaactatccatcacatttatagaaaaaaaaaaaaaaaaaaactatccatcacagcttggatcttgcggtgggccaggaaaaaacacatgagcatcggatctgtggaaaacaactgtcttatcgggtcaaacctttgagtcaattacacgttactgtgcatgtcataaaccatcaccaaaaaggaaaacaaaataacaaaccatgcatcttacttacccagtaacacaatgcatccataatgtacatagtatttgtgaattttttgaggaaagtattagtgaatattattactatgaaataccatgtaattacttctgaattatcttacttaagaaaattcaagtttagtcaatcaacattaaaactatagagaacccccaacgtgtaataatgcattgggagttgggactttcataaaatctcgaataaattaattcaaattgtctaattcgtccaaaattatcctgcatgggttttagctaagccagcctagctacatgtactgatttatacagagataaatatagacatgatatatatcaataaattaggaacaaatcagagtttttagatctaaaaacacggtgccttctcatttcctccggtgagttatccaaatcttgtgtttcttatcatatatcctatattttatctacataaaaattgataagtattcgttgaattcaaagggcattttacgaagaaaatggagacaagaaaagacgacatg

SEQ ID NO: 26785 - DNA, 3000 bp, Unknown; identical to SEQ ID NO: 10584
  misc_feature (1)..( 3000): 2750-1469P.txt file - cDNA_ID_2716080; gDNA_ID_2213664; Annot_ID_132633

SEQ ID NO: 26786 - DNA, 3000 bp, Unknown; identical to SEQ ID NO: 10583
  misc_feature (1)..( 3000): 2750-1469P.txt file - cDNA_ID_2716090; gDNA_ID_2213664; Annot_ID_132630

SEQ ID NO: 26787 - DNA, 3003 bp, Unknown
  misc_feature (1)..( 3003): 2750-1469P.txt file - cDNA_ID_2716094; gDNA_ID_2213664; Annot_ID_132629
aggtgagaaacacgaggaaacgcaagtaagtcagagaaaaaataggtaccaaaaggccccaaaataaaccattgctggcatgtacaactaaaaaaaaaaaaacaagttacctgccagttgagtccagaagcagcactctaacattatctgtatgccctctcagcttcatactctttgaaccggttctagggtcccagacacgtaaaacctgcaataaataaaaaaaacttagttttaagaaatcaaaaacccaaaaaaattatccgttgttgttctcaggtatactctctgcaacttgggaatgtacgaataccttttctgttccaccagaaacgagcatcgttccggtatcattcatcgccaaagcatacacagactccttatggcctttcgcaattgttggtgtgtacccatgagatggagatgactgcacagagatattgttgcttgaaccaacagttcttaaacttgtaacaggaccatttgcaccatttgaagaactatcttcattagcgtcattaggtttggtaactggtgacaaagcagcttcaatatcccatataaaaacctccccaccaaggccaccagatgcaacaacattattctaaaagttgtgaaatcaagatagaatcagaatgcgacaatgagaagcacatatatcctcaaaacttgcaccaccataccaatcaatttttttcagtgggaactataaagaaaaaagcatgacaaatgagaaattacattttttgccgcaactgccaaacaagtaacatagtcagaatgctgacggagagtcctcgtacagactccatctgataaaccgtcccatgtctagatacaaaataattaagccgcatttagaaaccaatatggaattacaaaaacaaaacaaagtaaaatattggttcggctagcgaaacaaattcacaaaccttgaccgtagtgtctgaagaacaagaaacaagagtgctctcaccagccagagcagcgtcgttcacctgaccagtcaacatggggtttgaaattattagatgcacaatagaacagcatccacctcaggaaacacaggatcctaatcactgatcatccctatacaattaaatttcagtgtcaagaaaactatatacccagtcaacatgagactcaaatgtagctgagcagaaggtcgcatcctcgtcaaatgcccatctcttgagtgtaccatcacgacttccagtgaagaggtagctttgatcattagaaacagacgacttcaacacatccaagcaatttatgccagcacaatgctgcagcttgcaaataacataagaagaacatcatcaggattgagttgagaaggagatgtcttataacttcaaactatttcaagtcatgtcttaatgtataatacgaaggaactagaaaataaatcaaacaaagagtaacacaactcctgatggcaataaaccatattggtgtaaaaaaactaacctttgtatcgttggcatcatttaacacataagtaagctttttctctttgcgagtgcgaacagaaccgccattactgccggcacttccaacccggtgcatttcaaattattctgaaagcctgaaaggagaaccacaaaagggaaaaaaccagcaagtgagggacaagcaatctcttcttcaagcagactagttatcatcatcatccaaaacataacaagaccaaaccgaatattgctactaagaaaaagctggtagtagtagagtgataagaacctaagggacagacatagagatccagctgagagtaagattctttctcttcacgagaatctcaaatattccggaagaaaaaaaatcaacaattatccacatcgaataacagctgataagctcccaaaatcctccattgactcatcaaaaggaaaatagtcggaagaagaagatcaaaatcaaaaggccacactcaattgagatagattacaaaatcatcatcactagtcagctataagaagactcttcagttttgatccatacacagtacccatcaccattgaacatatacgattaattcaactacttgctcaatttctaacaggagaacaaaaactgaacaataacaacaacaaaaaaaaagtggaatcagtcgtgtacgaaatcatcaacatacctttaaaaatctcaacttcagatgaaatcgatgatagtaacaaggtgattcagcaacccaaaacacacagagagaaaccctagaatcgctcgttgggggcgggagtgaataacgagatttgggaatcggattgatctagaaagtcgaaagtttttagcacaaatttggaaattatgagcaaaatttaatttaagagtcaagaaggacaaacaaaaaagagcagcctttttccaaaggcgtgatggcgtttggagaattggaagaagaagacgaagaagaagaagaaacaaaaaaaaaaaagtgtttttttttccttaagaaacacaaactcttctctcaaaggctctcgagcgagacttggtaaaatcagcccatagaggacaaaattgcgtttagtaaataaaatcgaaatagtgtttgggattggataagattatatcaaaatcctcttgtattttcttattggataagtgacataatttttgacctcacacaaaaattagctattgagatttaataaatttatgctaaaaccacaaataatccttaacaaaaatttatgcattttcttttcatttgtattttagtaataatcattcacttgtttaaagtcacatatattcttctaattaacacatctcatattccagctaatattgttagaaagaaaaaaggattacttggttgacaaaaaaaaggaaaacttttgacagtttaaccgttgatcgtgcaatgaccatgtttgattagagtaaaactaaatattgacaatactataattggtaaacgaactcatttccactcactagtttccttaagcgaccagagacacactgagatctctcctctttctgtcttcaccaatg

SEQ ID NO: 26788 - DNA, 3003 bp, Unknown; identical to SEQ ID NO: 26787
  misc_feature (1)..( 3003): 2750-1469P.txt file - cDNA_ID_2716094; gDNA_ID_2213664; Annot_ID_182010

SEQ ID NO: 26789 - DNA, 3000 bp, Unknown; identical to SEQ ID NO: 10581
  misc_feature (1)..( 3000): 2750-1469P.txt file - cDNA_ID_2716098; gDNA_ID_2213664; Annot_ID_132628

SEQ ID NO: 26790 - DNA, 3000 bp, Unknown; identical to SEQ ID NO: 10579
  misc_feature (1)..( 3000): 2750-1469P.txt file - cDNA_ID_2716108; gDNA_ID_2213664; Annot_ID_132624

SEQ ID NO: 26791 - DNA, 3003 bp, Unknown
  misc_feature (1)..( 3003): 2750-1469P.txt file - cDNA_ID_2716112; gDNA_ID_2213665; Annot_ID_132677
tgacaaacccgcagaagagtatatacacggaggtcatggacgaagacgacggagtttctttcgccgtctgatttagcaatctccgatcaaaagatttttcaggcgtcaagagttgccaaaaagagaaggaaaatgcaaaattccggtctaatttaacaagaagccaaaattacccggttcggtctatgtttacttgaaccgaatttaatttaccttcccggttcaaaaacccaaaattctagagagagaggacggcaatgcgatggggtcatctttctccgcctcctttactaactccaccaccgccgccgccgttcctcctccgtcgccaccttcatcgccgtcacgttccaatgtaaaatctaacggagaagagagacctcgtttcttcgatggaaaggcgaagaacaagtgctgggctaatgctgacatcgtacctggtcgacatcccgagaggtggcgtaaagacgtcgccggtaacatagtctgcaaacgcttcggaaattgcaatggttgtctctgtttcgagtatgatcacattgttccttattccaaaggtttgatttttcttatcactgcttccccaaatgtgacattttgaatttaggttttgagtagttaaaattaggatcttgatatttgtttctgtgtatataggtggagagtcgatagcggagaattgtcagattcttcaaacaagagttaacagattcaaatcagctcaagaaaatgttgatgccaccactcttaagagctattcttgtggtctgcaatttacgggtatgttgccaaatgttagcttcttcttcttctaattacatgtgatgatggatcatagatttgctcatctgctataagattcaatctttccttgttgggtttgtttttcagtgttcatttctatgttattatgtagataagatgggacaatcttgattgtgatttgtagtatgttccatattctgtagagattaagatcattaatcgtatagatatagtctttcttacctctgttatgctttcgtaaagtgctgtgttgaatagcatgttcgtttagaagtaatgccaatctcatacatgtgggagatgcttttgctttagatcttctttctcttttctctgttggtttgatcatatcaagaattgctattgagccactaggaatctaaatcttctttaaacccaaaagccatgctgtgagttgtttttaggtgttgctagtttacgttttatataggagtgaagcaaagtgttaaatgctcttgggaaatgcattttcttttcaaaaagactcaaaagattatagagctcttggtacttgcaatgattatacacaagtgaactcaagtgtgtgttgtgtgtctattctctgcatatttgctttgactttcttaagatttcttctattgtaaacattgcagacaaggagttagatgttatcgagatggcggtttatggagacgtgttacgacctggaaaagaatgtcgctgcaaaaccgtagctgagctgcttggtcagtccaagtccaaagatggtaaagccgcatgcgagttaccatcatagaaagtagtaatcaaccatgtctttgtaaagctttgattcatgctcatacattggcagattcatcagaatcttttacatatactggaaaccattgtttgtaagagtagtgatgattctatatctctatatacaaatggaaataaaattcagcttacactgatacctaacttttgaagtcaacaaattgtttgttaatatatcgaccacctaattcactattatatagtcgagaaataaaagttactgttacgatagagattttatggttggtcatggagacatgaaatatcaaaaaacgggaaaggtgcgcaattatgtgtgagctattaaagaaagatgtctgccaaaaagttaaagtcaacataaatttcctttggcttttttttttaaaaaattctctctgatatttaaatgtattttttcccatctatatataaaaaaaatatagtagctttcattcattaatacctaaataaaaatttaaaaattggtagttgtatcaatgggtgttcgaatttcggctttgaacaataaatgtagctcccacgtatacacatatcggctggttgaaaaactttatctatggagagagtcacatgatatatggtatccaacaataattcaacaatttaatgtggaatatgtattgattgccgtaaggttcgaaagctcaaatcccaaagaatttatcttactctaaaaaggggctattctatttaaatctcaatatgcattttgataccactacttcggttattattaaacaaagaatttcgaatcgatcccatattatacgaataagaaaactacaacaatgtttgtgattgtatataaagtacacaaatgacaagtgtgaggttaaaaaatgttggaaacaaacaagtcaacaacaacccaccaccgtttttggccgtattagctcactctcacactggtcgccgctagtcaaactctcgttccattgcataattttttaatcctattaatttcgattttctcaacaatgttactcacttaattagaaaaaaaacactactatatcaaattgaactatacaaagaaaaaaagctgtagaaatacttaacacagaaagtaaaagagagtgatcaatcaagtcatcattattcactgtcgatccaaaaaatcttgccgtagatttcgccttaaacatttctatttttgattacacgacatttacttttgatctatctctgtttaatttttgatttcgtcttccgcaattcacgcagaaatcaaaaactctaaaagaaaaaaacaacattctctaaacttttctctctgtatatatctaacgaaaaccgcaacagcaatagtttcatcattcaccggagatccgaatcacaataaccggcgccggtttaagagatagttccggtacacatgtgttgttgacgcggaggagcgaaattctgggaatg

SEQ ID NO: 26792 - DNA, 3003 bp, Unknown
  misc_feature (1)..( 3003): 2750-1469P.txt file - cDNA_ID_2716116; gDNA_ID_2213665; Annot_ID_132676
cgcccaatcctggatgatacttctctatcatctcttcatacctgtcaaccaaaccttcccaaaacccgtgcaagtagtattgattctccacataaaccttctctatccatttttccttctgcgaaagcaagagatatatcaacgccgattgatcatcggcctcaaatgctggcctgcctttcagataagctgtcagtatcttcccagtttcgtcacggatcttcccttttggtcccattggggcccaagcatctaataaatccaatgaccactgacaatttctcaacagaaagatacccgtgttcaatgcaacccatgatttttggttgaacagcaagtctggataaccgtgtatcaccagattatgattttcgtaccgaggcaacgggatctcaaacagtatatcagtgaacaaagcatcactatccatccaccaaatccattctacttctggatgagacagcattaatgtcctaatcataggtaatttcgtccaataccctgagagttcctcatccaaattcgccatgttatacacaatctctatcccgtggagtctacagtaatcaatcttgttcttcacagctttcaatagataatagtttccaattggtttatcacagggtccgggggaagaccctgtgagaagcaatattcgagctttgccattgacaatattaggaaactcagggttctgattcagccataccttgcgttgactatcccagttggtgattttgggccctagagtatatgtcgcattgggactaatatcagctttaggcggctcaagcaagtctgtcaaatgcgaatcagatgggatctccgcgattctggggcctagagtatacgttgcattgggactaatatcagctttaggcagctcaaccaagtccgttgaatgcacatcagatgggatctccgcgattcttggctctagagtatacgttgcattgggactaacatcagctttaggaggctcagccaagtccgtcgaatgcgaatcagaggggatctccgcgagaatcggaatggtttccttgatgaaactctgattaacagagtcggcgttggagcttccaaggttcccaacacggattgtgccaagtaggatgagaatggtcacgaagcagcagagaatcatgaacttgatgttgttaaataaggtattctggatctgccaaccgcgcaaaaacccacgggttctccatccaccatttgatacagccgttgtcgacagtcctctgccacttcctgaggatcttgacccatcctgaaacatttcacttgttgcctcctgtctctagatttcactcacaggggagagacctccagatggcacttgaatccagacacggtctaacttataactataatcggtgaagactgtctttttgttactcacagaatgtgtagatcccacactctctccctctctgaactacaccgctctgaaacttcagatttttggcaggatcctgatggaagactagtagatgatggacttggacaatctgaagagcctcttttaaaaatcattaaagaatattaaattggataatggagaaacctggttgtaattaaatatatttgatgcggagcaatatgttttatatgcatgccaacattaagcatcttattaaatgaaaaataaaaacctttcgcatcttcaacatatgaatattcatgccagattgcttggatattttgccagagaggtatcaaaagcatgatgcttgatatctctacaaacttaagtgactctatgcttacatatcaaagaagagccaaccatgtatacgcaactgtaaacaatctactcagaggcttattatacctatatcagccttggtttggaaatgaaatgcatagtcttacaacgtaaaatggcatcaaacttcacgttgaaacctctacgaaatattatatgtaataacaagttggatccaaaagaaatcatatacccaaattcaggaaatggaattggagatggtaaagagctcgtttagtcaactgaccataagaaacgacttcccagcaggcgaagttatatttgcaaaatcttccacaacattttcgttttcaagctcctctataacatgctgcaaacatggaaccattaaaccaagcaattcgttttcatataaacagaataaatgttcattctttttcagtatgctgcagtaacaacttactgctgtttcatcattgccaggtgtcacagtcccttctctatatacgagatttcttaacagcttaaaggcgtagtctatctgcaaaacatttagtagcactgatgatattaacaacataaagctaacagatttagcacacaacaaactgacagacctctataaaatctgatgagcaagtatatcctgaaacagatagaaattgagagaaacagtatgaagaatgatggtgaagaagaagcatcatggaacgaattcatgtcatggtcgattttgaaaaacgttcttcaagtttgtctgcaatgtacttgaactaagaccacctaaagtatagttctaaaattcaattagcctacttatactaacagaaatagagtacgctgagtttatccaagactcttcacgaaacaccacacacagacgcacacactcacccaacagtagatactaatttcaggactatctatggagtataagttactcgaaggtggaatcatgcgattgaaacaagactcaaatgaaaacagaaagaaattcaaccgaaaatgacaaacccgcagaagagtatatacacggaggtcatggacgaagacgacggagtttctttcgccgtctgatttagcaatctccgatcaaaagatttttcaggcgtcaagagttgccaaaaagagaaggaaaatgcaaaattccggtctaatttaacaagaagccaaaattacccggttcggtctatgtttacttgaaccgaatttaatttaccttcccggttcaaaaacccaaaattctagagagagaggacggcaatgcgatg

SEQ ID NO: 26793 - DNA, 3003 bp, Unknown; identical to SEQ ID NO: 26792
  misc_feature (1)..( 3003): 2750-1469P.txt file - cDNA_ID_2716116; gDNA_ID_2213665; Annot_ID_182080

SEQ ID NO: 26794 - DNA, 3000 bp, Unknown; identical to SEQ ID NO: 10631
  misc_feature (1)..( 3000): 2750-1469P.txt file - cDNA_ID_2716122; gDNA_ID_2213665; Annot_ID_132674

SEQ ID NO: 26795 - DNA, 3000 bp, Unknown; identical to SEQ ID NO: 10618
  misc_feature (1)..( 3000): 2750-1469P.txt file - cDNA_ID_2716126; gDNA_ID_2213665; Annot_ID_132673

SEQ ID NO: 26796 - DNA, 3000 bp, Unknown; identical to SEQ ID NO: 10618
  misc_feature (1)..( 3000): 2750-1469P.txt file - cDNA_ID_2716126; gDNA_ID_2213665; Annot_ID_182077

SEQ ID NO: 26797 - DNA, 3000 bp, Unknown; identical to SEQ ID NO: 10626
  misc_feature (1)..( 3000): 2750-1469P.txt file - cDNA_ID_2716159; gDNA_ID_2213665; Annot_ID_132663

SEQ ID NO: 26798 - DNA, 3003 bp, Unknown
  misc_feature (1)..( 3003): 2750-1469P.txt file - cDNA_ID_2716163; gDNA_ID_2213665; Annot_ID_132662
cgtagcgaatcaggacaaggtcgactcgcaatccgattatccaatccctcttagccacgatggtatctttgcgaatctgaaaccaaagctagaaaaccctaatcttggtacccttgtcaatccaatttccgggtggggaatctctgaaagtgatgttgaagtcatcgatttgggtaaaaagttttcatctaagctgaaaaggaagcttaaggatactaacgggtttgtcaaagatgagtttgtcaagatgttaaagcagtttcttgagaaaattggtgagaaagttgggatttcagaggctgagtctgagatggttttgggagatcaagctggttctgagatacagatactggtggagaaaaatgggtttttgatgggtagagatgtatctggtttagtgttgaaaggttgtattagtctagagatgtgggagctagtggaaattttgatttcaaactccttggttgatcattcttcatactcttatttagttagcaatcttgttgagaagcaaaggtcagatttgctttgcgtagtgatcaaagaagcttcagatcttggggcaactgagctactttcaatcttgaagtattttttatgcccatcaaaggaagcaattagcactatggctaaggtaagagaagaatgggagagtcaggctatgttggctattgaaaaggtgagcaacacagagctatcaaagaagtctaaagttgcagaagaggcttctatcttgttaatggttgctcatgacgggttttcaacctcagagctttgcctgcattacttgttagcttcacggaatgttgacgaagtcatgtttgcatctgcagtcagtaagttgaatggcaatgagatgggtagctttattcgatacctctctaaatggatgaagaagtatgagatgttcccacaagctggtccatgccctaaagccgcctccaagcttggtttgaaactatgcaactgggttcctgaactcacagacattaccaaatgtttgggacttcttatcgatgagaacttctccactctggttctgtactcggatttgcatgaagagctaaagtctattgcaagagtagccgatgggttagcttcagaatcaaaactttcctgttttgtggctaatgtggttgaaagtttgaagcttggagctgcccgaaactagattttcacaattgttggagcttaatgcaaccctgttttcactttttattatggtctccagtgacatttgtattttctagtttcagttcatctcttaactaaagtataattttgttcgctatctttgagagtttgtctccaacctctgcacattgccaatctcatttaggatgcaccacatggtttaaaattgttttcttttccaagaattctttatcagttacaacaggaagagtaaaaggtttatctttgcaatacaacagcttactttgttgaagaatgagcacaagttgttgctcaacgaagtgtctcacagagccggataataaaaaccgttcctttatgaacactcacgagaccttgccgcaaaatcaaacggctaatgtatcatcaccacgaaagtgaggtactctcgctgaggttgaagaagaagaaggggcaagaatgtaattacatccagaaatgcttcatagttacgcagctgagttattacacttgttcacaaagtaagctgcagtctggggactacccaactcctaactttcttcaccttcttaaattacctatctgtcaattatcatcatttcccaattgtgttgatacttaattggtagtagcaattttttccattaaagttttcatttttttggttttttgttgatggaaaaagtattgatccaacggctgtagaagaacggtgcaacaagattttgaattcggagatgcgtttgttttagttttaaaatagaaataaataaagttgttctctctctctcttcgtggacactggaactaacaccaccgatgcactacactctgtagagactgcaaatggaaagcatcttttggtaatcacgggtactgttgtcttcgtcttagtttttgtcggaaatcagacattagatccgaccagattctctatttggagacagacattactcggatctttatttcattttgtatgattctttattgtagattttgagatcaggtagtgtggatttgagatcaggtacatttacttgcaaggtgagttccagatctggttttggttatttcatttctggagttttatacgtttttgcaattttggagattttgttgattttagattaggatgatcattgcattttctttctctttcttgtttgatttcattggttaatgattgtggattactactatttaatctttttataaaaaaatccaaatccttagctcatgtacttataaaagaatgattttatgtttgatagtgatctatacatagttataaacaaatggctgatccattgaacttagtatgatgaatcctgttacaaagagcttatgtatctctttaatgtctaaaagctctagatagaaccaaaatatgaaaattgcaatctttagtaatgaaagtgttgtgttatagtcttgtgttattgcttgaccataatattttgtgattgttcggactaatgcaggtgttttgaattttggttgtggacataatgggaaagcctgcaaggtggttaaaaagtgtactacttggaaagaaaccatctaaatctagtggttctaaagataaggaggtaacacacttccgcacaatgttgtatgataaaacaaatgaatttcaagcttgcatagttaaatttctcaggttgattacagtagtggttctcgtagaggaccttgactgcttgacatctcttttactagttttttcactttagacattgcaaatttcccactaattttgtgtcgtctactattgtctatggtgtcactttctgatttcatttccctttgttgtctgtttctaattgttcctgacaacaattctctatg

SEQ ID NO: 26799 - DNA, 3000 bp, Unknown; identical to SEQ ID NO: 10613
  misc_feature (1)..( 3000): 2750-1469P.txt file - cDNA_ID_2716166; gDNA_ID_2213665; Annot_ID_132660

SEQ ID NO: 26800 - DNA, 3000 bp, Unknown; identical to SEQ ID NO: 10612
  misc_feature (1)..( 3000): 2750-1469P.txt file - cDNA_ID_2716170; gDNA_ID_2213665; Annot_ID_132659

SEQ ID NO: 26801 - DNA, 3000 bp, Unknown; identical to SEQ ID NO: 10611
  misc_feature (1)..( 3000): 2750-1469P.txt file - cDNA_ID_2716174; gDNA_ID_2213665; Annot_ID_132658

SEQ ID NO: 26802 - DNA, 3000 bp, Unknown; identical to SEQ ID NO: 10611
  misc_feature (1)..( 3000): 2750-1469P.txt file - cDNA_ID_2716174; gDNA_ID_2213665; Annot_ID_182058

SEQ ID NO: 26803 - DNA, 3003 bp, Unknown
  misc_feature (1)..( 3003): 2750-1469P.txt file - cDNA_ID_2716178; gDNA_ID_2213665; Annot_ID_132657
ttaaaaaggattatgtgttttatggagttatagaagaatatatggctttgactaaaaagaagaagaaattgagcttctttttgttattttccactttggttagttcttaattgcaacgtagaagccttgccctccccaagtttcgcaagtcttcaacaaaaatgttccgcaagtcttcgctattacacgtggcgttgctttcatgtcttgcccgtgactgtcctgttactctagtggtcagagaaagtttctttttcagttgtattttgactattcagattttggtggtaagttgagaaacgagaacttttagcggaataagcattatatgattaaaaaaactctataatcaaagaagaataattgtcttgtagagtttgctaatcctcttctccaagcaaggtgcaaagtctcctctgcatactaggcttagttcaatacatctttcaatctagttaggcccattagcccgttatgtttacaaagttaaaagcccacttacttgagaaaattcacagatgcacacatgcattagattatgtactgcaatctgaaaatgcatgatgagaggtctcatacacaaaacaaaatcaaaaacaatttagaaaaatattagagtaacttataaagactgttacagctgaaactaaaatactaataaattcgacttctggcaataattaaggattacatctcttttgtttagagtataattgaacttttggagctgtaatataatttgtatgtatgatttatgaaaagtgattgaacttatacatagatggaaaagttggcgtaacaacatgcatgatacatacagaacacatgcagccacagcatttgaatagaacacatcatcacaattcccaaacataatcattctcttcagcaaaaagacacactctttccaaatataattgtcacttttactgttttaaattttaagttatgccagctttaaagttgccgacgacaaaagcatgtccatcgtttctttcttcttcggaagattaatcagaggatttaaaataatctaaattcgagattatgttgtataaatatccattttgaaacttgaatgaacaaaaaaccgataaagttttccacgaataagttgttggtgtttttagtaggttcatagataggagggtggaaggtctctagttgggcaataaattgaaaccgcttttttctgacctaccaaatattaatttgatcgaatcattgaaaaaaatacatatataaaattatccatataaaaactatgtagtttgctttaaaatatttcatcgtatgcaatgatatatgcatacttaatccaccacatgtcccttgaaacaaaagcacttaagctctgtgtggttgacattaaatcacacatttcattttgttaaaattaaagtctaaaattttattcatggtagtacatccatcatcaaagaccattttcattgaacaaaataaagtttcaatctctaatcctttgtgaaaattcttactactatatattaattaggtcttttggaatatagacgcgcaacacacattttcttatatatggattgaatggtatccaaatccccaaggtaatgtaatgtaaaaccaagataaagaaaacgagtatgacattgacaattgaacttgtagcgaagtcaggataggacgacttgcggtttctactttctaagccaaagaaacatagttttcattgatttttagtgtttttaaatttgttgttgacttccattaatggaatatttcgtactttgcttcttcttttcgaattttatttacctatataactttgctttattttctacaacacaataagtattgctcataattgaggaagtctatacacacaatattttcctatcctttctttttttctgtcgggaatttcttcatatcctagcatctagattatgattgtacacatacaaaaacagaaaagaactagacttcaaaataatgcaaattagaaacaaaaaattgctccaaaaaaaatatattcaaaactataaataaaatattattatgatttttcttctattttacgtacattgtatatctctagagaagaaaataatttttaaaaaatagtttgggatcaacgtcgcacttattgttttgtcttacaatctcagagtctcaccgtatccaccacgctggtcaacaacttcaacaaaactctcttcctcgaacttcaatcttatcccttcatttcattaccattaattcacaccaacggctaacattgtcctcctcgctaaactgttaattatacgtttggccgtaatgttttgaagtctgcctatatttcttttcaataaatgctcttttaattaggttttaatttggtgaaatccaacctttaaattttctgatgctgttaaatctaagagtttgaattttctaaaatcattgttgtcggttatcatttgtacatcttgatagaactataatatgatcaatataaacttataataataataactgaaaatacaaatgattttgtttgtttgtttataaaaccactgaaaaatgcaagagttaatccactgagttcaaccaaaaaataaagaagtgaattctattagtcataagcttggaccaaaaaatccatctagaagaaaaaaaaaattgaaaaaaaattacaagtttctaagaagatggtgcaatggttagaaaaatctctcaagttattaaatgcatcataaactaatactgtatattactatacacaaaaatcaaagactcccttttttttaattgaatcaaacaaaatccgaaatttcgaaaggtccgacttttcctcacctgaacccgcgttttctctccccctcccaacccaactctccaattcgccggaaaatcaccgccaccgtcacttccggcgtccatatgaactaaagagataagcttttttcttctataatccttcttcttcttcttccttgatctcctttctctgagtttgctgagtttcttaactcagccatg

SEQ ID NO: 26804 - DNA, 3003 bp, Unknown; identical to SEQ ID NO: 26803
  misc_feature (1)..( 3003): 2750-1469P.txt file - cDNA_ID_2716178; gDNA_ID_2213665; Annot_ID_182057

SEQ ID NO: 26805 - DNA, 3003 bp, Unknown
  misc_feature (1)..( 3003): 2750-1469P.txt file - cDNA_ID_2716182; gDNA_ID_2213666; Annot_ID_132701
tggctttgtgttgtgctagatgcgatgcaatagcaatattttcctggagtttcaagtaactagtggcttaggttcataatagtgtttctttgtaggacgaaagctgtgttagtattctctccactgtaaaggacaagatgtctcagaagcgaaatcttccttcttggatgagttctagggatcccgagattactccgagtaagtctcattgtaagaagcctaaggatgaaggaccaaccgaagagcacaacagtagaaatgccccttccaacaagtcagaacacgccgagccaagttcaaataccactgaattctctaaacttatggtttgtgtgtgtcttcatggtcttgttgagactcaattatcttaagctgtcatgttagtttatatgcttttgtgattgagttgaaggttaaactatgcaggaaggcgttgtttttgtactttcgggctttgttaatcctgagaggagtacactgaggtcacaagccttgacaatgggagccacctatcaacctgactggaacgctggctctaccttgttgatttgtgcttttcctaacactccaaagttccgtcaagttgaaacaaatggtggaacaattatctcaaaggttacctctttgactcttcttataagggattgtgtgcggatttgaatttctcctttttgctgatattttatatgatttcactgtctccaggagtggataactgagtgttatgcgcagaagaagttggtagatatcgagcaataccttatgcatgctggaaaaccatggaggaaaagcagtagtccccaagatgctaatcgaggtaaaaagaattatattggaaaggctttagatagaatctccgttttaaccatcctgaggttcatcaaatcaccttgtttttacgtttatgacaagagaaaagcttttcttattgcactgcttcactccgatgtttagttgactctgtgaaccttaattgattgtattcagaaaagagagaacacctgtctaaaaaaccagagaagcaagtagagaaaaaaacagaaacaaggggaacaccatctacctcatccaaggcatgtttaaatctgatgatttggttaaccaaaacgaaccgtattttgctccaatcaatggtctatgactgtttatttccatatgttcacagaatagatcagcttgcaatcttgtgaaagagccattttttgttacagaggtgaagaaatgggccagggatgacctaagtcaaaccatctcatggcttgagagtcaggaggaaaaagtaagggaattaatatgctctttcaaaagacatgttttcttgattgtatgtttccgttattctaaagccattgtaacagccagaaccaggcgaaatcaagcgaatagctgcggaaggagtcttaacctgcttacaagacgccatagattctcttgaacagaagcaggttaatatctctgaagtctgaacaataatagttgccgcctgtgtacatttttggatttgttaaactttgatcagtttctttgagaagatcattggttgaatttattctcgaatgttcttaattttaggacattggatcagttacagagctatggagctttgtccctcgtgtagtgaaggagcttggaaagatggaatcgtcttctaaaaaggaaaattcaacagcatcaaaggaagaagtttgcaaacaagcaaagtcgtggaaaaagatctacgaagctgagctagcaaaaccgggcgaagatgaatcgacctctcgggttgcttgtggctatgacagtgatatgaccgttgagatgactgaagaagagatcgaacttgcttataggaacgtttctttagagtgtctttagatcaaacttgtttcattttgcatatgatctcttaaggaattccaagaattcttgttatactcggtttgttcggtttgagtaggatgttattactgataaaaatttgaaataatccggtctgcttggttcggaaagaatgtttctaattagaatttatttatgctggtttggattcgattgagagatgtaatcggttgcaattaataagtcggtttgatttgatactttttagtgtcgattgacgatgaatttgatcggttaatacaaatttgatttggtcaattaggttcagatgtctccagttttgaaccggtttggttctatccaatttaataaccgttttgtaatatcagacaaacgaattgaaaccggaaacatgtaccgatatggttaggatcgaagaagattgattgaagacaagaccctaatttatttatacccttattgggttttgtcttgtgagagttgtgcctttctttgtttcgcagtagggttgaagcggatagtacgccacctctatctctctctcaccctatcgaactcgcgaagaacatcttcttcttcttcttctccgtcttcgtcttcgcgagctctctcagtagcgcaataaaatgggggcttcgcttcctcctaaggaggccaacctcttcaagctcatcgtcgtatgttccgattccctctctttctttctcagtttttactttgtcttaaacatgcgatgtgatgttcctggtcagcagaaattggaatacgatgagttttatctgctctattaaaccctaaattaagttaatcgtcaatgtgttgggtcaatagaaaaattcgttgacatatgaagtaaactgtgcggagttgtggttccttaatgtgttaatttgatgtaccaagttcttagcttcagttacttttgactatcggctattattagacctcgattgcttctgggcttttttagtcgctcagggattcgtagtttactttgaagaacttgaaaaccaagctttatcaatatatatatggtttcagcatagattttgggtttaaccattatattgttcaacctgctttgaatagttgacctttttctttatgtaattttcgcaagtaagtacatcatatatagttattctgagtaatcttataatg

SEQ ID NO: 26806 - DNA, 3003 bp, Unknown
  misc_feature (1)..( 3003): 2750-1469P.txt file - cDNA_ID_2716186; gDNA_ID_2213666; Annot_ID_132700
gactagttctagtgtccgccatatgtataaagctgtaaacatctttaacgcatatatttggtttattaaaacaatagttttgtgattactatgacccattcatgtatttgcatataaatgtagtaacttggagttttggttaattagacaaaagatactccgatctaatattttttaaaataagctaattgaaacttcaacgtgggataaaacgggctgacaaaaaaaggttcaacatgaagaaaataactctaactgataaaacggcacggcgtctgaatgactataactctataaggtgacaaaacgacacggtgtcaacatccttaaaggggggaagaagagtcgtcgtgattcgtcgggtggctggctctttgataaatctaaacaataaacgacggaagcaatccgattcttcgtagataggaatagcccgaatagactggtactgggagtgttggacccacttcatcaatgttcgtgtcgatattttcaattctcatactcttctttggtcgcgttcaattattcaaatctcttaacaagtattttcttcacaagaaaattcgccaagcaaattggaaaaaaacgaagaacacacgaaataactagccaaaagagtttaattacttctttatatatgtgatcgttatttatttgcattttactcgtttttttttccaattatgtcgacacttgattaaattagaagcacaaagcctcgaagcaaaccggcaaagataataacatctgccagagctaagtaataaggtttacagttagatgatcgagagaatatgagctttggcaccgcagaaaacgctggccaattacataggaaaatgttcatttgaaaagatatatagctaaacagtatatatgtctcaaaagatagtttgactcgccgcatctttctattaggcactcgacgtcttcatcatatatgcattattattttgcatattaattaatggtagggatcaaattgttacgaagacatgcaatagatcatttggatattcatgcggtcgacatcaaataaaacagctctcgtacatacagacaggataagctcatgaagtttcctttggtatttatttttacgtccttttccatatccattatgatagttatccggtagctgatgtggacttcgtatcttctactgccagtaattgtatttctttttttataagtgcgcggaatatctattttcattcatcctcatcatcatatactaacatcaacttatctacctttttttttttaagggtttgctcgaggtttcatgtcattttttggaaataaattttgacaacatgatttaatgttgaatggtaatgaaataagaaaatcaagatgattcaatactcttcgatatatataaagtgagcgagagggaaagcacagagtatgataaatcaactgaatttagctaataaaacacatttttttatattgatagcgtcgaacagaccaacgacaacacaacggtcaaattaacatggcttaagtcaagcgaggacagaacgtgccaaagccattgaatatattgaatccttttataagcatatcttatttagtaaccacgtgagtcgtgacgatggcttattattagtacgtactacgtaactttgaagaaaagaagccctgaaatttcggaaatgggttcaaaagtccaaaaacagtttgcggttaaagaagggtacgttattttttttataacttttttttcattttttcatcaaagaaaggtacgttaaagacaaagtgaagacgtagtttaattttgacatgtttagactcattgatattcagaaacttagtcctggaattgtgttgtagcaaaaacaacaacacaacgagagaaagataagataaaagcatatatgatgggtttgtgttgcggatgttacgagaatatgagacatgacacatcatgacatcaatgatatggacaagcatacgatatatttcagaagaaataggatgtttcctccccttgcaagctttagcttctccagtgcattaagtctaattcatcgagctcattgtaggtatacgaaggatttgactgagctaacttaggaaaaaaagattgaaacgaggaatgatttagtaatggtaatttgaccttggttttgtacttcttttaattcataaaccccctccaccgtaaaaatgaaacattagaaatcctaaaagggcagacaagttgatgtccaaaaaaaaagaaaaaagggcagaagagtaaaaacgcgaatgaaagagtcaaagcaaaaaattggtaaaaaaaagcgtgaacggcaggattcgaacctgcgcgggcaaagcccacatgatttctagtcatgcccgataaccactccggcacgtccacctttgctagttgaatcatttgttaaattgaaaacccgtcattttgatctgattttgtactgtatgttgacaaattgaatagtctctgatgatttcgatcaaagagaagccacggggggagcgctagcacttaaaggttcctcgctttcttctcaagtttatagtcttctcctctgtgttggctcatttacatgggtagatttagttttcgagggttttatggcgaagttcgcgatgttctgttaattgcaatgtctttcttctttttttttttttttttttttttggtattcaattccaattttccagtgtgatttgatctgaactcgaattcaaattcagtgctactgagttatgttaaaaccattgtccattgatttttttatgttgaaattgaaaaaaggttataccattcgtttgtattaagatttgtctttcttagggaatgttttacattttttgcagatttgcaccgttttctctctggctttgtgttgtgctagatgcgatgcaatagcaatattttcctggagtttcaagtaactagtggcttaggttcataatagtgtttctttgtaggacgaaagctgtgttagtattctctccactgtaaaggacaagatg

SEQ ID NO: 26807 - DNA, 3000 bp, Unknown
  misc_feature (1)..( 3000): 2750-1469P.txt file - cDNA_ID_2716202; gDNA_ID_2213666; Annot_ID_132696
tttgccctgttctttttgttatcgctgcgtcagcggttggcgaccggaaattatagcttatttgcatgtaatctgtatggaaactaacataatcgttcttgtgaaaagagccgcagtgtctataaaaatggtcgccgttttttttagcgatgccgacgacaccggtatcccctgtaaaagtggccgcagcgacacccttattcttttttttctgtttcttttgctgttgttgacgtttaaatttcaatcgcagatccctgacgcagcgttaacgtgccgaacatggccattgattcaaatacatccaccatataacccattccaaaataaaacctgttcaataatctctttacccgtcccgtgatttttttttaaagtagtaatttttaaaatttaagaattattttttatatataaaagttttgcaaattgtatcattctctaatacatttatattttatagtttaattttatatatagtaacattatacataccacataacattttcggttttatataattttttctaaattaggatgatttgatatgtttaatattagtggtcttaaaaaataataaattaaagatttaacccgtattgaaacggtggattaattatattttactttttttattaatgttgattcaaaaacccgtcactccaaatccgtcttgccaaaaagccatttattttattaacattaattttattaatgatatgactctgaattataatctaaacattttagctaataacataggagtacaccatatttatttaataggggaatgtaccatatgacccgaatgcacttttacccaaatccaccaaaaaagtcttgcaaaaatactatagagataagaaacgatagtcggttttgataggtataagattagcaaatatattagttagcttaaattagttaaaaaatacaaattgaaaaggtatattacactttattcgaatatagtatcaaaacttatataatacagagatttgataaatttttaatcgttgaatacttttttgtgctaattttatgtgattaaaatttaattgattttgtatataaaatattaaattgttttacgaacttatttgtttataatttggtaacagatagatatttgagtattcagtatattttgcttcagtttaggaaatctttgatgacccgtctttagatccaataagccctataatctagatattaacttgcagtatatcgatggtaggtttatattttagttaaactaaaaacttttattgtaaagatgatttaaaaatatatgatattattttatttgattttaaatgtatagtaaattgtgagttgtatatgttttattgatattatctatattgtttaatgtttaagattatatatttgtagtttgattgttaatttaagagtttcacctgtagtataccatcttgtattaatatcgatctaaacttgtcaattctaagattttccagcttgtattaaaaattgaatcacatcatacacataaaaaaatctaatatgttattaattattatagtatataagattttaaattttcaatataatatgtatgaaattgaatataaatcttttaaattatgacccgttactcagtagaaagttttcttaaatctattttttactcgttataatattttttcatgtattgaacagtttatattcgtttttaaaattcaaattatggcatatgcaaaaaaactttaattatttttttataatgatgatattatttttcgcaaaaatcgaattatataaagatgagaagtgaactataataattaataaaaaattaatatgataatttagatatcaaatctaatttgttgattttaataggttacttttttggaaattaataatgtatttcgtttttctaattaaattaaattaattaaaatttagatatcaaatcttatatgttgattttcattggttattatttttgaaaattaataatgtattttgttttttaatttaatttaattaattaaattagtatttgactttttaatctttaaagagataaattaatttactttttaaaattttatttctaatagcatatctatgtaattacttataaaaattaaggttatatttaaaatgtacttcctaaatgatttgattagtcggctgcatgtgtctatacaagtccatggactcttaacgggcctattactagtttgtcaatctagttgtttattgggcctattaatgagttaccaagtaacattagtttccatctattgttaattttatcatttagctttgtttacgataattttgtttatgaaaagtcgtttttttatttttaaattactcatttttatttttctattatcgtatagatatgaacagaaatattaatacgcattttttaaaatatttttttctagtatatattcataaaattgaaattctgttaggcgttaattattgaatgagaaatttaaaatgaagaacaacagttagcaaaagtaatcattattttctacgtgtggtcttttcagattgccgtaaattaaccattttatcattattgtaattatcattaaatataataaatccaccattaataaaggccaagcgaaaaaaaagggtcagttattaaaattaaccaaggggcgtgactctttgattttgaatatatataccataaaaattgtcaaagagaagtcagatagcgagcgagaaaaccttcgtgctctttcttcgccgccaagttatatcgacggtgttttcgtatcgacgtcttctcctctctctctctctcgccgtcatcacctctttgaatgaacggcggacgcgggaaaaggcctaactcagtaagttatttcagtacccttatacaataaatatcatttgtttgtttctagacacctctagaatttgttggcttacttgtggtgacagagtcgtgagagtatactctgatttttgatggtttaggcagaggaggaaggaaccatg

SEQ ID NO: 26808 - DNA, 3000 bp, Unknown
  misc_feature (1)..( 3000): 2750-1469P.txt file - cDNA_ID_2716202; gDNA_ID_2213666; Annot_ID_182113
atccgtcttgccaaaaagccatttattttattaacattaattttattaatgatatgactctgaattataatctaaacattttagctaataacataggagtacaccatatttatttaataggggaatgtaccatatgacccgaatgcacttttacccaaatccaccaaaaaagtcttgcaaaaatactatagagataagaaacgatagtcggttttgataggtataagattagcaaatatattagttagcttaaattagttaaaaaatacaaattgaaaaggtatattacactttattcgaatatagtatcaaaacttatataatacagagatttgataaatttttaatcgttgaatacttttttgtgctaattttatgtgattaaaatttaattgattttgtatataaaatattaaattgttttacgaacttatttgtttataatttggtaacagatagatatttgagtattcagtatattttgcttcagtttaggaaatctttgatgacccgtctttagatccaataagccctataatctagatattaacttgcagtatatcgatggtaggtttatattttagttaaactaaaaacttttattgtaaagatgatttaaaaatatatgatattattttatttgattttaaatgtatagtaaattgtgagttgtatatgttttattgatattatctatattgtttaatgtttaagattatatatttgtagtttgattgttaatttaagagtttcacctgtagtataccatcttgtattaatatcgatctaaacttgtcaattctaagattttccagcttgtattaaaaattgaatcacatcatacacataaaaaaatctaatatgttattaattattatagtatataagattttaaattttcaatataatatgtatgaaattgaatataaatcttttaaattatgacccgttactcagtagaaagttttcttaaatctattttttactcgttataatattttttcatgtattgaacagtttatattcgtttttaaaattcaaattatggcatatgcaaaaaaactttaattatttttttataatgatgatattatttttcgcaaaaatcgaattatataaagatgagaagtgaactataataattaataaaaaattaatatgataatttagatatcaaatctaatttgttgattttaataggttacttttttggaaattaataatgtatttcgtttttctaattaaattaaattaattaaaatttagatatcaaatcttatatgttgattttcattggttattatttttgaaaattaataatgtattttgttttttaatttaatttaattaattaaattagtatttgactttttaatctttaaagagataaattaatttactttttaaaattttatttctaatagcatatctatgtaattacttataaaaattaaggttatatttaaaatgtacttcctaaatgatttgattagtcggctgcatgtgtctatacaagtccatggactcttaacgggcctattactagtttgtcaatctagttgtttattgggcctattaatgagttaccaagtaacattagtttccatctattgttaattttatcatttagctttgtttacgataattttgtttatgaaaagtcgtttttttatttttaaattactcatttttatttttctattatcgtatagatatgaacagaaatattaatacgcattttttaaaatatttttttctagtatatattcataaaattgaaattctgttaggcgttaattattgaatgagaaatttaaaatgaagaacaacagttagcaaaagtaatcattattttctacgtgtggtcttttcagattgccgtaaattaaccattttatcattattgtaattatcattaaatataataaatccaccattaataaaggccaagcgaaaaaaaagggtcagttattaaaattaaccaaggggcgtgactctttgattttgaatatatataccataaaaattgtcaaagagaagtcagatagcgagcgagaaaaccttcgtgctctttcttcgccgccaagttatatcgacggtgttttcgtatcgacgtcttctcctctctctctctctcgccgtcatcacctctttgaatgaacggcggacgcgggaaaaggcctaactcagtaagttatttcagtacccttatacaataaatatcatttgtttgtttctagacacctctagaatttgttggcttacttgtggtgacagagtcgtgagagtatactctgatttttgatggtttaggcagaggaggaaggaaccatggctgaaccctctgtaaagaagagcaagttgacggaatccgattggataagtggtttagcagatgatttgctacttcagatcctctcgaaagtccctacgagggaatccgttttcacaagccgtatgtcaaagcgatggagaaatctctggagacacgttcctgccttggacttggactccagtaaattccctcatgagtcggacttggaagatttctttgatagctttctgcagtttgatggtaatcttaagatagagagattcaagtggatttacaacgttgaagagcattgtgaccctgaatttgtgtctcggatcgatcatgtggtgaaacgtggacttaaagatctaactattctcagcaaggttaatattgaggatgactcagttcggatgcctgtctcgctctactcatgtgcgactctggtgaatttaactctctatagtgtagtcttcgatgctcctcgagcacaattggtttctttaccttgcctcaagactatgcatctcgaggcggtcaagtttgacggagagaccattcttgggactctcatatcaagctgctcttttctcgacgaattaaccataatcacgcatgatcatgatgaactcggagatgtatctgtgcgctctccgtcactaaggcgcttcaaacttgagtctatg

SEQ ID NO: 26809 - DNA, 3003 bp, Unknown
  misc_feature (1)..( 3003): 2750-1469P.txt file - cDNA_ID_2716202; gDNA_ID_2213669; Annot_ID_182231
caaatccgtcttgccaaaaagccatttattttattaacattaattttattaatgatatgactctgaattataatctaaacattttagctaataacataggagtacaccatatttatttaataggggaatgtaccatatgacccgaatgcacttttacccaaatccaccaaaaaagtcttgcaaaaatactatagagataagaaacgatagtcggttttgataggtataagattagcaaatatattagttagcttaaattagttaaaaaatacaaattgaaaaggtatattacactttattcgaatatagtatcaaaacttatataatacagagatttgataaatttttaatcgttgaatacttttttgtgctaattttatgtgattaaaatttaattgattttgtatataaaatattaaattgttttacgaacttatttgtttataatttggtaacagatagatatttgagtattcagtatattttgcttcagtttaggaaatctttgatgacccgtctttagatccaataagccctataatctagatattaacttgcagtatatcgatggtaggtttatattttagttaaactaaaaacttttattgtaaagatgatttaaaaatatatgatattattttatttgattttaaatgtatagtaaattgtgagttgtatatgttttattgatattatctatattgtttaatgtttaagattatatatttgtagtttgattgttaatttaagagtttcacctgtagtataccatcttgtattaatatcgatctaaacttgtcaattctaagattttccagcttgtattaaaaattgaatcacatcatacacataaaaaaatctaatatgttattaattattatagtatataagattttaaattttcaatataatatgtatgaaattgaatataaatcttttaaattatgacccgttactcagtagaaagttttcttaaatctattttttactcgttataatattttttcatgtattgaacagtttatattcgtttttaaaattcaaattatggcatatgcaaaaaaactttaattatttttttataatgatgatattatttttcgcaaaaatcgaattatataaagatgagaagtgaactataataattaataaaaaattaatatgataatttagatatcaaatctaatttgttgattttaataggttacttttttggaaattaataatgtatttcgtttttctaattaaattaaattaattaaaatttagatatcaaatcttatatgttgattttcattggttattatttttgaaaattaataatgtattttgttttttaatttaatttaattaattaaattagtatttgactttttaatctttaaagagataaattaatttactttttaaaattttatttctaatagcatatctatgtaattacttataaaaattaaggttatatttaaaatgtacttcctaaatgatttgattagtcggctgcatgtgtctatacaagtccatggactcttaacgggcctattactagtttgtcaatctagttgtttattgggcctattaatgagttaccaagtaacattagtttccatctattgttaattttatcatttagctttgtttacgataattttgtttatgaaaagtcgtttttttatttttaaattactcatttttatttttctattatcgtatagatatgaacagaaatattaatacgcattttttaaaatatttttttctagtatatattcataaaattgaaattctgttaggcgttaattattgaatgagaaatttaaaatgaagaacaacagttagcaaaagtaatcattattttctacgtgtggtcttttcagattgccgtaaattaaccattttatcattattgtaattatcattaaatataataaatccaccattaataaaggccaagcgaaaaaaaagggtcagttattaaaattaaccaaggggcgtgactctttgattttgaatatatataccataaaaattgtcaaagagaagtcagatagcgagcgagaaaaccttcgtgctctttcttcgccgccaagttatatcgacggtgttttcgtatcgacgtcttctcctctctctctctctcgccgtcatcacctctttgaatgaacggcggacgcgggaaaaggcctaactcagtaagttatttcagtacccttatacaataaatatcatttgtttgtttctagacacctctagaatttgttggcttacttgtggtgacagagtcgtgagagtatactctgatttttgatggtttaggcagaggaggaaggaaccatggctgaaccctctgtaaagaagagcaagttgacggaatccgattggataagtggtttagcagatgatttgctacttcagatcctctcgaaagtccctacgagggaatccgttttcacaagccgtatgtcaaagcgatggagaaatctctggagacacgttcctgccttggacttggactccagtaaattccctcatgagtcggacttggaagatttctttgatagctttctgcagtttgatggtaatcttaagatagagagattcaagtggatttacaacgttgaagagcattgtgaccctgaatttgtgtctcggatcgatcatgtggtgaaacgtggacttaaagatctaactattctcagcaaggttaatattgaggatgactcagttcggatgcctgtctcgctctactcatgtgcgactctggtgaatttaactctctatagtgtagtcttcgatgctcctcgagcacaattggtttctttaccttgcctcaagactatgcatctcgaggcggtcaagtttgacggagagaccattcttgggactctcatatcaagctgctcttttctcgacgaattaaccataatcacgcatgatcatgatgaactcggagatgtatctgtgcgctctccgtcactaaggcgcttcaaacttgagtctatg

SEQ ID NO: 26810 - DNA, 3003 bp, Unknown
  misc_feature (1)..( 3003): 2750-1469P.txt file - cDNA_ID_2716206; gDNA_ID_2213666; Annot_ID_132695
tcgtcatgaagtgataataaatttaaaatctattttttattatattcacatggataggctattttcttgtgggacgagtaaagatggggaatcgttcatagttgagtggaatgaaagcgaaggagctgtgaagagaacttatcaaggattccacaagcgttcccttggtgttgtccagtttgatactactaaaaaccgttatctcgctgcgggtgacgacttctccattaagttctgggatatggacaccatacagcttttgactgccattgatgctgatggaggtctccaggtatgcaaacaaatacctcgattctccctgggaaccgaatgttttcatttgcagccatcatggctctctatgttttgtaggcaagtccacggatcagatttaacaaggaaggctctctcttggctgtttccgcaaatgacaatatgattaaggttatggcaaactcagatggtctaaggctattgcacacagtcgagaacttatcttctgaatcctccaaggtactgaattttgtgctcactggatcttcaacaagcaaattactaacccccaatttgaaatttcttcaacactttatttttcatgtacatttgcagcctgcaatcaacagcattccgatggtagagagacctgcctctgtcgtttccatccctggaatggtacgaaaatcgatactttttccgtcagtttctctatctcttggtctgggtccaatcatcgttgttgatcacttacctttccaacagaatggagattcgcggaatatggtggatgtgaagccagtgattaccgaagaatcaaatgataagtctaaggtatggaagcttactgaagtcggcgaaccctctcagtgccgttcattgagactccctgagaatatgagagtcaccaaggtactaacacatagactgacataactgtacttatatggcttgattctaatgactcaaaacttgagcagatatcgagattgattttcacaaattcgggaaatgcaattttggcattggcatcaaatgctattcatctgctatggaagtggcagcgaaatgaccgtaatgcaactgggaaggtacttatggtctaaaatcttcctttaagatcgccaaaagagttgaaatcatgatgaaattcaatttgagattttgtgtaggcaacggcttctttacctcctcagcagtggcaaccagcgagcgggatcttaatgacaaacgatgtggctgaaactaatccagaagaagccgtaccctgttttgctttatcgaaaaatgattcctacgtgatgtcagcatcgggaggaaagatctctttgtttaatatgatgacgtttaaggtaaaatcccagctacagacagcactatgtctaatgtatgcaaacaatgcttcatctgttacatttaattgtgttgttggctaagcgcagacaatggctactttcatgccgcctcctcctgccgcaacgtttcttgcttttcaccctcaagataacaatatcattgcgatcgggatggatgacagtacaatacagatttacaatgttcgtgttgatgaggttaagagcaagcttaaaggacattctaagagaataaccggcctcgctttctccaatgtattaaacgttctggtttcgtctggagcagacgctcaggtgctgattcatctcatgttttgtaataaagaatccaaatccttagaagtcttagtgtgaatcttttggtttttgtatgcagctttgcgtatggaacacggatggatgggagaagcagaaaagcaaggttctgcaaattccacagggaagatccacgtcttctttgtcagacacgcgtgttcagtttcatcaagatcaagtacacttccttgtggtccatgaaactcagctcgctatatacgaaacaaccaagcttgaatgcatgaaacaggttttagtctttatatatgttcattctctctccttgcatctgagtaacccttatagaagaaagaaatgtctttattttgattccagtggcctgtgcgtgaatcagcagctccaataacacatgccacattctcatgtgatagccaattgatatacacaagtttcatggacgctacaatatgcgtcttcagctctgcaaaccttcgattgcgttgcagagtcaatccctctgcatatttgccagcttctctcaggtgagttaatgaaatgaatataaactagtgcaatgttggatcatgaatcttgagtcttcatgttgatgttttgtgcagcaactcgaatgtccatccactggtgatagcggctcatccgcaagaatccaacatgtttgcagtgggtctgtcagacggaggggtccatatattcgagccgcttgagtcagaaggtaaatggggagtagctccaccgcctgaaaatggctcagccagcgctgtcacggctacaccttccgttggagcttctgcctctgaccagcctcagagatgatctgcttcagtttcttactctgttttttttgtgggggttttagatcttttccgatttattattgttttgtttgtgtggggggaagaaagcattctaacaaggtaaatgaattaatagcttacaagttcttcttaattggttaattcgatgttgcttgcctctgatattttggtcttgagaaatatcagttttgcaaaaggacgaatttgcaattttgcactccgaatctaagcacgaactaaggattgaatgccacgtgcagcttcgagataggtttggatattcgttttgagatacgaaggaagaattactaaggcctatgcggcccacggcccacagacttatatatctacaatgataaatatcttcaaaaatagtaattttgagaaaatattgagaagagacagagaaaaaaaatcgagtgaaaattatctggtgtgtgtatctagaagaagctacagagtgggacgaggtttaaactcgccaatcgccattgacctctcgcttgctttctttaactaaaatg

SEQ ID NO: 26811 - DNA, 3003 bp, Unknown; identical to SEQ ID NO: 26810
  misc_feature (1)..( 3003): 2750-1469P.txt file - cDNA_ID_2716206; gDNA_ID_2213666; Annot_ID_182112

SEQ ID NO: 26812 - DNA, 3000 bp, Unknown; identical to SEQ ID NO: 10713
  misc_feature (1)..( 3000): 2750-1469P.txt file - cDNA_ID_2716206; gDNA_ID_2213669; Annot_ID_182232

SEQ ID NO: 26813 - DNA, 3003 bp, Unknown
  misc_feature (1)..( 3003): 2750-1469P.txt file - cDNA_ID_2716210; gDNA_ID_2213666; Annot_ID_132694
acaattattagaaaaatcaatgccttctttggaaaaaaaaaatcggtatgtggctctattaattgaaaacatattttatatttgactttgttttttttattgaaagtgatttgatagcatcgttgaatgatttagtaatatctcccgtaagaatttaattatcccgttagactttttaacagaccagccagatgggaccaacgtgcactgttttttggccggagaatgtataaaaaatattgaagatgcagtgaacactgaccaccattcacttctccacaacttttaatgaccggtttacaaaataaaacatagtactatataattttcaacgtgttagtctgatttttatatttctaaagagaagtactcatctatttttgagctattaatctattacaatttgtgttctgatctggagagtggagagttatttcaaagtaaagtatgtagattgtagaggatctatcgagaatctactcatttaaaatagtttgacgttgtagcaaacaatttttttgtcattgatgatttgtattgtttgtaaatattatttagaaaccaaatcgaatttttagttgaaaattataatctgtttaataagtgataattacatcatgcacatgtacctagtgactcataatgaaacgtatcataatggattgacgagtagttgtctgatattgacatcttaatttataacttcccttttcattgttaatgttccttactgtcttctgattgataataaagacgttgacatgtcaaaccacataattatttgaaaaatatatattatttcttcagattttcatcatttgttataagtctcgataagacagtttttgtttttttaacaattttttacaaaaaacttacgaccataatttagttcaggcgaaaatcagtgaatcattaatcatatttattagtttggatttttatgtgtttttctttttatgtatttgaggatttttcagtttgtgaaaacaaatctaatatgcttatttgatttcttctttatttgctgtattcttaatatatcttgcagagctaaggtaatactcaaattttttttttccacacgtaaaaactcatatttatcagtttggaattactgtattctttttagtagtcctctcactcgccatggcaagaagaaggtttttttttcctttttcttgcattccatgttaatcagtatttgaataaaaaagcaagctaaatcggcaaatgaacttatatccaaataatcaagatatcaatctgtgtaagcattactagaaaagtagagatactcgtgttaccgtgtaaattaaaagaataaaaatgtgcttttcaaaagttatatacttttcttgtgcacccataactttagcaaaagcaaccatcatcattcttgagcaattaaaacaaataatattgatcttcatttggtgccaaaatactttacggtaatgacgtcaaactcgatgtttcttgtcaaagtctgaaagaccaatataaaataacactagacacattataaaattaacatattggttcattgtaattaaaccgtcgaatatatataacgaaaataccaattacgctgtgaataaacaaacaaaatcattttattagtcatcgagtaaataaattcgattataatcctcaatagtcaatatatatatagctcacatcacattatgcgattaacaaaaacaatccaaaacagttaaatgattagaaattaaacgagtctcactaaattattaacgactccaaatcacgagaaggcttaagagttatcatgtcgggagaatttaactgataacctcttccattatctctcaatcacgtgatttttgttcaacgagtaccgcatctcaagaataaaaatggcaatttaggtaaatatttgtcattttcaagggcaatggaacttaaagatgcatttcagaaggaaaagctttgtcgtgttatgagggaaatgtggggacgcagctacttcgctttcaaaccgttggatgaatatcctttaaggttcatcgtacaagatcgacggcactcaccgagggtgtactcatgttgtgacacagaggatcatgtctacttggagtacagctagcagctagagattctgagccgataacgtcgagaattgtagccggctaagtcgtatatgctggtttaaactttaatctgtacttatatataagtcaacgtgcttatcaaaatcagctcccttatcgtgtgataggtgcattgtcttattagactccgttatccgtcaccttcgcatattaaaatcactttttattttttggttttaaattaaagtctccatttctgcaagattttaatgttcgtataaataagcctgaagagagagagagagagagagagaaaacttgttttttttttttccattagtttttttcttactttctggtcgagagaggagagtccaaaaaacccaaatccttggcctctttcaatatcaggagagagaaactgaagctctggcctttgtttctgaaatcgatcgtcttcttcttcttcatggcaagtaacgtatctaggtctttcatttttggtttaatatctaaatcgtagcttttctgggtttttgatttttgtttttgtctcatggaagtgaaaaagatggccattttaagctttatatttaattcggtggacaataataatactaggaagacctaatttttgtgtagcccaattaaacactaattaaatccgccggaatagagacttttggagaattttccggaggatagttgtaaagatctagttatatactgtgtaattaagaggctgtgtctattttcattttttaaaaataataattaaatggaggaatatctgaaacccagtaaattgggatgatttgatggttttgtaaggttatcatcgtcgccattatattgatatgcagatctggtgggtttttctgcatctgacttgatagctttatcggactgagtggcaaaatcaatcatg

SEQ ID NO: 26814 - DNA, 3003 bp, Unknown
  misc_feature (1)..( 3003): 2750-1469P.txt file - cDNA_ID_2716224; gDNA_ID_2213666; Annot_ID_132690
attactaatttgtgacgcgatgtcgtttatcttcaggattgggtctgcaatgctgtacacggggcaaaacgagttctacggtagcgtggagaggacgtttatgtacattgtgaaacaagcaactggagttttgactaagctaacgagcttatgggactcgattcaatctgctaaagacattcagctcgatggacacaacctgtttcctcccgagtttagaggcaacatcgatcatttcaacaacatgatcaagatgtctaacatcacttaccccgaccgtgtcgctaaccagacaatccgttatctcaccggagcactaaaccctgtgtaagtaataagtattcgcttgatatgtttcttgcctcacaagctaaatatatatagaagctctgtttgagtatttgactcaaatgcgttttcctcaggagatatgtgttaaatgtgatcgctggtgtaatgctcgcagtcgcattcctcggcctttgtaagtcacaaatcaaaacatatctattttgatctgaagatacagaataatctcattatttttgtttctgtttttcttcttctttcgaaacagtgttttcgttctgtggattgcgagttcttgtctacctgtgagttacacttagactacgttgttatattatcatatcatatccaaatcaaatgtttataatcagtgtttcaattatatcagattggtaattcttggttggattctcgtcacagccactatcctcctcagcgccgttttccttgtattccacaagtaaatgatatttcgtcgtcacttgatctaattcaagattcaatttgtttttatcaaactaatgatgttacttaataaacagtgtggttgcggacacgtgtatggctatggaccaatgggtgcatgacccagcggcagactcagcattgagtcaacttcttccgtgtttagatcctaaaaccattggagagacattggatataacgaagacgatgactgcgacggccgttgacatgaccaatgcgtacacggtcaatgtcagtaaccatgatcagttcccacctaatgcccctttctaccacaaccagtctggtccgctcgttcctcttctctgtaacccactcgaccaaaatcacaaaccgcggccttgtgctcccgacgaagtcctcttagccaatgcttctcaggtacatacattttctcataagtgatacatatgtcaaatgttaatgttaattcaatttgtatatgtttttgtaattaggtttataaaggctatatttgccaagtgaacgcagaaggaatctgcacaacgcaggggaggttaacacaaggttcgtacgaccagatgatgggtgcgatcaacgtggcgttcacgttggaccattatggtcccttcttagctagtattgcggactgtacattcgttagagacaccttcagagacataaccaccaagaactgccctggacttagcattacaagtcagtggatctacgcaggactcgcgtcgctctctggtgcagtcatgttctcactcatcttctggttgattttcgtcagggaaagacgtcaccgatctcaaaccaaaaagtctatgatccagatgaatagattttaattagtggagccagcccattatggactcggcccatattatcacccctttttttttttttttggaaacgttaatgatatatggttttaaaaataaagtcgtacgtgcaaaggaattcgtcaatttttttttatttgttgttttttttgtgcaaacgctcttttattgttttactcggtttattaacttttagaaagtggatagtctgtaaatcaacaacttatttagactattaacttcactagatagctataatagtattgatgtttttttcctggtctaaaaatataaattataaacttttcttttagataatattctacttgtataattatttactaatttcattctatgagaataagaggtgagaaaaaatgttgaacattctaagatacatgacatgagtaggtttttcaataaagcaaagccattgaatttgtcaacgaacgtcgccgttggacccccaaactaaatgtacttagtaattgcgacgactagttggggctagctaggcaccatacctaattgctatttgtgaaattctgacgtgtcggattgctatttgtgcctcgaggccggtgcagaaccaggtgtcctgccgtttcaacttgcaaattattgttttttttccgtcctcagtaggtaagatttttgagtattttagttaaggtccatatgtagcagtcaaaacaaaacaaacaaaaagttaggccccctctttaatttatttttatgcaacgataatcctgtaattgtcggtttttgactctataatgttttttaaatatgccatgggaacgttaagatctatgccaataccaaagtgatgtatcgggcggtccacgcgggacgaagtcacagtcaaatgacctcacgtgtttcaagcacaaaaatcttaacaagacaacaatttcctctcttacatatttgtaccataaaataaattttcaaattaagccaaaaaaataacggaaagtgtttgattggttagtgcttcttataactgtcgaatttcagacaaaaaataaaatagaataggaacaaaaataaaaaacgtaggatttttgtcattagttgtgaataatactaagaatctaactgagacccacttgcaattcttcaagaatttaatatgattagtttcaaaagtaatgctaaacctcttgcgaatcacgctttttatcctcttgagtttttttttaaaaaatagtatgaaactactataacgtatgctttaaatatgttaaaaaatatgacgtcattttgaagatgtttaatgctttaaatagaaacacaccaaacaataaagtgagagtgagtgagtctgattcatctcctctgtttaagcaaagcacttttctaaaatcccacaggagaagagagatcggaagagatg

SEQ ID NO: 26815 - DNA, 3003 bp, Unknown; identical to SEQ ID NO: 26814
  misc_feature (1)..( 3003): 2750-1469P.txt file - cDNA_ID_2716224; gDNA_ID_2213666; Annot_ID_182107

SEQ ID NO: 26816 - DNA, 3000 bp, Unknown; identical to SEQ ID NO: 10711
  misc_feature (1)..( 3000): 2750-1469P.txt file - cDNA_ID_2716224; gDNA_ID_2213669; Annot_ID_182237

SEQ ID NO: 26817 - DNA, 3003 bp, Unknown
  misc_feature (1)..( 3003): 2750-1469P.txt file - cDNA_ID_2716228; gDNA_ID_2213666; Annot_ID_132689
aaaatcaaattaaattaggcaacaggatgagaaagaaggaaccttcaagagacccagctaaacaaagaacgtcaacagcgactgggatcacttcgttaccgacgccatcgccgggaagaaccgcgatggtgtaccgtttctttggagtgttggcggcacatctgatcacagaagctctcctaaagctctgtttggttgcggacataaacgcaaccggaatctgggtactgctgacgtggatgactcccgccatttactacaacaaagactacaaggagacctggaaagaacttttgtgtttataatcaaaccaatattaaccgttcgattatttattttcacctctggatggctcaattatgatgggcctaagaaagattcgtagaagatagatcggcccaaatgttccaaatattaacacaagtccagcgggctttgggcccataaatggtattcgggtcagattttaaaatgggtattcgggtcaaaattcgcccgttagatgatgaaccctaatttcgtgtgtacagggagcggagaggggaaacaagagaatgctcttgttgcggcgactcaatcgagttcggattgcttccccttactccgttcggcttctgtcagtaaaacctatttcaaatgtcgatgatgcgaagtttcgatctcaggaagaagaagatcagtccagttacgatcagaaaacagtatgcgaagctctcacatgttacagcaacgattggcaaaaggcgttggagtttttcaactgggtcgagagagaatccggattcagacataccaccgagacattcaatcgggtgatcgatattctgggtaagtatttcgagtttgaaatttcttgggctttgattaaccgcatgatcggaaacacggaatctgtgccgaatcacgtcacgtttcgtatagtctttaagcgttatgtgacggctcatcttgttcaggaggctattgatgcgtatgataaattggatgatttcaatttgagagatgaaacatcattttataatctggtcgatgcgctttgcgagcataaacatgtggttgaagctgaagagctttgttttgggaagaatgtcattggtaatggttttagtgtgagtaatactaagattcataatctgattcttcgtgggtggtcgaaattgggatggtggggtaaatgcaaggagtattggaagaagatggatactgaaggtgttactaaggatcttttttcgtattccatttacatggatatcatgtgcaagagcgggaaaccgtggaaagctgtgaagttgtataaggaaatgaagagtagaaggatgaaactcgatgtggttgcttataacactgtgattcgagccattggagcgtcgcaaggtgttgaattcggtatcagggtatttcgggagatgagggaaagaggttgtgaacctaatgttgcgactcataacacaatcattaagcttctatgtgaagacgggaggatgagagacgcgtatcggatgcttgatgagatgcctaagagaggttgtcaacccgattcgattacttacatgtgtctcttttcccgtttggagaaaccgagtgagatcctaagtctgtttggtaggatgataaggagtggagtgaggccaaagatggatacttatgtgatgctaatgaggaagtttgagagatggggatttcttcagccggtattatatgtgtggaagacaatgaaagagtctggggatactcctgattcagcggcgtataatgctgtgattgatgcgttgattcagaaaggaatgttggatatggctagggaatatgaggaggaaatgatcgaaagagggctatctccaaggagaaggcctgagttggtagaaaagtccttggacgaaacgcttgtctgtagagaatagataactagatatgaagaaactctttggttatgtgttcaaaacagacatgaagcaatagagaagcgtccttttggatggagaaatctccccaaggtatatcatctttgccataaagtggctttgtttcaactcaaaaccgaggagaaaacactgaggttcattgagaaatctggttgagttgtgtgtcttaagccaaattccgaagatttggttttgaaagatggtttgtcgcctcctatatgtgttctactacatatacgtaccatttgtaattcactctctaacttaatttttttttgttgttgttccactctgtgacaaccacaggcattttgtggctattttgtaagatcgttaagctcaataaaacaccctacagaaacgatggatgatccatcatggatcacattcttaaaaccattggagaatatggcgttattattgtaatttgaaaaaaattcaactaaagaatacgacttttaatcttagcttacttttgtaaagattatgcagacatgacgtaacaattttctaaaaaaaatcttagttacaacatttttctttagaaaatgccatgacagagcaaaagcaggaaaagttggtaccagatgatcataaatgcaattttccgttacaaaattagagtagctctcatgtcagtattggtggtaattaatgccattctccgtttctttttctaatctccgagtcgaccctgagtataaagtatttttaccaatttcatttcaattttattgtataatcggttttatagaaaaaaatgtgattcattaatttaagttttaggtcacacagccaataagagttaaaagagtaattaattaaggattttaaaaactaagaaaatgaggtgaaaacttaaaacaaaacagaataacaacaatggatggtgaaaatctaaataaagggaacagtttcgtttcatcttctttgtccttgatttcctgaagaagtaaaagattcttattcatacgtttgattgataaacccttttttagagtttcagaaattagaaaccaaacctcccccaaaaaaacaaaaaaagagagagaattagacaagaaaaatagggagaataatg

SEQ ID NO: 26818 - DNA, 3000 bp, Unknown; identical to SEQ ID NO: 10636
  misc_feature (1)..( 3000): 2750-1469P.txt file - cDNA_ID_2716236; gDNA_ID_2213666; Annot_ID_132687

SEQ ID NO: 26819 - DNA, 3000 bp, Unknown; identical to SEQ ID NO: 10636
  misc_feature (1)..( 3000): 2750-1469P.txt file - cDNA_ID_2716236; gDNA_ID_2213666; Annot_ID_182103

SEQ ID NO: 26820 - DNA, 3003 bp, Unknown
  misc_feature (1)..( 3003): 2750-1469P.txt file - cDNA_ID_2716236; gDNA_ID_2213669; Annot_ID_182241
gttacgtcatgtctgcataatctttacaaaagtaagctaagattaaaagtcgtattctttagttgaatttttttcaaattacaataataacgccatattctccaatggttttaagaatgtgatccatgatggatcatccatcgtttctgtagggtgttttattgagcttaacgatcttacaaaatagccacaaaatgcctgtggttgtcacagagtggaacaacaacaaaaaaaaattaagttagagagtgaattacaaatggtacgtatatgtagtagaacacatataggaggcgacaaaccatctttcaaaaccaaatcttcggaatttggcttaagacacacaactcaaccagatttctcaatgaacctcagtgttttctcctcggttttgagttgaaacaaagccactttatggcaaagatgatataccttggggagatttctccatccaaaaggacgcttctctattgcttcatgtctgttttgaacacataaccaaagagtttcttcatatctagttatctattctctacagacaagcgtttcgtccaaggacttttctaccaactcaggccttctccttggagatagccctctttcgatcatttcctcctcatattccctagccatatccaacattcctttctgaatcaacgcatcaatcacagcattatacgccgctgaatcaggagtatccccagactctttcattgtcttccacacatataataccggctgaagaaatccccatctctcaaacttcctcattagcatcacataagtatccatctttggcctcactccactccttatcatcctaccaaacagacttaggatctcactcggtttctccaaacgggaaaagagacacatgtaagtaatcgaatcgggttgacaacctctcttaggcatctcatcaagcatccgatacgcgtctctcatcctcccgtcttcacatagaagcttaatgattgtgttatgagtcgcaacattaggttcacaacctctttccctcatctcccgaaataccctgataccgaattcaacaccttgcgacgctccaatggctcgaatcacagtgttataagcaaccacatcgagtttcatccttctactcttcatttccttatacaacttcacagctttccacggtttcccgctcttgcacatgatatccatgtaaatggaatacgaaaaaagatccttagtaacaccttcagtatccatcttcttccaatactccttgcatttaccccaccatcccaatttcgaccacccacgaagaatcagattatgaatcttagtattactcacactaaaaccattaccaatgacattcttcccaaaacaaagctcttcagcttcaaccacatgtttatgctcgcaaagcgcatcgaccagattataaaatgatgtttcatctctcaaattgaaatcatccaatttatcatacgcatcaatagcctcctgaacaagatgagccgtcacataacgcttaaagactatacgaaacgtgacgtgattcggcacagattccgtgtttccgatcatgcggttaatcaaagcccaagaaatttcaaactcgaaatacttacccagaatatcgatcacccgattgaatgtctcggtggtatgtctgaatccggattctctctcgacccagttgaaaaactccaacgccttttgccaatcgttgctgtaacatgtgagagcttcgcatactgttttctgatcgtaactggactgatcttcttcttcctgagatcgaaacttcgcatcatcgacatttgaaataggttttactgacagaagccgaacggagtaaggggaagcaatccgaactcgattgagtcgccgcaacaagagcattctcttgtttcccctctccgctccctgtacacacgaaattagggttcatcatctaacgggcgaattttgacccgaatacccattttaaaatctgacccgaataccatttatgggcccaaagcccgctggacttgtgttaatatttggaacatttgggccgatctatcttctacgaatctttcttaggcccatcataattgagccatccagaggtgaaaataaataatcgaacggttaatattggtttgattataaacacaaaagttctttccaggtctccttgtagtctttgttgtagtaaatggcgggagtcatccacgtcagcagtacccagattccggttgcgtttatgtccgcaaccaaacagagctttaggagagcttctgtgatcagatgtgccgccaacactccaaagaaacggtacaccatcgcggttcttcccggcgatggcgtcggtaacgaagtgatcccagtcgctgttgacgttctttgtttagctgggtctcttgaaggttccttctttctcatcctgttgcctaatttaatttgattttcccaactgaaatcgtgtttttggatatcagggatagattttagcttcgaggagttgcctataggaggtgttgctttagatcttgtcggagttccactgcctaaggaaacattgatcagggcaaagcaatcagacgctcttcttctcggagctgttggatggtatggtattattaccataactttcgttcatctcaagtttggattcatctaaagtttggatttttgaattgaaggccgaaatgggataacaatcccaagcatttgaagccgataacggccttgttgcagcttcgtgcggctcttcaagtatttgatgagccctccttcttctgtgaggtgctgctaataaatggatatatatatatatatatatatatatatatatatgttgtatgtggtaatgtaaggtgtccatttacaaaattaaaaactttggggtcaattctgaaaataaaacaatgtgcaaaaaaggacccataaatgcaaagaagtaaagtctgagtgtactagtagtatccatttgacttgcggtttcaaaatccgaaaaagaccaatcaatcctttctccctgaaatg

SEQ ID NO: 26821 - DNA, 3003 bp, Unknown
  misc_feature (1)..( 3003): 2750-1469P.txt file - cDNA_ID_2716252; gDNA_ID_2213666; Annot_ID_132683
tttaaaaacgtaattttaagcgtctttgttgtggtttgggctgatctactaccgagtacgcccttgacatttcagttggtagcttgtgggtattttggtcattttaggatccacgatcgtgttcttaagctgatcatgtaggtacaccgacttttcgttgaccgaaatacccccagcgtggacacaactccaatttaggcaatgatgtttttagtcttttcttttccaagaaactcaatctatctttctcgatttcttttgttgtcttcttggaaacacttgttagattgtttttgagtttcaaacaaacaggtgataaattcggtgatctctgctttttgctcttttcttttggcaacaaaagagtcacgttttcccacttttgtgcatctcagtcatctttctctctctctctctatgctgctttgcggaaagaccacaaagccctcacatcaagggagaggggagaggtcttctgggtcaaatcagcgttgtagacttcaatgctaaagagaaaaaataaacacattcattatcattaccaagctaatgactaaattaacccttgtcaccaggttagctgcttctcacgatagagggtatattagtcaatgccagagattatcgctggcgttatttataatttgggaggcgttttcgtggaattgaatttaagattagagtatgagtggattaggtacgtgtgtggtagggtttagtggggagagcagttatcagatgtggcgcagtggacaataagtagtatgtactcgttctctagtagtagtggtcaaagtcctcagttgttgcaacggattaggtcctgtgattcgtccgtcagattttcttggtgacagtcttgttgagttagcctgttttacttttttttttacaaagtttagttaagattgttgtctgatttgaagttgactttgatcggtgggttataatttgaaaaccaaagtaaagtcgtcaaactaaaggaaatggaatttttgggtagaataaaataaaaatagaaagatgatagataataaggacaagtggtggtgtggagaatacgtgacactagtttggggttggaggacaaggaaaagcatgacgtgtgaatgtgacgaccaaacacacacgctttatatttaaaagtctcccaagtcacgctccactcacgtgtttctatgtttttctatatatttatttatttgcccttctgttttttctttttgagtagttgaccaagaagatactgctgaaatttacatgatttggaattttcttttagatttccaagttctagttgttatttgttaatatgctgatgaagtgattcttttgtttccaacttatcgtgcctctaaagtctctctcgaatggtaggtgtgtggtttctttatagaaatgatatacaatacaaaaacaaattgtttttacggtattagtttggtgtgattattgattgttgagctggctttatctggtggtgttgtgtgtcttaagccataatctgattgtttttgttttgatgtccagatttctcaaacgagtgcaataacaacaacaacaacaacaacccttttcaagagatcaagaaagaagaaggtaaaaaatacgaaagacagtgtttctattagttactgatactgttaaaagataatattactagttttagaccagacatagagcaactctgaccaggctactacctactggtttgtttaaatctgttgaggcatattgtctaagatacgcctagcaatcttatattttctacatttggactgatatggttttacattttagccgattcaaacctatatttctctaattaatatatatgattgttgacagactttggctgagcttaaagaggaagagatcatgctcttgaaggaaagtaacggcctgaaaaatgtataacctccattttagcctctttctttatgtctctatatatcaagtccaagttctaatcttagatttggttaatcttattcttgaatcaggaattggcaaatatgcgcgatttgctcgagcaacaaagagcaagaaacactgctctaaagaagatgaaggtgagcccatcgctctctctctctctctctctctatctttctatacatgtactcattcaatcatatatacggaagataaacatgttaattattcaagtatatcattttcatgtgtatgcaggctgaatcacaatctgccttatcgtgcaaactcactttcgaacaaggttcttccttcttgctccctgacctaaacatgcctctagataacgacccgagccctgaagttgtctgctgaacgggcgagccacaagcatatcattcttttgtttttcccattacacaacactataccactatacctcctccgtccacaaacatgttttttgaactgtaactatatgaatatgaagaacgtagattaatcctatatatccttcacccatatcccggtggaagctgaagaagattcgcctgaaggtgaagtggttcgagactatggttaagtgtgttaacaatatcttctagtttagctggtagtaagatttttgttctgccaatctcctaaatgattcttatctttctcccattttattaggatgagatgtaattatctacttagataatagatgtacacctttttttttttgtttgttctttcttattatctctggtaagatgtattacatcgacatttataatcagtgtaacacgttccaaacattttactatattttgtattatgattgatggactaaaaaatatctgcagtcttgcattctttttcatcgttataaataatttagaaatttcaaaccattaatactaaaaacacgtaattacggaaaaagtaagatactaatcagattctttattaagctcagctaaaccagtagtagtaaaattatcactggccttaaaaccctagaaatagaattaatctcagctattttgtcttaacgactctttattgtcccgacacacgaaaatg

SEQ ID NO: 26822 - DNA, 3003 bp, Unknown; identical to SEQ ID NO: 26821
  misc_feature (1)..( 3003): 2750-1469P.txt file - cDNA_ID_2716252; gDNA_ID_2213666; Annot_ID_182099

SEQ ID NO: 26823 - DNA, 3000 bp, Unknown
  misc_feature (1)..( 3000): 2750-1469P.txt file - cDNA_ID_2716252; gDNA_ID_2213669; Annot_ID_182245
aaaaacgtaattttaagcgtctttgttgtggtttgggctgatctactaccgagtacgcccttgacatttcagttggtagcttgtgggtattttggtcattttaggatccacgatcgtgttcttaagctgatcatgtaggtacaccgacttttcgttgaccgaaatacccccagcgtggacacaactccaatttaggcaatgatgtttttagtcttttcttttccaagaaactcaatctatctttctcgatttcttttgttgtcttcttggaaacacttgttagattgtttttgagtttcaaacaaacaggtgataaattcggtgatctctgctttttgctcttttcttttggcaacaaaagagtcacgttttcccacttttgtgcatctcagtcatctttctctctctctctctatgctgctttgcggaaagaccacaaagccctcacatcaagggagaggggagaggtcttctgggtcaaatcagcgttgtagacttcaatgctaaagagaaaaaataaacacattcattatcattaccaagctaatgactaaattaacccttgtcaccaggttagctgcttctcacgatagagggtatattagtcaatgccagagattatcgctggcgttatttataatttgggaggcgttttcgtggaattgaatttaagattagagtatgagtggattaggtacgtgtgtggtagggtttagtggggagagcagttatcagatgtggcgcagtggacaataagtagtatgtactcgttctctagtagtagtggtcaaagtcctcagttgttgcaacggattaggtcctgtgattcgtccgtcagattttcttggtgacagtcttgttgagttagcctgttttacttttttttttacaaagtttagttaagattgttgtctgatttgaagttgactttgatcggtgggttataatttgaaaaccaaagtaaagtcgtcaaactaaaggaaatggaatttttgggtagaataaaataaaaatagaaagatgatagataataaggacaagtggtggtgtggagaatacgtgacactagtttggggttggaggacaaggaaaagcatgacgtgtgaatgtgacgaccaaacacacacgctttatatttaaaagtctcccaagtcacgctccactcacgtgtttctatgtttttctatatatttatttatttgcccttctgttttttctttttgagtagttgaccaagaagatactgctgaaatttacatgatttggaattttcttttagatttccaagttctagttgttatttgttaatatgctgatgaagtgattcttttgtttccaacttatcgtgcctctaaagtctctctcgaatggtaggtgtgtggtttctttatagaaatgatatacaatacaaaaacaaattgtttttacggtattagtttggtgtgattattgattgttgagctggctttatctggtggtgttgtgtgtcttaagccataatctgattgtttttgttttgatgtccagatttctcaaacgagtgcaataacaacaacaacaacaacaacccttttcaagagatcaagaaagaagaaggtaaaaaatacgaaagacagtgtttctattagttactgatactgttaaaagataatattactagttttagaccagacatagagcaactctgaccaggctactacctactggtttgtttaaatctgttgaggcatattgtctaagatacgcctagcaatcttatattttctacatttggactgatatggttttacattttagccgattcaaacctatatttctctaattaatatatatgattgttgacagactttggctgagcttaaagaggaagagatcatgctcttgaaggaaagtaacggcctgaaaaatgtataacctccattttagcctctttctttatgtctctatatatcaagtccaagttctaatcttagatttggttaatcttattcttgaatcaggaattggcaaatatgcgcgatttgctcgagcaacaaagagcaagaaacactgctctaaagaagatgaaggtgagcccatcgctctctctctctctctctctctatctttctatacatgtactcattcaatcatatatacggaagataaacatgttaattattcaagtatatcattttcatgtgtatgcaggctgaatcacaatctgccttatcgtgcaaactcactttcgaacaaggttcttccttcttgctccctgacctaaacatgcctctagataacgacccgagccctgaagttgtctgctgaacgggcgagccacaagcatatcattcttttgtttttcccattacacaacactataccactatacctcctccgtccacaaacatgttttttgaactgtaactatatgaatatgaagaacgtagattaatcctatatatccttcacccatatcccggtggaagctgaagaagattcgcctgaaggtgaagtggttcgagactatggttaagtgtgttaacaatatcttctagtttagctggtagtaagatttttgttctgccaatctcctaaatgattcttatctttctcccattttattaggatgagatgtaattatctacttagataatagatgtacacctttttttttttgtttgttctttcttattatctctggtaagatgtattacatcgacatttataatcagtgtaacacgttccaaacattttactatattttgtattatgattgatggactaaaaaatatctgcagtcttgcattctttttcatcgttataaataatttagaaatttcaaaccattaatactaaaaacacgtaattacggaaaaagtaagatactaatcagattctttattaagctcagctaaaccagtagtagtaaaattatcactggccttaaaaccctagaaatagaattaatctcagctattttgtcttaacgactctttattgtcccgacacacgaaaatg

SEQ ID NO: 26824 - DNA, 3000 bp, Unknown; identical to SEQ ID NO: 10635
  misc_feature (1)..( 3000): 2750-1469P.txt file - cDNA_ID_2716259; gDNA_ID_2213666; Annot_ID_132681

SEQ ID NO: 26825 - DNA, 3000 bp, Unknown; identical to SEQ ID NO: 10635
  misc_feature (1)..( 3000): 2750-1469P.txt file - cDNA_ID_2716259; gDNA_ID_2213666; Annot_ID_182097

SEQ ID NO: 26826 - DNA, 3003 bp, Unknown
  misc_feature (1)..( 3003): 2750-1469P.txt file - cDNA_ID_2716274; gDNA_ID_2213667; Annot_ID_132722
cattttcttggtagacttcatcagctaaaagaaccaaaccctcttgcttgcagaaattaacaatgtcacgctggttttcttccgcaagaacctaaccagaataagaacgcaagattagaagaatgttacattttgttaggctagtcttgaaaatctgtttgtacctgcccagttgggttaccggggtttatgacaaccaaggcccttacagagatgcccttggacctagcttcctctagttgcttcttaaggtcagatatttccagtccccatcctgttgcttcatcaagatagtacggaacctaagaagtacaaatttcaaaaacttgtaccaaaaaacaacattactccatgatgattatatgaacataccaaagatccaccatgaagggcaattgaagccgagtacaatggatactgaggaatcggggaaagaataccatctttctctgagctcaagagaagttgcatcatcatgtgaacctatagagtaaaaaacaccaaaaacacttagcatgaatcctttaaaagaacttactctaactctatgagataacgttttcgttttgattgttaccgctggacttgcaccatcagtcaagaaaatatcatttggatcagcagggaaaccatcacgtgcttcgattccagctgcaattacatcacgtaaacccttgataccctgaggcagaacaaaaaatgaaacattcagcaacataagaaccatctcaagaaagggtttaggacttttaactagactctaataacaaacctggctatgactgtaagccccagttgctcttccgggaatatggtccaaaatcctccatgctcggtcaattgaatcggtactgatagcagagtagaaatcaaatgttaagcaatcttaaaccgtgagcatacatgtcctaaagctgaaatatagcaaggaaaacctcacctgaacaaaccatgggtttcagactcatccaaaagacttgcgtggtcacacaatgcgagaacctgaggcatatagatgatagacgttatatctctgtggctgatatgacaaccaaactagtaccaaaaacattcacttacctcacggaagaactttataggcagctgaccaagagattgaggattcccaatgttgcaatagattatctgccaaaagtaatgaagaattctaagttccttgcacaaagagtttgagaacaggtaacatcaacactaaactaatcataaatccgtcaaaactgccgataaagaaagagattttacctcatcaaagggataagcatccttattagtcttcaagtcttcttgtaacttctgtaagatggaagcaaaaagcaaacaaaaatcaattagcattaaaaacaattttacagattttgttcttggttttacaagacaaagcacatgcatctctgacctgagcaatgttgacaatttctcctcgaacagcatactcacatttcagaacctgttccccggaaaagaaaaaaaactcttagttaacaataaaaccaacttctctgtaatataaagtacaaagaagttatgcaaagcttgtcgatttcatcgttgggaatcacaacgagaagcaaaggataaacctttggcgttaaatcagacaaccacagtaaaaaattgaaacttttttactaaattagaaacaaatccagatcaaccctgaaacccacaattcaaaaacgcaataaaccagctagagaattagaaaccgaccttgggattgatggagtcaagagtaacgggaagagaagaagtggaatcagaagcagacatctccgaagtagaagagaagaaacgagacagagcaggaggagaagaagcaaggggacgaggttgaggagagagaaagcttggacttttgtggtgatgttgacgacgagaatggtcgacgagacctttagcttggttaatcaagaatctccgcatctgtgaatcagctttatactaggaacgtgctctttaagccctaggattgaaaattctctcacgaggaaacaagggtcccaatatccagtgccttgcacaccgaattttgccttgtcctccacgctcagaaattgctttttcgttttttcttttcgaaaatctaattgatgaagatatttgtaggggttttttttaggcggctaattttgttgatttatctgttaaacacacgactaatcccaaaaaaagacatgtcttttatcaaaaaaagatgtctgaagtctatcttccgttgacttaattatccaaaaggaccaaaattgaataatccaatcacagtcgtaatctaatttggggataaatagatacttataaaacctacagctaatttgaaagttataaatttttagaaatctctaaatttaaataaatcacaacaacatgtagcagcacattgctaacgatgaggttttttttgggctacataattgggccctaaaaaggtcggtaaaatcgtgatttaaagcccattatttgtttatatccacgtcaacaaaacgatatcgtattaggttggacgagaataaaaccctaggaattagaaaatttgtacaacgtcaaaacatcgaagattttgatccaacgtataccaagagtttcggagacgacgtcgttttgtctctgcgccgcgttcttagtctgagctcacgcttgttcgtttctcctctaacgtcaactgtgtttttgcatcctcaaaggtttgtgatacaccttattgtttctgttcttttgtacaagcttcacatggattagtgtaaagtcttagaattgggactcggaatttattgttatgttttaggttattcaacccagttatggtatcgttttgaagtagaggtagaaaccctaatttttggggtctgtaaatttggagaaaaaattgaacctttcccttttttgttatattgtgtaatttgggactaatagttcttcgaagctgagtttttttgtgtgtaaattttgtagggtttaacatagttggggctaggaattttcatg

SEQ ID NO: 26827 - DNA, 3003 bp, Unknown; identical to SEQ ID NO: 26826
  misc_feature (1)..( 3003): 2750-1469P.txt file - cDNA_ID_2716274; gDNA_ID_2213667; Annot_ID_182150

SEQ ID NO: 26828 - DNA, 3000 bp, Unknown
  misc_feature (1)..( 3000): 2750-1469P.txt file - cDNA_ID_2716278; gDNA_ID_2213667; Annot_ID_132721
atcttggagctaattcttcccacataatacccatcttgtaaacaaaatcaattgaacgtaagtttactggcttcacggaaatagcacaaataaattcgaagttaagaagacctggaatgaaattttgatgtcacagaaaaagatgaagtgtatgataaagatacctgctcttggtctcttgcatgggagattaatgcttgaataacaaaatttgcacaccgatcaactgaaagctcaaataaagaattcttgaaaactttgttgaacatttcgttatacaaactttcaggggccacttccaaaataacctgaaaatggcatgcaaacgcatttaaagagatgactaagaaaattaacactccaattacagcatggaatcaaacagagaactagcaatccttatagataatattttgcatggtctaaagcaggcaatacgtccatcatcaattgttttatgcaaggtacagaatcttggtataaacaactcagtcagagcagccagaggttagactcagttacctccaccagatgactgaatgaattatccttcatcgactctaaaatttctttggcaacattagtctctatatgaaacccttctacttttttattagtagagttgcagcgcagaataagcggaatgatttcaagcaactgctcatcttgtttcagcattagtctgagagccgtctgtcaagagaagattagttagaatcaccgtgaatcagggagagagactaaataacagtcaatactaaagaaattgcttgaaaatgacataaacgattagacagggacataaaacctacctgtaagaccaaactgctatactgatcgacttgaagatacttcatgtcctctctgctacaacttaatagcccagataaaaggtacgtgagcatacctggaaacccttgatgagggatttctaaattattgtcatctagctgagacatcttcagattcaaacgtttggccagagcttttgatgattttgcgccataaagctcaggggaatctaaagagactcctttgcaaagacaaagaagccttcgtagtacatgcgaaccatagcagttgcacatcatatcaagaggattatccacaatcacctgaccaggggaaatatttcaccatcaaaattgaggtcaattactagactagaagcaataatctggataccttaatatgattgtcaaagccagtaaaaattgtataaagtaccttgcatatagaatgcaaagcctcctcaataacagaataggcgtctggattttctagatgtgtggccaaggatttgagagcagactctgcgacatgagaaccagatctatccattgcaatggctgggaacacactagcagaatttcgtatgaaactgcagagttggtcaagttcacatccctcaagtagagtttgcaagacatgacttatgatatagtctgtagcaatttcatactccctccctcttgtttcttcaagggcatttccacatattactgaacgttcctctaattcaacttcattactatcaaagagattggcaatctcagagaaatactttgaagtctctggatcaatctctttcctgaaaaagatacacccaaatcactaccacttctcacaacaacaaaatttcgactataaattagagcaaaggcccttggttaaaaatctcctttacctgacaaattgattctgatgttcgaattcggagtgtttctttgatgctggctttacattgggggcaccaccggattggttcttcttgctgctatctacatcaaatccacggttacccttatggtccttcctacgcattcccttattcctttcactgtgattgttactagactttcctcgttcacccatcaagctatcttcctcaatggtcctgtgcctcctagatggcaatgatttagaaccaacagaaaccatgaaaattcctagccccaactatgttaaaccctacaaaatttacacacaaaaaaactcagcttcgaagaactattagtcccaaattacacaatataacaaaaaagggaaaggttcaattttttctccaaatttacagaccccaaaaattagggtttctacctctacttcaaaacgataccataactgggttgaataacctaaaacataacaataaattccgagtcccaattctaagactttacactaatccatgtgaagcttgtacaaaagaacagaaacaataaggtgtatcacaaacctttgaggatgcaaaaacacagttgacgttagaggagaaacgaacaagcgtgagctcagactaagaacgcggcgcagagacaaaacgacgtcgtctccgaaactcttggtatacgttggatcaaaatcttcgatgttttgacgttgtacaaattttctaattcctagggttttattctcgtccaacctaatacgatatcgttttgttgacgtggatataaacaaataatgggctttaaatcacgattttaccgacctttttagggcccaattatgtagcccaaaaaaaacctcatcgttagcaatgtgctgctacatgttgttgtgatttatttaaatttagagatttctaaaaatttataactttcaaattagctgtaggttttataagtatctatttatccccaaattagattacgactgtgattggattattcaattttggtccttttggataattaagtcaacggaagatagacttcagacatctttttttgataaaagacatgtctttttttgggattagtcgtgtgtttaacagataaatcaacaaaattagccgcctaaaaaaaacccctacaaatatcttcatcaattagattttcgaaaagaaaaaacgaaaaagcaatttctgagcgtggaggacaaggcaaaattcggtgtgcaaggcactggatattgggacccttgtttcctcgtgagagaattttcaatcctagggcttaaagagcacgttcctagtataaagctgattcacagatg

SEQ ID NO: 26829 - DNA, 3003 bp, Unknown
  misc_feature (1)..( 3003): 2750-1469P.txt file - cDNA_ID_2716287; gDNA_ID_2213667; Annot_ID_132717
tgaagtgtatttcattcccccctgttgtgaagctggaaattgcatgggaccaccttcctgattcataaccccttccatttggtgtggtgaaaacctctgaatacttgtatttggatactgaatacttctgcctagcatgtcttggtgttgtagaagcgtatttttccaatttgtatcggatccatgaaggccatccatacgttgccctaactgttgctgcggaaccccatcaggacccatatgtgaaacccttgttcgcttattcaagccaggcatagaagacatttgtccttcttgactttctctctttctatgaaaagatgtaccagggttcatactatcagagccataaggcagcatcgcatctagtccaccaggcgaagcgccagagacactgacagaatttgatccttgatcctgcgtgtttcttgtacttccaattcccatgtacctttgttgctgaggtggtaccaaggccagagaggaatttggtgcatcttgcaacggctgacttcttaatcccgccagcatattagtaccaaggttttgaatagcctggttgttattggtttgctgcattatcaaatgccctggcaaatttcctcgctctgaactttcaggaagccgatcaatgcacacctttttcccctgaatcttattctgagacatgactgtcacttctgccatttgccttaatctctttctccgcaaagtagaaagcgacaaatcgagctatcgagtagagaaaaaaaaacattttagacactataataaacaactgagaacagaaagcacaaggagtctttttaatgagatattaccttagcagtcaaaggatttttactcagcctatcaagtctgggtaaaggatccagacagagttcaggttgtaaggcttttaatatcctggactccacttcctgcagttgatgtaaggatcagtacagaagataatagtttcagtgctcagatatacgacctataagccacgagctaccatgattaccatgagatcaccgtacgtccatgagttgtctgacattgatggaatatcttttaccacattctcgagtgacatcttaaggcgcaatttatttatcacaggagagacttgagatgaggtatgtttccgatagtcatgcacctacaatagtatgtgccaaaaattaaagaaaacatgatgatgtaagatggtacacagcagtcaattaaaaattagtataactaggttttttatgtttacttctggtcccagttactccattatgtttcagaaacaatcaaatacatgtacaattgagtttggaagataaacttccatgtacttataattacgacatttttttaatcttgattaagtgtagataatttctgttgagctctttttaaatatatttatatacgtttggactgtttccaagaacttatggaaggctttatcccaaaaaataattgcagataactcacctcacatataaccaccccatccacaaatttgcaaggtatatcttccaaaatgtccccaggaagcctgccagcctcaatagcctataaagcgtacaaagggattaaaaacatttactcagtagaatgaaactcagaaagtgtatttaacaaaacgcgagtaagtagtgcagtgaaatgcattattcgggtagaacaagtggggaaaaaaaacatcatcttcacatttactaaatctaagtactttgaattcattcaccaaaactttgattacatgttcaaatcaagtctataataacatagttcgaaagatttaccgaaaggagaccctctgctgccctatcatacggatgtaagacctttggaacatctcgaaacgatatctgttgcatagcctggtattcaaaaactcaaatttgtgaaaacgtgaaggttttaaaactcaaatacaagaaatcacaagataaataaattcatatagactctcagtacatacctcagaggtttttcctatagagtacccatttggatagaggctcaatatgaaggaaacttcatgatctgcagagaaaccaaaatgcactcaattcaacatagctagaatttagcaaaacattatgtgtcaaagtggttcgttgagatccaaacctggagatatatcgggtaaagatggcttcgaaaacccggaaacatcgccaatattgctatcatcagtggcctgaaccaaacgtaataaattttctatataactttccaaaataagcgaatttagttggaacacaatacaactaaaattctaagttaaattacctttggtttcccagatagaacgattgcttttggggaatcaggagtagccaattcagtagaaatcttaggtcgaaactttctaccaaccttcgatatcttaaacgagacacccatggattctctccagagagatgaagctcaaacctgtctaggtactgtcaataaacgatacagaaataaaaaagacacgagaattgaagaaatcgaagaatgaattttaagaaagctagagaaattgaaaccttatgagcttgttacagagaagatcatcaaacaattggatcggatagaaagcgagagaaatcaaaggtgactaagaatagagcaatgaagaattcataaacatggaatttgtgaaacacaggtgggaaatttttgaagaagatgcgatcggaagagaaaggaagagagattattgttagggttcttcttctaacttcaaagtagcagaaaaagaaattatcttttgtgtctctgtgcacacttggatttcggtttaagacaaaacggaagttgaaccagttattaattttggttagcttcgattaaaatttgggtaaccgagtttgggggtagaatagacattttgcaaattagggttttgcttgatatataaaatccttcacccttataagcctttcgtcgcctcttcgtgtgatttactgagtgaaaaaagcttatcgcggcgattagttcccggcgaagaagaagaagagagataagaaaatg

SEQ ID NO: 26830 - DNA, 3000 bp, Unknown; identical to SEQ ID NO: 10661
  misc_feature (1)..( 3000): 2750-1469P.txt file - cDNA_ID_2716291; gDNA_ID_2213667; Annot_ID_132716

SEQ ID NO: 26831 - DNA, 3000 bp, Unknown; identical to SEQ ID NO: 10666
  misc_feature (1)..( 3000): 2750-1469P.txt file - cDNA_ID_2716294; gDNA_ID_2213667; Annot_ID_132715

SEQ ID NO: 26832 - DNA, 3003 bp, Unknown
  misc_feature (1)..( 3003): 2750-1469P.txt file - cDNA_ID_2716298; gDNA_ID_2213667; Annot_ID_132714
gttttttcttaaactattaaagcattaattatgctgggaattagtgatacacatatatacagaaaaaaaaaatccgtggaagaaaaaataaataaattacgttcttcgttatgaacattttttgtgtgcgaccgaaaagaaaaaacatttttgtagattaagaaaaatataggctaaattgagggcgggaggtctaatatgtccaatctaaagtgggccgttaaggcccattagtgtttctcatgttttatcttcttaaattctttattgctcaatggctgctgattaccggttcgaatcgtacggaatctagttttagttaagaagatgtgctgatctaattactctatgatcaaaatcataaaattggagccaacaaaaatatcataccaaacacatgacgtggccatgtggaattgttggcaaccccaaaacatccaaacattggtttgttgcaaaactaatcagataattaatgagattaggtacagtatttcatatacatttaaggacatttaatgaaaattaatgctacattagaatgttagggttgtttgattggtgaaaattacaattgccagcaattatgttactgtaaaattgccattcacattttcacccaattgatcaataaaacttttcatcgtcattcttttttttttccatttgaaaatctgttttttttttctgtgttggatgtaattttttttctttgaaatatttttattacaaatatttaaccgtaataaaataaaatacagtctactatttttagaacgtttattgcaaagttctaaaattgctaataaagtcttccaagtgaaaaatattttaccgttgaaattatgtttatttattactactagctagagagcctaggcttcgaccaatttttagttacgatattaccctcatcgttataggctttattaggaaagtaaaccggtgttgttaaaaggttttgagggtattatggtaaaacgtagtactgcggctgtatcttttttttctttcctaatcgaagacgacattcgtcggaaaagaagttgtctgaataaggaaactctctctctctctaaacagtctccgcatattttctctctctaaagactctgtcttttttactacggagagagagagagagagagagagtgtgcgtgtgctggtttcgagcgtggatattaagggacagagcaaaatcttctttggtgggagaaataaagaaagattttgcattttgagcaaaaccagtagtgaagtgacaacattaactcctgacattgttagggtttcatcttcttttctctctttctcaacctctcttgccgattgagaacttggattaagtttggaaatactgagaattggaaagttcccagctcaatgctggatcggcaacaggaggatcttggtatgttctttatggattttgcatgattttgagttctgagctttggttttttttttccggattatattaaagttgggatttttatggttgggtctttacttagagtagtggaatcagatctgagaagcatcgtgttccgatgaattagatcctcgatttctatgtctggccatttatatggttcatgacctgtttttgtcttccttttcatttcccgagattctttgtttctcatcaaagttatattccgtgattgtcctacttatttcgtgagaatgactctggtttcattcatcttttgctttcaacattgttagcaagttggcttttttttttgtaatctctgagtaacagtttctattattgttttctcaggtttcttggcattaatttgagtttgttcagttgaattctgttaatctcagtgatacttctgctggttggttagcattagcaatctggtcttgtgagaatgaggtcagatacggttcttgactacgtggtattcgaattatcgccaaagcattcaaagtgagtatatgttccacttcaagatttcatgatttctagtttgttctgtataaacaagtgtgtgtttttcctttgatagatgcgaattgtttgtatcaagcaatgaacagacagagaagctagcttcagggttgattcaaccctttgtgaatcatttaaaagttcttgaagcaaaagcgtcgcctgttgctcaatcctctattagattggaggtggagaaaagcaacacttggttcactaaaagaacattagagaggtttataacaaagaattcaatatcattttggtttcttttcacatagccttttttcgatatagtaatagtttcttccaccatttgtcctttcagatttgttcaatttgttaatagtccagaaactctcgaaaaggtcaatacatattattccgagatgttgcagttggaagcagctcgaacattatattcgcaggttgtaaccactattttgaaacttgacttctaattgtgattcttgaccgatcgatctttcctaaagttttgttgtcatttttttggttcttaaagcggagtgaagactcaaagtttggtgcatcaggtgtgtttgattttactgttgttactttgctcgtacattgatctttaacatcaatttgaatcctatttccttccgtttcagatgatggagctgcagcagatgccacaaagtaaagcttctctgcgtttatgtttgttctgtgtttaaagagttttatattgattactttttcttctctatattcaggaaggagctcttaaaggctatagacttaagacttgaagctattaaaaaggacttgacaacgtccatttctcatgcatcagctagcggtttcgaccctcatactgtttccgaactcaaacaatttgctgatagatttagtgcacatcatttggagtaagccttttattgttttgctacttttcatttgatgaaacctatctttcatgctttgttgtttgattgaattggaatggttccatcagtgaagcatgcagtaaatatatctcactatggaagcaaaggccagacttgatcgacatg

SEQ ID NO: 26833 - DNA, 3003 bp, Unknown
  misc_feature (1)..( 3003): 2750-1469P.txt file - cDNA_ID_2716308; gDNA_ID_2213667; Annot_ID_132710
tttctattcgtgacaaaacatttgaggatataggaaattaatagcctataatatgtttgaccataaaaagaatttcttcttcttgaaccatcataagaaaaatgtgtgtttagtctattgatcagttttgtgttcaaaaaaaaaaaaaaaatgtctatcgatcagttaggtgtaaaaaaaaaagttacaaaactcgtgacaaaaacattctatattggacacacatcactgtcacttcagactaaataaaaaaaaagaacacgttatttcgttttctttatttattcgggagaggttaaaagccacagaaacttattggctagaattggttatttataacaacaacacatgagcaaaaagctcaaaacatctacatactctttggaatcctcgattttttgtacgtgtaaagaagtcacacaagaaaatcttgggttgttgtaatcttcatcacactagtatgtcaacgggacaagcgccggagaagtccaatttttctcagagatgtagtctgctcagccggtacttgaaggagaagggaagttttgggaatattaatatggggttggctcgaaaatccgatcttgaactcgccggaaaattcgatctcaaaggtatttatttatttttccctatctattccgacggccgccgcctataaagaccaaagtttatatcatatacttttagtatcctgcttcgttgattattagcataaagtttaactatatattttttttgttgaaatgcaaaattttaaatcatttttttcttttcttttctttaaacttaagcatggtattattttggacagcttaagtatattaaagttagagattctgtgaagttttttaaaaaacgtaataaacatgtaatttgattttgataaattttaatcggtttgcaatttctgttctaatttgttttaggacaacaaaatgtgattaagaaggtagagacctcagaaactagaccgttcaagttgattcagaagttttctattggtgaggcctctacttctaccgaagacaaagccatatatattgatctcaggtactgtacacacaaacttcatatgtattcgaactcctaaagtgtttgttttcacattttgtagcaattgaattagagaaagaactaccggttatagatgtatggactatggagtttgactaattgtaaaaatgggtttgatttgattttagtgaaccggcaaaagtagcaccggagtctggaaattcacagttgaccatattctttggaggaaaagttatggttttcaacgagtttcctgaagacaaagctaaggagataatggaagtagctaaagaagcgaatcatgttgctgttgattctaagaacagtcagagtcacatgaatcttgacaaaagcaacgtggtgattcccgatcttaacgagccaacgagttccgggaacaatgaagatcaagaaactgggcagcaacatcaggttgtggaacgcattgcaagaagagcttctcttcatcgattctttgctaaacgaaaagacaggtaaactaaactccgaaactgttttgtgcttggttatgctttttctaggccgctcgtcaaaatgtatgcatagattaggatcaaagtttcttaaaaaagttatatgtaaaaatagctaataattaccatattaagacttattcgagttattctaggaatcccacatcggattagaagcgtattaccaatcaagtttaagttgaacattcatgaaattgaacatagggtggtcctagtatgtttatgaattatgattcctagagtaagatttcgagatgtgactcaagtgtcatcatttataaagaacatgtaaaaaatcttacaagttacaatgaaattcgagatgggacctagagtagtatataagagatatgagtccatcatctatgtgtccttgatctaggaaaattattagtaaaatgtcgagaaatttctagttaaaaaacactaactaagagttctttgtaaatcaaaacttcaatatctactttgtcttaaatgttgattaattgttttgatttcagggctgtggctagagctccatatcaagtgaaccaacacggtagtcatcttcctcccaagccagagatggttgctccatcgataaagtcaggccaatcgtcgcaacacattgcaactcctccaaaaccaaaggcccataaccatatgccgatggaggtggacaagaaagaaggacaatcttccaaaaaccttgaactcaagctttagggcgtataaaatgcacgatcgagttcacgtttctagttttcacttatttaggatttgaacccaaatacccttttatattttcttccattacttttgaccaatttaagttatttatagtactgtattacgtagctagtatttatatttcaaaacatacatattttgatacttgttttttagattctttaattaaaattgtcatctggattaccctttatcgaaattttttaatcacctgatataatctcaccagtgatggatttgcgttgttagtaatttttctaagtggcaaaagtatattaacctataataggtttcaaagatatacatataatgtttctatcaaagatattagtataatattttaccacatgatcgaaatctcaccagttatggatttgcattgaatgttctagcgattgggctggaccgtctcaggaacccaaccttaatgaaaaaacatcgtctcattgattttaggtcgttaagtctgttttgcccttgtcttatcccgtaattacgaaattagccttctaccatttcctctgtctgcttctctcttgccgttttctaaaaccctaaaaatttctgttgaaccccaaacattgaagtttatctttctttttcattgttcgatctcaaagcacagagattgcttaaacctaactgtctcagttcttttaaaaacagtcatctctcacaaaactctcttaaccctcttcatatgctttgagaaaaaatg

SEQ ID NO: 26834 - DNA, 3003 bp, Unknown
  misc_feature (1)..( 3003): 2750-1469P.txt file - cDNA_ID_2716312; gDNA_ID_2213667; Annot_ID_132709
ttaaaccgtagaagtgacttaattacaagtataagtgttgtaagaacaactatcaagtaaaagtgttgtaaaaccaactatcaaaactatattttttacgtgttacgtgtgaaaactattaagtgatactccaaattttgccatactacaagataacgcatgtaaataaattttatgggaaaaacaaatggttttggcattaggaccaagagcatataatcttaaaactcgtacaacatttggttcagttctagctaacgtgaccttttaagtggaccacttcatcatttggattttcctcctgatgcttagttatgtcggatttctaatttactcactatagcatgacaaaaaatgtatccctatgccgaaaaaagaaagaaatttgataaatgtaaaacaaattgacgccaccaaatgtaatcatcaatcagttttagcttttacagttcctaactatttccaaatatgagaatatcgaaagaatagttataagtttcttatgtatcatgagtaaaatactctaatactcaattactcatgatattatatgcaactaaacaaaatatttgtctaatctattaattttctgtagaccatgacatgtattctaatgatttgacttagtgtccttgttgtatttctatccggtttcaattatgcaattgttgaaaaaatgttattcctgttccgcatgtaatggatacttattaatatgcgataatctttaggcacatatgttattgtcatagtacaagaggagcatgtgaagaagctgcaacattttggtgttcacatccaaagtatctgtcggtgtcaaagaaccaatttgttttagtcattgttgtaaaacggacctacattcgtagtcgttacccctaaattttaaacaaattttatgtttagtattgtcatacgtcaatgcaaatgagttgtataatctttcaatattgtcttctaattttattttattttctgataagtaccattttatttatgaagataacgactgtacagagaattcccaccacaagctcaagctgcaagaccaaacttacccgaagacaacctgttacagagacacgctagctcgtaacactagatagaaaggaaatcttacccagctcaaagattaagtctgaagcacacctaacccaaaactgttgacaccatcttgattatgtccatatatgaacttaggtctcaaaacaacaactatttatttgataaatgttgatatactctattgcttaaaggagagtccaacttcgagtggtgaccggaaggtttcgccgttgccttttcttttttgccgttaacgttggtttggtagtcttagtagaatcttctcacaatcttgatttttgcatatcaaatctgttagaatatgacattcccttattttggacatgatcaaatatgtgatcgaaacccaacttgcgcttccaacaatgtagataatcttcatgtgaaatagcgaatattatttggtcttttgtatgtattagaaaatgacaatggatctatattgtgtaattaaatacacacatacatgtgtatatattagactcaagttgttgttcaactcttgaaatcatatgatattgaagagtcttcaaagttcaaagtattatgttctcattttgcaagttgcgataaataattcaataaaaatgattttttcccttggcgcgatcgtctacgacattttgttttaaattcttttttggtactctttggcattgcctcttattcaaataaaattcaacgctcgacttcattgaacaaaacgattaaaagattttattattattattgttatagaaataatatttaactgagcaagtaacaaaattcatattaggactaaacagaaatcgttaaccttttaccaacatacaaaaccacaaattctaatattaattacactcagtttttgtaattaaaaacagaaaagaaaattaggcctatgaagtatgaacgctataatatcctttagcaaagagggaaaaaaaacgcaaatcatgcatgaaataaggttggtaccgccaagattccgacacgtgttgacatcctaaacgcacataacaatacttcacgtgtccttaaactttgtcggggataagtaattgacaccattcatcgataaatatccactcacaagtcgtactgttgctaatggatcccacatattaaattcgtattagccatcgcagccgacgcgagacttaactccgtcagaactccgttagactatagcgtttgcaaatgccctcatttacgccctttaataacgaatatcctaaccaccactaaacgaattacctcagaagggtaaattagtatttaacagaaactcttgggacccgaatgaattaaatgggttaacgcctttatgtaatgtcgccgtcaacttacaacagtttcttcacggcttgtgcaatgaaaacgtgccggaacttgtaacgaacattgtagtttgatttttgtaatcaaccataggaataaatcattttttccgcatataatttatttccctatttctattcgtgacaaaacatttgaggatataggaaattaatagcctataatatgtttgaccataaaaagaatttcttcttcttgaaccatcataagaaaaatgtgtgtttagtctattgatcagttttgtgttcaaaaaaaaaaaaaaaatgtctatcgatcagttaggtgtaaaaaaaaaagttacaaaactcgtgacaaaaacattctatattggacacacatcactgtcacttcagactaaataaaaaaaaagaacacgttatttcgttttctttatttattcgggagaggttaaaagccacagaaacttattggctagaattggttatttataacaacaacacatgagcaaaaagctcaaaacatctacatactctttggaatcctcgattttttgtacgtgtaaagaagtcacacaagaaaatcttgggttgttgtaatcttcatcacactagtatg

SEQ ID NO: 26835 - DNA, 3003 bp, Unknown; identical to SEQ ID NO: 26834
  misc_feature (1)..( 3003): 2750-1469P.txt file - cDNA_ID_2716312; gDNA_ID_2213667; Annot_ID_182137

SEQ ID NO: 26836 - DNA, 3000 bp, Unknown; identical to SEQ ID NO: 10662
  misc_feature (1)..( 3000): 2750-1469P.txt file - cDNA_ID_2716316; gDNA_ID_2213667; Annot_ID_132708

SEQ ID NO: 26837 - DNA, 3000 bp, Unknown; identical to SEQ ID NO: 10662
  misc_feature (1)..( 3000): 2750-1469P.txt file - cDNA_ID_2716316; gDNA_ID_2213667; Annot_ID_182136

SEQ ID NO: 26838 - DNA, 3003 bp, Unknown
  misc_feature (1)..( 3003): 2750-1469P.txt file - cDNA_ID_2716324; gDNA_ID_2213667; Annot_ID_132706
atacaatttttctagggattcaatataatttccctctcctcttatagatagtcgaaaaatggtagaaaaaggaatatttgagactgtttgatgaaacgaagtgccaatatatgaattgtgatcaaagccgtgacgttatctccaatacaaaaactaatattcttattgtactccattaattaattgagctataatacaaattaaatacgtacagaagaatgtttctttgggcctcgatcgtttgcatggggataggtgcgttaatatgagtgctacgttgtgagctgtataaaagaagagtgtgggaataggttttatctgaacagaacttaaccaaaacccaaacaaattgaaagaaaaaaaaaacttttttccttcttccttgatcctttatctttttcgaagaagtgaatctggacgaagaactaaggccgccaattttggaatttgaaccatcaaattcatcaacaacaaaaaataaagatcttaatctttgaatttctacttgtatttaagcttcttgattcaccttaaacccgagttatttcatttctttttccacctctttctttgtcttcttcttcttcttcttccgggtcactaagacatgaaggttcgtttaatcactcatacgctctggttcattgatttctgatcacataatgtgttacattacttattcataaatgtttttttttcttttcagtttttcgggtggatgcagaacaagctacatgggaaacaagagattactcatagaccaagcatatcctctgcttcttctcgtaagttcaagattacgtattcgttgaaaacaaaaaatttgattaccaaaactgttgtccacagtccacttgagacatgtgcaaaattgcaaatatcattcctaacattcttctttccattgattggctctctgatatttttgttttttcctatttaaaacaagatcatccgagagaggagtttaacgattggcctcacggattactcgcgattggtacattcggtaacaaaaagcagacaccacaaacacttgatcaagaagtgattcaagaagagacagtgtctaacttacacgtggaaggtcgtcaagcacaagatacagatcaagagctttcttcctccgatgatctagaagaagatttcactcccgaagaagttgggaaactacagaaggagctgacgaaactcttgacgagaaggagtaagaaaaggaagtctgatgtgaatcgagaattagcgaatcttcctttggatagattcttgaattgtccttcgagtcttgaggtcgatagaagaatcagtaacgcgctttgtgatgagaaggaggaagacattgagcgtacaatcagtgttatcctagggagatgcaaagctatttctacagagagcaagaacaagacgaagaagaataaaagagatttgagcaaaacctctgtttctcatcttctcaagaagatgtttgtctgtacagaaggtttttctcccgttcctcgccctatcttgagagacacgtttcaagaaacaagaatggagaaggtactactactaaataaagttcacaaccacgattttgatatcaattattttttctatgtctctaaccatttacactgtatatacagttgctgagaatgatgctacacaagaaagttaacactcaagcttcatcaaagcaaacatcgacaaaaaaatacttgcaagacaagcaacagctctcgttgaagaacgaggaagaagaaggacgaagcagtaacgatggggggaaatgggtcaaaacagattctgattgtgagtttctgatctttggatttcttaaaaagattaaactagaaaaattaatacatcaactgattccatttgcttcttctttaatttgcagtcattgttcttgagatctgaatatatggtccacttttcctttttcatgttctttcaagaaaatacaggtaaaataattgacctgatcagtgaatctttgttatattagctttgctcatagtactgaatcttatactaaatattctatgttttggcagatagagaatcttcacaatatcaagacaatttctttttctctctgatgaaaagtttttgggtctctctatctatctgcagagagcccatgagtccctttttttgcatggttgggtccataaaaccaaaacatgttttgggaactaaacatcagacatcgtacatgagatatgtatatgcatacatacatgtgtgtatatgtaaagatagatatatatgcgtacatgtatgtagttttgtattttcaggtggataacctttggtttctagaattcctgtctctgtctctttttttttttaaaactcttttttgtatctttcatttttacatggttttgtttcttcatgtatcacagaagagaactattcagattaataaatacttttatcgtagccttgtaaattattgttatcaatttatcattttgtaatctttgataggaatatcactaaaaccaaataatatccgtaaattaatttagaaactatgagtgtaactatttaatatatagaagtaaaataaacactaaatgagaatataacatttaaaaaaaaaacaaatttatataaattaaagctataactattaactataaacccattcttcaaatataactattaactatatttggtactacgtacttcataaaatgaaagtaaaatccagttttgatggaccatatttcacaaagcaattattggacacacgaacgaaggcccatcctaaaatcgaaatatataaaagttttgttacttactaaagtgtaaccctctaattaggctagaggcttcacttggaacacatgaacatctggagaatgatcaaggagcaatctttaacagccgtccgatcaaaccgacccatttgacacatctcagctctcactgacttcttcttcagtcatcagctctctttctcctctctttcttcagatctctctgcaacgaattgggtttacaatg

SEQ ID NO: 26839 - DNA, 3003 bp, Unknown; identical to SEQ ID NO: 26838
  misc_feature (1)..( 3003): 2750-1469P.txt file - cDNA_ID_2716324; gDNA_ID_2213667; Annot_ID_182134

SEQ ID NO: 26840 - DNA, 3003 bp, Unknown
  misc_feature (1)..( 3003): 2750-1469P.txt file - cDNA_ID_2716328; gDNA_ID_2213667; Annot_ID_132705
ggggaccaataagatatgcatgtttcctccaatgatgttagttcatttggtaacatgaatcgctattggactttcataactcccttagattatcttaattgatatattttatatgttgtataattgttttagaaccaacattaatggatgcatatactagaatgtatttattctaattatattaatatatcacacctatatatctaattatatatctatctatctataaatattataataataatatatttgattaacatacgttgttttttaaagtattttatacgtatagcttgtgcataaactatgatatgtacctagacggctagacccgttcagcaccgcgtccattcgaatttggactagacaatcgacccaccctatacataataatttgttggttcaaaaaatctcttggattttggtgcttaatttgctcaaaatagtactttggctacactggctagtgcatgtggaaactgatagtagccgttgaaagtcaacctgacccctttgggaaaaggattacaaacttagacccaccaaacctaacctttttaccttagaatacgtgtctttctcaccataattagtttgtttatctctagtaagaattggaactacaaaagtagtttatgtaattaacaaaaacaatgctcgtttgtttaagcaaagcgggggatgggaaaaatgacgtggagaatgtcgattggacctgagttcacgtgattgggagtggtgcggtgggctcaactctccgatgataaagcgaaactgctttttgttgctttccttttgtctcctttttttttcttccagttctctcaccctattttgttcctcatccttatttatgaattttaagataaaaaaatatatatttaagtaattaaaatgtcgattttttttataagttcatttgaattttttaggtttataagtaaaaatcaattggtcatgaatagattgatttaaaacgaaaagaaaagaaactaaaacgtattaacccttgtttaaatacctagttatatacaagcaaatcttcaaacgatattattaaagggatgatgcattagataaaacaaattactagcactctagcagtatcatcaatagtttatggtaataacccaaaccgttcaaccattaaaaaacgatattggtatatagatgtgcacaaacttggtcaacaaaagttcatgtagtcaattataaatcggggattagtataaattttcatacggctttgtattctatcgtggcaccgtggtgtgtaatgtaaagatgattagataagaaatgtgttacacgcccacaacatatgattcaattatttgatggaaaatatagataaaatgtatagagaaaaagtactagaagatgcgaaatccagaaggtaaggggacaatggcatgagttccttcgtgggatttgctttcttaatttcactctttctttctgtctctttccctcttagatttttctgaaattctctagaattttatattagctttagtgctttacataatttacatattatttagttcttttgtcaattagaattacttgtggatcaaactttaatgagcaaatatttctggtcaataaaacgcttcgcagtaagaggtcacaaattaaacccattttttcatatttatattttttgacgtttgatgtgtacggtaagttgaaacttgaaagctatattacaaacttgatttcccatattccttttcatgcatctactattactaacctagctagcaaataaaatgacatgtagcatattggttggtttataatgcatttgttgttactctcgagatttaaactcatatatacatttgttgacaaaaaagtaactttaaatagattttttagattagcgcttctaagttataactatacactgatttctagtgtaatttatgcattctagttctatatacttaatagtaacttttatacagtatttgtgtaagtagttttcaagtgaatttttttctcaacatatacaatgtatattacatataatttacgtgcaccttttaaaaatgaaaaattcgacgaaaatcacacacaacaaaatgtgtggaagcctctatatcttcgtgtcagcatagtaaccattcaaggacgatacaatttttctagggattcaatataatttccctctcctcttatagatagtcgaaaaatggtagaaaaaggaatatttgagactgtttgatgaaacgaagtgccaatatatgaattgtgatcaaagccgtgacgttatctccaatacaaaaactaatattcttattgtactccattaattaattgagctataatacaaattaaatacgtacagaagaatgtttctttgggcctcgatcgtttgcatggggataggtgcgttaatatgagtgctacgttgtgagctgtataaaagaagagtgtgggaataggttttatctgaacagaacttaaccaaaacccaaacaaattgaaagaaaaaaaaaacttttttccttcttccttgatcctttatctttttcgaagaagtgaatctggacgaagaactaaggccgccaattttggaatttgaaccatcaaattcatcaacaacaaaaaataaagatcttaatctttgaatttctacttgtatttaagcttcttgattcaccttaaacccgagttatttcatttctttttccacctctttctttgtcttcttcttcttcttcttccgggtcactaagacatgaaggttcgtttaatcactcatacgctctggttcattgatttctgatcacataatgtgttacattacttattcataaatgtttttttttcttttcagtttttcgggtggatgcagaacaagctacatgggaaacaagagattactcatagaccaagcatatcctctgcttcttctcgtaagttcaagattacgtattcgttgaaaacaaaaaatttgattaccaaaactgttgtccacagtccacttgagacatg

SEQ ID NO: 26841 - DNA, 3003 bp, Unknown
  misc_feature (1)..( 3003): 2750-1469P.txt file - cDNA_ID_2716330; gDNA_ID_2213667; Annot_ID_132704
ttttttaatattttttttgtgcaccggaaagtaagaatgatatttaagaaaatataacttgggaattgcatggattaagtctgggggagccggtttagtgtaatttaatataggtcaactcataaactggatgcatatatatacagtatccaaaaaaaaaaagatattacgtaatatacacataattcacatctaaaagtaagacattgacgtgacttgacttatgatgcataaaaaatctgcctggagacaaaaaaacaaaacaaaacattggtctcttgagtgctaaaatctaaaatgtatttatttagttcactagttctatgcgctaaatgggcgcaacaccgaagggtccaattgatattgtattaagccacgggcctcagtttgatttgatctgttgatcatttaaacaatgataatgggcctgggcctctgagagccagatcgagtattttatgtatatgtatcacatgttttagttattttgttgatatcatatgttagctttatcatctacttataagtgttggtaaataattaacgacatacgagtaaattataacacatctataggagaaatataatatacggatataaactagaaacatggcaaaaaaagacatacttatataagcataaaacaatttaattagtttgattcataagcaactttagaggaaatataaacttgagattattataataaccttgatcacgctttcgagatacttacaagcataaataatataaaactagttaaaagttttctcaaaattattatattaaacaaaatgagttggtcatgacacgcacattcatgtcgtttctcaaatgattgtactgagcttgtcagttgatgatacatatagttgaaaataaaatgttattataacttatgagtgtattgacttgaatcatcagaagataacaaaataattaattaattatatcataacgtagaaaaataaataaaattgagatgccagcagcaagcagtgttgtggttggcccgacgccgaatagttagtggttacaacttcattttataaataaggtaggaccgactcaaatcttagtggacctaaacctaaattcagtaattaaacaaaaactttgcccaattttcattaatccgcattactaatggaaagcatggcagacaacacaatccgttaaatcagctttttccctcaaccattaattaaaaaagctaaccctatattttaattttagtttactttgaatgaatctatttttgtgaaatactttggccaaattatgcaaaccaaatttgaaaccagtatgtgaaattgaatgatcaccgatccagagagctagaaatcagaatatacgaataatcgattaaagttgtttgtttttgtatgcgataaatgtgatttattgtacatggcctacatgtccaatgattttgttcgacgaatttatattgagcagtcgatcgtggtccgatgtcgacgtggagagattctgtagagtttttacattatttatttattgaaataaagtgataaatagtagtcaaatgatatttatactttactttcttacacataaaagtatatatattgaggtggtagccgaaatatccaaatccaagtccacactaatttatagaagctacatttgtcatgtaaattctaacattggaagaaaattaaatagtggtatagttggacatttttccctttttaggagtgaatgtaaatatacatggacattaaaactaacgtgcaaaacgtttttttggataaacttcaactcgtaatattttaaaacaaaatgatggagttattaagcaaaattacagaactaaactgtggaatgtaagaggttcttattttatgatcaaaacaacataataattgaacatcaatcatactgtttgtgaaaaaatctttagtttgttcatctcttgaagaataaatacattgcgagtaaaaacagagatgtggacgttttggaacgccatggttataaatatgaagaatttatgaattatgatgcttcagtgaatattcaaaccacttgatttgatcgatagaacttgaaaaatagaaaaataaaagtgggtgatttaaaggaagcataaccaatggagagaaaatgatagaactattcatcaaactgtcgaatttttgggttgatttgagagtgtgaattctaaaacaagaaaatgcgtgaaatattatgtctcccgaaaattctgaagtcttcaaaacattcaaaaaaaaaggtaaaacaaaaaaaaacaaaaacaaagcagttataagttctaacaatataaaaaagatgactagatttctattagatttcgacaaaaaaaaaaaaaaaaaaaaaagatttctattagattcataatttgtagtgttaagagattcgtctaaacagactaaatctaataacacatccactaacaaattcgcgtatgaccgtaggataatttgagccgaagcacatttgcttagtaaaaattgaatgaaccacaacctaatttatgtatttttaatgtcgttttcgtttgtagaaaaaataattttgacccccaaaaattatattctttatcaattgcaaatttcaactcaaaatgatacaaaacttccacacaaaaaaaatgttagttatttacttttccaccaaactattattgtgtttaaagtagaaacattatttagcttaaagttgaaactatttatactacccttgaaaagacaagaagaaatctactattccataaaaaccaataaaaaaattatctataaacaaatccgtgactgttgtggcggcagggatgctttccacgtgtacataaaccattggctacactatcccacttattaaaatctttatctcgccgttcctttcaccggccgattttaaaatccccctttaaatacggacctgataaatctctctttcactttcttcattttcgctctcaccatcgccggtaaaatctcgccggagaaaacaaaaagaatg

SEQ ID NO: 26842 - DNA, 3000 bp, Unknown; identical to SEQ ID NO: 10654
  misc_feature (1)..( 3000): 2750-1469P.txt file - cDNA_ID_2716338; gDNA_ID_2213667; Annot_ID_132702

SEQ ID NO: 26843 - DNA, 3000 bp, Unknown; identical to SEQ ID NO: 10654
  misc_feature (1)..( 3000): 2750-1469P.txt file - cDNA_ID_2716338; gDNA_ID_2213667; Annot_ID_182130

SEQ ID NO: 26844 - DNA, 3000 bp, Unknown; identical to SEQ ID NO: 10693
  misc_feature (1)..( 3000): 2750-1469P.txt file - cDNA_ID_2716373; gDNA_ID_2213668; Annot_ID_132736

SEQ ID NO: 26845 - DNA, 3003 bp, Unknown
  misc_feature (1)..( 3003): 2750-1469P.txt file - cDNA_ID_2716402; gDNA_ID_2213668; Annot_ID_132727
gaattcaagatcttaccttctttaattatctttttaaactactattaacctaattttcgttttaatttttgattagttaattctctaaatgtatctgattcgttctccatccaccacacgaaggattgatcctatccacgatggccattttctttgtaaaaaaccagcacctaattacatctaactattgtttttatttagagagattgtataagttatccgaatattattgttgttgtgtgttgactgttggtataatattaaaattgagctcggtttaaattaggttcgcgtgtgtggagttcatccataagagcaatcttactttaagagaagttttgatttaaggctaagggttcaaaagattggagagatgataacaatttagagttcgagttgattaaccagtgttgtattcattttaattaattgatttgttgttatgttaatatatatattgtgtgttatgattgatgaattgttttgtaatctcttaagatcataatgaattgttagcgtatggttgtggccgaattgtgatttttttttttttttgctaatcgaaatataatgtcacatattcatagatcataaaatctcttgttcaaacattctttggtgatcaaagtaacgtgaaatttaaggattccgcaattcaagatagtgaatagtggatgttgtcaagatactgaatagtggatgttgtcagtacaacaattgtgaacgattagaacgtccatctatctaccaagctatcgacatttaagtggctatagtgctagctatttaagtagttatgctatatgttggcttcaatttatagaattaagcttgttatgagttattattggaattaggattgtgattataattgtttttatatttgtgcaattataagatataccaatatattttaacaaaaagtaaaagaaaagaaataggagtataaatataaacgaaacacaaaatagaactgtttaggagaatataaaacttttacgttgtctctacctcttcaaattcaccaaatttattttttaaatagtttccatcacttgtcaatgtcacatcacctatcatctatctctctttttctccctctcgtcctttttcatcactttcatcattcatgcatctctgcccccattctctattttcttctatatttctctagtcaaccaaaaattttgccttaaggaaaccaaaagagaaatccaattgaaaaggatattaaaattaagggtaatattaaaaagaaaattttgggcccaacatcagaacaccattttatgactgtttctattgtcgactgtttgacaaactgaacaaacaatggctttgattggtgaacaaaatcaaagcactacaatttctacaatttataaatttatcaatcaaatatcaaaattgttacactgtttttttacagtttttctgtactatttttctttttcttttttatacatcattatgtaccatcttaccattataactaccaggtaaaaaacttgtaaatttttatattattaataagacccaatatatatatatatatatatatatatatatatatatataagttagcaatccaatggtcttgcagtctttcattattgtaatgatgcttattaggttttgtactaaaattaatgctaatcaatttagaatttacataataatatttagaatcatctgtttttgtaactatcttagttttagaactaaaaataaaataacccaaaaaaaactggtaagtactagtctctaatagctatgctttctttctacaatattatggtagtcaaattataaaaatatggggatgtttcgaatctttctaccgtaaaactggttgtgtccaaacgtatatatttgggatacaataaaataaaaaataagactattaagccaatgaatcataatgaggccataattttaaacgattaatgggctcctaaatatctatcttcataattcacactccacatgaatctattcctagtaaccctaagtgttttaataataggatctagagatgttcgaagatataattgcattttacttttcgtcgtacttatgacgaagcaagccttggacatctccgttttaaaacagggatctcatgatcttgaaaaggattcttcaagaagcacagaaaaagacaaattcgtatgaattattgactcatatcaaagttatttcatataaacaaaatcctatgaattattgacactagtcaaaactcaatgaacagattgattggccgtgaatgctacggtccatgaagggatcgagtgtggaccagtctctgcaatatatgttgttaggttgacttgttttcactagaatcgtatgtttttccaatccatcagtacgtttaacttcaaaccaccgtcaaatgaaagctaatttaaacttcttctttttttgtaatattttgtgtcaacaattgaatttgatccatggtgagagaaacctctaaacgccggagatatttgtgatgttttaacgtggtctttcatcttcaattgctagttacgcctagaaacatatgtgactttaaactatcagataaagacttataaaacacacttttaaaaagtcataaacaaagacatctaataataatcaacccttaattacacaaaaaataataatgtaaaacaatattagaatgatcaatttttaaaatatttagtttttttttttttttggtgatagaaactaaaaatttagactataagccgataaagctgataagcccattaagtataatgagaccctagttttcaaatttggactagacaagcccatttacggttttggtgtaacaccaaaaaatactgttcaatttacaataatacccatatatcacttcatcttcctcgaagaatcttcataatttttaattcatcctccattagaatccctagggttttcttccatacacaatcagactcaacgataagtaccaatcggagaagagatcacaagtggatgatg

SEQ ID NO: 26846 - DNA, 3003 bp, Unknown
  misc_feature (1)..( 3003): 2750-1469P.txt file - cDNA_ID_2716420; gDNA_ID_2213669; Annot_ID_132756
aagaagcgagctgttcttaaggatatcactaatgttacctgcgagaattcttacacaagttgcttcagtgttgcggttgttaactacacaatgcagcattttagaattgctaagtttatatgacaagaagtatgtttttgctgacaattgttgcttcttctttttacttaggtggagaatatcaagcagataaagaagggacgacagagttcttcttcttccaaggtggcatcttcttcggctacttcacaagttacagatgcaaaggtagaagttgtgtcaaattcagcaggagcaagcttgtctgtttttacagatacaagcttaggcacaaacgaaacatcctatagcattatcgcaaagccaagctccagatcgcctccaagaccctttgggacaggtgaattttataaatggtcatttactgaagcttgagtgggcaatgtataacatttctgatgcatctttattcttgcaaatggtttacagttgagagaagttgtggtggagcaagtagcccgaaattcgttgacattgattcagatgacaaagatcctctactctgtagcctttatgcacctgacatctactacaacctgcgtgttgctgaggtatttatcccttggattttgatatcttacgatgatgcatttgaggcatttgaatccttacgacttgtctacttatcagcttaaacgaagaccatttcctgattttatggagaaaacacaaagagatgtgactgagacaatgcggggaattcttgttgattggcttgtagaggttagttctctacttccagtttgtttgttgcttacttatgaagtctttttgtgtagcttctcacaactcaaaatttcaggtctcagaggaatacacacttgtacctgacactctttacctcacagtgtatctcatagactggtttctccatggaaactatgtggaaagacagagacttcaattgcttggcatcacttgtatgctcattgcttcgtaagttcctcatccacctaaaatcaaataatgctctggtctgaacacaacatctaaaagagttcttgcaggaagtatgaggaaatccatgcgccacgcattgaggagttctgcttcatcacggataacacttatacaagagatcaggtcctggaaatggagagccaagtactcaagcattttagctttcaaatttacacccccacttcaaaaacattcctcaggtaatcttaccagacagtgcaaatgctttatcatgtgttgttgctttttagtctttggtgattcagagtattcattcatttttgcaggagatttcttcgagcagctcaagtttctttcccggtaatgtgcttttcttttatcagatcagatatatctattgctcataaaacatgtagcagaaagattgaaactttgttggtaatttgtctgcagaatcaaagtctggaaatggagtttctggcgaattacctaacggaattgacgttaatggactaccctttcttgaagttccttccttcgatcatcgctgcttcggctgtttttcttgccaagtggacattaaaccaatcaagccacccttgggtctgtaattgaccaactatcttcttcattaagaaacacagcgaatcttgaatctcactcttgtttactttattttatgaacagaatccaactcttgagcattacacaacgtacaaagcctccgatctcaaagcatctgtccacgccttgcaagatttacagcttaacaccaaaggatgttccttaaactctatacgcatgaagtatagacaggacaaggtattaaaaaattattaatcttagtttggttttcttaaaccgaatgaagaaatctggtctgtttcggtttaacagtttttttttttttttttggcaatttacagttcaaatccgtggcggtattcagttctggagagctaccggacaagctattcatctcctaaccgatatgacacacgaatctgtagtaacatttttctgatggtccacattcatctgtctgtcaaataaaacagtgtcttcccacggtctctcatcattaccaagtaaccggattcggtgttagttcggtttagttgtagacaggtttggttctttcaaaccggacttgttcttgtcggtaacacgagttaattgtagtggaatgtacatttttcccccggtttattcaaggcaatatctggtctgcttcgaatattttatctttttattacagttgacagagagacaaagcattaattacacattatccaacggagaaattgtgactcacatagtatgtggcaagaattgctttttcgttttacgaaaaaccaataataaaaaattatcaagttggtcttcttcttcctcgttgctgatgtgtcgctctgcttgagagagtcagagagtcaagagagaaaaggggtcgagaatggcggtcgcaatatctgggagtagtttgatatcgtcgactcttcagcattataataatcggatttatatccgagattatccgattccgtgtcactcttctaatccaatttgcaattcttttaatttcaaaagacgttcgttctctccttcttcccccaaatttaacgaccatgtcgttaacccttcctcttcttatttatcctccaagctttctccaattcgaacccattcctctttcgctggtaaacgcctccaaatataatctcttttcttttcctcgcttccttctaatttttgaggtttgcttttcttttcttttgatgattgtttggctatttcgtaaattttatgcaaaattgctttagaatttcctcatgagattgttttattactctcctcgacgttctctggttgttttgttctcttgttgttgttgttgttaagggtttgattgtttccattgtgttggtttggctctgcaacttcaggttttcagattgtgaccttctttttttaattacgtgtgtagcgtgtggctgctcctggattcaagacaattcaatg

SEQ ID NO: 26847 - DNA, 3000 bp, Unknown; identical to SEQ ID NO: 10700
  misc_feature (1)..( 3000): 2750-1469P.txt file - cDNA_ID_2716430; gDNA_ID_2213669; Annot_ID_132752

SEQ ID NO: 26848 - DNA, 3000 bp, Unknown; identical to SEQ ID NO: 10700
  misc_feature (1)..( 3000): 2750-1469P.txt file - cDNA_ID_2716430; gDNA_ID_2213669; Annot_ID_182219

SEQ ID NO: 26849 - DNA, 3003 bp, Unknown
  misc_feature (1)..( 3003): 2750-1469P.txt file - cDNA_ID_2716442; gDNA_ID_2213669; Annot_ID_132748
ttcctccctcgttcctctgtagacactcgtgctgttttgatatgtgatgatgacgtcgagattgaccagagatcgttggagtttgcgttttcagtgtggaagtcgaatcctgatcgccttgtaggaacgtttgtgaggtcacacggtttcgatttgcaggggaaagagtggatatacactgttcatccagataaatactcgattgtgttgaccaagttcatgatgatgaaacaggattatctgtttgagtatagctgcaagggaggtgtggagatggaggagatgaggatgattgtggaccaaatgcgtaactgcgaggatatactgatgaattttgtagctgcagataggttaagggcagggccaatcatggttggagctgagagagttagggattggggagatgcgcgtaacgaagaagtagaagagagagtaagagacgtgggattgagcagtagaagagtggaacataggaagagaagagggaattgcattagggagtttcatagagttatggggaagatgccattgatgtatagttatggtaaagttgtcaactctgttggggaacaaggattgtgtcgtaaagccggcaaacttgtcttttgtgatcgagattgaccgttttttttttgtgtgtgtgtcaaaatatcgacactaataggatgtgtaagctcatcatcgtgtaatagaaattggcaactagcagcaagttaacaacatggaaaccaagttttgaaccaagcagtaaaaagtgtaaatttgagtttcgctaaaagaagaagctgggcttcgagaatattgtccgtttgtattgtaaatgggccttacaaactatacaggccgcattaacaaaatggaatttcaaattatgaaccaaactcaaattacgaaaatcgtaactaggattttgtttttttttaatataaacatagattgaaaagagatgtattagtctttttcgaaatggtaaatttgtagcgtgtgggcgttactcactatgtgatcatttttgtataaaaggaaacaggaagcttaataataagttcaaaaatggcgtggcaaaggcggagccgtcggaggatttttagtttacgagaaaaaaagaaaaagagagaaatatctgaaaaatacgggaaagatgcaggcagctgtcacagccgcaggtaaagagaaggtgtgtgacgtgtctcaataaaacaccgtttctctctataacacgattctgtcattatgtgtctgagcaaaagtgcctccttatttacatctctagaaccgtttactattggccacgtggaagatatcggtaccgttgcgttgttaaaaagggttactagtactcctcgtgaaatgatttggtcccacttcacaagtgttaatgtttctataagaaaaaaaagagaataaagaaagacagaatcgagaggagagagtatcggatcttcctaagccataaacaatgcagcaatacgctccatgcctttggatatttcttcggcaacttgtaaaactgacaatcggagccgtctctttcatcccacggctctcaattatcctctcgaccatatatatcatcgacaacgtgtatatatgtgtttaccaaattatgttttttattttatttttcaaaaaattgcactattaggtggacctacatatgggttcgattcgactccaataaacaagctaatgatgccgcccgatgaccattcaaatattgttggtagtggctttctcctaaatatttgcattttcttaaaagaccctctttgaaaaaatcataattgaaacacgacgtatcacctacatgcacctcttgaaaaatatttccattttattctcaacgaatgtatttattgatgtatattatttcacaacgaaagttcgcatatatgttttctaattggtccctagaatataattatgcgatattaaagttggatgcaagggaaaaaaagataattctgaaaaaaagataattctgaaaaggataattctgaaaaggacaaaatattcctctagaatgtataagagttggtcattttttttttttggggtgaaagtaaagagtttggtcatcttatttcgtttgacgtccttattttggaccgccgtcggaaataagcggtcaactctgaggaggatgcaaattcttttacgtttaaaaaaggggaaaaattgacatcaaaacaattgagtgtagatgactactttattattgaccaattacggaaattcataaattgaaatatatattttgttttgacattggccacattacacgaatattttttttaatgaaagtttatttttaataagttttttaaataataataataattatatatatattttttgcatttgtacccgaacattacaagttatgtaaaagtcgatgaaggcactattttaaactccctcagattttgaaaagccttgaaaactaatattttaattttaaaaacgacacgtgatttaatatagataaagtaatagccaatttagccaccaactcaaagaaaaaagttgtagccaccaactacaaaacctcacaacaacaaaaaaaaaaaaagaagaagaagaagtaataccaaaaggtcattacagtcatttgaagggtaccctcgagactatttctgtgttggctaccatgaaaaagctcacatgcctcaacagtcaacaacaccaccgtaaattgatctaccccgataccaatttgataaatgcgaaagattagcctttccttgcattaagcacaagttaaaacagtgagcgttaccacatttcatttacaagtgcaaaagaaaatttcaaaaaaatcctttccttttaccggatatatacacatcaccacatttgttaatattcaattggcgatactatattctttcattgcactaaccaaccagtctcctttatcatctctccatctcatcatcctcctccatttctctcccattttttcttctgtgtatctgcgggagagagtgaaatagagagatg

SEQ ID NO: 26850 - DNA, 3003 bp, Unknown; identical to SEQ ID NO: 26849
  misc_feature (1)..( 3003): 2750-1469P.txt file - cDNA_ID_2716442; gDNA_ID_2213669; Annot_ID_182214

SEQ ID NO: 26851 - DNA, 3000 bp, Unknown; identical to SEQ ID NO: 10753
  misc_feature (1)..( 3000): 2750-1469P.txt file - cDNA_ID_2716466; gDNA_ID_2213671; Annot_ID_132808

SEQ ID NO: 26852 - DNA, 3000 bp, Unknown; identical to SEQ ID NO: 10754
  misc_feature (1)..( 3000): 2750-1469P.txt file - cDNA_ID_2716474; gDNA_ID_2213671; Annot_ID_132806

SEQ ID NO: 26853 - DNA, 3003 bp, Unknown
  misc_feature (1)..( 3003): 2750-1469P.txt file - cDNA_ID_2716478; gDNA_ID_2213671; Annot_ID_132804
agcggggctaaactgaaaacacatgaaagtcaaaggagtagatgcgaaacgctcccccagtaattagcggaaatagaaaataatggaacgcaacggctagtgatctcaacggtcgaaaatttaaacttttttataataattgacagacctctctcttttgttaaaatcctaaccttgttctcacattaatcctccgccgagattccttttgtcttcttcttcttcatcttctccatttcaattacaaagatgatgagagatgttttcaggccgactaaatcagccccttgttctcctgcaaagccacttggtatctctcgcactcaatctgaatcatttcatgctattcacaaagttcctgtcggagacagtccttatgtcagagcaaagaatgttcaggtgatttgattatatcccttctatagatctgaatttgtgtttgatttgatttttgttctgtctctgattgttgttttatggatcagttagtggagaaggatccagagagagcaattcctctgttttggaaggctattaatgctggagatagagtggacagtgctttgaaagacatggctattgtgatgaagcaacaaaaccgcgctgaagaagccattgaagctattaaatcactcagagttagatgttcagatcaagctcaggaatctctcgacaatatcctcttagatctctacaaggtccgtcctttatacataaccctgtttcctctgtttcgtttttgcatttggtttgattctgtattgaaatggatttgttactgcagagatgtgggagattagatgaccagattggacttttgaaacataagctcttcttgatacagaaaggactcgctttcaatggtaaacgaaccaaaacagctagatctcaaggcaagaagtttcaagtctctgtggagcaagaagctactcggttactggtaagcagcaatttcaaaatgtgcattatgtttagcaattaccaagtttgtgttaattcttaattggatgatgattggtttgaaacagggaaacttgggatgggctctgatgcaacgagacaactttgtggaagctgaagatgcatacagaagagctttatcaatagcaccagacaacaacaaaatgtgtaaccttggtatctgccttatgaagcaaggaaggatcgatgaggccaaagagactttacgacgtgtgaaacccgcggttgttgatggccctagaggcgtggattcacatctaaaagcttacgagagagcgcaacagatgctgaatgatcttggatctgagatgatgagaagaggaggagatgataaggttgaacaaagaaggctctttgatgcaatctttggatcttcctctatatggcaacctcagccttgtagtgagcagactgtgaaggctaaaccaaagcctggtttaagcaatggtgatggatacggtgatgagaacgtgaagatgagtgtgaatccagtagtagtaaacccattaagggttgatgcaaaaccgttcttctcttcgaagttggtcatcagtaacaacgagaagctgaagagaacgagatcgtcgagccaagggatggggatgttgagtggtattggtggtgatcatgagggagagacaaacacaagcacgagaaggagattgtcaatggagaagaaagcaacggagtgtggattaccagacaataaagactttgaagatgcgatcatggctgctgttttaggaacagaaaccaaagtggacaagaagaggctcaaggtgttccaggatatcactttgtgtctcaatcagagtctctaaccactcttatcattttatcattctaatttataatttagtcaaggaatcaaaaaaggagatgagcttaattcttcttggtaattttattaatgtttttgtcagctttaagttgctgccatttttttcacaattattgtcttcattgaccagtaataaaagctgaagttattattttccttgccattctacaaatatagttattgatcaagaatagtgttgtaaaatgttactaaaatctaatgagatagagagaaacaaagaagatgaagatgacatgagtggttaccatgaatatcccattaattaatccatcagaatcttatttactgcgttaccattaatcagatggttgctcttactctttttattcaccactcactcaacttttgtggtcaagtttgtagcaaattaggggtaattagtatccattaaaccaatcatttgtatctatcaatttggactcttctgcttccaatttgtagtaacgcttacccacacttttaattcggccaaaatacatccgttgaaattgtataaagttccggaagtgcccctcttattttattaaccatggcaaatgaaacggtgtaaaaacttgtttttttcccacttaatctctctctatttgaaagttatgcatttttggtatccgcattaactcgagtcttttaaactttgactgtcagaaaaaggcaaaaaaggtaaatttgttttgataattccatggtacattttgtaatagaattgagaaataaaggatattttagtcaaatggactgttttggtttttggaagaaaagaaaaaagaagagatttaattggaggaaagggctctctgaccaaagcttaaggagagtgtgaggttaaactgaaaaaagaagaatcccaaattccaactacattcctcagggaagccaaagtggccttcacaatcctaaagttaaaactcttgagtgttttttttcagatcaagacaaagtttagatcttttctttttggtttaattgttttgacacaaacgaggtaagcacaagcagaagaagaagaagatagagtttgagttcaaattagatttgttgagaagaaaaagagtgatttttgttttctgatgcatggtgaagaagaagaagaagaatagtgagtgagagaaaaagagtgattttttcatttttcagacagagagtgagtacttgaagaaatg

SEQ ID NO: 26854 - DNA, 3003 bp, Unknown
  misc_feature (1)..( 3003): 2750-1469P.txt file - cDNA_ID_2716482; gDNA_ID_2213671; Annot_ID_132802
tggagttttaggccaatgtagctcatcttgggcccagtacagaaataaatccagtgatgattctttctgattggctggaaggtgtgtgtacgtgaacctgtccgcaggtgattaaaacagagctgggcttttggcttgtcgcctaagtcgggaatcgtttactgtgaaataaaaacgagagagagtttttgaagaagaagaaagaacactcacaagatccagaaaaaggtaaaagatggcgagatacgatcgagcaatcactgtattctcccccgatggtcacctcttccaagtagagtatgccctagaagccgtccgaaagggtaacgccgccgtcggagtccgcggcacagatactgtcgtcctcgccgtcgaaaagaaatccacccctaagctccaggattccaggtattgctccgatctctaccgatacaagatgcttaaaccggatttagtccatttacttttgtttctgcactttgattttggttttaagcttcacctggatagctcgcttgatttactcaattgctacttgtatgatcactgtttcaatccttctgaactaaatcctgatgttgggattttgtatcacttcgtaattgcgaatctagtattgttagatcgtagaatctgagctgaaccctagtttaagtctttttctctacgagtgtacaattacagttcctgtatctcagacgtgtttttttgtataagaacacgtttttggttatactctgcaaattgatcattcactgcgtaaaaatataattttggtgttgaacttgctgaaatctaagcaatatcgtcttcgtatctgttggctgagctcttgctccaatagatctgagtttttttacctattgttatccgtatataggatctggttggtgttccttcccaatcatatgagttttgataatttttttgcttctcagatcagcaaggaagatagtgagccttgataatcacattgcattggcctgtgctggactgaaagcagatgctcgtgtcttgataaacaaggcgaggatagagtgtcaaagccacaggcttacgttggaggacccagttactgttgagtacattactcggtacatagcagggcttcaacagaagtatactcaaagtggtggtgtgaggccttttggtctttccactcttattgttgggtttgatccctacactcgtatacccgcgctttatcagaccgatccatctggtacattctctgcttggaaagctaatgcaactgggagaaactctaactcaattagggagtttctggagaaaaactacaaagaaagcgctggccaagaaactgttaagcttgctatccgtgctctgcttgaggttagtttgctctatcatgttctataactaaaccttgtagttttcttttgagctattgtcggggtgccctgttagtgaatgttctataactaaacctagtagttttagttgacaatgagatctgacctattaattattttgctgcgtgacccggtgattttgtgagcaacatgccaaactttgaacctcattatgattcttcattatttataggtgtggctttaggttaaaagtgaatgttagagaatgttaaagtttttgaaaatgtagaagaccttactaattgagttggattataatgttagatgagcttacttagcaaacgcacaagtagtggtggaacttgtaaagaagctgaaaaggatttgcattttgcaggttgttgagagtgggggaaagaacattgaggttgctgtaatgacacgagaggaaggtgttctgaagcaactagaagaagaagaaattgatatcattgtggctgagatcgaagcagagaaggctgcagctgaagcagccaagaaaggccctgcgaaggaaacatgaaccagatcttaaagtagcggtctcagattatgagttgtaatgctggttcaaagtcagggatattcaagggttgaatagaaaatctagaccgcatgaaatggtttgttggattactagcctatttgacactgttgctttaaatcttaaatgacattttagcggagtttcgatacttgtcagttggaactatggcatgttcagtattctagatgactttgcatttgcgctcaagagttgtagattttgattttggaaacgttgtttcttactaaacatgtctctcttcttattatctccattgtgtaacttaccgtttttaccatctttgtacctccattaacttgttcaccaacgaataacatgaagagaacaacattacaaagtggaactgacataaactatgatcaccaaagtccataagactgccagcaaccctgaagatagttagttgtagtttgctgaaccacaatggttttgaatcaaacgaaattccattaccagacaacaagatgctagccctttcttctctttagctttgtgtgtcaccattgagacgattacctcaaatgacgtaaaggtatccccaataaggcaataacgtaaaggtaacgttaatgatgttaaaaatcttgaaaaacaaaaaagacgccgttgccggggatcgaacccgggtcacccgcgtgacaggcgggaatacttaccactatactacaacgacctcgttgttaggatatcaaataacatggtattaatacaatagtatacaaagatttttctaaaagagagttgaatcttgtgtctaaaggattttcgagttcacaaaaagaatttcctcgctctaccgccgccgtctctcttctctcaggtaagctacttcagtttctctgataaacctattttgctctgttcttgtccgaaactttaccgtatctagtcgatatctagtttaggtgagttatctgttaaaagtttttacctttgagtggtattgtcggtttgtcgtctagggttgcattcaatatcacagcaatttgagaaattgatattttattcagcaaggttgaatcatcagagaagaaagggttttacactgcggcgtaaaggatg

SEQ ID NO: 26855 - DNA, 3003 bp, Unknown
  misc_feature (1)..( 3003): 2750-1469P.txt file - cDNA_ID_2716486; gDNA_ID_2213671; Annot_ID_132801
ttaaaccggcgggagtacacttttatttatagtctatttttacgccacgtcatctctaccttgaaaaattgaaattcatcatttttcttcctccttaagattttttttttttcttttctaattaacgacaacacgacgaagatgaatccttctcacggtggcgacgacaagcaacgaccggcgatgtatccccaagttgatcaatccattcctgataatccttttgcttctacaaatccttacgtcgcttcttcaccttatctatatccttctctatcctctcataatctcggacctaatctcttcccagaccacggagatgcatccaacgaccaatcaccatctgctcctcctcaggcgacggaggaggttctcatccgtgttcccggcgctattctcaaccttatcgacaaatcctacagcgttgaactcgcgtgcggtgatttcaccatcgttcgaattatccaggggcaaaacattgtagcggttctagccaatgttggaaatgagattcaatggccgttgacgaagaacgaggttgcagctaaggttgatggatctcactatttcttttcgattcatccgccaaaggagaaaggtcaaggatctgggtctgattcagatgatgaacaagggcaaaagagtaaatcgaaatcggatgatgagattcttaattacggattgaccattgcttcgaaagggcaagagaatgtattacttgtgcttgatcaggttttacgagactacagttgtttcacagagcagagaatgtctgaaaaagccaaggagactggagaagaggtgctgggaaattcagtggtggcggacacttcgccggaggagcttaagggtgagagaaaggatgttgtggaaggtcaatgtgcggcgtattggacaacacttgcaccgaatgtcgaggattatactcacagtactgctaaaatgatagcttccgggtcaggtaagctgatcagagggatactgtggtgtggggatgtaactgtggagagactcaagaagggaaacgaggttatgaagaataggcttagtcgtgctgagaaggagaaagatgttagccctgagacactgaggagaatcaagaggtatggttatacttaggaattttgcatctttgaccttgaaaataactgcttaggaatctagtagggattctcttatctggttccttgtttcatgatcattagagaactgagtagtaagggatgattattgtttgcagaagaccaattctatgagcagtgatgaaatttcttgtttaaaaatgtttgaacattgtgcattctcatggtagtatatcttgaatgaaatcaatttttatgcctttgcttatctccctcatgtggtttctatctaaagggttaagagagtgacacaaatgacagagaaagttgccactggtgttctttctggtgttgtcaaagtctcgggattcatcactggttcaatggcaaactcaaaagctggaaagaagctttttggtctcttgcctggagagattgttctcgcatccctcgatggatttagtaagtagattacttgtttttggtttctcatatttcctatcccatgcttggagggtcataaaagcttcttgattcacgagttgccttgctttctttcatctcacttgaatacatgttttgacatgaccagcattacaattattgtttatccgactttccctctgatggccattcccataatttttccaatttttcgaatatgacatttagcagaagttccttgatatagtgtattagtgcttggatctgcttcttgcattgaacaagttagtctggtggactttggagcattattctttttgtgggtttttaatttcaaagttaccaaatgttttgtaatcgctggcttcccttatataccgaacccttttttgtttaaggcacatgggattagtacccttcttttcatgtttacttcttgttgcaggcaagatctgtgatgctgttgaagttgctgggaaaaacgtaatgtcgacttcatcaactgtcacaacagaattagtcaatcacaggtattgattagcaaaggcatatataaacaatcacatatctccgcatgagtgatcttcagcaagagtgatcaaagtttccttagatcttaaagaaacctcatggattctgtttcgaaattacaggtacggcacaaaagcagcagaggctactaacgaagggctagacgcagcgggacatgcatttggaacggcatgggttgctttcaagattcgaaaggcatttaaccccaaaaatgtcataaagccttcatcattggccaagtctgtttcggaactaaaggctaagaaaggctccaagtaaacactaaacagccttcaactgttctgtgttcatctaaacttgcatttagtttttcattttggaaaagtatatgaagattgattgatgtaactctatatttagttttctgtgtatattgtgattctatgtaaactatataaacagtttcttccaatcttctcccatttatgggtttgatttgtaacttcttaatgcatcgagaagcagtattagtactctttatctttcttttgtactgctatttcttaccgctaactctcatctctggtgacttatcctgccttcgtttaccttttttagtgtttgcttagaaacactaattgcacctatgttatgtattctaccagattaatttgacaaaaaacaatgttaggagttttaatgttttgaagaagtgggccagatgtttggagttttaggccaatgtagctcatcttgggcccagtacagaaataaatccagtgatgattctttctgattggctggaaggtgtgtgtacgtgaacctgtccgcaggtgattaaaacagagctgggcttttggcttgtcgcctaagtcgggaatcgtttactgtgaaataaaaacgagagagagtttttgaagaagaagaaagaacactcacaagatccagaaaaaggtaaaagatg

SEQ ID NO: 26856 - DNA, 3003 bp, Unknown; identical to SEQ ID NO: 26855
  misc_feature (1)..( 3003): 2750-1469P.txt file - cDNA_ID_2716486; gDNA_ID_2213671; Annot_ID_182314

SEQ ID NO: 26857 - DNA, 3003 bp, Unknown
  misc_feature (1)..( 3003): 2750-1469P.txt file - cDNA_ID_2716508; gDNA_ID_2213671; Annot_ID_132791
ctttgttttcgagagattccaaactcctcccaatgcagtccttgtcaaaacagcagtcacgtttgcagttcttggcgttctaaccgttctgttcccgacagaagaaggaccgaccttgcaggttttgttatcactaatagctaccttttacttcatccaccaaaggctccagaagaagctctggactttcctttacgggtaataagctgatcttaattgtaaaaccgttgctacctacttgattagaatccacacctgatcaggttgatattttgaaacagagcgggagctttcatcttctcgtggctggttgggactttcttgatggtatctgtgatcccaccgttcatcaaaggaccaagaggttttgaagtcatgtcttcgctcctaagctatgttttgctttgggtcgcttcgagttacctccggtagcgtgctagcttttttcttttccccgtcttttgggccagaaattcaagtgttatctcggatatatgaaaacacacgaacagagaaaaaatgcatcattttcatgtgacagagagagagagagagagagagatatgatttgtggtcttggagttgttatttcacggagacctcattaactttcaaagctcagtttccaagttgtggctacaaacaaagaatagtaagagttgattacggaaattagtcggatactagtctgatttcataggaattaggaaacatggcctcatagcacatcatgtgctgtctcatacataataactatggctgcatgattttgtccatggcctcattatatgtgcatggccctcttatttatttctgtgtctaatttatgtatatctccaccgaaataataaacattttagatcaaaaccatttgtcagcctcacgattaatttttttctttcttatcaacataattctttttttttggcaatgtacggccttccaaactagtgaacgttgtaaaattgggctatcattagaagttcaataatttgaaacgctaaaaaggttggctaacgcaaattttggtcgtttcaaatataaatataaggtttatttattaattaatccatctagatgattaactagattggtaacgacgactaatctttagacgatattttcattgaaccactttatgtatgttagtaagaaaaagcaaatgcacatgccttcatgtgctctgcttcacttatcaatagtgaactaaaaattcgttaaccataccttaaaaacgcgaaaaatgtaaataaatgcttgtataaaatagttgcttgcaaaatcatataatttattgtgtggtactgatgtgatgtaccattaattaagatcgaaataatgtgtgttcatcataggtgaccgtttaatgatgtgattaatcaactttagactgattttggattaaaacattattattagataatgtgcataattattttttggaataagaaagatatggcctagacaaagtcattattcttttttgaaaaaaatatgtggataataaaattgagacacatttatggcatatattattaatgaggagaaatctttgaaattttgcaatttggttattaaaaaaattggcttcatttggtaaccttttaattaagctgaaaccaaatgtagataaattacagaagctgatccatttttttttattttttttttaatattcttggacaattgtctgatttacgagcaacaagagagagtctctctacacaaaaaaaaaatcattagctgctctaaatgatgctttctttagcgcgctaatataattagctaattccttaattgtaccaatgaagacgaagaaaacaaaaagccattaacgatttaacagctccacaattccgactttttttgaaaacacctgaattattttttatcgctgtagcgaaagcgaaataggtcgcctgagaaatctctggtttctccgaatcgcctccttagcatcgttcctccgtcggaacaccgtcgcttctgccattgttctccatctcgcatttggtctcgtttctcagatttccatacctcattcgctgattcgcaggtgagaacaaattcgttgattgttcttgatccctttaccggattttatgattttgtggcattggttcgtcttaatgctttgcggttccggtttctagtagaactacgcacgatggttggattttggtagttttggttttgaattttgtgagattcgttgatttgaagttctagtgtgagtctgtgagccggtgaaaggaatttctgagctcctcgccgaaacttaggttcatgttccggcgaggcatgtcacactattgaaaggatttgaaatttgtttgggtgtaattgcgtcgtgttcgttattatattagtactttcttggatcttacggctaagtttgtgttggattttttgttctttgttgtttaccagagacatgtgtaagtagtcacaaactttgtttcctcactgtgcacatggagttaccaaagattcttggctccacattgaacattctgcagaaacggctgtgattattataatatcaaatctgttaaggtaactgatttcttttgtttaagtgttttcttgtggttttaggcaataaaatatgagcgtaggcttgaaacttatgcaacatgcaaggaagactttttgacagactgtttaggagggggaccattgcgaaaacacacaaaatcctctccataatattatatgaaacttgggtttctttatgtctcaaacaatgatgagaaaaaccatgttactgatttcgttgtcattttctgctgagatattttggatataaaacacgtggatagagacaatgttcttctgccaaagacatgaatatagacaagttgataagtagtctgatgatctttagtgattgatttgtcctcataattcctgttcgctctctctatatgtatgacattgctttgttcttgacctggtttcttttggggtaggatgcgggaagggaggtgacgggtgaagatg

SEQ ID NO: 26858 - DNA, 3003 bp, Unknown
  misc_feature (1)..( 3003): 2750-1469P.txt file - cDNA_ID_2716512; gDNA_ID_2213671; Annot_ID_132790
acagatggtcacattgttttaccattaatgtttgaatttgttctatcaatgtttaatctttttaactattgcaggggctatccttcgagtttccaattccaaaccagtacacggactgctgccatgatggagaaggtttgttcttctccggactccagtgaaattttgtttatattttttgtcttgtccgatatctaacttctcagatttttttttctcctttacaaagcggcactaccgttagagtttccagatggcaccacaccagtaacatgccgggtctctatatatgacaactcaagtgacaaaaaagttggtgtcggaaaattgatggatagagcttctgttcctcctctacctcctggcagtctgtatatggaagaagttcatgtcaaggtttggcttatcttcatttacactcgttcctctttgtgtattttaatatctcgtagcctaacttaattagcagttaaccggttccttactcttcgcatgacttaatttaatatttatgcagcctggcaaggaactatactttactgttggaggccagcatatgccttttggtgcatcaccacaggtaaagtctgtaccttgtcttattttgcttcttctttgatctttggaactaatcatttcgtgcttcgagcaggatgtatggactgaattaggtcgaccttgtgggatccacccaaagcaggtgatctataccgtatctctaaacttgtttgtatatcacgatcagatgcttccattagcttctcttactatgttacctgcgttatctgttacagttcaatactcaactggacatttgtatttctgcttctgaattgtcctttgctttccaggtagatcaaatggttattcattctgcgtcagatcctcgaccaaaaacaactatctgtggtgattacttttacaactattttactcgtggtttggacatcctgtttgatggcgaggtaggaaactcatcaactagagttatatgttccattcgtacgttttctttattcacaactctaccttttctgcagactcacaaagttaaaaagtttgttcttcacaccaactatccgggtcatgctgatttcaactcatacataaagtgcaactttgtgatttcgggtacgtaatacttatgaagcagctcatgtcagtcaatatattcaatactcgatatatgttgtctatttttccaacaaacctacgctttcatgtcacttttcagctggagcggatgcggcagaagcaaacagaagtggaaacaagatcactccaagcactaactgggatcaggtcaaggtaaatcttcagaccaatgtgataaaagcagaacagaaaattgaatgaaaaactagtctatgttagggcttgaccaattgttcgtgagagtttttactgacgtaaaatctctttaccatcccatcattgatggctctaattgcgtaatgggaagaaacttgggatgaagcattaggaaattgatctgaatagttaaatctgggatcagaacagattgaatgagtcatttctcatggaaatgtctttatgcttaggaaatactcggggaatgtgggccagcagctattcagacgcaaggctcaacgagcaacccttttggatctacatatgtgtatggctatcagaatgttgcttttgaggtaatgcatttttgtaataaccctagattcagtaactttgatccttgttatatacttgcagactgttaagtgaaactttatgttgggttaaaatatttgcaggtgatgaagaacggtcatatagccactataaccttgttccagtcatgatgcgtatccaccgctgaggtatatgcccgttactaattcttcgtttatgttgaatttggtcgtaatgaatattcactgtttggttttgtagaaaaaatggctcagattaatgtcttgtgttatatgctacttaacaaagcttcttacatcaatcaatgtctttgtaggggctcaagatgctatcttcaaccagactctgtaaatctaacgtcacaagaagctacgaaaactatcgatgataccaaaaacgacaaatgttgtacagttatacatttgtctagttactatcacccgggttataataacagttattctggttataattcttttcagactttattatgactaattatatatcatttatctgttaaaagttcataaaatagcctcatcatttgagttttttgcggtatcgataaattttaaggttttaaaaaaagaaattgaaaaaacaaaaaaaagctccgtcgccgggactcgaacccgggtctctcgggtgagagccgagtatcctaaccagctagactacgacggaatgttgcctactgatgacttaaattttatatagcacactactggtatagtcgagaaggttgtgcggtatctcttctatccgttgcgtagcaaggttttgtctttcgtgtatggttccgggaaggaaaaggggaagtggattgttttcatcggcgataagtctcttctcctctggtacttcttctttcgattctcttctcttttgtttcgggttccacttagatactctgtagctgctttcatttcagaattggcttttggttcaatccattggtagtgcgagaacttgaattccgaaatagttccgatttctcttcagattttggatgttatcttgctaattgagtttagaatccatagtaatagtgcgattattgatttagcggttgtttagggtttaagcctgtttttcatttgattttagggattgaggttggtggtgtgaggtaaagcttcggtagttagagatgaatgcgtccggcttaactgttactccgcccagatttcactttcgatggcgttctgatcgttttggtacatctcagagaagctctcaagcttttactgttcttagcaaattgaataatcgaaattccgcttggcctgttcttaaaaggtagtgttttttggttattgtttcatttagcatatg

SEQ ID NO: 26859 - DNA, 3003 bp, Unknown
  misc_feature (1)..( 3003): 2750-1469P.txt file - cDNA_ID_2716516; gDNA_ID_2213671; Annot_ID_132789
aactcgaacctcgattcttaaacctccatagatagctatttttaacattaccctcttgcttgtttagaaattgagtagctctaacctatgagcattaaccaacgcataatcgatacttagaatctcgataatgagatacagaacataatagaatatccaaaaaaaaactacgaaattaagctcttcttcgttgtgaaccaactaaaacatatggcaaggctctaatctcccactagagcatactatctaacagaattattatcactataagctaacaatcacttaccggcgatcacagagaacaaggtctccaccgtcgaagcaaataaagcaaacatcttcttccttgtcttccttcttcggcggcggtgggggtggacgaatatgcaacggcgtattagcctgtgcccttggaggcctcccccgttttcgttttattggggcagcttcatcaataactttaacctcttgctcattggacataggcacagcaaccgccccagcaaccgtggaggcaggtacagagagagcaggacttggttaacaccgatctcttcacattgatcaactctcataagatcgattcctctgacggaactctcttcgcgaccagccaaagaagccaactccggcacgccttgctggagttgcttctgttgattctccatgattagtgaagaatttgaaaaaattgtgagcagtacttgcagatcaactagtgaaatagaaaccctaatctgaggttctttggggattttggcgatgatgaatgatgatgatgatggagagaagtatgggtgatgtgtttagaaaacgaagactagtgggaagaaaaaatcatatggactttttttttcttcttctattcttttccacttctttagttcttactttgttatgaccaaatgtataacaaaaatgttgtcacttctttctgcttatagaatttttattatttcaaaaatactagtaccaatttctacagattccaaaaatactataatttctagatttcaaattcatttctaaaatcttatgttagatttcctagcttggttaaaccttcaaatatttatccaaaaataacatttgagttaagtagatatggaattccagcttattaggtagatagttattttcttaaaaaaacataggtagacatctatttgtggtgtccaatttagcaaaatatatggagcattttattttattatttaagaaaatatgatattatgtaatatacaatgttcatatacaataacgtaaaatttatcaacatcatttaaaaatcttacctacgtaaaattccttggccaaaaaatattatatagtattaaaaattccttggcatattcttgaatgttttgtaagaaaaacatgacaagaaaaaatgtaaatttggttacattccacgtaaaacttctacctacgtaaagttacttcacaaaaactaaaaatagaaaagttatttgtattcactatgaatattcttaaataccaacacacaacaaagaaatcatattcttgtatgttttaataagaaaactgtgatgcgaaaacaatgtaaattttgttaacagtccacctaaaaaccctatatttgtaaagttgcttagcaaaaaaaataaaaataaataataaaatagaaagttatttgcaaataaccttctacaatttgggtagttactatgatttttttgtttttttcaacttggtagttactatgaatattcttacatattaacaaacaacaaacaaacaaaaaaaaaaaaaaaaaaaagaatccaaccaagaaatcaagtgtggaggataatagaatttttttttgactcaatatgttctaagttttcacatcattttacgcatttcacacaattagtatcccaaggttgaagaaacaagtaccttaaaacatctatttactaaaataaaaacataaaattgtaacccaaaggagtgtaatctcatagaaatttcatgatttggtcatctatgcttgaataacttcattcgcgacactcacatggtattgtaggtaggctttgtacctttgttgggcattgttcacgtgcatgttagacttcacttttgttataaagttttgaactttgatctttttgtttatagtaatatattatccttttactatttctaataaaagtatacatcggtgatattcggagtcttacaaactttggaaaaaacacattttctgttaaaactacattttgtagatttatattttctttgaagttttcaaaattttgtagatgacatagctactgagattattgtagtcaaaattcaatttattttcttttaccttgaaggtactattcaatcgagtcaatatctttgatttatgatgatgctaagaagtaaaaaaagaaacgagctaacaaggaaaaaagagtacaatccaacgtgagggaatgatttcagatctcaaatttatttggttagagtgcttaaatatttgtcaccttacaaattaaagatttctaacacacaatcttctcaactaatgatgttaaccacaaaaccgtattaattaagtgtctgcagaacaacatcacataatttatgaattatttaacaaaacattaagtatatatctctaattatttttttgaaaaggtgtacatttttagtaaccagagaacaaaattgtaatggtaggcagctagagcatatttttcatatttgtacatttttacatggtcaattggtcattactcattagcttaattgaaattatttctgcctatatagcttaatttttcgtaaatttattagagggagtaggtgttaaattctgattggtggggaagtaccatcatatatggataggtcaaacaacaacccaaacccgacccgtgcagcaaaagtttgtaaaaagaggaactaaagtggacccgacttaattcagaacttcagaaatcagaaagcaaaaacagaattgtgtattattctcttctattcaggaaattgatccaacaaatg

SEQ ID NO: 26860 - DNA, 3000 bp, Unknown; identical to SEQ ID NO: 10738
  misc_feature (1)..( 3000): 2750-1469P.txt file - cDNA_ID_2716520; gDNA_ID_2213671; Annot_ID_132788

SEQ ID NO: 26861 - DNA, 3003 bp, Unknown
  misc_feature (1)..( 3003): 2750-1469P.txt file - cDNA_ID_2716528; gDNA_ID_2213671; Annot_ID_132782
cctctctttttctcctccacgtcaactctgattcccaccttcctctatttatttaattataaattagtcttccttatttcttcttaattagtattctcttatttttattactcctgaattctaaattatattctgaattcctgctatgtcattttcttttattttgggtcgaatatctatctctcattggcaatggttttgagatcattggcctattggcaatggtttagaattccttagaattattgtaacaatgatttcagaattgaaaaaagctgtttactaactccatgcattttgaatttatttgagggaagaaaagctttcgttggattttggagtattgattgacagaaagcgcctagagaattgagtgataagcaattttgttttatataaacacttgcccccaaaataaaaatattttttctttaataataaaaataataaataacgacttagaaaaaaagaagagaatgttatggacaaaaaaagagactgtggttagactgaaaaacgcgtgcagagaggccgcgacagtcttatcatcaattaaatttcttcttaattagggtatcctaacttgcattttactctcagttacgttctacacagtattacttaattattcatattatacacgtataggtttttaatgcatacgtgcaacgttgacatgtagaacagattttgaaaagagaaattgtttagtataagtgttgtttcgataacatcctaagtttcgtcatagtccaaatctactccagattcataggcttctcagttccatccatctcttattcaaattccatacaaattaaaagtttttttttgtgaaactccgttataaattttgtgtgttggttgctggttggttctgcctgaaactattattccgaaatgatgcttatacttatttgacatttatatatttttgtaatgtagcaaataaagaatagactactggagaaaaaaggtcttttttttttttttgtcaaaagagaaaaaaggtcattgtctcgattgtaatgtatccatcacaaccccttgaattaattgattccctctattaatctagtatactcgaatattttgtggttttttacttacctctaaaactatatcgatatataatgaacaacctaactattgttttcaaattgagagcaataataatcattcgattattaacttaaattattggatttgtaaattaaatcaagaaccggtacggaagcgtagggcggcgaggcaatgcttttaccctgtctcaaactattcattattcccattttgaatcttaatacttttgaaatgtctcatttaaccccttctacattagtcaactctctctactcttttggcaaaatccttttaaacgtccccatcttttactttatttttatttcatgtcctaacttttttatttatatgacacccatacatacttctctagatttcggatttatcgggacatattttttcgtgccgttattctcaggcaattcaaaggataatacctaaaaaaatactcagctaattataatgattagttaaattaggatccatgatgctcacggcacgggcatagaggtgtgtttgtctgtatataaattctgtaaacatttagtagtactattatacaaaaagataatgcagtaacatagggcacctcaacaaaatcgtacgtttgtctctctacaagagagagtatgtttacgtgcatttttatttatatataaaatattactgtgatatactactagtatatacagaaatgtgtatatcataatgtttttcgtttcctcggaaacatggacaaaagcatctgcttttcagctacaaactttaaacacttaatttaagccacaggtgcacccaaattaatattttttaaaagaagattatgggctaatggatgattaatgcctataatttgcaaatcctccttactttaaagtaattagttagattatttaatccacatgtttatctatttgatgaggatttttgaaaccttgaagtaccttacattttttcaggcatttttagtttgctgatgctcctaactcgtagacaataatatatttgcagcatttgtcacaattagtctcatagtcactcatatatacacaaaatgaaataaaaatgaatggacctatggacttttgacaaggttttgtagtcagttctagatcatgattaggaggtctaattaataggtcccgaaatatatatagaactatcttaggataatcaaaaatagtattctgataccgtaatgatattatttttactcctttttaaggaaaattagttattcacattccaccatttatacatataaaaatttcatatatgtaagaaaaaaagaagaaagaaaaaaagcgggtttcccggaatgaaaaggaccaagagagaaaaatccattttatgctaacgtggcagcataataaccgcccgattatatatcaacgataagagatgaattgttttcattttgtaacaacaaaacatgagagaaacaaaattatatttttgcaaaatctggaaaaacaaaacaaagaaacaaacaaatgaagaagagatgagaggagacagagaattaaattagaggagcagaagagagagagagagagatatagagattaataaggtcatggcggcgttgcagagcgcaagaaagatgatttaaatctctcttcttcttcttccttcttacatatctctgtgtgtttcttaaatactctctctctcgtaccgacaaacaagttttgctttttcatcagagtctcaaaaagctattccaacttcaatacactacaaacccagagaatgaattcaacctaaaaaccctagaaatcctctaagatctagagtgagaaagttagagtgtatagaactacaaaacataggatctttggttttgggttttgttccattttcttgattggttagtgggtgagtggtggttatgggtggtggttgttgtcttggtgaatg

SEQ ID NO: 26862 - DNA, 3003 bp, Unknown
  misc_feature (1)..( 3003): 2750-1469P.txt file - cDNA_ID_2716532; gDNA_ID_2213671; Annot_ID_132781
ttatagaccggaaccataacaaaggggaacaagttataacatgtcaagagtaatagaacaattaatccaacatcttaagagatatataagagtggaaagcttaagccaagtgtttggcaatggtagactgaagctcatctttcttggctccaacaactttgtccaaaatcttcccttccttcaaaaacatgaaggttggcatcgcctgtatcgcccaatcacttgccaccgactgttccaacaaaaccataaaagagattgtgatcgaagaaaacaatatctctcaagaagaagggaaaaatgttggtgaatgtaccttcaattcatcagtatcaaccttgaggaaaagcacgttaggaagtttcttagccaaatcagcaaagaatggagcgatgaaacgacatggtccacaccaagaagccgtgaaatcaaccaccaccttcaacaatataaccaatcatgaatcattttcattgaaaaaccatttacactaaaaacatatcatatcgtaagaattgtgaacattacatctatcttcagcgtaaacatttttctagggatcccttagtttcatagaattatcaacatgactcgtaatataagtcattatgatctcctaccaatcctaggatctaatctatggtaatgcagatccaagaattgtcataaaattcaaacatgaattcatacaaaaaagaatcatatcattacattgcttaagtatgagagatcaaagactctatttaaaaacgcaacccaaaacaaaccaaatcaagaataataacaaatccatatctcatcaaaaacaaaatgaaatcaagaaatttgggagaagaagattacaagagttttggattcattagccttctgaagctgctcgttccatgtctcaacggtgtggcaggcgatcacttgtccttcttccgaagccatcttctctctttttcttctctgttctgtttcttctcctcttgtgttttttttttttcaattacttagcatgcgcgtcacctaccaatcccaattttgcccgtcaatagtttttctcttctactttattcgacgcgtgattttgtttcccataattacacccaccaattgctactttccttctttacccaaatcataaatattcacacttttactcctcaaagttttacttgtaacaaattaaccacacacaaagcaaagttgtaaatatccatcgtaaaaagtaaaaaacattttgtagacatcatttgtacattatgattcaaatctacagctgaatcagtttcttgaaacaatacgttccaatgatgaaccacccggtaagcaaaaccactagaatcgagcaggaggcaatgaaagtccaaccaccgagtaagattcctatagtgtagactatgagtggaggcaacaaggactttactatagccgttttgttcacccaacgtcccttgaaaagcactagtgtcgcgagattcaccacgttccatccgcctgactttatagatagacggttcaggttgttggctacaaaggaatgacagttgcatgtgagtatgttatatgagtgatgttggtactcttgcgtgctttttctcagtgcatcatcccatgttggctctttctcatgactatcttcttcttgctcatatctcctctcaccattgaacataccagaactggaagaacgagatgactcctgattcaaatccaaggccaatatgaataaattgttactttgtatcaaggttgaaaatgaaagccggcatcttgcaaacgttaccatttctttgttgatttgaatatatcgagaaacagctccaaatgcaaaattatcaacacagacaaaattaggtcctgcaaagtcgaggatgacaccgtcttctctgcagataccgacgtggccgatgaagggaaccagccatgaaatgaagggaagaggtgtccaaacaatgcagcatggaaaccggtctcttttgggatcaattttcataggatccgataatccgatcatcatgcgatgttctgaatctgttgctgtctctcccatatccaaatccagttgagctcaattatttgattctctgtaagcaaaaaacaacacgtccagtgatccccatgtaagtaagattcaataaagcacttggatttgatatgtaaaagttgttcttaatactcgaatagctgatgcatatcatttacatcgaacccaaaacataaatgcatatcatcccatcatggaagtccgagttgggactgagccttccagaagcgataagcagctccttctagccctgtgctgctttggatttttgcatataccaagctactaccaattcattgattactggataaacttgaaacaagagtcgtctaattgatattcaatcaacacattgtgctaaaacactacgaccactacatagaaaagctaagtaaacaattctcgtagttctacgaatcgcgagtcttaaacactaaacgatgaatccatacgaacatggcgaacgagggatccagaaaacgccattaaagatacataatccaactagcaacgagtcaacatcaaagcatcttcatagacattgattccgaaactttttcataaagaatagatcaaagcatacataccagttcaagcgaccaggaagacgattaatcggatctaatacaatcttcaatcactgcctttttcctgggaaatttttgtttctctctcggccccaattttacgaacgatgacactaaagaacgtgtttggctccttgtttaaactaatcctctctcggatatcttcaccgtttcaaggatagtagtataaacgacataacgttcggtcaaagagaacaaaaacgtcaggatgttattctattaaacgtctgatatatctatacggcgtagttttgaagttgtcgactattcttcatcgttctctctgctctggtaaggagattgctgctacctactgatgcaaatctgccattgatacatctgcttgcggttagggcaaagatg

SEQ ID NO: 26863 - DNA, 3000 bp, Unknown
  misc_feature (1)..( 3000): 2750-1469P.txt file - cDNA_ID_2716536; gDNA_ID_2213671; Annot_ID_132780
gggcatgacactaagaattgattctctaaattccctgcactcaaacttcagtccagcaaagctttcaaattatgatagtgcaatagaaatctcttccgaaagaacgaaggaaaggttaactatttcgctcaataatcaatggagaacgaattaattttacctctcctgggtgacggctatttagagcatgcacatcaagcttgtaattgtgttgtggaattaattgtgatgcatctgaggtgtgagcttcaacatcctagatgagaagaacgaaaaaaatctatcaatctgaccaccaaatttgttgcaggtacgaatgtagttaaggaatatgcagataaagaagtgagcagaaaagaataaataactgacatcagtctttttactccatcgaagaaggccagtcttgccagcaaatgcatagacagaaaagtgacgcaagtttatggctccagaatcttcagaggcctgaaaggaagcttaaaattcttctaaactgtccaaacaaagttcttatgcacattggaacatgtataactacaaacgaatagctctttcttcagaattgttcagttctagagaaaatgtataaggaaactataaatatacacagctacgaaacagtccaaggaaactatcatatagtcgtacctgattctcagtagcacttcttctgtgttgatcagcattttgtgctgtcatgccaagttcctcaaatgggtccatgtgattctaaaacgaaaagaataatctattggtaacatatggaagatacataggaaatcaacagaggaatttttcatcctacatacatatggctgcatctccatccgtccaccaacaataaccaaacccgtatcaccatgcttcaatgtgtaattgcttatcgaaattgctatctctctatggtgtgcattatgtgggaaatcctcctgtcattccaccaacaaaggtaagcaaaaggagaatcaatactactgaaccaagacaaacttttatgcagaacgttagacaaagaacgaagaagataaaaacctgcagattcgtttcccacagctttttcaggttgtgatcaaagcagagcacagaccaacctgaggtaacaacgaccacaacctgcttctggggagttccatttttatagtacctatcaataacacctgtggccatggccacagcacgtctccctgacgcaacacggatcttgtcaggcaaaagagtgatttccgcaagaacacgtgcttcactaaaaccttcatccacacgcctggaatgaggctccagaacctaatccaacaaaacatcaacagtttcagaacttaatccaacacagaacagcaaaccatagaagagaaatgcataatcaccaagcctcacatcattagttcgacaaaaaggctctaaaacaataaagagcaatgcataagcactgaactataagctgcaatcattcgttctaacgaccgaaatagccagatagactctataaaaattggcgagaaagatcgaaatcagaaatgtttttacctacaaaagttagaaaatttcatatgatacctgaattttggcatcattagtagcaacgagaacctccttctttccatcaccattaagatcagctacaataggtggtgggagacgatcagcttcgtatttgactgggtattcatcatacaaatgaaaccatgcttctttgaacgcaaaatcaccctcgtgctgcaaaagtcatcaagtcccacatatcaagtaaacgcaccattaataagaaaattgaatccattggttccatctggaaattctacaaattcgctaacatgacactacttacggatcgaattagcagtctaagttctacccacaaaggaaaattcaaagctttctcaagtaacagatcgatcaatgattctagatgttcagctacaatttgattgaactaagaaagaataagaagacgattagtgtgtaaaatcacctgaagagtgaagaatatagcaaatccagagagcatcaaaatagccaaatcgcgtttcctcatctttgccctaaccgcaagcagatgtatcaatggcagatttgcatcagtaggtagcagcaatctccttaccagagcagagagaacgatgaagaatagtcgacaacttcaaaactacgccgtatagatatatcagacgtttaatagaataacatcctgacgtttttgttctctttgaccgaacgttatgtcgtttatactactatccttgaaacggtgaagatatccgagagaggattagtttaaacaaggagccaaacacgttctttagtgtcatcgttcgtaaaattggggccgagagagaaacaaaaatttcccaggaaaaaggcagtgattgaagattgtattagatccgattaatcgtcttcctggtcgcttgaactggtatgtatgctttgatctattctttatgaaaaagtttcggaatcaatgtctatgaagatgctttgatgttgactcgttgctagttggattatgtatctttaatggcgttttctggatccctcgttcgccatgttcgtatggattcatcgtttagtgtttaagactcgcgattcgtagaactacgagaattgtttacttagcttttctatgtagtggtcgtagtgttttagcacaatgtgttgattgaatatcaattagacgactcttgtttcaagtttatccagtaatcaatgaattggtagtagcttggtatatgcaaaaatccaaagcagcacagggctagaaggagctgcttatcgcttctggaaggctcagtcccaactcggacttccatgatgggatgatatgcatttatgttttgggttcgatgtaaatgatatgcatcagctattcgagtattaagaacaacttttacatatcaaatccaagtgctttattgaatcttacttacatggggatcactggacgtgttgttttttgcttacagagaatcaaataattgagctcaactggatttggatatg

SEQ ID NO: 26864 - DNA, 3000 bp, Unknown; identical to SEQ ID NO: 26863
  misc_feature (1)..( 3000): 2750-1469P.txt file - cDNA_ID_2716536; gDNA_ID_2213671; Annot_ID_182292

SEQ ID NO: 26865 - DNA, 3000 bp, Unknown; identical to SEQ ID NO: 10731
  misc_feature (1)..( 3000): 2750-1469P.txt file - cDNA_ID_2716544; gDNA_ID_2213671; Annot_ID_132776

SEQ ID NO: 26866 - DNA, 3000 bp, Unknown; identical to SEQ ID NO: 10769
  misc_feature (1)..( 3000): 2750-1469P.txt file - cDNA_ID_2716557; gDNA_ID_2213672; Annot_ID_132840

SEQ ID NO: 26867 - DNA, 3000 bp, Unknown; identical to SEQ ID NO: 10777
  misc_feature (1)..( 3000): 2750-1469P.txt file - cDNA_ID_2716560; gDNA_ID_2213672; Annot_ID_132839

SEQ ID NO: 26868 - DNA, 3003 bp, Unknown
  misc_feature (1)..( 3003): 2750-1469P.txt file - cDNA_ID_2716564; gDNA_ID_2213672; Annot_ID_132838
tataattgctctcgactatagttagagcatcttcgttggttaaaatacttttgtataatcataaacttttgtattcctctttagagatacattaatagattctttaacaagaacccttatatatcacttttttttttcctactcttttctttgttgtaattttaataaaggtatcgaaaccattagtggagactacacgtttccctctcacctttctagagtcaagagtgtcaccccttacacgtttaccttcatctcaagagtcaaggggggagaactcacggttcaactactatccatccctcacagtaagattttagctttcttattctcgaatcaaaatctcgatttatatatatctgaaatttgaatccgaccttgtctctagctaaattcaggaaagcaagattcaagtggaactaagtcatggcagagaagaccgagatattttcatcaccttcctcacctccaccatcattttacatggtagataagaccgggaaactttcatcaccttccttaccttcctcacctccaccatcatattacatgggagaaaagaccgagaaatattcatcaccttcctcacctccaccatcattttacagaaaatatatcatatcttacatcaatgagcaggtagagttagactcaagaagtgagaaacgagtgcttctcttggaatcagctggtaaggaatcttgttgcatcttcagagtccctaaaagcttcgcagaaatgaatcctgaagcttataagcccaaagttgtttccattggtccttaccatcacgggagaaaacacctcgaaatgattcaacagcacaagcttcggtttctacaccttttcttacgcacggcaagcgtggatagagatgtcttgtttaacgctgtagtggattgggaagatgagataaggaaatcttattctgagggtcttgagggaagtccacatgaactagtgtatatgatgattcttgatgggtgcttcattctcatgttgttacttatcgtgtcaagaaagatagaattgtatgagagtgaggatccaattctcaccatcccatggattcttccgtctattcagagtgatctcctcctcttggaaaaccaggtccctttctttgttcttcaaactttatttgacaaatcagagataggtgtacctggtgatctaaacaggatggcttttagcttcttcaacctctcaatggataaaccagaaagatattgggtcaaacacagaaacttcaacgcaaaacatcttcttgacctcattcgtatgagcttcttacctatggatggatacgaagatttccaactcactaagggtaaatctagaaagaaatcatcctccggtcttacattgctattgtcggctacaagactttctctccaaggaatagatttcagtttaaggagtggtgcagattcgatgttagatataaggttaaagaagaacaggcttcaaataccagtgttaagattggatgggttcattatctcaatcttgctcaattgcgtcgcctttgaacaattttacgcaaagagtaccaaccacataacaagctatgtggttttcatgggatgccttctaaacggcaaggaagatgccacattcttaagtcgtcgccggatcatagagaactactttggcagcgagaaggaggtatcaaagttcttcaaaactatatgtaaagatgtagtgtttgacatacatgcaagttatttacggaatgtgtttgtggaaattaacgagaacacctcaaaatggtactcaatatgtcgaagttttttactgtcaccaagaaattttgtggcattgcgctttcgtccaatttatcgattctaaataccattcttctaccttagcaacagcaacagcaaaaccgcatgatggaacgtcctccaggcaaagcaaacatgctcgagcttatgtagaaacaatggaattaaagtcgtttttatcttctacagaaacatcattgttccctgttttttatcagttgtgtaacttgtgttattgctatctttttcgttttatgatgttatcctatatatgtatttaagtattttgttactcttgttaatttgcatgaaataaagcttttctactttcctttgatgaaataaatttgactttgctttgtcttctcgattatcttgcgctatgagaagtcttgaacttgtcatgcagctgccctgacttagggtgaacgggatataacttcatgctaattttcagtgaagtccaaaactttatcgaagtcgagtctctatttttcttatatcaaaattcatcattttcattttataaagagagagttgttgcatttgatttgaatataggacaaaaaaactcatttttttagtgaaatggatttgaacgataacctttttaatttaacttaattttaatcgataattattattaatatataatcataaaacatatacacaaaagaaaataaaagtaaaagtggtaaacaagccaactaggatgttgatgattactatgtaataaaatggtaaagtatgatacatgttgatatttactaaacaaaattattgattacatattgaattaatagatagataaaagaaaagattaggtgaagtgttaaaaaaataaaatcatagtacatagtctaaaacaactggcacattattaaaaaaactacgtacaaaccaatcaaaacaaaaagttaataatacacatcatgttcccacggtgacgttccaacagaaacacatgagcccaacgcataaacaaaacaaaaaaaaagacaaaccaatgaaaccaattttaactatttaaatttcaaaaagaaaagaaaaaacacttgagggtcaatgatgtaaggagaaaatgggttagcaattatccattggatctatgcttgcttgtacctcacaaaccgcaaaatctttcttgaagtcgtcttaggttgaccaactaaaaaaagcgagggatactttggtttcgtccatttttcacaatatg

SEQ ID NO: 26869 - DNA, 3003 bp, Unknown; identical to SEQ ID NO: 26868
  misc_feature (1)..( 3003): 2750-1469P.txt file - cDNA_ID_2716564; gDNA_ID_2213672; Annot_ID_182379

SEQ ID NO: 26870 - DNA, 3000 bp, Unknown
  misc_feature (1)..( 3000): 2750-1469P.txt file - cDNA_ID_2716568; gDNA_ID_2213672; Annot_ID_132832
gacaaatgaaacattcaagtacttgacaatgaagagatctagctagctatgtcatgtcaaaatataatggaatcaaaagcaaatcaacgtcgtaatataattgcatgctatgagcagttgatattatggacaaaaaggaggatcatgaaagaaagtctattgaaaagtggacacaaagtaatgattagccaaaaatggaaaagaagaaatagacatataattataatctctagtagagatatttggactagtagtctatgcacatgatgtgtaaaaccagtggaaaataaatgagtctttatgtgaaagaatagtgaaattaatgagattttcacaaagataagaaatgtattatgaagaaatatattctcttgtggtggatgtaatatttttaagtatctaaagtctgacaataagagatggaacactggatatgacatttatatgaaattcttgaaagatataatctctgaaggattaattatatgagaattatgttctctacaactctactcgatcgaataaaaagaaatatgtaacatgacatataatcatataaatgtatatttatgttgagtttgtcaaaatatattgatcaaactaatatttgttttgaaaatcattaaaactcgtacagagttatataagtaatacgatgacaataatctatgataaaatatcagtagataatgatatttataagtctatatgaaaaccatataattttgatcattaagattatggttattaatttcaacgagatattgtatttgattgaaaatcatctcctgaagaagatgtttccgagggggagattgaatgatatgcgtggatgtaccctttttccttatcatagtttttatcccacatgatttttctatgacaagatttttaacgagacattaaagaacacgcaaataatacacttgatgaatattaagaaattctatcaatcatccaaatgaatattatacactaatgatatttagagaaataaataagatggttaagatgaatcatctaaaagattcatgagcagaagaatggcgttgtactttattagaaatttgttcaagagaagatttggcagacttattctcaaatactgtttattctctgccacatcttctaatcatgcagagattttactaattcatgaagctagccgcgagtgtgtatggctaagatccatagttcaccatatacaagaagactgtggtatgtatgcagggaaaaaaactccaacaattatgtacgaagacaatgcagcatgcatcgcacaactcaaagacggatacatcaaaggcgatagaacaaagcacatcctaccaaaattcttctacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccaaggtttttcccattaggttttcctggtaaggtttttaatgaggcagcatttcaaatactttacgagttatggtactataatggtcatcaagggggagtgttatgaataaagatggatgcccattataagacccatcatctaagcccatcatctagatgtttgtagggttttaccttttccttatactcctatagaaccattttctcaatggaaaacacactcatttcttctatctctttctctggttataacagatacatatatatatatatatatgtagagattttgatactgttacagcactgttgcggtgcgattttgggtgcggtctatgtcaccattcacagtcttagtataccaaaatccgcgaaaaaaaaaaaaaaaaaagtataccaaaatctgcaaattgttaaattgaaaaaacttggagcaaaaaaattgatatcaattatttctctatctttattttttcacttgttctcataagttttcctttttttaatttgtttgcgtagaaaataacttattataaattagggatttactgttacttttcaaacttaacaataaatatataatctgataaaaaaaatatatataatataaaaatatataatataattgaaaaaatagtgttatgaaatcatacatttctccaaacttttaacattgtttaaagaaaattcttagtaaacaaaaatattatttgcaaatttatattaaaattatattgtcaacagttaagaagtacaatatagatattaaatatgtataattaataatctagttgaattataaaatctaatatcttgatgaaatcagtattaaaaataatattttcctttattgttttcttatatatcaatttgtttcatttgtcatctatccagaatctgttttctagtaatgtattcaatgataataccacaaaacaaaacaacaagtgggtgattgacttttcataattaaagagatgacaaatgattgttaagcctaatcaagcagatatttaatccttatcctccacgtgtcaaaacactattgcaatgcacaaatcagacacctacgccataaacagaagataactcccgacaagatttttatatctctctctctaacattagccgaacaaagggcaaaatggtcaatcttgtaacccacttccgcgtcttttctcgataaagcttcttcgagaatcgtaactgaagtttatctccatatgcaaagttactaaaataccattgtctcatacccgaatttacgaaaataccattcttctctctcatctctgatcatcgaatttgggtgaagaaatatcttttctatctaattgctaaaaggaaaagcatcaaactttgttttctttgcttcttctatcttcttcttctttcttcttctcgctttaatactctttgattcctctgttcgtttgatgagaattagattttaaatg

SEQ ID NO: 26871 - DNA, 3000 bp, Unknown; identical to SEQ ID NO: 26870
  misc_feature (1)..( 3000): 2750-1469P.txt file - cDNA_ID_2716568; gDNA_ID_2213672; Annot_ID_182369

SEQ ID NO: 26872 - DNA, 3003 bp, Unknown
  misc_feature (1)..( 3003): 2750-1469P.txt file - cDNA_ID_2716580; gDNA_ID_2213672; Annot_ID_132826
tccataacttagcttttcatggaaaatctccaatgtaaaaggagctgaattattgatcttctggttgttctttctttttttgaaccagcttagagaaactatgaacaatagcaaaagcaaagctatgcctacgctgaccccaatcgcaactttcttcaaaagagatggatgccttgtctccactggtggtgcttgggcaatgcatggctttagtttcagttccttgatgcttccacaaagatttttgtttccgaatactgaaactaaagtagcattttgaaatattccttctgttgggactcttccctcgaaattgttatcggatagattgagatattccaacttggaaaagttttcaaaatattcagatatacttccagagagattattgtttgacaaatcaacgtttttaacacccatcaacccttttatatctggaatggttccatcaaaatggttttcttgtagataaataacttccatcgaaagacattttcccaaagtttgtgggagatgtcctgataagttattattcccaagtaatagctcaacaagattttgtaatcttccaatatcgtttggtagagagccactcaaagaattagattccatgttgaggtgaacaagggttgggatttgcatgatctccttaggtatagtcccatttaacttattatacccaatctgtaagtcgagcatgtgactacaatcaccaagactcggaggaacgattccttcaaaactattgttggataaatatagttttactaactgagtaaggttgcctataaaagagggtatctctccagaaaacctatttgaaaacaaaattaattccccgagccctacaagatttccaagagaggttgggagtggtcctgttaatagattatctgccaacaaaagtgattgtaggcctatgagatttccaatatcatgaggaatgcttccataaatgaggtttcctttaaggttcaaaacggtgagttccgtggacatattgacaatggatgtaggcaaagcacccccaagcctattgtaactcacagataacccatgcaaatgggagcaattagtcaaagcatcaagaaatgcaagatctccaaaagagtaacttcccaaagaattgttagcaagttctaggtaatgcaaattctctagttttccaaagttgggagagatacttcctgtcatcctgtttttaccaattccaaacatttccagagttgaaatattggcaagtgttgttgggatggctcctgttagaaaatttccatgcaaagataactcatgaatgtttggtagcagattaccaaaatcaggcttcaagttacccgagaaaccattaccaaggaggtataaattctcaagtgaggacaagttgtagaaagcaggaggaaaaacgccagagaagttgttcattgttaatgtaagagacaccatttgactcagcatagctatatcatctggaatttctccttccagatgattatatcccaagttgagcactattagagacgtcaagtttcgtataaatacggggaactttcctttgaggtcgtttagaccaagatatagataaagaagctttctcaatgaccctagttctgaaggaacaccgtctccaagattgtttgaaaataaatcaaggtacaacaatctagagcagttggacaaactggctggaatctctccttccagataattaaagcccacagccaaatatttaagtctaaacaagtttcccatctcttgagggatggttccaccaaaagagttattagagaggtcaagatatatgagaaacgaaagattaccaatagatggtgatatcactcctcccaactgcaatcctccgaggtccaaacgagtaactctcttgtgtttgcggccacatctaacccacttccagctgcagagagggaatgagttattccacgcggacaaggcatcccttttgctttcagaaacttgagacttgatctccaacaacgcttgcctatcactttcatcggtaaaaccatatgcttcgagttgcatgagagcattgaaagcaagtaaaagaaatagtctcatgcttctcttttctttttttgttggttaaaatattgtggttcttctcaaactttgcaggaagtaaatatataagagacgaagcaattgcaaaatgcctacttgtagtgctaacgcaacttgaagccaaataggaatgatcaactaccagatttttccaaaatataagtcaagaagtcaactgcctaaaaagacaaggaaagattaagatgcgcatttaactagtctttctgacttttctataggcatcatgtggtggctggatttatcggtcccatatgtctggaatctgaacaattaattagcttaagcatggaacattactatcacacggcagtcatcttttgtcttaaaccacacaacactactttatgatattgagcaaccatacatgtgacaagccctttcattgcttgcaaactttgtagaggaaaccaaaaaaacacttcagcctcgaaccaatagcttgagcgaaggtgctcgcagttattcttcccagtaactcagatggacaaaaactacagaacacacgttacacttacatgacagaaaatctgaaataacactaaataatcaagcaatttacccaaataattctttgattccatttttgcatagaccaagtcaataagattgaattaaaatgaaaaagaagaaatgcaatttacctcttaaacttgctttctaaagattaagacgagaattgattgatcactgcaatcatgaacacgttcaaagctgctggttcagaaaaaaccacagaaatatatagcaaaaataaatggttgcagctttaaaagtttagcatgatcatcgcagaaaaacacattttcagtttaaaacttgatcagctctaacatcacaatccagagactttttcttactcttcggtaccaaaaaagaagagaaggtaaagaaggtaagcgaatg

SEQ ID NO: 26873 - DNA, 3000 bp, Unknown; identical to SEQ ID NO: 10767
  misc_feature (1)..( 3000): 2750-1469P.txt file - cDNA_ID_2716586; gDNA_ID_2213672; Annot_ID_132820

SEQ ID NO: 26874 - DNA, 3000 bp, Unknown; identical to SEQ ID NO: 10766
  misc_feature (1)..( 3000): 2750-1469P.txt file - cDNA_ID_2716601; gDNA_ID_2213672; Annot_ID_132816

SEQ ID NO: 26875 - DNA, 3000 bp, Unknown; identical to SEQ ID NO: 10766
  misc_feature (1)..( 3000): 2750-1469P.txt file - cDNA_ID_2716601; gDNA_ID_2213672; Annot_ID_182352

SEQ ID NO: 26876 - DNA, 3000 bp, Unknown; identical to SEQ ID NO: 10764
  misc_feature (1)..( 3000): 2750-1469P.txt file - cDNA_ID_2716612; gDNA_ID_2213672; Annot_ID_132812

SEQ ID NO: 26877 - DNA, 3003 bp, Unknown
  misc_feature (1)..( 3003): 2750-1469P.txt file - cDNA_ID_2716632; gDNA_ID_2214456; Annot_ID_132954
gaattgcccaaatgaagctgccaacaatgaccttttaaggaggcaaacacacatagttaagcataagaaatctaaattcatctaaggaatttgataacaagcgtaagctcacctggacttggcttgctgctattagaggacctccaattccaccaccaatgacacgaccatcggggctagcaagtgagaccgctagacttccagtgcggtttgggtagtcattgtcagttgtgttcagataagaagttgagagagatatgagctcgaatagaccctataagtttcaaagtatacaccaaaataagtaatgtttttgtcttctaaaagataataaaatgtgagtgatgattcaataaaacctcgtatataatagttccatgagaaggtgctggctgaagaagagttgcagtagagacagcaccacttgcggataagacacatatcgctcgtggaccttgatgcgagaacgatataacctttgaagcaatgtcctgaaagcaacaccgagagtatggttatctcaagaactagaggcaagattacaaagaaaaaaaagaacagatttattcaagaggagacagaagaaacatacttcaccaatggaaactacgattacatgcggtgtgaagctcatcccagttgatgaaggcatcatttcaccttacaaaaaagaatcaaatgtcttcagaaaaatcacagctaattgtaatcagggagaaacagagcaataacaaagtttaagagaaaggccaaggaataataaaagaataaatattgaattcaacaatttgacattataaaattccacagctttaattaatccttaacagttcgaattagcttataataaacttcccaccaatgtcctcatttgaaaaactatatcatcaattaagctcaaaacttcccaccatattcagagccaatgtccttgtcggaaaataaaactcataagttagagattagggatattaccaatggaagatagccgttgcttcttgccggagccaggaggtcttccacggccacgtttgttagagttcggggaaacgttggagatagaaggagacaatgccaacgaaacagaaccaccatcttgtccatattttctaggccgtcctctcttccgcttcacagacgtgtcacctgaaggaggagcaaccaaagctcccgccgccgccgctgacgaatcagccggagaagagtcaacgggtaaaggaggagacacgaatccagtagagacacctccagggtttggatttgggtttgggtttgacccaaaaggagagatggaattggtgaaatgatgaaatccttgtgatccgtgaaacgttggttgagtttgaggaggaggaggaccagaaccggggattcctctttggatatagtaagaacccgacccggataacgccattgcgtctcttcgatccatagcttaaccaaaaagactctgactttaacttagtaaaattcgatggggaccctaaatggctaacttataggaggagggataagaagagaacaaaatcagaatctaaaagggttcgatagacttcaagagcaagataacaacatgcaaccgaaaatctctgaaaacttatcaaaacacacaaactttcatttcacctaattgttttttatgtagctttagtatcaagctatgagaaaatctcaagatgaaattagatccaaaagagaaaaggaaagaactttaattttcttcatctcttcttctctgtttcattctctcaccaaaagcaaagaaatgaagtgtgaataagctttctcatccatcaatcaacaatggtgaagaaaaaaaaaagttttctagggttctctctctttctttcttcagagtgtatgtgatgttgctttttttcttttactgggtgacagagggaaaacagaaacaaacaaaaaaagatcctttctccaagcatttactgtggattacaatacaatgggatgatgaggcaggatttcaaaattcgaaattaaatttgaagtctctgacttttgactgtgatataagctctctctctatctctctaatagacttctttctagcatctagcaatttgtaggagggatccatccatccatcatcatcatcatctttgtgtggctcattctcaacgctatagattaggtgcgtgtatcaaacgaagcattgggaatgagagagtgaatctcacgcttctgatgtcgagagtgagagaatagtgatgtgatctagtcaagactttctttgttcctcactggcttccacttcatcataagctttcaaaatttatgaatcccccaatctatctttagactctattttaccataaatacttgagactaatgattatatattggcattaagagacatataacatgaatataaattcccattttgtggagtaaatattgttcttgtctctgttctgttcactttaaatcttcatttttctctacaaacaataatcattaggacccaagagtttatcaacaatacagaatctgaacgtttagtactcatgtcatgtgaagtgaagtgaagaagatcaacaagaacattaattgtttgctataatcttctatgggccggataggaataattaggcccagtatctaacacatcaaacaaaaacacatcgaagtcgaatcgtcggtgggataattaggcccagtatattcaaacaaaataacatttaacagatccaagtccaatgttgtcgtggaacgaacgtcgtttagaataattaagcccagtatttaacatatcaaagcccaatgttgtcctaaaacgacgacgtttgaatgtggaacgtaaacaatcctggaacaaccgtttcaactacctttttcctatcacttgttttttcacctctcgaagtcctccgatttgctacccttacgcagcctcatgtgtcaaccaccatttctcttcttcatcttcgtctctatcaaaccctaaacctaaaaccccttattttcccgccaatgtatcaatccatg

SEQ ID NO: 26878 - DNA, 3003 bp, Unknown
  misc_feature (1)..( 3003): 2750-1469P.txt file - cDNA_ID_2716655; gDNA_ID_2214456; Annot_ID_132947
aactcacgcttatgggtgtcacgcaatattatgcttttgtcgaagaaagacagaaggttcactgcctcaacacacttttctctaaggtcagatgtctagatttatccctgtaactacagaattatgaggggcttgatttagatgttctaaagtggttatggtttttcaatcccagctgcaaataaatcaatcgataatcttttgcaactctgtcaatcgcgtggagctgttggctaagaaaatcacagaacttggttattcatgcttctacattcatgcaaagatggttcaagaccacaggaacagagtattccacgagttccgcaatggtgcttgcaggaatctcgtttgcactggtaagctttgtgttttttagcatgtactttgaacattgaccaagtgtagattatgatgatgatgatctggcttattggaaaatgactgcagatctgtttactcgaggaattgacattcaagctgtgaatgtcgtgatcaactttgattttcctaggacttctgagtcatatctacacagggttagtcgaaacaaaactggtttgtgatctagtttcttacatgttcattttaactcatgttgcgaaatgttcaggtgggtcgatcaggacggtttggacaccttggattggctgtgaatttggtaacttatgaggaccgtttcaaaatgtatgtcgttccttcttttcaatgttctaaccggtttttctattctgttaaagttttcttagtcatttatcatgttttgaaaacaggtatcagactgagcaagaacttgggaccgaaatcaaaccaattccttctaatatcgatcaagcaatctactgtcagtaaacttgtaactgtgcatgaaacgtgtctccacccaatgagaggtacaagatggttaaaatggtaagagtaagacgaatcctctctcttaggcttaacttgtcaaaacaacatttaaaatcaaaaagctatattgcatgtttaagaccagtgtgcccaatatttcaggtgtttctcaagctcgaggggaggagatgaggcaactagtacttggcggttcatgtaaagactcgttactcagtggtttggttcctaatctctcttaaagacacttgttatctggttctatggaaacctctttacgctgcacttattatgagactccctttgacttggttagtaataaagatagaacgtatgactctcctcttttttattttcgtgttgggctctgtttggaattatgggctttatcctatttaggatctatttatcatgaaagttgcacttcttaatttttgcttccacggaattattttgatttttccaaaatattttcttccacatgcttattattctagtttggtattaagctattttcgtcaaaatgtttgaaccgtaaccaatcttgttttatagtgttatatccattgagaaattatagttttcacgtgtttatttatttatttgggttattaaacataaatcatgtaaatctgaatcctgtggagatctctccctagttgatgaatagatatgatgaatttaattctttcatgaaataaaaatatatgaaacatatgtagcagaaaaagaagcatatctatgaaacaacaaacattcaaaaaaaaaaggaaaacggaaaattattaatatgaaaactacggctttgacttgtagctgactacatttacgacatatatatataaatggaccccactgagtgtctgcaaggtctttacacaacagtatcttcttctgtttctttgactctttgtgatccctaagcctacccataatacgtgtctacattttattggattgtttcgtgactctgtaatcttttttataagaaaacaagtaatagtgaaattgaagtaaatagctcagcacagaaacttcgacaaaaataactcacagattagaaaagaaaatatatgcataaatagccatggttcatttatgaacaatttattcgtttttttagtttataatttcattaaaacatgtttgtcacatcacatttcatgtccttcggctcctactacaacaacaagtcactgtcatctccattacttccacttctgctcctttctttattaacttgttcaaaaacaattctaagataaataacaataaatgttggtctctctttattatttcccggctaaagaaggaggatgtctcgtattatccgccatcaatgctcttttgtttcctgtttcttgcaatttgaatccctgagaatcctagcccacttatttactactttgccttagctgttttcgacatcaaaattttggtcatatgactcatatcaatcttcaaatttgataaaatatgttcccaattcacaaaaacaaaaaagttttcgaaagctcaaaaacctttaccatttcaatagtagataggattcttttagatttgcatttcacgaaaagagaagaaaaaaaatcgaaaaatatttgcaatcatgattttttgtttctgaaggagacctgtagttgctgtcatgaacattaaatacaaatctaataaatgttgtacgaattttgcgtgtaataaatggtcagggccggctcgaagctcgctgatcgtccttttttcgtgtctctatagcaacacacaatcgtatttatttcaaactttttttactttgtttcccatccatcaaatataagtataaaaatgtaaagaatcatcatatatagatcgtaaattcattgcttcctttggctttttatttcatctagacgacgttaaaaccagaccagaccaaatacatttatcatttttcccttttttctaaaattctctctttgattcctatcttcttctctttattttcactttgtgctttctctgtctctcctattatgagtctaaaagtctactagctgttcaatagttttgtctttctgtgtttcttcttcttcaaaaccgaaagaaattcaaaaagagtctttcgctgcttgttagtggggtgaggaacaaatg

SEQ ID NO: 26879 - DNA, 3003 bp, Unknown; identical to SEQ ID NO: 26878
  misc_feature (1)..( 3003): 2750-1469P.txt file - cDNA_ID_2716655; gDNA_ID_2214456; Annot_ID_182655

SEQ ID NO: 26880 - DNA, 3003 bp, Unknown
  misc_feature (1)..( 3003): 2750-1469P.txt file - cDNA_ID_2716659; gDNA_ID_2214456; Annot_ID_132946
caattactttcatgatattattagtattgatgatcttctgtgaagtatttaaatgttttcttgttatattcgacatggcaggaaggtttcaagtgggatgaaatcatcacggagacttatgagttaactgaagaatgcatcaagataaactactatggaccaaagagaatgtgtgaggcgtttattcctcttttgaagttatctgattcaccaagaatcgtcaatgtatcatcctccatgggtcaactaaaggtaagtaagaaaagattagatatcaaggaagcttgagagatgtattgttggctaagaaacactatttatgttacaattgattattgtttaccagaatgtactaaacgaatgggcaaaaggaatcctgagcgacgcagagaatctcactgaggaaagaatcgaccaagtgatcaaccaacttctcaatgatttcaaagaaggtacagttaaggaaaaaaactgggctaaatttatgtcggcttatgtggtttcaaaggcaagtttgaatggttacacgagggtcctggcgaagaaacatcccgagtttcgcgtaaacgctgtgtgtcctggatttgttaagacagatatgaacttcaagactggagtcttgtctgtggaagaaggagcttcaagtcctgtgaggttggctttacttccgcatcaagaaactccttctggttgtttctttagtcgcaagcaagtttcagaattctgaatcttcttttgtgtgagaataataagccaaaaatgtagtaatttaatgagaggattatcgtttgaatgtcgaacatatactcttagataaacaaaaacttttatgagatgttttggtaattactcataaacttgaatataattactttacaaacagaataatatatagttccataagaagaaactaaacaaaatttgagtctacttcattgcattagttaagaaattatctctttaacaatttatgattatatatatttcacaaaaggaactcccggatatttcttaggattcatgttcttcagctgctgcatcagaagtttcttcttctgtagggtttgcttcatcttctttgggttcggttttgtcttcctcagccgtcgagcgacggtggttagccgcggcttggaggacatgattgtaattacctttctcaaggaaaagctggctgaagtggaccttacagtaaaggacgccatcgagagcagcatatgaagaatgtgttaatggacaaccactatgtgcacatctgaagcaagtcttgtggtaagattctccttccattgtcatcttctctagaggataaactgttttcttacaagctgcacatttgtcttgtgtgccgctaaagaaggatgataacctgtttggagccttcgtctatgcaaatgatcacaccaagaaatcagattagaaaacaaaaagagaaaacagaggaatgttgatgaattatgtgcttaccgcatcattcgatttctcggtctttccagctgtaaaagaccaagaagagaaagtagcaaagattgttagcttttcaagagaggttaataaaaaacagagcaaagaaaacagaggatttgttagcaacctgtttggaaattcttgctgaaatttccagattctttgaagagctgttcaaaatgggtcttgcaatacaaaactccatccatggatgagtagttacatatctgaaaaggagaagaaagatgttctctttgtgttttttttttcatgagggaacaatggaggaaaaggaagatagatagataccacgagagtgccattgcaatggctgcacctgaagcatgacttgtgataaggcattccttccaaagtcatcaagtccataacgtataccgtcttgtcacacgccttgcatttgtctgttgtccctgtaaacgccgccattggtatctcttcttcttcttctttcaaattacgaaagagttggaagatggatcaaaagttttcttcttctttttgttgttcgtttagacacgaatcaaggtttgttttgccatcatctatgagctctctgcctttttattatatcaaaatcatggattgagatttttaggggtaaaattttcttctgatggttgagattcaaatgaggagagcccttaaaatgttcttctacattctaaatctatttctggctatattttattttatttaacacttatttttgttttgctttctaaattatatcgtgtaaaccaagggattaggtgcaaagtttatatatagttagcctccgattttaagatgttattaattcatatacacaattataaggatctttatacaaaataagtaacacctaatctaacatcacaagactgccttttaagcatagcttttaataatcataagcataatttgttttgttagatatcattaatcaaagggcaaagaatctgggggtctaaaatgacaaaaacaatacaacatggggtgaatacctgaaagaaaagtaaatccgagttatactgtaaataatataaagcttatgggtcatgtatttatttaacgtaaacataaaaggccattttgataaatagtgagagtctgaaaaaaagaaagaggagaaaatccattgacgccctaacaaaagacgccggcgagtgtattcgtcactttctctagtttcctgtaacccaacccactcaaacgaaattttttcttaatctctctttcgttcttcttcttcttcttcttctttagattgttgtaattccaatcggaactctcgattcgctttcttctccgttcttctgtggcggaccggttttgtggttttttatttgaacattcccgatcttgccctgagttccacgatcagtttctttaaaccctaggttttacacaagcattctgtttctccagattatcgcagactctttcgttctattctttgtagttttgtaaaaggtatttcggtagatttagggtttgtctgtgtctagttttcgagatcgagagagatttgtgatg

SEQ ID NO: 26881 - DNA, 3000 bp, Unknown; identical to SEQ ID NO: 10862
  misc_feature (1)..( 3000): 2750-1469P.txt file - cDNA_ID_2716663; gDNA_ID_2214456; Annot_ID_132945

SEQ ID NO: 26882 - DNA, 3000 bp, Unknown; identical to SEQ ID NO: 10862
  misc_feature (1)..( 3000): 2750-1469P.txt file - cDNA_ID_2716663; gDNA_ID_2214456; Annot_ID_182653

SEQ ID NO: 26883 - DNA, 3003 bp, Unknown
  misc_feature (1)..( 3003): 2750-1469P.txt file - cDNA_ID_2716667; gDNA_ID_2214456; Annot_ID_132944
gaaatataacgtctaacatcgcatttatgccgcaatccactataaaagaacatgttttattgttattcctcaccgaattgaaggaaataacgattatcgcataggttaactacgttacagatttgtccgtaaataataaactccactaaaatcatacatgaaaaactctacgtactaaataaatacagctttttttgaagtaaatttcagttcagattaacaactggaaaaatcttgaagtaactagaaatcgaatagaataataataaaataaagggaatgtgacactatgaggcacttttaagaaatgtttttccgttttagacacttttaagagtttaggcactttatcttgtttttggtgagaaaatagacaaaattacccttgagattttgtctctctctttttcgtatccattctctctctttctctcgctttatcaaaaataaaaaatcaagaaaacaaatcttcaaaatttacattttttttacgccattaaagagagaaaaaagttgttgaacgtttgcaaagaagaaatcatcaacttctttctttcttccttcttcaacaaatcatcagctttctacaaaaagagagattgattgaacaatcagattcaactttatttttccagttaatcggatctcccgatttctccgtgtctgctttgattaaggagaatttttcagatcaccaacttcagaatatgaatctgatttttataagagaggatctgttggatttaaagaactgccatggtaatatcatcacatattcacatcctcttcgtttttctatcgttttctgtttttgctcttaaataatttatttttcgatttcatgaaccaccaggttgtgaataaaccaaattggccaattccagtattgaattttatatccatttgatcagcttgtttggtatcatatgattttggctcgataaattgataatatcgttgaacttctaagttaagagtattttactttgcatacgagaatcaattatttccacatggtcacgtctaagtggacatgttattatcaaagcttccaacacgatttcattatgtagaaactaataatcatataggtctccaaaacacaagaacaatctgtagacattactttcaaacatcaacacgctaaatccaagtagataatgatagtttgtgtccatgataactcatccacttaaacttgaccatatggagtaatggtgaaacatgacaaacacttgaacacaaatgattcatgtttagagctttcatcaattataatttgaatgaataagagtatcattggtgatgcaagaatcacaacttggtcaaaacaaatcataccaacacacaaaagttcatacatcaatgaatatcaccaatttcacgagtagcgtccattttttgttgaccactagttcacttgtttatagacactctcatcgttatgtgggttgatcacttgtttatagacacatatgctgcaaacaaaatacgtggttgtccattacggattgtccaaatgttgtagtccaatagagaacatcaagtactgaatttcaaacaaacggggcagagaagttatctaacattatcatagaattatgaacaagatcaccaaacacttggaagcttttagtaaaccaaaccattaatctttagttttataggagaaataaccacacaaaaatcaagggatgcacttcactcctccatatcaaacctaaagagataaatgtgtctcaatcaaatactatatatgtgtaaattgacgctaatactctccactagcaaaatcaaagtctgaataaatcgttcaaatcaatctaatttcatcataagagttaaggttagtttataccttcaattccaaacaatttcaattccacaatcaatcaaatccacaatctcacaacaatttttcaaatttctgcaacattgaaacttcctgcatctcgtcacatcaaactttccactataccgattctagaaacttccaataacatcaaaaccagactatgacacctcaaaaacacgaagaatcacgaagcaagacaaaagtaaacatgaatggagatgagtaaactcaaatcaccttgagtttatgaacgacgacgacgtcagaagcgccggtgatgttgatcaagcggtcgataacgttctaactcatgtcgccataagaaagaagatatgaagaatcaatttgagcgagaagcttggttcacaacaattgattgattgtgaaattttgtttttggagtgaggaaggagaaaagaaaaaagattttgttttgttgttgtgaaattaccgtgaaccgatggattgaattgggggagatggattgaattggagggggggaagagagagagagatgaattgtatcgagaaagagagagaattataataagaagaattgttagcgtaaatgtaggagagatatagttaaagggcaaatcgagaattttgtctaacaaaagtgtctcataacttaaaaatgcctaaatcgacaaataactttttaaaagtgtctcacaatataatattctctaaaataaattataataacttgtaagtttgtaattaaccatcgcccaaatatgataactatcatcagtaacgttttgttccaaacaaattgcctttattaacgaaaacaaattgcctttattaacgttttgttccaaacaaatataataactttagttatctcaaatatgtgtcaatataatgcaagaaaaagaaaaaaaaactgtaaattatgaaaatcgacgtcacaggtaaatatactaacatgttcaactttaaataatgcaagactaaaacaacggcgtcggattagaagtctaatctcccatgaacatcaatttctgagctacgtggcttcgtttgcctccacatttcttcgtatggtttctgtgcattcactgcatgcgcataagaaaaaaagaaacgccaattattgatattctttgtctaaaacccagaaataaaaaggttcgaaaatg

SEQ ID NO: 26884 - DNA, 3000 bp, Unknown; identical to SEQ ID NO: 10858
  misc_feature (1)..( 3000): 2750-1469P.txt file - cDNA_ID_2716686; gDNA_ID_2214456; Annot_ID_132939

SEQ ID NO: 26885 - DNA, 3003 bp, Unknown
  misc_feature (1)..( 3003): 2750-1469P.txt file - cDNA_ID_2716690; gDNA_ID_2214456; Annot_ID_132938
tctcatgtcctccactgtttccacttccactaatccatcccgtaagctccctcaaacgctgcgtttctgatttattttgtagaaatatatatttgtttgttgttgttgacgtgattcatatcttatcctaccagaataaataagatttaataaatagtatgaactgttgactgagtcacaaagaaaaagatgatagctgttgattctgtaattatcaaactatatagtttaattaatctttttttggttatattaatgggcacagctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgtaagcattcatatttattacactttctatttgcatgcgtaagtagctaagctaatctccaaattttagtttaggttttggtgaatttagtattttataaacattagatggttttggaaaacttgaaattttagtcggtttagttttttgtttacggttttcaactttttctgatttttttgggttggttttagataaattaaagttaaaccgacttgtgtggacattgaatatttgatctataaacagtgtatgaaaggactttgttgtgttgtgtgaccccaggatggtgttgtcatatgaatcttgtcgcgtgtgattggaaagtgacaaatctagaatttggaagtattgtgtgataaaagtcaatagtaataagacatttttgacctttttctttcctttttggctccgacgttttgaaaaatcctctgtttttttctctctttatttctgcattattggtgtcttttctccgttgtaccccttgagctttttctggcttgtgacggtgacactgtaaaagtctcctcgttcatcatcttttaatttattgtttccccttttgggatttataattttctcttctaccaccaaagtttccatttatttaattttgttttgattttttcatgcaggcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaacgaacctcattttgtgatgaatccgtttttgtgatggttcgggtattgactcgatgaaatttaaaaaaaaaaaaaaaacaaagaatgttgtaatttggatcggttttattttggatcatgtcgatgaaatgtaattgtttcttgtttctcttcttgtaatgactcgataatatcgggacagcattatatgaaacacacaagttttttttaggggagctcaaataattagttataagcaaaaacgtattatcatttttttggttataaatcaaggcaaccagaagcacaatccgtgtttacttttgtggtagtttataatgtgaaaggattggtttggaccgtgtcctttatttaatgttgttccaagtttacagtacttttctcaataagatggaaaaggaacgaacgaagaagagtgaaacacgtgagtgcatgaatttagttgcaatcccttatagttattatatccatgcaatgtagacaactacaacgaaaggctaattgattaggttggtttagagattgtttgataatgctagcctagatccaaaggtcacatcagaagagaccacaggctactaatgggcttttatctaaagcctgtcattaactactctattatggctaccaagtaagtcttctcaaagtgtattgggccaatcattaactaatttattgggctagattttaagtccattggagtatatactattattacaaacgacaataatattattattacaaacgggccgaaagaaaagagtcaaaaggaagagtcaaacttccgaataatccgcgcgcttaacgttcgatcgccaccgttgaatgaacaaacggtcacgatcgtatctaatacagattatttaattccatttttttcttgtggggtgatgatctctgaacagaaattaagggtatgagaatgattgattggtcttggaattgtgtaatagaccaatggcgagaaatgccatctgttcttttttagtttaagctatatccgctccgccgcagagatatatatagatatttctataaatatgtttttgtatatatacacagagagttttgattaaggaagaaaaatccttagatcattttttttttgttatctttgtttcgtttttctggtagaagagagaagaaggagagacgaattggcagctaagcgattctctctctttctctctttctcttctcgtgtaatcttttggtgttcttgaaaccacttttttttttgttaattcctctgtttccttggaattgttttctgcttttttaagaagaaaaaaacgatg

SEQ ID NO: 26886 - DNA, 3003 bp, Unknown; identical to SEQ ID NO: 26885
  misc_feature (1)..( 3003): 2750-1469P.txt file - cDNA_ID_2716690; gDNA_ID_2214456; Annot_ID_182643

SEQ ID NO: 26887 - DNA, 3003 bp, Unknown
  misc_feature (1)..( 3003): 2750-1469P.txt file - cDNA_ID_2716694; gDNA_ID_2214456; Annot_ID_132937
ttcttagatgttaacccagaacttggaaattcctataatgaagtcattgctcctcaagatattgccacctatggtggactctgtgccctggcaagctttgatcgatcagaattgaaggcatgtatcctatttagcatttcttttaactctgccatttttctccaacacttggtctataacttagtctaattttgcagcaaaaagtcattgacaatatcaacttccggaatttcttggagctagtgcctgatgtgagggaacttatcaacgatttctattcaaggttgcatattcttaccaagactctcgtctatttcttgcatagcaccaaattactaaccttgaactaaggattattagtgtgaatacccactaagaccagatttacccaacgaagtccctcataattattatgtcccttgaatccactatttattctaatcactgactctgataaactgaagtagctgttgtgacgttagactctaatcctgtatcgattatgaaggcttccaatgttgccctccaaattcttatctatgttaacaatgcgtaagacatgcaaactcgacccttttagactgtattctcgttgaatctaattattaagtttgcttgttgcagccgctatgcttcctgcctggaatatcttgcaagtctcaaatcgaatctgctgctggacatccatcttcatgatcacgttgacacactatatgatcagataaggaagaaggcactgatccagtacacattgccatttgtctctgttgatttgagcaggatggccgatgcattcaagactagcgtctctggtctagagaaagaacttgaagccttgatcacagacaaccagattcaggtccgtagtgtttcccgaaataactttgttttatgttactgtcattttaaaaaccttaatagaggcaaaatcttttttccatcccggacaggcaaggattgattcacacaacaaaatcctctatgcaagacacgcggatcagaggaatgcaactttccaaaaggtacttcagatgggaaacgaattcgatagagatgtcagggcgatgctgttaagagccaacctcctgaaacatgagtatcatgccagatcggcaaggaaactttgatgacatctgctttgctaaactgagaggtaatggcctattccaagatcataagatatctgttaaaatttaatttggtttagttactggttagctttctatctgaccttctctgttctctagttatcgctttgttttgtcaacttttagtttaagattctttgaattatctatggactttgaatgaaatcccgagtgtgaatctatagacgcatgaatcacactgaaagtgaaatggtcaaagagtacagacataagtacacacacttggtttcatgggccgatatgatttatgatctttgtatgcatgtgggtggtgggatcaaaaatctcatctcccaactaatatccatttcattttgtcaactaaacgtcgtatattatatgatagtttgtggctttgtgcacagttgtcactctatagttgaagacttttttttttcttatctacaagaaataataatcaaaacggttaggtcttttttttataagtagaatctcgaaaattgcaaaaccaagatttgatgtcggcaaacgcatcatgtagactaagtgtgaacttttgattttcttgtgtcaaagaacttttgatattaatcactcgatagctacgtttcatcattattagtttcttctatagaatttttatcactgaatgggatagttcacattatctggtactattatttttactattgcaagtagttcttttctatgcatttctttgaagttgttctctttgtagtttgaggtatcttatatatatatatttctatatgtttgtgtttgccaggaatattcaagggtgttttttcaagattcgaaccaaacgagaaattgggcaagattacttttttgtaagaaccaagtgtttcaatgagtcgatgacatttagagtaagtaaaggttttattctaagatggacagtccattattaatcaactattgaatgatattgccttttaaatgagtcttaggtagcatcgcaataactccatgtttactcaaaactcacaaaccatgaagttaagaatccgccaaatttggaagatgggccaactctaaatttactcaccccaatactccatttattttgggttgcattgatgaaagtaatttgtataattgataggttgtgtatcaaaaaccggatctcattatttgtgatctttgcattagttatttttggagactaataaccatctttctaaactgtgagtaatacaaatataaacaacttcttgttcgctatggaaaataaaacataactctttaggtacgattcacgatgcaaaaacaatagtcatcgtgaataaacatgtccgaaatacatgaattaacaaatgaaacgctcaacaaatgaattgacaaatgaaacgctcaacaaacgaagaatctcacatcccatgatgaaattgggatttacaaataaaaagtagcacaagaagaagggggtagaacagtaattttaaaagaaagacagcgttgattcaccacttgaagtggacttttatagcaaaaagagttgagtaacgtcaaaagagtcaaacccaacttttcaaaggttgtgtaaggctttccatgactccacatcttcttcttttccctttttatccttttctcttctctctcttttattttttcttttgaagtaaattaatttcacgaaacaaatcagagaaccttttatatcttcctttttcgtcgttactatcgtcctttacctttttcatttactgttctctctctctctctatctctatctctatcttctattcatggacatgcaccgaagcgacaaagcttagggcttttctctcatccatggcggatttcttctatcttcattaaatatttccctctttattaaaatctcatg

SEQ ID NO: 26888 - DNA, 3003 bp, Unknown; identical to SEQ ID NO: 26887
  misc_feature (1)..( 3003): 2750-1469P.txt file - cDNA_ID_2716694; gDNA_ID_2214456; Annot_ID_182642

SEQ ID NO: 26889 - DNA, 3003 bp, Unknown
  misc_feature (1)..( 3003): 2750-1469P.txt file - cDNA_ID_2716698; gDNA_ID_2214456; Annot_ID_132936
atagttttcatcttttgctgtacttgaggcagaatccagcaactcctgatgtcaaatctaataacctgaatgaaaaacgtgacagcatttcaaaaggtagtggcttttaatttaagtggcatctctgatttgacgttttccatctctgattcttctatatattgctgatgcagatagtatccatcagaaagttgagacacctacaaagattcacagaagggtaactattatttattaaagttcaatgtcatgatgcatcaaatactctttagggacttcttgtgtctttagtatttcattatcaacattttttttatccatcttgacatttcagcaactaagagagaaaaggcgtgagatgcgggcaaatgagttagttcagcacaatgatgacacgattttgaaactcgaaaatgctgccattgaacgctctaagtctgttgattctgcagtccttggtaaatacagtatttggagaagagaaaatgagaatgacaactctgattcaaatatacgcttgatgcgggatcaagtaataatggctagagtctatagtgggattgcaaaattgaaaaacaagaacgatttgttacaagaactccaggcccgacttaaggacagccaacgggttttgggggaagcaacatctgatgctgatcttcctcggaggtaaattactccttttggtttctactacttgccttttttcgactgcttgtgtacttcttaaagtaacatgctctctaaattacttttcatatagtgcgcatgagaaactcagagccatgggtcaagtcttggctaaagctaagatgcagttatatgactgcaagctggttactggaaagctgagagcaatgcttcagactgccgacgaacaagtgaggagcttaaagaagcagagtacttttctggctcagttagcagcaaaaaccattccaaatcctatccattgcctatcaatgcgcttgactatcgattactatcttctgtctccggagaaaagaaaattccctcggagtgaaaacctagaaaaccctaatctttatcattatgccctcttttccgacaatgtattagctgcatcagtagttgttaactcaaccatcatgaatgccaaggtaaaatcattagctcttatcacttgattcgtcctaatatctgtatgtttaattttagatacgcattgcagagctgaaattaaaaatgtctttattccctatatgtgcaggatccttctaagcatgtttttcaccttgtcacggataaactcaatttcggagcaatgaacatgtggttcctcctaaacccacccggaaaggcaaccatacatgtggaaaacgtcgatgagtttaagtggctcaattcatcttactgtcctgtccttcgtcagcttgaatctgcagcaatgagagagtactattttaaagcagaccatccaacttcaggctcttcgaatctaaaatacagaaacccaaagtatctatccatgttgaatcacttgagattctacctccctgaggtttatcccaagctgaacaaaatcctcttcctggacgatgacatcattgttcagaaagacttgactccactctgggaagttaacctgaacggcaaagtcaacggtgcagtcgaaacctgtggggaaagtttccacagattcgacaagtatctcaacttttcgaatcctcacattgcgaggaacttcaatccaaatgcttgtggatgggcttatggaatgaacatgttcgacctaaaggaatggaagaagagagacatcactggtatataccacaagtggcaaaacatggtaaataactctttaattctttgcaacaaatagtctaatgatggtttattattttatttattgtggtttgctcattttggcttgtgttgtttagaatgagaacaggacactatggaagctagggacattgccaccaggattaataacattctacggattaacacatcccttaaacaaggcgtggcatgtgctgggacttggatataacccgagtatcgacaagaaggacattgagaatgcagcagtggttcactataacgggaacatgaaaccatggttggagttggcaatgtccaaatatcggccgtattggaccaagtacatcaagtttgatcacccatatcttcgtcgttgcaaccttcatgaataaaatcaaatctttgttagatgatttgaggtaattacttctaatgttctgttgttcccattccattgctctttattccacacattgttaattgtttattcatatcgttttttagtcattcttttcttctcttcttctttcgggttaaaaacacttatgttattttttgagtttttctaatgatagtaatatgtttctggagattctcttgatggtcttgtgaaaaaattgaagaacacatactatctctctatttactatatactgtaagtcaaaataataatccaattttttgttgatgtgtcattaataaataaataactatcattaataattggattggttacacattttaaattttatttatgtttggatatccaatttttttttttccattgctaatttaattgttatcattatgatgttcatattcttttcttgtattggatcatattgtatatctttattttccaattgtaaatattcaaaataatatattttcttggaaaaaaatctattgtggtttctctttttttatataagcaactatttaatggtaatatgacatataataataatttaaaaaattagatagtatttagattttagactattagtggaaaattttacaaaataaataaatcccaactatgatagaaacccaaattgagtgaaaatagaagatgggctttaaatcggaccgacgcttattgcttactaatacaaatcgcccttccttaaggtctgaagacgaaacgaagaacaaacactgaaacaaaagagaaaaatcccaaagctagaaaccctaatcccaaacgaatcaatg

SEQ ID NO: 26890 - DNA, 3003 bp, Unknown
  misc_feature (1)..( 3003): 2750-1469P.txt file - cDNA_ID_2716702; gDNA_ID_2214456; Annot_ID_132935
cacctcttgacgcaagccctgcaccaaaaagcagaagattaactacaatttatcttagctctatttattttatacatcgttataatataatagttagtttgactatgtatacacttagaatgaacaaaggtcaaatttcgtatatatataaagataaaatgaacatacttaagaaaaaaaatgattgacctgagtatcttcaagcgtatcattgtccaaaagattgtctttacagcgatagtacctctcaatggttctgccaactctacagtttataaaacaaaagaaaccacaagatattttaattaataatctgaatttgcttaaattcaaaaccaaagaacgaaaaccttaagttctgtgttaacttttaatgcatgtctaaaggaaattctaattacacaaaaatctctgggaagatatatctgcgtaatggattatagatctacggctacccatgataaaccctaattaatttctctaattagaattagaaagacatatctatttaaagaggcaaaacgtatatatgaggtttcatggatcttaaggacatacacatatcaaagctggtgataacaattaaaacccaaaataaaacaaagaagttttctttcaaaagatttaccggatctaaaagctaaactgacccatatgtccgatggatcctgagagatcgatggatggtgatcaaccttaactagttagggttagaataaaaagacataacctttttcagatacccacaagacagaatttggtttcttgatcttaagaacagacacaaatcaaacatggatgatcttaatcatattacccatgaaaacctaggttttcatcattaggaaaaccgaattaatgatcttgaatgaatggatatacgtacccgacattgctgaactcgtagagcttgccaccggtggagaagattatgagagaaacctctgcatcacaaagaacagagagttcgtaggctttcttgagcaaaccactttttcttttggagaaggttacttgtctagtgatcttgttctcaattctcttcacttccactttgcctcttcccatctctcactcgctctctctcttctttctacgttgtttcttgtctttaatatctctcaatgttggaagtttacatgtacatatcaatcaaaatgaattactttagttctattgctggatatacgtaaaaaaaaaaagcgtatttattaaccctatagtttctctttttcttatcaacctatttcaaccctacatacatagtggaaccgagttttatctcaataggacaatatctcatcataaattacaaagttctcatttcaattaccatgcaagaagaattcactttccgtttattaattatagctagagtgtaaaatggtaatgatcttactgttgtttgacccaaatgaaaattcttttggtatataaaaaattaattgataggaacaaaacgaaaactttctcctacctagaattagaagtatggaaatacagttggaccactggaaaaatcatcattatttcttttaatatcagtatttgatgacatattgttcaaagttcaaactggcactcaagaaaaattgatattcttttttgatatgcaacagttggaccaaacctttttacttaataaagtttacatctattgtgattcttcaaactaacacttatataaaactgttttttttttgttcaatggctatgatttcgtcaaggttaatttgtacatgtaaacaattaaacgttcatccactaaatgttgttcaacctgaaccgatgtggagtcagtaaaaaacatataagacatcgaccctaatgacaaaaaacagagtgtaactatattacgtgtgtgaagtttattactagttcgggaagttttaattggtcaaaaggcgcaggaaggttcatcatttgttgttgaaaagttgcattccttttcaaaagaaaaaaaagtaaggtttttatgaaaaagcctttcaagagaaaacaaattttggttatatcttatttatatggtttgacaactgaatcaaacatttaccaaggttgtatttgatcattattactaaaaataaaatcagctaaaaaaaaaccattactaggtctagttacagtgttacactgtattgtaaatcatttagtaataaaccaaacaaattactatcatcatttttaatttgtgtagtcattacatacatgcaaaattgtaaattaaattataaaatcatgccatactatactgctagatgaaaattgaattgtcatatcaaattaaaaattaatgtattttcatgaaaactggaaaaaaaaaactattaaattagaaaggcgaaattcaacgtgacgcatctatctatataggcttgggcttataatatatacaaaagcccagttaattattaatgggtcgaagtcgaaacttgaaagcaagcagtgtcatcgttctatttatcatcagcccaaaaaaggaagaaaaaacaaatcaattttatgttcgtttggtataatatcgattttaattttaaccaagtaaaccggataggaggagattcgtaaattgtaatcgataaaagagatctgtgtcaaaagtacgcgtgaggttctctcttctctgcaaacaaaaatcctggcgttgatagcgattggttaattgtcggtgaatcaacgtttttctgttacacatatcaatcaatcatcatcctcttcatactctcttcttcttcttcatcgtaatcattagcttcaattccgagttttctcttcgtcgccgttgtgctagagttttgtcagatctcgccgggaaattagcaatggcgttttagtctgtttacctgtgaagcttttgcgtaaacgctggattcttctcaaatctctctcacctgatctcttattagattccgagtatgatttgtttctctccttcattatattcgggttgcttccacgatttcgttgcttgatttagttttttttttgaatttgatagggatg

SEQ ID NO: 26891 - DNA, 3003 bp, Unknown; identical to SEQ ID NO: 26890
  misc_feature (1)..( 3003): 2750-1469P.txt file - cDNA_ID_2716702; gDNA_ID_2214456; Annot_ID_182640

SEQ ID NO: 26892 - DNA, 2096 bp, Unknown; identical to SEQ ID NO: 10885
  misc_feature (1)..( 2096): 2750-1469P.txt file - cDNA_ID_2716713; gDNA_ID_2214460; Annot_ID_132972

SEQ ID NO: 26893 - DNA, 2096 bp, Unknown; identical to SEQ ID NO: 10885
  misc_feature (1)..( 2096): 2750-1469P.txt file - cDNA_ID_2716713; gDNA_ID_2214460; Annot_ID_182731

SEQ ID NO: 26894 - DNA, 3000 bp, Unknown
  misc_feature (1)..( 3000): 2750-1469P.txt file - cDNA_ID_2716728; gDNA_ID_2214460; Annot_ID_132967
accaaacttctttctcgaggcaagagcagtctccaagttgatagcccattcttcatagttatcacctcggagaagtggatgggagatgacatgtcccggatgatcacttgcttttgaataataatatgacacaatatcttcaagtgagtaatgtgcgtttaatggggatggaattcagattaaagttttaaaattatgttttcttgttctgaaaccagatatgatactaattaattgctggagtagtaacatgatacaattaatcgtaagacaataaatatgcggtcgattcataagaaccacgtctgatgctctaaagatttgtgagactcgtttttatgtaaagcataaatgatatttgttttgttttcataattgtatataaaaatgcaaagaaataaacgatttaaactacgaattaaaaacactgggtcatacagtaattcagagatcaataaagaatgaaacaacaaaacagaaattcaacaattaaacaccatgactggataggggcatgcagaatccactgatggactaaagccaatcttcttcacaattaatgcaattgtctatgtagttcaggtatattgttatatcgtataattttgtttgtaaaatctataagaagtttgtgaaaattcaaaatgtaattttgtatgtataactttacttttagatatctctttggttgcttcggatgtggaagtcgagttatgctaatcctacctatgatgttcttagcatgtaatttggttccatccaatttcaccaaaagtatatatttgtcttgctatatcatatatggtactttagctgtctcaactctcttgtgaatataacataattctaggtgtttcattgttcgtcgcctttggatttttacgttatggtagaaggtaatctgtcgctacttgaatatatactacatttgacattagaatgtaaatatgctcatcttgcttgcattctagttcaccccgctaatgcatggatagactagattccctcttggtgctaaagccgagtacatctacgtaccatttaaaatgatcatggcatgcattggtttatcaaaaaagagcttgatttcttatccttgtattatgtctatcttttggcagcctaatgttggatcggtttctagtagaatttaaagggcatagcaaaaaagatgaaagaggtgaaacatcaaattgtacaaaatcataaccaatcaatatttacaatatgacgcttcttgactcttcacactctttctctcttatgtatggttggttatgtgacaacaatttgctttacatgtttcctcatccgttgtatcttggtagagacacacacacatacacatgtttatcttgatatctattaatccttaccttcttggtttaaattttagactggacaactaaccaaaggtttattcatttaatatggtttagatatgcttcgctgctttctacgaggaagaaacccatgatatgatggatcatccaatccttaatctcatatattacctggtaagctctctcttaaactaatcataaaaattgatcatgaacatctgtctcatacataatcaaaccattgtttctgcttgaaacctaatcttgttgctcaattacagttggtagagatattaccgtttctctggttctgcccaccttgagaaacctgccaccaaaacgacgtgtacacgaaagttaatgatccttagaccagtttaatcccataatttctctgaagaatctcaagctttctatctcatttggatgttagcttcaataatctaagctttaaatcttgatggtctaatctccatttacatgcttttgaataaatctgtttgacacaattttttcaagtctaatgcggttaattaattgattgaccccatctgttttgacataatttcttcatgtcttttaggttttttaaccaattatgatacaaattttaaatattgctaccccaatgtctttgtttgtaactttgtgttaaaggccggatctaccaagatagccctgtctaaatttgatttatgttagtcatgtaggtgatgtatgatatcttataatggtcatgtaggtgatgtatgatatcttataattaatcatgttggaaatcacccccacaataatatatgtaaatatatatcttaattatatcttaaaatatacaattatggtaatcaaacttaacctactaaaagaaaaacattagatgataataatggcatctttgtaatatttgataaaaataaaagttgttatagtctatttatttgtgaagatgtataaaatattgacatttctcttctctatatacgattttcatgtatcttctcctcatacttaatttgattataagtttaaacacttgctgcaattacaaggaaagaagttgacaaagtggaatggtcaatccctattggcaaaaatagatattttatatccagaacatccaaaatggaattcataagtttccgattaaattttgagtgttgacaaaaatagatatttttctatataaaaaaaaaaaattggtatctatccaaaacactacttgtaccaaaatattatatatatatatatatatatatatatatatactatgtattgatgagtatactaatgaatctaattaatttgtttttccttgcaacttgttttagaaaataaattatcaaaaggataggttcgagacgttgactttgattgagacctttactcagtattattatgggtatccattgactttaaacatatcgaccgttgaaaagtcaaaacttaaatgtgaactacgtcattcaaaatttcttctttcttttcagcatagaagtttattcgttaaatcaaaagaaaaactcaatttttctattgaatattatttgattaatttcatggcttaaggaaatatagaatccttctccttctcaaattctcctataaatcaacccttcacgtcaaaactagcttgctacacttaacatatcaaccaatg

SEQ ID NO: 26895 - DNA, 3003 bp, Unknown
  misc_feature (1)..( 3003): 2750-1469P.txt file - cDNA_ID_2716736; gDNA_ID_2214460; Annot_ID_132965
ccaccacacaaagacgcatgagcacaaaagcggaagaagacataagctcattattgtgagtagaaggagaaagtgtcaagtgattgaagtattgaacatatattaaaaaaaaataagagaaaattcttttttaaaaaatgtttgcagaagagtgggtgaaaatttgagtcagaacttagaagaaatgagaccgacaaaaatctaattttttgagtaaaacaatgaaggaaatatgagtctgatgaactctgacacaacttttgtttattatttggttgcaatgaaataaattggggttaacgtgcaattcaagcaatctctcagtgataatgtattcaactattcatatactacagtcttctccacgaactatccacaaacattaccatatatataatataatatatacacccacccacacatatggacttctgctcccccattaaaaaagtatctaatcaagttttcagttttatatcagtttttagtttggacaaacaagattttatagataggttacatccattgaaagaggagttgattacacaagataataacaaagccataacaattttatatcgttttgggttgggaaataatctataaaaaaaaccaaatagaaaagctgttacagttttgcttaagttgggcttcttaacaaacaaaatctataatatgaaagtttttttaaagatcagtttatgtttagcttctttcggtttatagatgtagatattttctagcataaacattagactaatgtgagctatgcctatgagtttctcgtaattattcgcaattctttttttatcatccctttattagtctctatatcttcatttctttctttctttctttttttttctcttcatttcacattatatgaagatgttttctaacataaaaacttaaaattacataatccgaattagattgctacgagctatgcattttcttgtgatatttcacaattctttttagtaaaaatgtctcattcagtgctaaatcacctctaggttttttcctctttttttgaataccaattcacctatacgttagttgtcataaatacgtcttttctaacgttggagactaattggagtagttaaattaaatgactcgaactactactactatagagaatactagttacttaggtataataacatattatatatttctatcgaactgaaaataattgaataagttatagtatatccaaaagaaaaatagctttcagagtatccgacacccacgtgcaaggggaatgaataaagtcataataaatatttttctctttaagactcccacattcattcgcatcattatcacttttttttattcaccattttttcaatgaattgcattattgtatatttacttgaatacttccacacattagtttactaggttatgttataatataacaaacacatacagttaatcgacaatgtgtaaggataaattattgagctaaatttattcatcaatgtatgagttttttctgtcagactgtttaataagattgacttatgatatgaataaatgactgatgggtcgaaaccagaataaaaagctattttaattatgattgcactaactttaacgtgtcctttatttctataaaagataaagaataaataatcaagaaaaaagtccttaacagaaaaaaaaaaaaaaagagaaaaagaagtgagagacagcgaagaaaagaaaagctggtaacctcatgggatgttttggctttgctcaattatttcgaacttttgatatgattttgttccattccttttcattaatcggatgtgaaagctatctacttcgtttattgtataaagtgatgaagaattcttacaatctgaatgtgaaaagtaaacagttctttggctatcaggatttggagcagcgtttaatgcggcatggaaacggtgaacatccgtgatcactttaaaaaaaactatggcatacacaaaacttctgttttaaaaataagcgtataattggcaatgacagaatttagcaaaaaatgatgatgatacaaattaatggtgattgtgtgacgaaatttgacaaattagttaagagaataaatgataacaaagatgaccgaactaaagatttagttaattaaagataactcaaaattattgaataacatgcatgcgatttctctggttcacatattcttgaataagattacaaaaaaaaaaaaaactaatagaacaaatggataattaattatctgacgatttaacaagaactatattaataaaggttatcaaaagaataatgttttgactcgtaaaattaaactagtcatatgtgagctattttgaaatattcaaagatttacctagaataagaatttattgagaattatttcacaaacttaagttgtgatattggtttgttcgtcgcgttttttgtttcaaccaaatttcacccatttaacctgattaaactattatatactataaatgtgaattttcttatattttggttaacaaattatattatattatatgggttaaaacttgtgtaataacgtagcgataccactaacataaaacaaaatattaattttagctagtgtaacaacagtttcaataatattttccctttgatgtaactaagcatataattttagcaactataacaacagaaaattctatccgaatagcaaaaagaattattgaagttgatgtcattaatgttaacacagtctaaattaaaaattattttcataatttattattttttcacttaatgttttttcctcttgtcccctataggcgttagttactagtattaattgtccactcgtcgcggaaatgtaacacacattcctcgctctctctctctctcaaatcacttgcaaagacaaagatcttccacttcctcttcttcttcctcttcctttttgcctttctctgtctccctctagagtctcttctatataaatatcactagatttagtgtttgatcaaatcacattcaacaatg

SEQ ID NO: 26896 - DNA, 3003 bp, Unknown; identical to SEQ ID NO: 26895
  misc_feature (1)..( 3003): 2750-1469P.txt file - cDNA_ID_2716736; gDNA_ID_2214460; Annot_ID_182724

SEQ ID NO: 26897 - DNA, 3003 bp, Unknown
  misc_feature (1)..( 3003): 2750-1469P.txt file - cDNA_ID_2716766; gDNA_ID_2214461; Annot_ID_132980
tatgttttgctaaaggatgataaaagacttaccaggagaatgtctgctccttcagcctcgtcttcacgtgcctcaatcaatgcctctctgtagtttgctgggttcatctgatacctgtagttcaaaacgtcagtttgtaactgttagtgttagcagaagaaatgcaaattcagtatcgatgagggttgatgggatttacgttttcttgtctccgaaacgcgggtttgagtccagggcttcacggaaaggaccgtaaaacgaacttgcatacctgttggccgaagattcattcaattagacagaacaaacaagaacatgcttccagaaaataaatgtatgattacttacttggctgtgtatgacatgatggagacgttttgaaatccttcagcatcaagagctgagcggattgcacctactcgcccatccatcatgtcactcggactaactacgtcagcaccagctcgagcctggaaagagagagagaagaagaaatcaacctcattggtaagaaaaagtttcagacattttaactctttgatatcgaaaaaaattacctgggaaacagcttgtttacagagctggtgtactgtttcgtcattcataattacacctacagagataaaattgtatcaaagctccagttaaaacgttatagatggaagttgggtataaatacttaccatcctctctaactatcccatcgtgaccatcagatgagtaaggatccaaagccacatcagtgtagataatctagcaacagaggagaacattagtcacaattgcaaattaaccaatttttcatctcctggtataattaacaaaactgggattacggatcttacaagatcaggatatttgtctttaagaagacgaattgttcgaggcaccaaaccattgtcattgtatgcctcatcccctgttgaattctacaaaatgaaaaccaaaacaaagcgttaaatatacaactcaagaacatatgtacacaaatagaagagaagtgtgaaacaccttcaaagcctcaggaactttagggaacaaaacgatactgtttaccccaacagctcgagcctttgcaacctgtttgcatataaaatcatgttattgtaacacagcggcaacagatacaggaatcatcatatcaaaacataaagccaaacctcttgtacaagaccatgcctccagccaagtctgtagcaaccgggcatagctccaataggcgtgtcttcctcacctgccacactccaaaaccttataatgtttcttaaagacaagagagagagccattgaatgtcagaatacaaaagaaaataacaaccttcatgaatgaaaagtggatatacaaaatttgcaggggagatatcagtttcctgaaaggcagctctagtaacaggggaagcgcggttacgacgtgggcgtcggcttagattctgaaagcattcagtaacaataagccacttataagcttcaaccttacagctaaacattagattctgaaagcatgaagtaacagtaagccatttaaaagtttcaaccttgcagctaaacatcagattatgaaagcataagtaacagtaagccatttaaaagttttaaccttgcagctaaacattagattatgaaagcataagtaacagtatgccacttaaaagtttcaaccttgcagctacttattgttcactatacggagatacagagatagctaatacacaagagtgatgaaatcaattaaagaagtatagattgattcaaattatgttcttagataatagcaaaatcatctatacaatgcaactagagcaaattcacaatgaaagtaagagacttggatactcacaagaggcttaattatcggtgtcccaaccggagcagccggtttaggtggaaccggaggagcttcaggaacatttccagcagcaacggcagcttcacactcagcatcactcattccaagcttcttagcatgtccattgccggattcactagctcttacgacaagattacgacgttgactagttgcaatgcgagaagaagcaacactcactttactcacattcgatctcagaccaatatagcttttgcaatcgattcctctagtcgaaggaaagctgcaagaagcattaaagatgggtgtagtagccatgaatctgcaacacacacacaggaacacattgaggattttataagcaaattgtgatattgaatttcgaaattgaggtttcttagatgtacccgtgactaagaatgcaggtttgaattgaaagttacagactttagatcgtatattgactaaacaaagcaagatttaggtgaaaaatgaagaagaagaagattaaagctgttttgttcaaaatgaaaacacagaaagcaaagagaaacagagtaaagttgtgttattcaaaccttgaattgttaagaagttgttgggattaaggaagactgggaaaaaaattgggtttatgagaaagatgataactttggatgatcgccgattttgacattgacaaagaagatagagactgatgttcacgcgctttatctacgagtttgagaactgggaaattttaagtgttgatggttttggaactgggcttgatagagttttaatgggcctgtattaattagatgaaactgggcattctaaagtattgtccagttacaaaattttaaattctctaaaacggtctacaactttatatcggtactctttttttttttttttttaaatttatcttgcaaataatggaggaagaaaattcaaaagatggaagaagcgagattgtttcagtaggcctacgaacacatatagccataaaggcatttcttactagtcttgattgagaaagacaaaagataaaagacaaaagacgaagacttgagacttaatttctgtccaaggaaacggaatctttctaatctacctcttcgtacaaaaaattgtctgctttacaaaacaaaaatattcaggaaagaacaagttctcttgagcaaatcataaacatg

SEQ ID NO: 26898 - DNA, 3000 bp, Unknown; identical to SEQ ID NO: 10896
  misc_feature (1)..( 3000): 2750-1469P.txt file - cDNA_ID_2716770; gDNA_ID_2214461; Annot_ID_132979

SEQ ID NO: 26899 - DNA, 3003 bp, Unknown
  misc_feature (1)..( 3003): 2750-1469P.txt file - cDNA_ID_2716778; gDNA_ID_2214461; Annot_ID_132976
aaggaaaaaaccaaacaaaactactatttgattaaccccacataagagctgttctatcttgtctctccctcctttcctcttccattcctttccataatcaatctttctttttattttattttattattttcttaatttctcttcccaacatcccttgtgccgtattcatcgatgatgtttactctaacatcatcaaccacataattattaacattttaacgttcattttcactttcgattagactactattcattactttgagactacttatccgtctctaactgacatttcacgcatcacatcgtgccgttctgcaatcaaaacttttgtatcaaagtacttttacttatccatgcatacatatagcttcacaaatacccgaatatttattgaatgagtatgatttaatttttattttgtatggaatgtgaatgacccaaaaagttatttttttttttggtaaggaaagagaaattaaagaagttataaacaatctggtttttagaagacgagtaaaaattgttaatttcaactaattatttttagtactcaagtatatattatatttattggcaaaacataaaagatgtaaacatctagatacattttaatccattcgaagaacttaacaaaaaaaaatttcatacattatattacattcggtgtggtacagatcgcacggtcaatcaatctaaagatcacttgcggtgattgagcgacgttgtatgattttatccatacttcatattgtttactgttatgatccattcttcacaagattgactagacgcgatatatgtgcactcttatcatcaagaagtgaaatatagcgtatgattagatatgtgaatttaaaggctagtcttacaagttgctagcgaatttggaaaacttgtatagtcgtttttttttttcggtatgatcacccaactttgacgtatctatttcagacactataaaagcatatgtttcgattactgtttatccaaatggaaatgtctcgcccaaaacctcaacatgaaagtcaggaaagtccaacaacgtagttttcaagaagtcacaatatgtccctcctctcgtgtcacaccactcctagtcctagcgaactagctgcatagtgtaaaatactttatatatgaaaaacttagacataaatatatatatacgtgtgcgtgtgtgatgcatgtttattgttttttattcaggcctatatgcattctacatgttttagatcaagatggtgatacagagacactactaatacaaacacttgcataaatcctctatgattatgtcattcgtattcattattttaaaaagaaaatttacgtcaatacttgaaatacattaattgatatatgttttcctagttttggagaaaagggtggtgttcatatgttgcaaaacacaaacatgtaaatacagcaaagaagacatagtggacccatgacaagaaataaggcccaaaagttgggctaatttcagccatcacgacaaaggctacttctcatttcgacatccatattattctattcttgtacacttctctttcattcactcgtcattaatatgccttcaatctaatatatttaaggacacaattatacacacgtccatatataaacttatattgttgccttgttggatatatataaaagttattgtaattagtagttactagttagagtaattttcaggtctaatagtgatgagattaacgtattttcttctttaaatttcagttatttgcaaataatgtcactgctcgatttcctggaataaaggagctaataagagtatcatgttctccttcatgttaccatttcacgtttgcacgttttttttttttttattatgaacaagattacgatcacacgttcggtttgttgtttagtcgttccaagtgtataggagttttatccacacaaaaaaaattttgataggaatgtgtaattccataaagatttccatcgttacacactaaagttttatcttacgcgccacgccgtttgtggagtaaccgagtaactaatttactactagtcttgatgttggtaggattaaataaaagaatcatggagataggatacgattgtgtttgaataattcaatatgtttatatctggaaagatctacaaatttgatatgatcactaagattgtgggaatttattcaaatccaaaacacatagttacaaatcatatacaaatatggaaaataaataatgtctaataacatttgtgtaacatcatctttaatgcgagtcatttagaaatgtaactttttttctttctgatatgtttatttctggaaatatatacaaaattgacctgatcactaagattgtgggaataattccaaaccaatatagaaagtgataatttattaaaaactgaacatttgtgtaatctttttttttttttttttaatgtaatgtcaaattatattcaaaaaaaacatatacttttttacaacttgtgcttcatgtgtaagaaagggagagtgctaaaaaaaattctgaaattgtccaaaaatgattagatctttcgtagagtcgatgttgactaccccgggaatgaacccatttgtgtaatcttttaacatttattaaaaacaaatcatagatagctaagattgtgggaagaattccaaacgaaattaaattcacactaacacatttactaaaatcatagatagatatagaaagaaaaaacttttctactaatttttttgacatttgtgtactcattatagcgagagaaagagatgggcctcaaaacttttattaggcccaaacgttttaaattcattataaaaataaaacaattccacgaaaatttcgaaacccatcactttggcgcttatgtgacgcgcttatttcgccctcaatctcagattatttagtcctcacactcgtcacacccccgcttcctagggtttcatttcgtctctttatcttccttcgtctctttagcttccttcgattctctgactcaatcatg

SEQ ID NO: 26900 - DNA, 3003 bp, Unknown; identical to SEQ ID NO: 26899
  misc_feature (1)..( 3003): 2750-1469P.txt file - cDNA_ID_2716778; gDNA_ID_2214461; Annot_ID_182774

SEQ ID NO: 26901 - DNA, 3000 bp, Unknown; identical to SEQ ID NO: 10892
  misc_feature (1)..( 3000): 2750-1469P.txt file - cDNA_ID_2716786; gDNA_ID_2214461; Annot_ID_132974

SEQ ID NO: 26902 - DNA, 3003 bp, Unknown
  misc_feature (1)..( 3003): 2750-1469P.txt file - cDNA_ID_2716794; gDNA_ID_2214462; Annot_ID_133008
ttcgattcaaattaggtttttttccttagagaatcatatctgtttataaagagtcggctttgagttgtggtacgatttcgtatttggtctctttactagatagttcaccaactgctcgacgtaatttctcaatgaatccctactctctttttcataatctccggcgaaactacctgtagattgttttagatattcatatataggttattgagctttattctgtctgttatatactgtcactttctcaaaattcaaaattttggatatcagaagtcccaattctgttcaatgttttcctattgtaaagaaattgactttttacttcaacaatccaaatttcttcaccatttgtctgatatttgtatatatgtttacttattggatgatttcatcagtaatttgtgggatttccaagctccagtttttcgaatatggcggaagtaagtcttggtatgcttatagacattgtggacgaagagtggatgagggacactttgcctgatgatggtaaccctttttcctcctacattatacctcaagatcattgtgtttctcctattttctatttcataagagattattgttgcagatcttccattgcctccagtgcttgctgttaaaactgatgatactgaagaaaccagtatggctctttgtttttttctttgctttgctttacagtttacatagctttatgattcttaaggtctaaattctttggaatatagtcttttcttaaaactgctagctgtgaatccacactggtgatgcatttctgatccaagatgttaaacacccatattgagaccttgaaatgtcataaggaaagtaatggagacacatacgtcactttttgtgtatgtttcaaacatagtaaagctcaaatttgagctttgtttcagagggtttctgagatttaacaactttcacttccaagatacctatgaatcttcatataagcagcttgactaatataatccctcacattgtgattgtttcagatcaggaaactcagcaagcagatgctgaaacttggcgtgatctagctcttgatacacagtaatagcctcttaagtacaatggaaaattcttacaagtcttgtttctcgttgtgtatgatcaaaaccaaaactgttcctggctttgtatttttttttggtagaagaggggggcgaacccccatttttattaaaactgaaaaactaaaaaaaattacacttgaacgttccgggggtacgcagaccccgctacattgtcgtgaacaatcgacataacactatctggagtagaattaaacaaatgaaaacctaacggtaaaagaaaagcatagttagctaacccatccgcgagatgattagcttctctataaacatgcgaaatccggactgaccagtcctttgaaagtaagccatggcacaaccgcaccaggaaggacagcggatgcgaatcatcaatccctgtccgaagaaaacccactaccatctccgaatcaatctccatctccaactgtgtgacaccgcgctcccaagcgatatttaaaccgtaatatgctccccatagttccgcaagcggagccgaacaaatcccaatattcaacgaaaacccataacaccaatttccatccccgtctcgaactactccacctactgtagctagtcccgggttaccacgcgaagccccatcagtattgagcttaaaccaacccacccttggcggagaccacgcaatcaatctctcctccctagctgtccgcgtcgtcactcccattttgtgcacatgcgccttctaaacatccaacgcacgatccttaataaaacgaacccgatcccgacacttcctgttctcgccaaagatgttaccgcaacgccatttccacccccaccatatggcctgcgaaaaagtgaccgcccatggacaaccattaatctctatctcctctcctaaatttgcatagatccattctaacagcgatttcgaaaagaaagaagagagtctccgtgctggtaacaagcgggtccaaattcccgccatcgccggacagtcccgtaaaatgtgtagaattgtctcctccccactcttgcatactgaacataagctcgaatcacataagtgccgtctgtgtctctcaacattcgtcatcaacacctgatttgcagccaaccatatgaacactcgaactctttcatgagctacaacacgccaaattctagagaaaaaacgcgccatctgctgcttcgaactccagtccaagcttaaaaaagaataagctgacttgactgtaaatttaccattggaacaccctccccaagacaaacgatccctagcccctgtcacattatccaccaccaaagatagtaacttgagcttcataccttctgtgatatacggcgtaagcctctgtaaatcccagcccactccatctctccaaacatccacaactttaaccgcctcccagttcgccggtaattcgcatgttaccacctcacataacggggtctgcgacatccacctatctttccagaagaggatatcaacaccatcccctagaacccagctcaaacccgagaaaaccacctccttcagacccacgacaacgctcctccatgtagaagaccatgtacctttagacaccatccacgctctgttatgaatatcaccgacacggtacttgcttctcaagattttcgaccatagactcacatcatcatgaagtaaacgccacccaattttcgagagaagagccgtattcatctgtgtagagcaccagatgcctaaccctccatcctgttttggcaagcacacacgatcccatgcaataagatgttcctggctttgtatgatgaagacataattgctactctacttaatattaaaaaaaaccttggtggcataaattttaagaatttgtcgctgacgtgtctcgtgatgattcgtccacgtggttggcaaacggctcctatttaaaatctcaaaaccaaaaaaaaaaatcaagcgaggaatatg

SEQ ID NO: 26903 - DNA, 3000 bp, Unknown; identical to SEQ ID NO: 10915
  misc_feature (1)..( 3000): 2750-1469P.txt file - cDNA_ID_2716798; gDNA_ID_2214462; Annot_ID_133007

SEQ ID NO: 26904 - DNA, 3003 bp, Unknown
  misc_feature (1)..( 3003): 2750-1469P.txt file - cDNA_ID_2716804; gDNA_ID_2214462; Annot_ID_133005
agatgagtgcgtatggctttggcacacaggttgatttaaacaatggcgaaaccgttatgcagtactacgtcccgtacctatccgctatccaaatccacactaacaaacccgccttgctttccaggttacgtttcccacttgattctgtgacattttagtctgttgtgatgaaagtttgactatggaagtattagaacatctcttgatggtttgttcttgggtgttgcaggaaccagaatgaggtggctgaatctgagagtagcgagggttggagcgatagtgagagtgaaaagttgttgtcaaggtcaatgagcaatgattcaagcaaaacatgggatgctgtctctgaagattcggttttcgatccggatggttcaccgttgctgaaagatagacttggtaaccttgactttaagtacattgaaagagatcctccgcacaagcggattcccttaaccgacaaggttctcttctctcctttcattttcatttcttagtaacctcattctcagttttgaaacgaaagtaacgttcttggttcttgttcagataaacgtattggtggagaaatatccgggactcatgaccttaaggagtgtcgacatgtctcctgcaagttggatggctgttgcgtggtaagtagttctttgttaagttaacaaaacccttcctgtttggttaactgctagaaatagtgattgagtgatggtttgatgaattaggtacccgatataccacatcccaacctgcaggaacgagaaagatttgacgacaggcttcctaacttatcatactctatcttcgtcttttcaaggtacgtatgatcacttcgaattcattgctcagtaacaagcaccattttctggttttattaatggtgttaaaaatgctgcagataatgtggtggaaggagatcaaagcaacaacaatgaagaaacagagttttgtgaagattccgtaataaacaagagaatgccattgcctccgtttggtgtaacaacttacaaaatgcaaggagatctttgggggaagacggggtttgaccaggaccggttgctttatcttcaaagcgctgcggattcatggctgaaacagctcaatgttgatcaccatgactataacttcttccttaactcgagcttctaaagatcaatcgggtcgttcgtatgtttatccttctccaaaccttaaacaaaaaaaaaagacctcataaccctttttctttgttgttttcaagctccttttgtttctctgtgttttttgttctttttgtttttgtctggctcgttgtgttgttttaggtagcaaccgccatcgcggagttttttctccttttgcaagccaatcatggaagtttctaagaagaaaacagagcttttttttctttttttttaacggtgttgagaaaacaagaaagttgttttcttttcttgggtgagagatcatgtaaattgaccttgaacagaggactctgttttgtacttttctgtctaaaatatataaaaaaatctgtctttcttgtatgtcggtatgagtggaagaagaagactgtttttgatagatttgatatgtcctttcgtttcttttcaagattttttagtgttgaatatgatgacgatgttgtcatacaatatttacttagtaacagttgttgcatacttttttttctatgttctttataatttaatttaaattgtttctatgttcttttcgaagcttaaaagaattgtgcaatcccaaactgaaacagtcaaacttactagttcaacaaaattgttttgctatatcgggctgatatttactgtcgaacacaggtaaaaaagtatttattttatttttttgttgaacacaggtaggtatatgcctacatggtatacaaataatatagacagtttcataacatttacaattgtaacatactgtttttacaatttttgttgtcgttttcttatttatcgtattaaaattgatcttatcctgaattttaaaatttagataactgacaaacgaaaagattaatgctaattgtatatgaaatgaaatgtattgttgtacattttaaattatatagacaatttaatgatatttacaatcacaaccgatcgttttgtcaatttttgttgtcgttgtattatttattgcatttatatcgatcgaaccctaaattttacatgtaattcacttacaatcaaaaataattaatgctaactttatatgaaattacatgtagtaaatttaaaattatattgacaatttcttctttgcatttttgttggcattttcttatttattgcattcaaatcgattaaaccctgaaatttaacatgtagatcattaacaatcaaacataattaatggtaacattaacatgtagtaaatttaaaatacaatacacaatattttgatataattttgagtttaaccaaattatccaacctataaaaacacatgcaatggattcttgaaatctttatgtctttagcgatttgaaatgaatttatgtagattttcatgtgtacacacaataagtaataaaatctaaattatcatctacttaaaataaaaacataaaatttaatcataaaatcaatactaaatatatcaaatcagtaaacaaaaaatcctatttcatattaatatgttaagaaataaacttttatgattttttttttccaaccactacatttatggttgtttttcaaatgttttcttatgattttctgagtcaatttttcgctttttgttagctggatactctctcttctgataatggtcttttgtttttcaaaaaaaaaaaaaataataattcttttttgagcaaattatttggttggaaattgcaaagtttatcaatcaaattaatctcatcctccttcttcttcttcttcttccaagtgacatgaactatacaacattacgcgttttcttctcttattgattccttcgtaagaaatcttctccactagttgaccaatcgagagacttgtggtcttcccggagatg

SEQ ID NO: 26905 - DNA, 3003 bp, Unknown; identical to SEQ ID NO: 26904
  misc_feature (1)..( 3003): 2750-1469P.txt file - cDNA_ID_2716804; gDNA_ID_2214462; Annot_ID_182808

SEQ ID NO: 26906 - DNA, 3003 bp, Unknown
  misc_feature (1)..( 3003): 2750-1469P.txt file - cDNA_ID_2716812; gDNA_ID_2214462; Annot_ID_133002
cacgcatcgtgctcttcgtctgcgctacttccctcgctggattctgctcctctgctgtgttttgcttgtctagtgattcgtttggacccattggaagaatagggtttaggggattagtgactggattgctttacgcagtcctctttgttactaagcaacgatgggttttggagtttcctatcattcaggttttgtgtctttgcttcttgatttatggaatgtttcatcaattttgtatctttgctgattcttacttgtgttttttcaaaacagcgtccaccgttcttcagcttcaagattggtcttccttcggctctaacacaagctttgaagctatctggtgtgctttatgtgttgtcgacgataatgctattgtttctgctagactggtcaggtgggcttgtgtctgtatcgaaatttttgggtgagcaggtcttatcttatgccggcagtttctgtttgattctctcttgggaagtcactcaccatatacataaggttagttaagttttctctgttgatttgctattgatagatgtaattggttggtcgtatagccgtttagattggtggtatagtgtttagtattttaagatccctgtagcttattagtgaacatagttgaggttagcactcagtattacttgagtgatgcaaaacttaactgagaaaaatttgaaaagacgacaagttagctgtgtttgcaatcaaatgttgcattgatagtatgtgtagaattgttttcctgttttgttagtcatttctgtctttactatttatgttttggaagcctataccaaggtctgtctgtcttctgtgtatgtggatcagttcaaagaagactcatataaatttgtatcgatatgtttacttttcttgaataacttaactctattcctacctaaacaactttaagtattcatcggtgagtttgctctgtgtattacttgttacatccataaacttcagctacttttccaggttctagatacaaaagaagttagttataattgttgttttcatatccaggttctgcacacaaaacggttcagctttgctcctccaaaaggatctgctgcagcagaaacgaatccaagcgagcctcttcttgctgctttagaagggagcgctccaggttccctcgagcagtctcttgcataccttgatctctacatggtgtctcagaataatgttgacacatggcgtcgtgctgccttctttgaggagtccaccgagacgtacaaaagagtaattactctatgcttgaggcctttggaagagcttgcctccaagttagcttctgggctagaccacacctttactgaaaaaggttatcagacaccactccagccaccaaccgagtcctttattgatccaaaattcggcgaatcacttaagtctttccaggtaaaacgaaattcaaattttgatcccttttctatgtgataatttcttcatgtagctgtaaccaaaatctgtttgctctgtatccgatatttgcagctatatgcatggtgtgctcaaacatctgcatccctgacttcaatctctcacaaggaagacaggctcggagtagctcaactgtctggtggaaacgctgatgttgtctcaacacttctatcgcttttgctagctatcgaaacgtttatggggaagaagactaatcttcaatcacctcaacaactgatgggacctgctagtatcaaatgggcgacctcgagtatggtcagaaaagacgttaaacccatcaaaaggagtattggcgcaatgtacgcctacgcatatgcagcgacagatgttttgaggatatcagtataccagattctatccacattccgcgatgaaatgctcaacagcgacagagccggacttcttggtagagattggattggaagcaagaaaccaccttttggaacaaacgacatgctcctacagaagcttaagctcttcctcgagttccaagcttgatggaagattaaagaggtacaattcctcgattaaatgtggtaacaagtgtcatcatgattcaagagctggatagaaaaaggaactagagtattttgttacatgatcaaaaagccttgtattggaaaatgaaatccctcgattttgcagaaatttgggattaatcttgtttttggtaaactagaaaattatataagaatcaaactttaatggtaagttttgcatcttaaatcttgattacataaattttgcagaagactctctatatgcttaacagtaactaactcttacgcaatttacgaaggaaaccaaaattagaatctgaaatgggccagagatttattagggcccatggcgtggctaatagtaatatcgaaggagagatcgtgaccgttggatgatgattaatataataattgtatagtggttaaagcttagattggctacattacacatcgcatttacttaaagggcaaaaccctccagcgccgcttggatctctctctcctctgttctctcttcccttatcttcttcttatacccttcgaccaacgaagaaccctagaaatcgattaacaaggtaagcccacttcagcaaatcgttcactcatttcatttccaagatattcgattgtttccttctgatttagcacaagggtcaagatcatttttttgtttttgttcttcctcgattcatatgttttttttcattgattactgtttttgatattggttatcttgttttccaataacttgttagttagttaaaagtaatgtttgtgtaatggtgacctaatcgattgaaaaaattgaaactttaggttaagctcattgtaacaatacgagctttgttcttctcgctgcactgttctcataatcctagtgtaatcaatttgtgggttgtgactattgctcagtattactgtttttgtcattggctaattaataacagtattagttattgtatatgcttaatttataagatacattttgggctaaatgggtttagctttgtgtgtttgttttgaaaaacagatg

SEQ ID NO: 26907 - DNA, 3003 bp, Unknown; identical to SEQ ID NO: 22734
  misc_feature (1)..( 3003): 2750-1469P.txt file - cDNA_ID_2716816; gDNA_ID_2214462; Annot_ID_133001

SEQ ID NO: 26908 - DNA, 3003 bp, Unknown
  misc_feature (1)..( 3003): 2750-1469P.txt file - cDNA_ID_2716823; gDNA_ID_2214462; Annot_ID_132998
ttatctacgaggtgggagaatcaagattgcgagattttccaattaaaaattgcaacaaggtttggtcatgtagccaaaattgaaagatagttggtaggcgactttttttttgttttagtataaaaatgtaattattgtccttaaaaggcattattgctacattgctaatcagaaactgaaaaaaacaaaaaacaaatggctagcaactacgttttctctgttctgaggtcgctgcttctgttaattcacactgtattcttaggtcagcaccatgttagttctgccacaattatcaagtctcttcctggttttgaaggccctcttccctttgagctcgaaaccgggtttgctttggatgtcttcgttttattaaatccgtgttctgaatctgagtttggagataatgtaaaaaaattaggttactgtttcttgtgaatgaaggtatattggtgttggtgaggaagaggaagtgcaactattctactacttcataaagtctgagaggaacccaaaagaagaccctcttcttctctggctaagtggaggacctggctgctcttccatctctggccttctttttgagaatggtaaaattgaaaaaatcgataaacttgttcttttgcgtctctgattactcgttgtaactcgatatatgtctatataagcagggcctctggctatgaagcttgatgtttacaatggaactcttccttctttggtctctactacatattcatggacaaaggtaatacaaaagtgtctagtgatacgactatcaacaaaacccgattgatcatcattttcctcaggcctcgagcatgatattcttggatcagcccgttggagctggcttctcctactcaagaactcaacttttaaataaacctagtgattcaggagaagccaaacggattcatgagtttctgcaaaaggtaaattaatgataaacttaattgcctcttgaagccaaacggttcttagtaggagcctttttcttttttttgttgttgtggtgtagtggctaggcaagcatcaagagttttcctccaatcctttctatgttggaggagattcttactctggtatggttgttccggctaccgttcaagaaatctcaaaaggtatatatatatatatatatatgattttatgatatcaatccccaagaccttttctcagtcttttattataacaaaaggtatatatatatatatggttttatgatgatgattgcaggaaattatgaatgctgcaatcctccaataaatcttcagggctatgtgctcggtaacccgttaacagactttgtatatgattacaactcccgcattccatttgctcatggaatggcactaatctctgatgaactcttcgaggtatgaagtatgacatttgcttttgtttcgtgtcaccccaatgaaaagcggttcaaaacaaaactttttgtccgcagtcattgaagaaaacctgcaaaggagactatagaaatgttcatccacgtaatacagaatgcttgaaattcattgaagaatttaataaggttacacactcaaagctgatgttgtttgtgccgtacgtaaataaatattcatccctaaattcatacctttttgtgattatctttatttagtgtacaaacagcatatgtcaacgacgtataatagatccattttgtgaaactgaaactccaaattgctatgtaagtaattcatacaacttattcttgccctctgttaaaccatttgagaaaaatatatgtatacaaggttgcttttgcagatttaccgttttttgctagctgcctattgggccaatgacgaaaccgtacgcaaagctcttcaaatcaagaaggtaacaatttattttaattttcttggtaagggaacaatgtttcttggtaagagaacaatgtcattcttataggaggatctatgattgcaggagactataggggaatgggtacgatgtcattatggtattccttacaattatgacattaaaagtagcataccttaccatatgaataacagcatcaatggttatcgttcactaatctacaggtttagagtttataacccttctgtccctaccaagattctagtcttttgttaaactttgtgcggtttttggtgaatagtggtgatcacgatttcgaagtacccttccttggaacccaagcttggataagatctctcaactattcagtcatcgatgattggaggccatggatgatcaaagatcaaattgctgggtatatataaaccgaatttgttcttccgttttatgagattcactttgaaatgtattcttgattcttacttgaatggcagatacacaaggacttatgccaataaaatgacatttgctactatcagagtaaagtctttcttcttcttttttttatccgctccaatatttttttattgcggttttctaacttgtactgagatgtgggttttgattgtagggaggtgggcacacaatagagtttaaaccagaggaagcctctatcatgtttcaaagatggatcaaaggccaacctctgtaaaagaggggagtaacgtcctttacgtataaaggaaaagaaaagtatgattctagtaacacatccaaaaatatatacataaggacccttggccttataagtgaatagaatttagggttaagttaaactcataatttgtaagcaaaatgtgtgttgctctattcaacaagcttggtacagttgcattttaccttcttttttgtcaacaagcttgttttccatttgtttgaagcaaaagttaatttacatgtattgttattaataagtgtcactaaagatatttaaattatatttttaatgataaaattatatgttggtagaggacaaggttggtcatgtagccaatatttaaagatagacttggtagacgactttttttagattttagacttttagtagaaaaatgcaatagttgtccttataggcattattgctaatcagaaacaaacaaaaaaatg

SEQ ID NO: 26909 - DNA, 3003 bp, Unknown
  misc_feature (1)..( 3003): 2750-1469P.txt file - cDNA_ID_2716827; gDNA_ID_2214462; Annot_ID_132997
tataagcagggcctctggctatgaagctcgatgtttacaatggaactctcccttctttggtccctactacatattcttggacaaaggtaatacaaaaaagtgtgtattctggatatgacgatcagcaaaacgcaatgatcaataattcttgatcatcattttcctcagacttcgagcatgatattcttggatcagcccgttggaactggcttctcctattcaagaactcaacaatataataaacctagtgattcaggagaagccaaacggattcatgagtttcttcaaaaggtaaattaatgacaaacttaattgtctcttgaagccaaacggttctttgtggatagacagtttagaagaattttcttcctttgttgctgttgcatgtggtgcagtggctaagcaagcatcaagagttttcctccaacccattctatgtcgccggtgattcttattccggtatggttgttccagctaccgttcaagaaatctccaaaggtatatatggtaatgatatcattctccaaaaccttagtatcttctaagtgaagaaccatgatgatgcaggaaattatcaatgctgcagtcctccgataaatcttcagggctatgtactcggtaacccgataacagaacatgcaatcgattataactaccgcattccatttgcacatggaatggcattgatctctgatgaactttacgaggtatgaaacataacatatattcatgtccccacaattggaaaatataaaataacaagcaattcaaaaacattgtttcgttggcagtcgttgaagagagtctgcaaaggagaatatgttgatccacgtgacacagaatgcttgaaactcgttgaagaatttagtaaggttacatattcaaccgaagaatcatattttagctgttgtgtgtgtgtgtgtctgtctcccttagtaaataaacaacatcacttttgtggttattgtgtgttttagtgtaccaaaggagtatgccaagaagttgtaataaaaccattgtgcgtaactgaaactccaaattgctatgtaagtaatccaagtatcttgccctctcttaaccgttaaaccatttgagaaaatatatatatatatatatatatgtatacaaggttgcttttgcagatttatcgatatttgctaactacgtactgggtcaatgacgtgaatgtacgcaaagctcttcaaatcaacaaggtaccagtttgttttttaagttcatggtaaaaagaacattgtcattcttataggagggcctatgattgcaggagagtataggggaatgggtacgatgttattttggtattccttacactcatgacattaaaagtagtgtaccttaccatatgaataacagcatcaatggttatcgttctctcatttacaggtcagagtttaacctttttacgatcatcgttgtccctaaaaaggaaccaagacttatgtaaaatattgtgtgggtttttggtgaatagtggtgatcatgatttgaatgtacctttccttgcaactcaagcttgggtaagatctctcaactattccatcattgataactggaggccatggatgatcaaagatcaaatcggggggtatataataataaactgattttgtttttaaatggcttctcttattctttcgttttataaggctcgatcacttcgaaatttactcttgactcgtcttacttggcagatacacaaagacttatgccaataaaatgacatttgcaactgtcagagcaagtctttcttctttcctttttttaatccactcgaacatttttattgcggtttaaggtgtattaagttgtggattttgattatagggaggtgggcacacagcagagtacaagccatatgaaacctatatcatgttccacaggtggatcaatggccaacctctttaaaagaagagagtggccttttatgtataaaggattagagtttatggatctagtaacccattctccaaatatttaagatatgatcgttgtatgcaagcttggtttgcctcaagataattgcaaaagcttaggttttttttccttatcttctgacctgtataaaaatcttctaaacaaacgttgcacttgatgtaaaaaagttttttcgaataaatttaacattttattcaaaaaaaaaaaaaataataaaaaaaaaaaaaataagaaccctcggcctcataaagtcataatttgtaagcaacatgagtgttgcttttcaacaagcttggtacagttgcatttcactttatacaaaatatatccgttgtccttgccaaaaaaaaaaaaatatatatatatatatatccgttgtctgaattaaggtttttcatgcttttattgattgctggatcattgaatgtatgcaaatgagatttgaaaaaaaataaaaaataaaaattctgagatgaatgggatccaaattggatgaaatgaaccagttttctggaaagtaatctaagaatatttacaacattatatttgtgtacaattgcttgatttttcatgtacgattataaacaaaattttatagtcataactctctttgtgtttctctgtttactttgttcatcaaatctggaataaaaacatttttcctatgtttcttttaacatttttacagatcacatatgtatttttatatcaattgtttttaaaggtaatcttgaagaagaacgaaaaaaggattcagatcattaaagatatgtaaaattaaaaatttattctaatacttctatgatcgtgatcgcgaaaaaaacgaggaattaacaaataatttttgtattatctacgaggtgggagaatcaagattgcgagattttccaattaaaaattgcaacaaggtttggtcatgtagccaaaattgaaagatagttggtaggcgactttttttttgttttagtataaaaatgtaattattgtccttaaaaggcattattgctacattgctaatcagaaactgaaaaaaacaaaaaacaaatg

SEQ ID NO: 26910 - DNA, 3003 bp, Unknown
  misc_feature (1)..( 3003): 2750-1469P.txt file - cDNA_ID_2716831; gDNA_ID_2214462; Annot_ID_132996
tctactacttcatcaagtctgagaggaacccaaaagaagaccctcttattctctggctaactggaggacctggctgctcttccatctctggccttctttttgagaatggtgaaatcgaaaacattgataaactccttcttatgcgtctctgattagtcaattatatatatatatatatatatatatatatatatatatatatatgtgtataagcagggcctctaactatgaagcttgacgtttacaatggaactctcccttctttggtctctactacatattcttggacaaaggtaatacaaaaaagtgtgtgtattcttgatatgacgatcagcaaaacccaatattcaatatattcttgatcatcattttcctcagacttcgagcatgatattcttggatcagcctgttggaactggcttttcctattcaagaactcaacaatttaataaacctagtgattcaggagaagccaaacggatccatgagtttcttcaaaaggtaaatggcaaatcttgatgcaacgtttctttgtgcatggagaaactaggagcctttttctatatttattgttgttgttgtttatgcagtggctaggcaagcatcaagagttttcctccaaccctttctatgttgccggagattcttattccggtttggttgttcccgctaccgttcaagaaatctcaaaaggtatatatggtatttttaatatcaatcccacaagcccttttctcaatcaattattataacaaaaaatcatgcatgatgatgcaggaaactatgaatgctgcaatcctccaataaaccttcagggctatgtgcttggtaatccgttaacagactatgcaattgatagtaacagccgcattccatttgcccatggaatggcactgatatctgatgaactctacgaggtatgaaacatgcatgacatttgcttcttttttcttgtccttacaacgaaagcggttttaaaaaaatactatttggttcgcagtcgttgaagaaaacctgtaaaggagaatatacaaatgttcatccacgtaacacacaatgcttgaaattcattgaagaatttaataaggtttacacactctagcgcctttagtaaataaaaaggttcatgatcactaaattcagagttcagacactttttttttgtgtgtggttatttcattttagtgtacaaacagaatactccaacaacttatactagatccgttgtgcgaaactgaaactccagattgctatgaaagtaatctatatatctaaatgttctctgttatactttggtagatttatcggtattcgagaaaaggaatttgtatacttttgcagatttatcggtatttgctaactacctactgggccaatgacgcgactgtgcgcgaagctcttcaaatcaataaggtaccaaatttatttttaaggttcttggtaaaggaacagagtccttctgataggaggatatatgatttcattcatgcaggagagtataggggaatgggtacgatgttatcgcactattccttacgataatgacattaaaagtagcatgccttaccatgtgaataacagcatcagtggttatcgttctctcatctacaggtgagagtttaacacttgttttgtccctaacaagattcaagactaaaacttttgcggtttttggtgaatagtggtgatcatgatttggaagtaccttaccttggaactcaagcttggataagatctctcaactattcaattattgatgactggaggccatggatgatcaaaaatcaaatcgctgggtatgtaaatggattctttttttattctttccctataggagactcactttgaaattcactcttgactctcttgcttggcaggtacacaaggacttatgccaacaaaatgacatttgctactataaaagcaagtctttcttctttcctattttatccactcgaatacattttaattgcggatttttttaacttgtattgagatgtgtgggttttgattatagggaggtgggcacacaatagagtttaaaccagaggaagcctctatcatgtttcaaagatggatcaatggccaacctctctaaaagaggggagtacctgccttaacgtataaaggaaaagaaaatacgattctagtaacacatccaaatatatataagaacccttggccttataaatgaatagaatttaaactcataatttgtaagcaacatgtgtgttgcttttccacaatcttggtatagttgcatttcacctttttttttttcagcaagcttgttttctatttgtttgatgcaaaagttaaattacatatattgtatcaataagtatcacaattatagagctaaattaaagttatatatatggttatcataaaatgttttaaactaaaatattatacagtagtataattaatttgttatgatcgcggtttattctttaacatagttttgttgtttagtaattttatacatggagtgaggatcaagattgcgagattttaatatttttatccatgaaaaaatgggacaacgttggtgaagaagccaaaactaaaagataagagtttggtaggcgacttttttgggttttagtataaagatgtagtaattgttgtccgtaaagacattgctaaccagaatccgaaacagggaatggcaaacaactacgtttcctctgttctgaagtcgctgcttctgttaatttaccttgtattcttgggtcagatccatgttgattatgcctcaataagcttatataatcgtgatcgtgaaaaacgaggatgatgaacaaataactttgtattatctacgaggtgtgaggatcaaggttgcgagattttccgataaaagaatgcgacaaggttggtcatctagccagaattgaatgatatatagttggtaggcgacttttgttttgggttttagtataaaaatgcaataattttcaagccatatattattgctaatcagaaacttgaaaagaaatg

SEQ ID NO: 26911 - DNA, 3003 bp, Unknown; identical to SEQ ID NO: 26910
  misc_feature (1)..( 3003): 2750-1469P.txt file - cDNA_ID_2716831; gDNA_ID_2214462; Annot_ID_182799

SEQ ID NO: 26912 - DNA, 3003 bp, Unknown
  misc_feature (1)..( 3003): 2750-1469P.txt file - cDNA_ID_2716835; gDNA_ID_2214462; Annot_ID_132995
ccctttgagctcgaaaccgggtttgttttcaatctcttcgtttaattaaattggtgttcttagtttggagataatttaaaatccgtcagatactgtttcttgtgaatgaaggtatattggtgttggtgaggaagaggaggtgcaactgttctactacttcatcaagtctgagaggaacccaaaagaagaccctcttcttctctggctaactggaggacctggctgctctgccatctctggccttctttatcagaatggtgagatcgaaaacatggataaactccttcttctgcgtctctggttactgtctgtaaccctatatatgtaaaatataaccagggcctctggctatgaagctcgatgtttacaatggaactctcccttctttggtctctactacatattcttggacaaaggtaatacaaaaaagtgtgtagtcttgatataaccatcagcaaaacccaatgatcatttcttgatcacttctctcagacttcgagcatgatattcttggaccagcccgttggaactggcttctcctattcaagaacgcaactttttaataaacctagtgatacaggagaagccaaacggatccatgagtttcttcaaaaggtaaaataatgacaaacttaattgtctcttgaagccaaacggttcttagtaggagccttttcctattgttgttgtttgtgcagtggctaggcaagcatcaagagttttcctccaaccctttctatgttggcggagattcctattccggtctggttgttccagctaccgttcaagaaatttcaaaaggtatatgtatgttttatgatatcaatcccctaagcccttttctcaaataccattattgtaacagaagaaacatgatggtgatgcaggaaattgtcaatgctgcaatcgtccaataaatcttcagggctatgtgctcggtaacccgttaacagactgtgtatatgattgtaactaccgcgttccatttgctcataaaatggcactgatctctgatgaactctacgaggtatatacgatgacattttgttttttttcttgtcctcacaatgaaaagctgttcaaaaacactatgttgttcccagtcgttgaagagaacctgcagaggagaatatgtaaatgttcatccacatgacacagaatgcttgaaattcgttgaagaatttaacaaggttaaacactagagctgatttcgtgttgtggatctgccttaaattaataaataaagattcatcactaaattcagaccttgtgtggttatttttatagttaacaaacagagtatgcgaacgacatatattacattcatgttgcgaaactgaaactccaagttgctatgtaagtaatccatatatcttgccctctcttatctgttaaaccctttgagaatatatctatcatacacggttgcttttgcagtcttataggtttatgctaactacctactgggccaatgacgaaaccgtacgcaaagctcttcaaatcaataaggtaataatttattttaaggttcttggtaaaagcacagtgtcattattataggaggatctacgattgcaggagagtataggggaatggacacgatgttatcgcggtattccttacaatcatgacattaaaagtagcgtaccttaccatatgaataacagcatcgatggttatcgttctctcatctacaggtcagagtttataacccttttgctgatcttttgtccctatcaagattcaagactattgttaaactgtaaggtttttggtgcatagtggtgatcatgatatccaagtacctttccttgggactcaagcttggataagatcgctcaactattctatcattgatgactggaggccatggatgatcaaagatcaaatcgctgggtatatacgggtttttttttttttaaaacgggttctcttattcttttgttttatgagattcgctttgaagtttattcttgatacttaactggcagatacacaacgagttatgtcaataaaatgacatttgctactgtcacagtaaatctttcttcttctttttttttttttttttttttttttttttttttttaattttcttttaatccatctgccatttttattaacttgtattgagttgtgggtgttgattatagggaggtgggcacacagcagagtttacaccaaaggaaacctttatgatgttccaaaggtggatcaatggccaacctctgtgaaagaagagagtgacttttacgtacaacggacaagagattgtgtgtgattctagtaacacattttccaaatcaatgctgcctctcggcccaagtttctcatagagacaaatcaaaatgatgtggattcatcatttctaacatcgactctatgaaactgctttagctatttctcgatatttcagttgtttcttccagatacaagtgaggttcctttaataaacaatggtgaaggaaaatcgcagattttaaaagttttaacgaataccaaagtagtaaatcgaatgtctaacacgttaagcttgaaatgaaatgggtgctataaaataattaagtaaatctcttaaaaccacacgagtccaaaacaataatattagtggattggttaattggtctatttttgtgtggacctttttttttttttgttttttggtgctttaaaaaatggattcagaatttcagatcattgaagatactctggtttgcgttttgaatcagatacaattatagagcaaaagattaatagtataattatatttctatgatcgcaaaatgcgaggacgattatttagtaattttatataatactcaataattttatagtccgtttatcattgacaattcattgttaatttgttatacagggtgtaaggataaaggttgcaagattttatccattagaaaactgtgacaatgtgcgactttttttgggttcaagtataaagatgttgtctttaaagacattgctaatcagaatctgaaatacgaaatg

SEQ ID NO: 26913 - DNA, 2532 bp, Unknown; identical to SEQ ID NO: 10910
  misc_feature (1)..( 2532): 2750-1469P.txt file - cDNA_ID_2716839; gDNA_ID_2214462; Annot_ID_132994

SEQ ID NO: 26914 - DNA, 3000 bp, Unknown; identical to SEQ ID NO: 11056
  misc_feature (1)..( 3000): 2750-1469P.txt file - cDNA_ID_2716859; gDNA_ID_2214477; Annot_ID_133141

SEQ ID NO: 26915 - DNA, 3000 bp, Unknown; identical to SEQ ID NO: 11129
  misc_feature (1)..( 3000): 2750-1469P.txt file - cDNA_ID_2716869; gDNA_ID_2214479; Annot_ID_133223

SEQ ID NO: 26916 - DNA, 3003 bp, Unknown
  misc_feature (1)..( 3003): 2750-1469P.txt file - cDNA_ID_2716875; gDNA_ID_2214466; Annot_ID_133038
tttcagttgatttctttgtctcttcatccccctctttgtccatgactattcttgatggagcttcggttttggtttcagtcgatttctttgtctcttcatcaatcatttcattggcttcaatctctaaacctctgattgtttcatatgttcttgtgtcttttgtctctacactatcctcctcctctctagcctcatccatgaccacaacttctggagctttggtttcggttctctctgataaatcatctgcagagttgttgtctccttctttgatgaactcgcctatttctaaaagcttctgcgcttttaattcgccttcttcattaacattgtctgctatctcagcttctgaaactttctttgcagcttctttcaccattgcagcatctacttcttttgaaaccaatttatcttccggagcttctctcgcggtttgctccaatgtaacagcttttaagttactcgtctctggtttttctttaatctcagcttcttctaaggctttcttttctgtattttcaggtttatcggattccgagtcagtaacaatctttggtttgatttctaaaggccccagctttccatcaatttccttgaccagatttgttagtgatcttgcattacgagcttcagataacctagtagacaactgcaacataccacaaaaagttttaagcaaaaagtcatgttttgcgctcaaagcagtttagctcagaaaggttgaaatggagaaaaatgtatttgctgatatttcacctgctgtatctgttcagctcggggtttgagatcatccagagatgcttccttgtaaatactccgaagaatgtacatcaaatgagagctaacattatccaaatgatgttgttggacctcacattgatgtacatcagagagacaaccaacagaatgaaatggacagttgacaagtttcataggacatacggttatacaatgcctatccatatcacgtctcatgatactctctgagcagttctgctcacacggaatgatcttgaacgggcaaacagaatcgtgattctccatctgattcgcacaaaacaccgcagtacaaccctcattctcacagttcattgttctatacccacaattcatggcgtgctcggcgagttctccttcggtttggaatttcatctcacaatgtgcactgcttttaaaatcaacgtttttaagcaaagtctgagcgataccttctctatgatcagtcaaccaaaacccgcttatctccatctcttgcgcgaaatcatcgatattatcttctctcctttcgctaagcatccaacccgaaacccggctgaacaaattccgcttagaagtggcgaaatcatcgatgaaatcagatataatgtcaaaaggatcatgagaagcttcaatctcagaacctccttgaagaacaatgtgttcagccacaaaggtttcgcttctacgagtcaagtactctatcatttcttttcgaatgtcagcagcaacagaaccaggactcctgaagatatctccggtagtgttatcgacacaagcagtggctaaaccagggagaaaaacctgagcaatcttgtgaactacttgtgtatcgtaaagatcacagtgaaaggaaggtcctccttctttctgatcttcaatactctcaagatccgacacaggaggatccattgcctgtatatcaaaaatcgtctgcagaaacacacacaaattgaatagccaaatatcatcactagatcagattaaaaaaaatgcaaagcattgaaataagacacaaactccataaacaccattaatcaaaatctctactttttttttcttctggaatcgctagatcagtagaatcctaaaatccgatcaacagccaatgatcacgatccgtaaattgacaaattattaacgaaagtttcagaattgagtcaaattacaagcaaaaagttcaactgttggattgataaagaaatgtcaaaacaaaaaaacgagaattaccctagaaagaaatcgtgtcctaaacagacaatgacaaatcggagaaaggaactaacgaaagcctgtaaggaaatctgacggtgagatcaaaatggaacaagaatggaatgagagaaagagagagagagagaagcacctctctggttttggcgcaataaacgggtctctttttctcttttaccacaacttcgtcgcctcttctattaaaaacggactctctcctcctttatttttatttttttataactggtttctttcctacaacatttttgtagttagtactgtacagtgattattagtgattttacaagcccaataaactatttagaactaaacaaatctaatggaattttaataacattttttttcttatctaatcaccaacccaatgaagaaacaaatttaccctttaaattttttcatgtcacaaagacacttcattattaattatccacaattatactactacacatcaaatacaatcaagaataacaaacataattaccaattaaaaaaaaacaattttctcttgcgcattttccaaattagcaaatcctttatgttgtttttttgaaacatttttaactagcaaatcggtcttatgactagtgactaaaaaagttaaattccaatagatctttgaaactgtttaatatatcatcgaacaatactaacaatagaatagatgatgaatatattattaaattatcaaacttagatataaatctaaattataacacgttacaatactaatacaaaccactatatgatagtatattttttggaacatacaaatcatcgtatattttcaccaatttttttgtagggtttatgttaataagtaataactgattttttaacgattgttatatggatttaactgtttttttttttcttatgataaaaaatgaaacagtgtcactgtaagatttgggtcccttttttaatttcacaagacggagaggaaattaaagaaggaaaagcacgacctttgccgacttccttctgttaatcatg

SEQ ID NO: 26917 - DNA, 3000 bp, Unknown; identical to SEQ ID NO: 10941
  misc_feature (1)..( 3000): 2750-1469P.txt file - cDNA_ID_2716879; gDNA_ID_2214466; Annot_ID_133037

SEQ ID NO: 26918 - DNA, 3000 bp, Unknown; identical to SEQ ID NO: 10941
  misc_feature (1)..( 3000): 2750-1469P.txt file - cDNA_ID_2716879; gDNA_ID_2214466; Annot_ID_182856

SEQ ID NO: 26919 - DNA, 3003 bp, Unknown
  misc_feature (1)..( 3003): 2750-1469P.txt file - cDNA_ID_2716883; gDNA_ID_2214466; Annot_ID_133035
caaatcttaaaagattttctttccaatggataatttgattgaccaattaattctatttatttttggttaatttagtttttattttttggcaccatattcaaatatcaagtaattagatttatattttcggttattatgcaggctgttgaaataggcaagaggttagccgagaaacactttatccaccatgtctttgggtacgtacatatatataaatcgtgtcctttttttctttggtttacataattgaatattcttgatttagtgaaatgttcataaactgtatgtttgttgaatagagagaacgagtttgaagatggaaatcattactaccgtttcctagagcacgagccgtttgtttcaaaatgttacaattttagaggttctaccaacgacatggagccccaaagtgcagccattgttgggcagaagctattcaaaatcatgacagctattctcgagtcttattcttccaatgaccacactagtgttgattacatgagaatcagccagagtgaagaattccgaaggtagaatttggactcaagagtgcttaaacggattttagtctaggaatgcttactttagttctatcgacattaatttggttatgctttaattgtgtataaacgaaggtacttgaatttggctcaagacttccaccgtttgaatcttgtggaactctcaacggaagagaagttagcattttttttgaatttgtacaacgcaatggtgattcatgctttgatcagtatcggacgtcccgaggggttgatcgcaagaaggtcattctttacggattttcagtatgttgtaggaggctactcttattcacttagctccatccgaaatgacatccttcgtcgcggtcgaaaaccctcttatccatttatcaggccaccttttaataacggcaagacacggcatgaggtaattttagcgttccatgtttgtttgtattttactcatatcggtgattttcggattatcctatagttttaattctatggtttaatgtcagcttggtcttctaaaactgaatccattagtacattttggcttatgcgatgggaccaaatcaagtcctgtggtgaggtttttcacaccgcaaggagtcgaagctgagctcaaacgagcagctagagagttttttcaaaatggtggaattgaggttgtcttggacaagaggaccatacatctatcaagaatcatcaagtggtaatcaattctctttacaataatgtctacattgaaatttataaatagtgagacctaatgagacttatatgagtcattttggttattagtctaatgagctaagaaaggatatacattgatgtgtatatgtttgttgcggtaggtacaaagaggatttcagtgaagagaagaaaatgttgaagtggataatgggttatatagattcaaatgatgcaggtcttttaacccatctgcttggtgatggaggtggttcttttaacatcgtttaccaagattatgattggtctaccaacaattgaaatttaacaacaactcttctttttggtggtatattgacattaaactattggtccataaattttatgttaaaagtcatctatttgttattcatgagatttattcatgaatcacaggtatagtactactatctgaatcccggattttggatctttactctataagaatcgaagacaatagatgatgaaagaaaacttaattactactattcactattttaaagacaaacaaattcaaattaatatgcatatatagaatcgtacgcctttggtgtgttcctaatatacacacaacttattatttggaacaaaaaaaaaaataatcatttaactaaaatactatccggataatgtcatatatatgaattatcattcatctatgaatatatgtcaatttattcttacgtggttgaagtagaagcctcttctttttggagaaatgagtagaagctttttatgttatcataacatcatcgtcttacttttctccttttctttctttttcttcacatttttactttctttggtatcgaaaccttaaactttcaagctaattccgagaaatgaaattttatactaaaaacgtccatgattcaagattattacaagaaaaattgacatgaattatcgttttgctctggtaacaaaatcactacgtacttaaagcaaatttgaaatatcatttctgtcttctgatgacaataagttaacggtttggtagaactttttgtagggaaacttgtgaagatagagttagcttttagatgcaggtaacgtataaacttatttgaacggttagattgagaaacgaacaaaatacattggatgcaatatcttcctttgtactttgcaagtgttgtatataaagaaaaaaaaagtgttgtatataagtaactcatattctgatattccccacttccatttcttataaacaacataatttgagtataatcttcattttaattatatatcaaacaatagaaccttaagtttttgattataatctctgcctaatcggcagctaaactcatataacccattgtttagcccagttatataactttggaagttgcataatcagcttaactattttctactacaaaaaactaaacatttttctttttgagctcatcaaattcaactaaaattgtctctcagcttcttttttcccttttcctttatagtgagtggcgttttaaaactaaaagcaaacggatcaagatagagaaagccacgatcaaagcaaaaccataagcaaacaaacaccaaaccactaaaagaataccgcacacaacttctttctatcacatgaatctccttttaacaaataaaataataataaagtaaggattatgcatatcttattgcacgtggccggtgccctttgagacgtatcaccctctacatgcaatataaaaagcattgcaaatgaaccaaagtttgatcacatccatcacttataactaaaaacacaaatcaagataaaatg

SEQ ID NO: 26920 - DNA, 3000 bp, Unknown; identical to SEQ ID NO: 10951
  misc_feature (1)..( 3000): 2750-1469P.txt file - cDNA_ID_2716891; gDNA_ID_2214466; Annot_ID_133033

SEQ ID NO: 26921 - DNA, 3003 bp, Unknown
  misc_feature (1)..( 3003): 2750-1469P.txt file - cDNA_ID_2716895; gDNA_ID_2214466; Annot_ID_133032
aaaaagatttggtccggtcggagagagatctgaacgaaagaaagtcatcgtcactcccagaaagaaagaaactcaaaggtatgagaagactatccgactcgtagctgcttctggatacgaattgtttctccactatctcaatttgtctccgtctgctaagaaaataaaacaatttgtaattctagggtttgatcctctctctttcaatcgtccctaatttactggtagtttggattgtaatatcttaatcccgcggattatactaagattacaagttcgagaattgattcattcactgcaaatttccttcgtttgctttgatttcttggaaacttctgataacaaatcgtttctgagaacatgtttttcttcttcttgtgattgtgtctttcaaagcatacttctccaattctctttggtttcttccttgtgatttttgaataaattgtgttattttggtttccttttagcttgatgttgttgttttgaaatctcaggttacaatggcgaagctaaggcctagacagttggaactgagcaagactgttccttccaagttgggttttgatggagaagaagacgcttgggtctttgttaaaaagcagaaaatcttcattgtcttgccttctcttccacttcctcaacaacagcatttcactttggagaaacctgcaatatctcctcaattagaagctgggtttagagaaagcatggaggttacgcaagatagtacctttgttcacactgtggtgccttctcttcctctgcctgaaactcctcaatcacaagctgagttaagagacgctcttgcggatacacactttaccactcctgttcccactgtggtggtacctgctcttcctctacctgaacaattcattttgcacaagcctgaaacttctcattcgcaagttcagttcagagattgtattgcgaatacgcataaaactactcctcttcacacagtggtgcattctcttccggtaactgaacattccactttgcagaagcctacatcttcccagtcacaagttgagttaagagagtctattgcggatactcatggaactactcctcttcaaacagagatttcttctcttccattacctcaacacttcgttttgcagaagcccgcaacttctcaatcacaagcggatacacacgaaactactcttcttcacacaatactgccttctcttcctgtacctgaactatgtactttgcagaagcctgcaacttctcaatcacaagctgagttaagagcgaatacgcgcaaagctactcttgttcacgcagcagcgatgccttctcttcctgtacctgaacattacagtctacagaagccttcaacttctcaatcacaagctgagttaagagcgaagacgcgcaaagctactcttgttcacgcagcagcgataccttctcttcctgtacctgaacattacagtctactcaagccttcaacttctcaatcacaagctgaggtaagaacgttgacacacaaagctacccatgttcacacagcgatgccttccctttctgtaactgaacattgcactttgcagaagcctgcaacttctcaatcgcaagctgaaactagtcgtgttcaaactgtggaacctgaggcctgtcctgatttcacctcagtagacaaaccggagatagttatgagtcgcagtctcacaaccaggaaagctccagcaccaaagagatcactgcaagaaagtaggaagaatcaggatagaagagtggagatccacaggaggcgtgcgggtcacaagcccataaggtttccaagagtgatgtgtagctctgttgttatggataatgagaagctgagagtgttgaatctggagaagaaggttgagaaagcgggagggttgaacgaatgggttggatctataggattagggagagagtttgagaggatgttgagaggacagaggatgagtaagtttcagatggcgaatttgacaatggagaagcttaagcagatgggtgctttagccgttgggccaagaagaaagcttatacatgcaataggttgtgtctatcacccacattgtctacgtgcttcctttaactgagaactatctgttagagtttagttgaggccaataaaacttagcttacgctttattgatgttcaactagtattgttttggttattgatactctttggaccatatatgtaaaacagagcaacaatccactgtttgatgtgatcattgcatcgtgctattttgtatttgactatttggggatcagtcgtctattagcgttgcacatgcaatatcattatattgcttcttcttctttttttcaatcactaaaggatctagaaccagaaacaaaaagtccaaaattcaggttaatcattatagttttgctaattggaaacgtatgcaatgactaaacataaaatttatagtagaaacactagaaccctaattcttcaatttcaacataaatctttcaatttgagtggaatcattcaaaacttgattcccctaacttgaaagtaattatttgaatgtaagaattaaaaaaagcgtattttgtaaagtatcacgactaaaacatgctagttgagttaaaccttcataaaaaatgaaacatattatttgagtttcgagaaagaaaaaaaaaaaacattttatttgagttgtcgcagacacgatcacgatgtaccctatatatagttccaattagcattatttatcccatcaacaacaactattatgtcagaaatattgaattagtaaaagaaacaaatcttatctgggccatccatttgcacacagaccaatggacgtagagcgtggtaggcacgagccagatgtgaggtaccttgaggtgccacgtcacattgaggaatctttggcggggtttcattgtttacctataaaaatggcggccgcaaagtttcgtacgtctccgatgtttcaatcgtgaaatcgaaacaaacaaaataattaaaaaaagaaataagaggaggcgatg

SEQ ID NO: 26922 - DNA, 3003 bp, Unknown; identical to SEQ ID NO: 26921
  misc_feature (1)..( 3003): 2750-1469P.txt file - cDNA_ID_2716895; gDNA_ID_2214466; Annot_ID_182850

SEQ ID NO: 26923 - DNA, 3000 bp, Unknown; identical to SEQ ID NO: 10948
  misc_feature (1)..( 3000): 2750-1469P.txt file - cDNA_ID_2716914; gDNA_ID_2214466; Annot_ID_133027

SEQ ID NO: 26924 - DNA, 3003 bp, Unknown
  misc_feature (1)..( 3003): 2750-1469P.txt file - cDNA_ID_2716918; gDNA_ID_2214466; Annot_ID_133025
tgttcttctggtaaacccgagcggtttgtagctggtcagttccgcctctgataaaggagctagctcgacccacatgactctcgatgtcatcaagctgagctccctggtgctctaccagcacggccatgtctagaaacacctggtgaagctccctgagattcttctcaatgtctttaaccgcatcatgcctttcttgaatctcgttaatggtgtctaacacccttcctcttccttgttcttgtattgctttctgcaagaatctctcactctctcctgcaacaaaaacagtatcaatgtcgcaccaccactcatgtaacaacatgtctaagtatccagagatcaattccagctctaacagctaggaactagcacaacataagatatacaaatccattttcatagtctaaacgcaaaatctgaagttactgttcttcacaaccacaacactgtatactaagaagcctggaatcagtgttcggaaaccaattggtcatcatatgttaacctagatgatgattctacttgaatctggaagtgatttgaatggaagattaaactaaccagtggaaatcagtcgatctagggttcgttcatccggattctcgccggtgacggtgaagtacctcctctgtacagtttctctatactcggacgagataagctccctcaatcggttgaaactatccatagagtccatcaatttcttcctgagaccattgaggacagaggtcctggttcgatcggaggaagaaccaggtccacagccagggagactccgattagcagcattggcacgatctagcgcctcgagtttaactttaatcatcttcgccttcttcaacgcgactccaacgtcaccgtccattttagaccggagatctttaacggctttagcattgtgaagcgtcttgctctgctcgtgacatgaagagagtgtttcgttgagccgatctagctcctttagctcttctttcacagattcaacatcttcgaagaacttgtcgaggttcacaccaccggttgatcccgcgggattcgccatctgaactccgtcgccaccgccggcaacgtctcggcgaggggatggttctccgctgcggaagcgagagaatgagctggaaaacaaatcgttcatttaaaattcgaaaaatagagaaatctagagagagatttcagatcggaatgaatcaacgggaagacttaaagaatggaaaaatgagaagaagtcgtacagattcaagtaggcggttttattgaaaagtccaaaaggaggattatgaggtaagagaggaagaagtcaaacaagtaagtctctattggttgacttggaagcttctgagaaagtaacaatggcggagaagggaaggtgaagttgaaagcgaaaccgtgtgcccttgtcccgtacgtgtaagtatatacggtaacagatcccaaaatcatatataaattggagaaagaaaaaaacattcgtaatttgaatgatttttaaaattttattttgtcggctttggatactttaagtttatcatccaaaggatacattagcccatacgaaacacttattgataaattgacttcagcagaaaacatttaaaaaaacaaaaatgttactgtatatcaaattaatttacataatttagaatcgtccatcgaaccaaatttaaagaagcccaccaaatccttgcttttctccgttaaagggccaagcctaaacccatagcccagtctttgagcaccggaaagcaattgtaatacttcgattgttcgatttgtaagatatacaacatcctaacaaccatacaccgatatacataaagaacaagtcaaatgttcaatatgaacaaccatataaaaatagaatcactttcctccctaatctataggatacccatatgttgtataaatcgttgattccaagtttcctatttaaagatctcaaacaaacaaaaaatatacaacatttttgcaaaactaattgttcctgatttgagatattttgtcatcagctggtaggttaataaatcagacatgaagatcatcccattgatgtccattgccttggtcatattcatgacgtcatttccggctcccatcaaagtagccggtggtgtgggtaattgtgaaaaggacatgcaatggtgcatagacaaaactgaattctttactcacggttacatttatgagcgttgttgttataatatgataatgaaaaaaaaatgtatgtgtttgtttctcaagtcccccaagctaaagatagctgctcgcaacgttaacaatgcgtgtggtcgtggtggtcttccaaaggatgcattctctgagttcaagtgttaaatatatagatacataaaagtaaataattaacaacaataaagcaaacatatttttgatcagatttgtactatgtagtttaatggtttgtactttgtagtcgttatgtttaataacttgtcaattgtccttatagttttgatagaagttagaacacataatatataagaacaattgtctagagagactaatgactaattaaactttgatttatcatgtagcttagttacaaacaacaagtattgcttcaaaaagtataatccttttgagttcctcccaaaagagccacctccattgccatcctttccacattagagtttaccaaattctaaattaacagagcaaaagtgaaaaatcaacaaatatatgcgtcgaaagccaatttttacataattttgtgtctgcataatttaactccattaaaaaagcatggagaaacttttaaataatttaattatgactttctaagtggggtccagaccataaaacgctgcgttttaagtgaaattatcggttcaaccggccggtccggttctaagaacatcggtcgatctagttgctcctatatgaacaacagaagacctaaaccctaactccccccctctctctctctctctgctccatttctctcactttcttcacatctctgaagctcttcgtcacgcatctacaatg

SEQ ID NO: 26925 - DNA, 3003 bp, Unknown; identical to SEQ ID NO: 26924
  misc_feature (1)..( 3003): 2750-1469P.txt file - cDNA_ID_2716918; gDNA_ID_2214466; Annot_ID_182843

SEQ ID NO: 26926 - DNA, 3003 bp, Unknown; identical to SEQ ID NO: 16739
  misc_feature (1)..( 3003): 2750-1469P.txt file - cDNA_ID_2716924; gDNA_ID_2214466; Annot_ID_133022

SEQ ID NO: 26927 - DNA, 3003 bp, Unknown
  misc_feature (1)..( 3003): 2750-1469P.txt file - cDNA_ID_2716946; gDNA_ID_2214467; Annot_ID_133050
ggccatagatgtgttaattttaaaattttgccataattaggtttaggtgttctgatcgttggttaaaatttggtgtttaaaaagagttttgttttgttggacacattaattagcctatagtttataggatgacactcaccataacaaaaacaccttcaaactctaataatcaccaaactcgaaatgattgatgattttggttgtttactggtgaaagaactcaagaggtttgtttggttcagctaaatccaaaccgggatagaaataaaaccaaaaccttaaaccggcttggaatttctctatccatgcatttgcatgatcataacatatacaatattaaaataaataaataaacatttggggtcaagaacgtacaaaattagatagaatatgggactcaataatatattcataaattttcaagattaaacaaattccatccacaataatgtcccaagtaagtccataagatggtggctgaataccaactaagcaaattcccaaaacctcttattcaattatacaaaaacatgcatctaagcacgtagatggtgtaatctcttgattatttaattaacaatactgaccaaacacaacctcaactgcttcaacattattccaatctgtcatctctgtttgtcttcacatgtttttaataacttcttctcttccttcttcattcctttaatccatttttctcgatcttggctaatccatcatgactgtcaaggtaaacatcctagtactagttccttttcaaatccgacaccgaatgtttgagtttttgttgtggttgtgagcagaaagttgagatcaaggtggatataaactgtggaaaatgcaacagcgcaatcatggaagcagtcacagagatagaaggtaatgaacgaaaaaagactcaagaaatatgtgctcttaagtcttaacatatcatcttgaacatgagatttggtgcaggtgtgaatcatatttcattagatgaaggaaatagtatacttaccgtggtggggacaatggatccggtctgcgtagcaacaaggctgaaaaagattaaacagaaacctgtgatcattagcgttggaccaccaccaaaacctcctgagccaccaaagcctccagagcctgaaaaaccaaagcctccaccagcacctgaaccaccaaagcatgtatgcaagccaccttactgcaacagttgtgatgttgtgtctgttactacctatgaaagtggaagcggctgcaccattctttgagtcatatatcgcgtaccatagccttcatgttaagtcctgtatttagccaatactaattcatcatgttctcatgcttttttgtttatttctttttctcaaatatgaatctctgttgtttgtccctcccctgtttataattagtcgcttctttgacacaagaagtctcatgagttcatgctaaagaaaataaaagttcaaattaaaacaccaaatgtttgattaatttccataaacctgtgaagcagaaagttagtcatgttgacctgaacagagcttaggaagtccttgaaggacatatcttcaagtgctattgggtcgtagcactcttaggcccattaacttcattgagcccattaaattatgcaaaacaagaaatgagacatatggaaacattagggttcttacaggaaaaaataggaaaaagcagggacaactaaacaaaaattcagaaacaagaggcaagtggacgaccacggcgtaagatcaacatgtggtgatgtgcatgagaccaagaccattttttctcgttcttcaacgcacacttggtcttttcttatgtttgttgcatttctttattaggcagaccctctctcttttttaataggatagtaaaaaatatatgattttattttgttgaaacattttgagttaaaacctaaacttatagtaagcatttgtagagtgaatttcctatacgacatctatcaacatgacctctaaccaaaaaaatattgatgaaactactttaagtagtaaaacctaaagcaattaaaatttcctttaaattagtagtttgtgtaaattaattgacatgattgcgtcgaaagaaatcaaaacagttatatcgtgaacttaggagaatgttttatatcgtgtttcaacacatgattgctagcatatgtgtaggtgtcgtagacgttacataacaatcatcactcgtaaatatcaaagtggtttctgagagaaacaaagggttatgattttcccaactgcactagttgtgtattgtttctttcacacgtatgcttctgagttctgcccaaagtggaaattaaagcagagttgggagagatcataatttattagggttcgttatgctcaagtcatgacgtaaaatgaaaatttgtttttattctttcaccaacacaaagaatagctagttatctctttttttatatataacaattcatgaagttgatcagctttatacacatcatccaatcgaattgctaatctagagatggaaatatcaggatagagccaataagatatcaaatccaatggacccattttctccatgtgctaattcatacaatctgtttttgtctgctttatttgatgatgatgctgagcgtttttaagtgtgaactaagatctagctaaccaaacaaaagatggtctcttctgtctttgtcgtataagagcaagagagtggtttgattcaatttttaaaattctaaataaaactccaaccgtgaatccagccatgaaactctttttagaaaatccttttttataacaaataattcctctgcttcttcttcttcttcgtttatttcaccttttttggtttctttagctcagaaaaagcccattctttttttctattcttgtttattttaatcatactgtgcgtttctacaaagtttgttcctttcttcttcaactctctcactcacagtcacagagatctgtttcttttctttttttgctttcactcttctcttccagtgagagagagtgagagaaaatg

SEQ ID NO: 26928 - DNA, 3003 bp, Unknown; identical to SEQ ID NO: 26927
  misc_feature (1)..( 3003): 2750-1469P.txt file - cDNA_ID_2716946; gDNA_ID_2214467; Annot_ID_182888

SEQ ID NO: 26929 - DNA, 3003 bp, Unknown
  misc_feature (1)..( 3003): 2750-1469P.txt file - cDNA_ID_2716954; gDNA_ID_2214467; Annot_ID_133047
aaaacgcaattcttttttacaacaaagattgaaaattcaaatatgaaggtggcctgtaatccaataattaatattatagctcaacttaagatttagataattattattgacttaatcacttaattgtgagaaatgtggatagagcactcaaacaaaaaatagcaatatgtcaaacatttaccctctagcctcctttgtttttttctaaacttcaatttgtgaatgtcatcagcatcacatcagttttttccatagttgggggaaatattattagttttttcattgaggcaaaagatgaggtactaattctagatttataccacacttaagtagtgaactatataagaaaattgccttttttataattatataattcactatataaatataaacatgtacgcaaaatctaaagtttttaagtattctttaatctcagtgataaaaataattgtcaattctttgttttgtgaaagaattctttctttgttcattcgcctaattagtcgtgtaaatcaaaaataggagattcaccaatgagatgtaacctttcgtacgactcttaattaataaaactcccattaaaaaataaatataactttattgtgctatatatagcgcatcattagcgtgcaatatttctcaattccttaccacaaagctaaggataaagaaaataaatagtaaatggaagggtttcttcgctttcttgtagcgaaagccatcttattggctttagcatcttcatttgtatcttgttacgacccaagtcctcttcaggacttttgtgttgccgtcgatgacgctagtggtggtaatctctctaatttactatacatactccttaatatagttcctcaataccgtactaattatgatttatgagatactatatctttactctctaacatcaattagttaaatcaataacatcaataagatcttcatctatttatcagttttcgtgaatggaaaattctgcaaagacccaaaatacgtgaaagctgaagacttttttacttccggactaaacatcgccggaaacacaataaaccgcgttggctccaacgttacaaacgttaacgttgacaaaatccctggactcaacaccctcggagtgtctcttgtccgaattgactttgccccgggaggtcaaaacccgccacacacgcacccacgagccactgagatcctcgtggttgtcgaaggaacactcttagtcggttttgtaacatcgaaccaagacaacaacagattgttctcaaaggttctttacccgggagacgttttcgtgtttcccataggaatgatacattttcaagtgaacgttgggaggacgaacgcagttgcgtttgctggtcttggtagccaaaatcccggtacaatcacaatcgcagacgccgtttttggatcgaagccttcgattatgccggagattttagcaaaagcgtttcagctggatgtgaacgtggttaaatatctcgaggcaagattttcttccaattatgatcgtcattattaacaagttaagagaatgaagggaaatgtaccaaaatatgaataaaaatataaaataaaatgtattatagcgtggtgtgagaactaaaataaaacaattaagactgtaaaaaagaaaaagaaaaaaagagatgtgtcttttatagtataactttttaaggtaaggtgcttgaacttgattacaaaattaaaaaacacaattttgctatttattaatataattatggttgaaaagctggagtacgtgattttgattaatgattttgcaatcaaaaatctaaatagaggtatatttaaaaaacacaattttggttgtatcctctctctttctacaaaatgtttatagaactaaaaaattgttctataaatttagtatgatctttttattttattattattaacgattatataaaagacataatattttgtttgcgaaatacattcctacatggcggactgatcctgtttgtgttgtgatttgatgtttttgtgtcttgtatgctgataagtttatggcaatccactcaaacttaaggtcagatagcagagaaaacaagctaaatacccacccttagatataggtagtttttttttttttttttttgtatattttgtgatataggttgtcggagctaaaaacttcaaacccacaaaagaacattcttatcgaacaattcaaaaatagaaaaattgttcttcgttggtaagaaaacttggttggtaagaattgaaatcccgatggccgacatcatttttaattgggccggttctaggcccaaaccatatatcagcccaaactctagattttactgcataatggaaattcccaggctggaacttaaatggattatataatttaattaatgataaaacatattccttaatctcgactctgctgcgttgctttatcaactgaggaattttgaatttcatatctccaaagtaatctcttttccaaggaagatcagtacaaatcttaaaacccccgatcagagtaatccggggaactatctccgccgttgaattcagtctgagggtttctccgatttcagttcgatctgtgtccgggattctctctgtgttgctttctcattgcgtttacgattcttcttcccctttcaaggtacgctcttgttggttgcgttctaatcactctcaaattccgggttttggcttcattactgcaaattttccccttttattcacttgcttcgattcaacaattgctgaaagctaatcgatagttaaatgcttttgaatcgtgaaattcgtttcggatttagggttttttttctccgctataagcttcaatccttagtccactgggattcttgagcacctcccggagaatttaggagggaattagctcttctccagatcttgcttagctcttgtacaggtacttacctttagcatttctcttgtttagagtttgacgagtttgatcagaacttagttacgaattgtctacttttgtctcccagaatg

SEQ ID NO: 26930 - DNA, 3003 bp, Unknown
  misc_feature (1)..( 3003): 2750-1469P.txt file - cDNA_ID_2716962; gDNA_ID_2214467; Annot_ID_133044
cacacaaaaataaaaagccattacatttcaatcaagaagatatcatattacgagtccaaaagtacctgcagacagctttaaaattatactcatttctttaaaatatatctatttatgtataaatggaaattgtgtttttgtctactatttgacaatataagatactaatagcaaactattgggtatggacaaacaaacagacaataataatttaaatggggtatatattgaaataatatggtataagaaaaattaaatccaagtaatatacttggaagcacgttgagctgtgcgggtttcttggtgttggaccactcgttttggttctagttttctttcttcctttttttttggtatgtcaacgttttggttctatagtttagtctgattattttatcggagtatttactttgaaaagtattatttattatcaactacgagttgcttttttcgttttttttttacgtgaagagtaaaaaattattactaaattttgttaagattagaatttacgatttggtgttaatcttattttcaggttttctgatatatatatacctatgcaatcataactagaagaataagaatcaatagctaaatagatatttgtgtcaattattcctaagttcaaaacttttttttttatagttcaaaacctatcaaaaacatattccctaaacaatgataaacgaaacaaaccaactaaagtaaaccgaaccaagatcttgttagcttgattctatcatcagtttctctaatccgtgactgttgtctgaagaggcaaataactctagactcctcctttagcctcagtttgctgcttctccgcaacagcctttgataatccaaacatatatcttgaaaaaccaaaatatattactattaacaaagtcataagtagtggttcagtgatcaagatctattatgagtttagtaaataatgaagaaagataaccttcttaatggttttgttgaaacagttcttgtgatcatccatttcttaacctcgtctacaactgcacattaccaaattcgaattcgaattgaaaccatgttttttataaaaaaattcgaattacaacatagcgaatataatagtaaaacaaacaatttaattaaacatattttttcttttatgtaatccatttaaatgttcaattgaatcccagtagtcattttccacaagaacaagaattagaggaccaaaagatgatatgcattccatggtgtctcaaaacaaatgggcctttagttataatgcccacttgtctctcctacaatatatgggcagcacagaacattagcaagtggccgcttaacattaaaagaaaaaaaaccaactcaacgaccccgttcaacgatttcatcttcgttctttaatttatgaaaatttacttaagataaacaatttagtataacattttttttatattaattaggttttttaattttgtaagatcttgaaatttattagaacaatttaagagtatatataatgtagaaactggtatgataatacccatatgtgaccaaataaataaaaatttgataccatttgaactaaaaacattacaatttaacttatatggatctgatatggaatatgaatacatataaaagcaaaaaatcttaaagtaatcaacgagtcaaactttaggtggctatatgatcaatataaaaaaaaggtagaagaaaaagaagaaaaaatcttttagaaaaaaataaaacttttaagtggctatgttttgagagaaataaatattcagctaaggaaccatatctgccaaattaatcaagtttgacttaacaataacatgtgtccaaagtaaaacaataacaataaccaaaaaaaaaacatccgcctaattactgccataacccataaatgataaaatgaatgacagattgtaatccgttatgaacagctcaatgtcttcacactccttcttctttatttatccatctttctatgcatttctgtaaaacctaaacatttacatacaaaacttaatccacataaaatattataaccatgtccaagcgacgcatttgctgcatagtttccggaatcatctttgtcctcttcgtaatcttcatgaccgctttgatccttgcacaagtgttcaaaccaaaacatccgatactacaaaccgtctcttcaactgttgatggcatatctacaaatatatcactaccatacgaggtccaactaaatttcactcttacgctggagatgctgctcaagaatcctaacgttgcggattttgaatacaagacagtggaaaacttggtttattacagggatacactagtcggaaatctcacacttccttcgagcacattacctgccaaaggttcagtgcttttgccatgtcctctatttctccagctcgataaatttgtcgcgaatttaggtgatatcgtgcaagatgtattgcatggaaaaattgtgatggagacaagagcaaaaatgccaggaaaaatcactttgttgggaatctttaagatacctttggattcaatatcgcattgcaatctcgtactcggctttccttcaatggtagtggaggaccaagtgtgtgatctcaaaactaagctgtaaatagttttttcaggtaaacatttaggcttaagagagcagtttaattctagctagtttcctgtaataataaagattgtagtgctcttgatcgctgttctttaatcaactccatttttgtgagttcttgaaattaaatgtattcctttgaatttgaaataatgaatttgattcaaaaatctgaattattttatttttacctccatttgaaaaaaggaaaaatagtgtattattattattattattttatgacaaataatttggagaagacttgaaaacacgaaatcaacggatagcgacatcatgaaacagagttagaaaagcgtgcctcctttttttagtatctatctttctctctttcggatcattctctcctctgattccgaatcgggtaaattattatg

SEQ ID NO: 26931 - DNA, 3003 bp, Unknown
  misc_feature (1)..( 3003): 2750-1469P.txt file - cDNA_ID_2716970; gDNA_ID_2214467; Annot_ID_133042
gaacgcaagcaacacaaagacatcaacgagcaaaaaagtgatagaatctatccaaactgtgagtgatgggacgagcgaggaggatgaagaagagcaagaagaagaaagagcgaaggagatgagtggaaaacagagagtggacaagtctgaagaggaagaagaagaaggtgaagaagagaatgatggaaaggcaatattcaagtggaatactcataagaagaaaaggtctagatactcttttacgtgttcttcgtctgactctagagctcaaagttccaatggaagtagacgaaaatgaagaaggtgaggtgagatctgagtttgactttggtctcttcttctacgtgtttgtgtgtcttcttgccaatgtaacttatcccaatctaacatgtaatagtaatacatgtattttaattggtctctggttaagtttagctttttgttgttgttttaaggtactactaccaatgtatatgtttcttatgtagaatgatttattcgggattgaaaaacccttttcacctaaaagaaaacatacagcatgtaataatttgttcagaagatctaagagaccaattcattttttgagctactctaaatgtgcccttgccaaaatagcatccaaaccactgtctatgagtacaatacaaactaataaaagataaatacactcacaaattcatcttcatcattctctcttaaatcatcatcatcatccacattatatacgttcttatccaaaggtccaagtaactttggacaattcgtgaatatcactttgatttcctcaatgcctttaagagagatcatatttccatcaatgttcaacatcttgaaacttcctttcttgacaacaacacgagccaagcgcaatgctccttctcttctcaagtcattgtagctcatatcaacatattctaactcccaatcttccatactctttacaatctcaacacatccctcatcttttagatcattttcagacaaattcaactttttcagatgtctctttgctgccaaacaaactgcgatagctgtagccgcctcataagttatgttatttccagccatttctataacttgaagagatggagcggagttcttgagagcgtttactaaagctatagcacctccattctctagatttgtataacttagattaattacagtcaagaaactgaagcttgaaaatggtttgctcatagaaactccaacttttatatgagtacaagtctcgaatgcagtctcctctatagtatcctcattggttaagctagtgtccaccatattcaccaggagctcctttatttttttctcccaagtgaaccagaagcccaattcttatagttaaccatagataaatacagtttctattttgaataataataacagaggtgttataggaccatagaacctaaactccaacaaaatctgttgttatttattattgaatttaaaatcttcaagatattgacaagatatgtctaaaaatttgtatcattggttgaaatgtgtaagccatcttaaagagtttaattgatcccattagtagatattttactcaatatgttatgaaaagaatgataggtaattaaatcagaggaattgtataaaatccacttaaaatcaaattacataaggaaactttcgatataaaacaaagtttcctaaaacagtatgatttcatatctatctgtaggtcgggctcttgtatcaaacttaatataaacaaatgggcctcttatcccagtggtgaacaccaaatataatcttctgatgaacaccaaatatttttcactaaatccgatttcattctttgtaaacgaatttgtatttcaacatgttactattttgttctgtagagtttatcaagctaatgtttttttttttatgtagacgcctaatttattaaataaacgttatcttagcatcaacatcctcttattacgtacagctctactcatcctaaatattcattgagatggatgttttccgtattttaacgatagtttacaaaataagtaatattttagagactttttggaccgttgtggtaggccacaaagtaaacgtgtatgagctttgaacaaaatgcaaagagataccaatgttatattttattaatgcgagcacatgaaatgaaatcttgtgattcaccacgagcacgcttagcatccgaaagctttaatgcaatttttcattgaagaagcaaagaaaagtgaggaaacgtaaacactacttaaaaagagcctccaaataatatgaagtttaagatataataattaaagttattaatgttaattagaacaggtttggttatgtagggtttgatgtttgatctcgatccataggtgtgatttttagttcatgatggaccaaaagatttcatcgaggaaatagtgttagaaaaacccacatatatataaaataatatcgtcatatatgtatcaatccattgattggtttcacattatctaccaataaaatgtgaaaaaaatattaggaaatcgaaagattagaattcatatactaaaggttgaaaaatgaaaatagtaaagcttagattgatcttttcaaaccgcatatcaaaaggggtttttcaaccaccattaggtaaattaccgaatcaacaacataccaaaattacataaatcataatatcacattctgatactttgtggaagaaattacaaatgtaataatgttttcgtttgaggaaattgaacgaagacaaaagaaccgggccggtcataattccactttaccaatgtagaccgcaacagaaataacggaataagataataattttttgtcgtcttagaaaaaataaacaaaagagacaaaacaagttcatcatcagctacctctctgacctgttcctctaattctctcattcttcaaattctctggagctggagggtcaacccacccccctccttcttccaacctaaacctctcttttatgctaacttcttctctaccaccgtcgtctccgccgccatg

SEQ ID NO: 26932 - DNA, 3003 bp, Unknown; identical to SEQ ID NO: 26931
  misc_feature (1)..( 3003): 2750-1469P.txt file - cDNA_ID_2716970; gDNA_ID_2214467; Annot_ID_182876

SEQ ID NO: 26933 - DNA, 1314 bp, Unknown
  misc_feature (1)..( 1314): 2750-1469P.txt file - cDNA_ID_2716986; gDNA_ID_2214471; Annot_ID_133106
caagaactattggttctaggatctacttcagtaccaacaaactgttcgtcccaatcaataaccacatcagcggcagtaaacacctggatcagcataaagggaaaacattttcagaaccatcagctataaactaaaaaaaacaaactttatgattcaaatctctcccttgacacgtctcaaaaagtattcagacattatggttcctaagagtatccagaatctataacaaaatttatatggtaacataaattacacaacaccaaagtagattgaaaaaagggacctgcttgacagattcagcgatttcgggaccgatcccatcaccgggaaagagagtagctttgatcggagtggaggaggagaagaaagccctagaaacggaaatgaacggaccggagctagaactcgaagtcccgagaatctggctcgatccgttaccgataagccgtctcgcgagaaatgctgtcatggtcatcgcttccagcctcagaaggacgcagagagagaaagagaggaaagaggagactttttgctgcgttggacctgaaaaagtttacttttataccttctctagctccagcagagaagcagagaacatttcgatttccatgaaataaaacggcacamagttagtgtctgaaaataagaaacggcatcagcctatgttcttaaacggccatggtcaaatgaaccggatatcaataaattataaaaaccggtcagatgaaattaagcattcagatcccgataagcagtgtgacactgaaacagcgaaaggagctctctctcactccgaggcgatttcttctgtctcgacgatcttgcgcttttcacatttgaatcctccaatccattacttcttctccgatcttttattccggtgatcctttggattatgattatcgagatccattgctgcctatttgagtcttgaatcatttgtttgcgttctcatctgtgcttagttatgtgattctccgataagatttagttatgtgattaatgcatgtatgtatcaatccgaattttggtgattcgttgtctattattaaatacgtcaatctccatttgtaatccctggttgaaataatagctatcttgtcatggagatcatcaacattacatttactacactacacacataatgtcacatatgatcttagtatatgtactcttttgtaccagtgactagaacaactgtgagtgtgggttgaagtttttaatatcttgttaaaatcgaaagtttttgactcagatactacttggttttgtttttgtcactgtttcaggtacatctcaagtcttacaacaatg

SEQ ID NO: 26934 - DNA, 3003 bp, Unknown
  misc_feature (1)..( 3003): 2750-1469P.txt file - cDNA_ID_2716986; gDNA_ID_2214470; Annot_ID_133066
actccactcagtagcaaagctgttgggttcgccaggttctacacaacaccagcaaagaataacaaacatgtggatcataagctaaaaatcgaatcaagttctgatattgaatagtggcaagataatatctaaacccactgtatttgaaaacatgatttatttattagactccttaaccctcaatgctaggttggccagttattaacatcattcaagtactacaagcacgatcatccagtaagaaccattctacaatataaactagacaataatccattctacaatgaaagcttctgaatgttcaaccaagaaatggcatagaagagagtaatggagaatcttctctcaggaacagcttctatcatacttagttttagggtaaaagtaggcaagttcacttaaatttgtcaaaatctgtaatgcagtgtctaaatcctatttactctaataatttaacaagttaacaacaactctatgcatcaaacgaatttagaacgatgataacatctaagaatgatgactaaccattccagcaatatcaggtgcagagccgtgaacagcttcagcaagggcaataccatcctccccaatattcatactggaacaaaacataataagagcataagatgattgcctcattttcatactagacaataatctgtgagacgaagaaacaaatgttacctaggagtcagtcctagtcccccaacaagtccagcacacaaatcgctgataatatctccatagagatttggcatcaccaagacatcaaaaagtgctgggtttttcacaagctgtcagaattaagattatcaatcccacattgttccataagtaaaattagcgaaaagcagacccaagtatgggttgctgggaaatctaaccttcaaaatcaacaagattatcccaaatactaacttaattaacaatgagattgacctttacataatttggaacaaaagatagggtggatatcatgttatagcttaccatcatacagcaattgtcaataacaaccttctcgtaatatatctcaggatacttcgcagcaacttcatcacaacactgcaaagcaggaagcaaataaaaacttgtctcagaacaaaggttaagaaaaagaagccagtgagagactagaaaaattgctatgttcccctaattgagaagtgctaatgtattctgagttccaaaatgagctgacctgcaggaaaagaccatcagttttctgcataatgttggctttgtgaattgcagaaactttcttccttccgtgagtcttggcataaagaaaggcatactcggcaactctcatactcgccttacgggtaataattttaagactttccactacacccttgacgacctagcaaataaaaatgacaaatcatcaacatggctctaaaaatgatactagatacagattcactaaaatgacagaacaatagactaacctggtgttcaagcccactgtactctccttcagtgttctcacgaatggtaatgagatcaacatcatcataacgggttttgtaaccaggaagactgtaacaaggcctaacattggcatacaaattcagctctttcctaagagtaaggttcaaggaacggtgaccctttccaattggagtagccattggtcctttcaaaccaaccttgtttttaagcacagattgaagattatcccatgtcaagaaactattggttctaggatctacttcagtaccaacaaactgttcgtcccaatcaataaccacatcagcggcagtaaacacctggatcagcataaagggaaaacattttcagaaccatcagctataaactaaaaaaaacaaactttatgattcaaatctctcccttgacacgtctcaaaaagtattcagacattatggttcctaagagtatccagaatctataacaaaatttatatggtaacataaattacacaacaccaaagtagattgaaaaaagggacctgcttgacagattcagcgatttcgggaccgatcccatcaccgggaaagagagtagctttgatcggagtggaggaggagaagaaagccctagaaacggaaatgaacggaccggagctagaactcgaagtcccgagaatctggctcgatccgttaccgataagccgtctcgcgagaaatgctgtcatggtcatcgcttccagcctcagaaggacgcagagagagaaagagaggaaagaggagactttttgctgcgttggacctgaaaaagtttacttttataccttctctagctccagcagagaagcagagaacatttcgatttccatgaaataaaacggcacaaagttagtgtctgaaaataagaaacggcatcagcctatgttcttaaacggccatggtcaaatgaaccggatatcaataaattataaaaaccggtcagatgaaattaagcattcagatcccgataagcagtgtgacactgaaacagcgaaaggagctctctctcactccgaggcgatttcttctgtctcgacgatcttgcgcttttcacatttgaatcctccaatccattacttcttctccgatcttttattccggtgatcctttggattatgattatcgagatccattgctgcctatttgagtcttgaatcatttgtttgcgttctcatctgtgcttagttatgtgattctccgataagatttagttatgtgattaatgcatgtatgtatcaatccgaattttggtgattcgttgtctattattaaatacgtcaatctccatttgtaatccctggttgaaataatagctatcttgtcatggagatcatcaacattacatttactacactacacacataatgtcacatatgatcttagtatatgtactcttttgtaccagtgactagaacaactgtgagtgtgggttgaagtttttaatatcttgttaaaatcgaaagtttttgactcagatactacttggttttgtttttgtcactgtttcaggtacatctcaagtcttacaacaatg

SEQ ID NO: 26935 - DNA, 3000 bp, Unknown; identical to SEQ ID NO: 10987
  misc_feature (1)..( 3000): 2750-1469P.txt file - cDNA_ID_2716988; gDNA_ID_2214470; Annot_ID_133063

SEQ ID NO: 26936 - DNA, 3000 bp, Unknown; identical to SEQ ID NO: 10988
  misc_feature (1)..( 3000): 2750-1469P.txt file - cDNA_ID_2717003; gDNA_ID_2214470; Annot_ID_133057

SEQ ID NO: 26937 - DNA, 3003 bp, Unknown
  misc_feature (1)..( 3003): 2750-1469P.txt file - cDNA_ID_2717005; gDNA_ID_2214470; Annot_ID_133055
caactgatgctctggaaagtgtagctgaagatggtgagattctttttttcatcacctgtaaaatgattcatactatttttcttctactgatgatgatgaaagcagatacaatcgaggacgacatgctgtcttaccacgaaggattggttctcgttcctcggggaagtgaaaatactgtaactggccctcacatcagaggcagcagattacgagcatccgctgttggtgatgaagaagtagatctccttcttcctggaacagccaggtaactaactctcacctggttggaaaaatgaaaaactaagacttaacaaatgctgatgacaaataaatggaatacatatgatccagacgacatggaactgattgaaacttagtccagttcggtttttgaaaagaatctctataaaatgcaggctgcagatacagcaaggagtgaacatgccggcaagagcagagctgataccgggaagagaagataaagagaagcagattttacatgactgctgcgacgtcgtactctaccttggcattatagacatcttacaagagtacaacatgaccaagaagattgaacatgcttataaatctcttcactttgattctctttcgatctcagccgttgatccaacattctactcccaacgttttcttgagttcatcaagaaagtatttccacagaacaacaaatcatagacagagaattgagtacagagttttatgtttttttttgtagagataaaaaagaattctatgttgtaagtatgttgtatacagatcttgagagcttcaataaataagtaaaaaactaattctccttttcttgattgcatgaagtatttggtttaattattaaaaggcaaaaatataaataatcaaaagtcacagaaaagccctaacgtgttgtcttcttcttcttcttcttttgaagagtaagaaatcaatgtcgtccctggaaaagaagaggaagaggaagactacgactaggacaaagaagaagaagctgtccccaaatcagtcaatccctatgatttgctattggacatcatcgcacgcgtcccaagattgtactatccgactctctcactcgtttccaagagctttcgatccctcctagcttcaccggagctttacaaggccagcaggtcattcttgggtcacaccgagcgttgtctctatgtgtgcttacggtgctgtcctggttatcgctggttcaccctgtgtcggaagccagatcaaaccctatccaatgacaccactgaaaagaagtcaagtgggtatgttttggcaacagtccccattcctagttttcataaaccgcgcttttcgagtctcgtggtggttggttctgatatctactacatccacgggccctcctctaacgtctcgattctggattgccggtctcacacgtggcgccaggttcaaagctcgattctagattgtcggtctcacaggcggcgcaaggctccaatcttgccggtggaacattcgtcacttactgctagcgtccttggtgaaaagatatatgtagcaggatgttacagcgatatgcatttaggttcttctttctttgaggtgttcgacacgaaaacggaagtttgggttagtgagcccatcccttacagcgacagaaaatacaactttcttcaccccaaaagcatttgtattgatggaaagatccatgtagtgactgacagtgagggggttgttgcttacaatcccaaggaaggtatatggttggatttggatcagtatatgcgttcagattcttattgtgagatagatgatattttgtactctgtttatagcagaacggttatatggtatgacactgaggcaagcaggtggagatatttggagggcttaggacaacttacgtttcctcttggtgcttctattagggcttaggaaagttagcggttttgtgggacgaggatttgctttatggtttgactagtttcgtctataagaagaagatttggtgtgcggagatttcgcttgaaagaagcaaaagttgcgaaagttttgggaagttgaatggtttgatcatgtgcttacagtgcctaaagaatgtgaattggtgaaagttcttgctgctactgtttaataattgcgtcacaaggcttgaaacgaggtctctttgtctctttattcacttgtaatcatttgatttcacttgctgattgattgttaagcttactttgttgtgaccaaaatgcttttgataactacggtcgtctctttacatatgtgtaaacaaaacaaaaaaacactttggagagtaattgatttgaatggttaattttgcaacagaaagagttttttttttttttggttatgttttaaagtgtaaaaaaagcctttgttcatgtacttgttccaaaactgatagtaacttgtaatccatacaagtgaacttgtgaacactctttataacaacttatctttcatgagagcttcactaagaaaactagttttcctttgtgtttttttgggtctgaatcgccgcaaaccgcaaaagataattgcaaacgtaacagtagtgctttgattgcatgaaatatttggttttataataaaaagctaggaaaaaataaaaaaaaatttgggagggagcaacaaacacgtggatacaaaacaagacggactttggaagaaacgttgaaacagaaacagatacgtgtcgtgaagcgaaatgtcggagaaaggagaagaagcagtaaagagttctttaatgtttttgacagtatttgttcaacaattctcattaacgtttttcattatttgttttctgctctgtaaagaataaagtttcttaatttgttgtatgaatcatagatttctctgcagaggcaaagttttctctcttcttttttcgattcattcttttacaagataacataaaaatcacttcttttgtttgtttgtttatctaagttgaatttgatttgatctctttactgtagtattagatagagtgagagattgtagaagaaaatg

SEQ ID NO: 26938 - DNA, 3003 bp, Unknown
  misc_feature (1)..( 3003): 2750-1469P.txt file - cDNA_ID_2717012; gDNA_ID_2214475; Annot_ID_133133
taagtttttgtttggtgatctgatcttattggttggatgtgaaatgcaaagatcacggagagctcttctggttagaagaagagtttctgagactacttctaatggaaggaatcgcttctacaaagtttcattgtctttggtttttctcatatgggggcttgtcttcttatctacattgtggatcagtcatgttgatggtgacaaaggtaactttttgagttccttatttggacagaatgcaaaacagttattagaatatggttagagaactgaacttaagtaatatacgctcttagagatatgacaatcatgaagatgtatagaccatatcttaagtgtatctaaggcttactcttgggcatttgcaggtagatctttagtggattcagttgaaaaaggtgaaccggatgatgaaagggcagatgagacagctgagtctgttgatgcaacatcactagagtctacctctgttcattctaatcctggattgagttcggatgttgatatagctgcagccggagaaagtaaaggctcagaaaccatcttgaagcaattagaagtcgataacacaatcgttatcgtaggaaatgttacagaaagcaaagacaacgtgcctatgaagcaaagtgagataaataataacacagttccagggaatgatacagagaccactggttcaaagcttgatcagctatctcgtgctgttccgcttggccttgatgagttcaagagcagagcgtccaattctagagacaaatctttgtcaggccaagtaactggcgttattcataggatggagcctggtgggaaagagtacaattatgcagctgcttcaaaaggtgcaaaggtcttatcttctaacaaggaagcaaaaggagcttcaagcatcatatgccgggacaaagacaagtatctccgaaacccgtgttctactgaagggaagttcgttgtcatagaactttcagaagaaacgttggtgaacacaatcaagattgcaaatttcgagcattactcttccaatctgaaggattttgagattttggggaccttggtttacccaactgatacgtgggttcatctagggaatttcacggctttaaacatgaagcacgagcagaactttacatttgcagatcccaaatgggtgagatatctaaagctaaacttgctaagccattacggttcagaattctactgcaccttgagtttactagaagtctatggagtggacgctgtggagcgaatgctggaggatttgatatctatccaagacaagaacatattgaaactccaagaaggagacactgagcagaaagagaagaagacaatgcaagcaaaagagtccttcgaaagcgatgaagacaagagtaaacagaaggagaaggaacaagaagcctcaccagagaatgcggttgtgaaagatgaagtatcacttgagaaaagaaagctgccagatccggtggaagagataaaacatcaaccaggaagcagaatgccgggggacactgtcttgaagatactgatgcagaagataaggtcgctggacgtgagcttatcagttcttgagagttacttggaggaacggagcttgaaatacgggatgatattcaaggagatggacctggaggcgagcaagagagagaaggaggtggagactatgagactagaggtagaaggaatgaaggagagggaagagaatacgaagaaagaggcgatggagatgagaaagtggcggatgagagtggagacagagcttgagaaggctgagaatgagaaagagaaagtgaaggagaggttagagcaagtgttggaaagactggagtggatggagaagaaaggtgtggttgtgttcacaatctgtgtcgggtttgggactatagcagttgtagccgtggtttttggtatggggatagttcgagcagagaagcaaggtggcttggcttggcttctgttattgataagctccacattcgttatgttcattttgtcactttgatgagagaagagttctcagttttggtctttctttttgttttctagtttttttcttactgtagagttagctgagtcttctttatacccaataaaactatagaagttacctagataagttatgatgtgcctatgaggtttcaaatacaagagttttgtccggttcaatggaaaaaactcttatcaaatcaaagcttatacgtagaaagagttttcattgcagaaagttgatttacaaacaaaactattattcacagaaaacattttcttatgaccaaaataattataaacattttctttcaataattaaccctagcttcgtcattgccacagagcaaagatagttttaaaattcgaatccaatcaacctcttataccaatctctcacatgtcatctcctactcttcatagttcatccaaagtggggttatttgtcaacgtaacttcagcataaaactgagctttatactagagagaaataaagttagctataatcatttataaactgaagattgatggaggtttattaatggttaataaacctttccaaaaataggcgtatgccgctaagaacagagaagacacggtattctttagtaaaaggcgaaagaacagttcgctttgtcttcactgcacagctccgtgactcttgaaggcaagctctcgatctttatttatactaaagtttactcactgttctcaagaaatgagccgatgtgggatagtacaatcaatcaaattaattcatgggttattaatagcagtatatgggccatatcttgtttatttttaagcccatcccaaagcctggaggtttcatcatcttacaattctagactggttttggtgaaccggtttgatgaaattagaaattacaatgcaagagacacgtggcaggcttagaaaaataaccgaaagcaaaaacaaaaaggtttaagagagagacgacactagtctggttttggttcgagtcccgcagtggtaaagggacgactacaagcgaacataatg

SEQ ID NO: 26939 - DNA, 3003 bp, Unknown
  misc_feature (1)..( 3003): 2750-1469P.txt file - cDNA_ID_2717032; gDNA_ID_2214475; Annot_ID_133127
tatgagcttgacctagaaaaagagtttgcgtcggtggagcttgaagtcgccgctatcgctttagggtttcggttctgacattcaatttataattcccaaattatgaatttattaagtatcgaaaatattttacataacgtatatggaaattgtactaactacaaaatagtaacttccgctctttaaccgcttgttaaaccgacagctttgatttaccctacccggttggttcctcaaccgaatcgcagaagatctatcttgatcaagcagcaatacccggtttactttacctcttaacttttttatcttaccatctcttaaggaaaaacagaggatttagggacaataaagtagacacaattccgattagtttagttacaaaaggcgtttctgtcagacgaaacagttggttacttaatttgtcttcataaacaaggtaatgaatttcgagcgtcgatgattacaagcttatctcaaatctcttttgggacattgaggcgctttggctcttctgttttaccttctgcactgaaacgcgaatttgttgaaggattgcgtacgttagtaaggtctggtgatatccgtcgagctgtttccttattctattctgcgccggtcgagcttcagtctcaacaggcttacgcagctctgttccaagcatgtgcagagcaacgcaatctcctcgatggaatcaacttgcaccaccacatgctctcacatccctattgttattcacagaacgttatacttgctaatttcctcattaatatgtatgccaaatgtgggaatatcttatacgcacgacaggtgtttgatacaatgcctgagaggaatgttgtttcatggactgcattgatcacaggctatgtacaggctgggaatgagcaagagggattctgtcttttctcgtctatgttatcccattgtttccctaacgagtttacgctgtcaagcgtgttaacttcatgtcgatatgagcctggaaagcaggtacatggacttgctctgaaacttggtttacattgttcgatctatgtggcgaatgcagttatctctatgtacggtaggtgtcatgatggtgccgcagcatatgaagcttggactgtgtttgaagccataaagtttaagaatttggttacttggaactcaatgattgctgcttttcagtgctgcaatcttgggaaaaaggccattggcgtttttatgcggatgcatagtgatggagtgggatttgatcgtgccacgttgcttaatatatgttcttccttgtacaaaagctctgacttagttcctaatgaggtttcaaagtgttgtcttcaactgcattctctgactgtaaaatccgggttggtgactcagactgaagtggctactgcattgattaaagtttattcagaaatgttagaagactatactgactgctacaagctttttatggaaatgagtcactgcagggacattgttgcttggaatgggattataacagcgtttgcagtgtatgatccggagagagctattcatctctttggtcagttacgtcaggagaagctaagccctgactggtatactttctcaagtgtactaaaagcttgtgcaggacttgtcactgctcgccatgctttgtctatacacgctcaagtgatcaagggtggttttttggctgacacggtgctgaacaactcattaatccatgcgtatgccaagtgtggctctcttgacttgtgtatgcgtgtatttgacgatatggattcgcgggatgttgtttcctggaactcaatgctcaaggcttactcattacatggccaagtagactcaattctaccagtctttcagaaaatggacatcaaccccgattcagcgactttcatagcccttctctcggcttgcagccacgcaggacgagtagaagaaggattgagaatattcagatccatgtttgagaaacctgaaactcttcctcagctaaatcactacgcttgtgtgatcgatatgctaagccgagctgagcgttttgctgaggcagaagaggttatcaagcagatgccaatggacccagatgctgtagtttggattgcattattgggatcatgtagaaagcacggtaacacccggttgggtaagttagcggcagataaacttaaagagctagtcgaacccacaaactcaatgagttacatccagatgtcaaacatatacaacgcagaaggtagctttaacgaagccaatcttagcataaaggagatggaaacatggagagtacggaaagaaccagacttaagctggacagagataggaaacaaggttcacgaattcgcatcgggaggaagacaccgtccggacaaggaagccgtatacagagaattgaagagactgattagttggttaaaggagatgggttacgttccagaaatgaggtcagcttcacaagatatagaagacgaagaacaggaggaagataatttattacatcacagcgagaaacttgcgttagcgtttgcggttatggagggaagaaaatcgagtgattgtggtgtgaatttgatacagattatgaagaacacaaggatctgtattgattgccataacttcatgaaattagcttctaagcttttgggaaaagagattcttatgagagactcgaatcggtttcaccatttcaaagattcttcttgctcctgtaatgactactggtaattttctatgttactttcatcacaagacaaagacaaggactgatttggcaaataaataaaagtataagaaaatgtgttaattaagggaaaaaaagaaaaaaaggaaaaaaaacaagttgcagaaagagagagaggtgggggaagaagacgatcttcgatccagagttgagcttctcttctgccatcgtcttcttcctcgatctcggtcaattacgcattctctgatctgatttgtgagatctctcgtcggatcaccgttttttacatcgtcgccgacaacacttaggagtaattggatccagcagaaatg

SEQ ID NO: 26940 - DNA, 3003 bp, Unknown; identical to SEQ ID NO: 26939
  misc_feature (1)..( 3003): 2750-1469P.txt file - cDNA_ID_2717032; gDNA_ID_2213625; Annot_ID_195818

SEQ ID NO: 26941 - DNA, 3003 bp, Unknown; identical to SEQ ID NO: 26939
  misc_feature (1)..( 3003): 2750-1469P.txt file - cDNA_ID_2717032; gDNA_ID_2214475; Annot_ID_183087

SEQ ID NO: 26942 - DNA, 3003 bp, Unknown
  misc_feature (1)..( 3003): 2750-1469P.txt file - cDNA_ID_2717040; gDNA_ID_2214475; Annot_ID_133124
cttatttataggtgtggattagtatcttaacagcagataaactcctgtgtactcgttttaaaatctcaaagcctccaaagttagcttcgaggaaacttcaaaattgttatgggcctttgtgggtgtaacaagtgttatctatttagtatcaatgcactgtagattccctcaaatagtaatatgagtaaactaatgagaggttttaggaaagaggcagaatattaaggttttgttttaagagattggatttgctatagtagacgcggttttcttgcatcatctatgggacccttttgtgatccattccataactttgtgatgctaagagttggtgcaaaagtgggatttatcctaaaacaaatgtcaaagctcattgggtcataataatcttccttttcttgagtcaattgatcaattaaaacattggtcgtaatataaaaaaacattggtaataatttattttactaatcaagcttactaattctaagacattttggttgcttcaaggatgaaattttgatccctagcatctatctacaagatatgcccttaatcattaggctaccacatttgattgattaccacatttgaattttattgatagttcttttgtgtgatcaatatatatgagttaaaaaaaaaaatctaactatgtgtagctttatttagtctgattttattttttagattttagattccattatatagtcatagattgtggcaaatatctctctctctttttttttaataaagaagtaaacaaaatatctcttaagctttggaattatgcatttttgttatcaatgaagtttttttttagtcggacattatcactgaagttagacaactagatgctcttagactgctttagttgactcaacacatacgataataaatgatcatttaatgttcaatctttttttttaattgattgtgcgcctcgataaattatttttaaatttcgttcctactaaaacatgacattcttaattctttgaatataatgttttgtctaattctcatatatgatattttttaaaatattatggtttgctatttgattatatatatatatatatatatgtctatatatatacaaatattatcagtgataatattttagatagtttcccatgtatctaaatatctaatatatattgtttcatcttaacacgtttagaaaatgagttatatacgttgggtagttgcttgcgtagtgttttattttttaaaacagttgttgcaaccatttgagatatatcggcctatgctttaaaacaaatattacatttctttgcatcacggtcttttaagtaagacggtttagacaattttttgttttgttttgagtaatagaacgaacgtgtataaaatcacatctctgtctgctttgcatgagtgtcggagggaagagtcttggtttgaaaaggatagctttttgttttctctggcggaaaagacagaagatataaagttaacttgaaatgagacagaaatagaggaatttgaataacaaaaaaacaaacaaacagaaactaatgctgtgtaaacatgtgtcattgattatatatgagtttagaaagttagaagctagaagaaaacaaaagtttctttagaccaccgacttcatttttcttatatttctgatttgataaaagctctttagtatatagttcgtacttgtaaataactcaacgtaacaatgggacgaaaaaataattcaaatttgattggttcttcttcttctttcccttttgttgtttgttttctactcagcgtaagcactaaacatgggtcttacgcgttgaggaaaacaatgaaacgagctccaaaatttctcctccttagaaaagatccaatgatgtatgctttgatatattaacatatacctttatattttcatatatttggttgtatcaagaactaaagctaattaacaaaaaaaaggaactaaacccttttttatttaaatttagaaggaccaaatatatgaaaagattatgtcatactcaaattcaggttttggagaattaaattctatttgaaagattttatttagttaaaatactaaattaaacaaaagaagtgtggttctcacttctcaacaatggaagatgtccattgggcttcgtaaagatgaacattgagagaaagagatatgtgtgcgtgcgtgaattcgaattggtggtgaattgcaagctggattcctaattagagaggattttttgtactaatggtgtgttgcagctggattcctattttgaggacttaagtgtctattatcatcaaaaaaaaaaaaaaaagtcttaattattagtttaatccaaaacttaagtacactcctttcgtccgaacatagccaaaacaaaagttgccactttaagttcctttgaccactgtcggcacgagaatcgtttgacttctttctcatatgggctttaaattagcccatctctataattttacttttgttgagggttttataagcccattaagtttcggcccactcttgacgttaatctgacgtcagcttgatttttccggcggatttctcaaatcgacaaattcgttttcatcggttgtttcagacgtaatttccaaaaatgaaggctgagtctagcaacgagtctttcataatcgggcagcgagtccactctctcaacgattcgcgtcgtgtgggcaccgtgaaatacgtcggagatgtggagggatactccggaacttggatcggcgttgattgggatcaagacggtgatggaaaacataacggttccgtcaatggcgttttctactttaacggtcgttctcagagctcagcttcatttgttcgttcccagaatcttagtcgcggtatcacattgcttcaagctttggagcttagatacagaacaatttcaactaaggacgaagaaggtcttgaaagagaatgttatattttagtttcagtgagtttttggaatttgaaataatgaatcttcttctttgtttttgttagatgaaatg

SEQ ID NO: 26943 - DNA, 3000 bp, Unknown
  misc_feature (1)..( 3000): 2750-1469P.txt file - cDNA_ID_2717068; gDNA_ID_2214475; Annot_ID_133115
cccaacagtggctgatacagaatggaacggaggtggaagcatcaaaagacaaactaatgcagagatgaagtctaggacatctcaaacaggagacttgtctggtgaatcttataggagagatcccaacagagattactcaaccgtaagtctctcctcttgttatatcgtgtaccttaaaccttttggtatgtaattattaagttgctttgggctgtgtcatcagggcaatgcaccaaggaaaaacagaatcaattactcaggaccattgatgcctcctggtggaaatcttgaagatttgcttaaagagcatgagaagcagatccaacaagctgtccgcaaagcacgtgtagaaaagtctgcatcaagaaaaaaccaagctttaacaggacaacaacagcagcaacgttacacaggaagaaatgctcggtagctgaaaaagggaacaagaagccatagaactcataagcgtttttgttgttgtgcctcttctgtgcttgaagccagggattgatacaatgtatagtcgaatttgtttcttaggccaacaagattgactacactataatgtcaagctaccttttgtatatacacaaggtctctctattgagttgagtcaaacaaacaaagatgtatctgcaagggaaagcaaaaaattccaaatttgctacattctatgattctagctcagctcaagtaattaaaacctaccattagctgaaaatctcataccacataacctctgcaacaattccacatatcaagctaaagctactgagcaaaaaactcacgaggaaaaaaaaggctgaattcttgagaaattagcaaacttttttgcataaacaagttcgctctgacctagctactgagtagtgagtactgagcaaacattccacgagaaaaaaaaaaccttaattcttgagaaattcgaaaactttttgcataaacttgaaaagcttaaattagaatcagataatgaattcttcaaaccagaaaaacttcaccgatattcccaaaaccaaatcatatgttttcaatcgaaagactaataaacctaaaccctctgttttctatttcccggcgaagtggccggcgatatcttgcttttttgtaacctctgttttctgtttggcccaaatccagaaaagcccaaagcccatttgggaagatattaataaaaatattttaattaaaaaatagacgggtatgggttcaaagacccgacaacgtacggtattcgggttacatatgaataattcgggtatatatatgtttttaaggattaattagaaacaaagagattacagtaatatactatgtatggtcaaagttgaaactcgtaaattgtgaatttgtgatgttactagatgagctgataattttttccttttttttttgcaaggattgaatccaaatctcttatgatgtttttatttattttccattttataagtacaagactttattatacttttaaaaaaacgtaaagtataataaaattgtaaattttcaatgcgtacttaaggaaagtcgttaaaaaaaatgtaatatttaacaggatgtcaaaaataaaacatatttggtcatacttgcatattttactattgatgatatccttacccacaaaagaaaagtaatttgtctggtttgaaaatcttataatttatgtattttttataaattggtaataaactgtgtaattatatgaaattttcttagtttaaattgttaatgatttgtaggcttattgaagtgcgaaaaagtcgggatgagtaaggctagaaatgttagtaaagaagaaaatatctgaaaacaaaataaaataggcaatgtcttgcttaccgtgaagaggaaagggcattaacccaatgccacacaaaaaaaaactgaatttcgtaggccataattttttcatttttagccttatgtatttaaattgtatagtgcatagtgagtatttgtttgggaagtccacacgctatgtattagaaatttatgcacatgctaatggaagataattttaataacataagtacataactaaaataacgaaaatctcttttggaataatcaacatattaaaagaaaatgaaaattaaaaagaaaaagagaaattgattttgtgttatcaatgggccacttaaaaaaaaaaaattataaacaaaattagtagtaaggttaatctttgtaaccgtgtcttcttctaaatcataaacttctttttttgcttcaattttataagagtatttggctatcatatctatagagagaaaattggtttgataactacgtgagtttgttgaataatttttttaaaggaaagatagataaatagtggtttgaatattttattttctttcatcttatcactatcgaatatgtttttcgttatttggattatttttttaataataaaagccacatttgtttattcgccctaagctatatttagccttagcacgacactgaaaatagaaagagaccagagtcgttagattttacgagtgacttctaacttacgagattaaccgcagactggttcaaaagaccatcctcactttcctaagatccaagtaatcaaaattcactttcactcaaatcacctctctatttaaacaacaacaccactttttcaatcctcattaacaaagttaaaaaaacaaaacaacaccatcttcactttttttttttcttcttattttttgttttctttctctatacatattgtatcaaaaaataaatacattttcctgtattttattttttttgtgagtattaaagaaaacacaagacaagaatgacatacacagcggtaactatgctctctctctgcctaataaatatcttttcatcttatggcaaagagtgtcgagttttggcccgacttgtaatgtagtttcatcaatgagactcttaacattatatcatatcattgcctcactttattacattttttgtaacgttacgcgctgttagttctcttaattcattatattaagcatg

SEQ ID NO: 26944 - DNA, 3003 bp, Unknown
  misc_feature (1)..( 3003): 2750-1469P.txt file - cDNA_ID_2717080; gDNA_ID_2214475; Annot_ID_133112
tgaccattaaaagagctaaaaaaaaaagtaaatgaactttaaacttgaggctgattttttttccgttgagttttgggaaataagaattaatagttgaaagtttggaattactttggattaaaatatgaaagtttagttggtttcttattgtaagatccatatattcgaagaaataattggttagaatgtctaacaatactagttagatttttctagcatatatcaattaattcatatattaatgttatctaaagaaacccactttctcagatcgcaatgcacataagctcatagttaaattaaaagcatgcattaggataaataatatacaaagaaataaataaattttagggagtggagaatcaaaagaaactttatgcccctaaaagacatgaaaatcaaacaagtgtcaatcatagatacgatcttgatcgagccaatgagcgcaaagatgcgaggaaaaagaagcaacagatcgatcacacactttttgcgttttgcatgtttgatgcattttgatttgacaaagattctttatttacttccttcttccttacttaagctgaccctctttcttaaagtttaaactgtttttagaacgatcaatcatttcaattttggaagcatcgaaatcaaaatgtccaaaatacatattttgacagcgaaatattttgactagatttcaatagtttagaactttggttccacaccagtttatgttgtaatggcaaatgtaaattatttatagaggaatcccattctaatactattttgaatactaaccttggccttttcaacaaaaaaaataaatcgaaatgtgtacaatcaccacgaaattatcatattttttagttatggattctgtaaagatggattaaattagttaaagggaatatactcttacattagctatattaaaaaaaaaaaaaattagctgctaaggggatttagtccatggaaaatgttatttaattctagtttgattaaaccttactttcttcatggtgaaatttaaatttgatgatataatccacgctaaaaaataccatcgtaaaaaacgttgctaaaagctgtgtctttttttttttttttggtaaaagaagctgtgagtcttttgttatatgatgagttaaaccgctcacagaataccagttagtgaccttaaccaaaaaagttccatcgttacagagtatcaatctatgtttcaatgtattatgtatttctttgaaatattgatgtcgaatataaggtggattttctactcagaaataagagaaaaatcccatattccaagaaaaaagtgagttgaaaaaccccgtaatgttgaagaagaataagattcaggagtttgttatgtagaccaaaggcaaagcaagatggtcaaaaaaatatttagaaaggagaaaaacgacctacttaatcaattaacaagcaaaaaggtgaaattcaataaattaatacacctaacaaaaaaaaaaggctacattggcacctaacatgggcaggtcattggttctccaccacgatgagatgcacatgatacccgctttaatatgggctaagtatgcttaatgaccatcacttaattgttctttttagttgttaaaatgggttaagaattccacgtcgttaaatgtgagaaatgtataattcaatacagaataaaaagctcggacgaaaaaaaaaaaaaaaatacagaataaaaagctcaccatggatttttaacatgacataataatgatgagcagttctatatataccacaatgaaaattctttgtaaacttctttctattagtctgctttatattttctagtaatcgaatttcatatttagacactaaatagagatcatgtgagtttcaactctagatcaaatatggttcgttttaataataacaaaaatatatacatataatatattttgttattattcggacggtaattcgatagtgtaaatacattaaacttttgcttaatcaatagagcaaaaacctcccacttttttttttttttttgataacttcttgtttattattagttgattttaagatgaaattttatgtatttttaatgatttacatcaagtcatcaacccaaaataaatatattcgatctttggatccagttaaagtaaataagatatgagaggtacgtgcagagatatattcagaactatacattagtaaatataagaggcaaaataaatgatgctatgaataaagatgctatgaatgtttaactaggaacagaactagtttttgtttcattgttgaactcttatttactctaaatccttcacataataacgctttgtttataaaaaataaaacaaagaattctttttttaagaaagtgaatcgcatgccatttgggaactcaatctttttttatatatatagtcttgcacatatcaaatccagcctccatctcttggtgtagaatgtaaattgtaccaaattagattgttaaatatatttggatattgtaacaatagtgcatgtcaggtcatatgtcacatcagatgtaacatcaatcaatcaaaaagaaacctaggaaattatactacaagctagaggaggaagggatagtacaatacaaaccccttataataacaaagaaagacggagctttcgcatgtaaagctatatactattgtatgaatgcatacttaacatataacgtatatgagcgcatacatatataagggaaaatgaggctgatgtggaaaaggtgctttaagaagcagtgaagttagtgggagaatatgataatggagattatatataaagacaagaaggtggcatgagattggtaataacttcacagttgtctccgaagaaacagagaaaccaaagagttaagtggggaacctcgaagctagttcaaactagtgggaggttgtttcacgtttcaactttcaagtcataaaaccaaatccaactctaaacgtaaacccaaacgtcaaatcatcagatagaaggaaatattctgattgagagatg

SEQ ID NO: 26945 - DNA, 3000 bp, Unknown; identical to SEQ ID NO: 14832
  misc_feature (1)..( 3000): 2750-1469P.txt file - cDNA_ID_2717080; gDNA_ID_2684228; Annot_ID_192123

SEQ ID NO: 26946 - DNA, 3003 bp, Unknown; identical to SEQ ID NO: 26944
  misc_feature (1)..( 3003): 2750-1469P.txt file - cDNA_ID_2717080; gDNA_ID_2214475; Annot_ID_183070

SEQ ID NO: 26947 - DNA, 3000 bp, Unknown; identical to SEQ ID NO: 11149
  misc_feature (1)..( 3000): 2750-1469P.txt file - cDNA_ID_2717109; gDNA_ID_2214480; Annot_ID_133241

SEQ ID NO: 26948 - DNA, 3000 bp, Unknown; identical to SEQ ID NO: 11149
  misc_feature (1)..( 3000): 2750-1469P.txt file - cDNA_ID_2717109; gDNA_ID_2214480; Annot_ID_183310

SEQ ID NO: 26949 - DNA, 3000 bp, Unknown; identical to SEQ ID NO: 11141
  misc_feature (1)..( 3000): 2750-1469P.txt file - cDNA_ID_2717124; gDNA_ID_2214480; Annot_ID_133227

SEQ ID NO: 26950 - DNA, 3000 bp, Unknown; identical to SEQ ID NO: 11141
  misc_feature (1)..( 3000): 2750-1469P.txt file - cDNA_ID_2717124; gDNA_ID_2214480; Annot_ID_183296

SEQ ID NO: 26951 - DNA, 3000 bp, Unknown; identical to SEQ ID NO: 11163
  misc_feature (1)..( 3000): 2750-1469P.txt file - cDNA_ID_2717144; gDNA_ID_2214481; Annot_ID_133263

SEQ ID NO: 26952 - DNA, 3003 bp, Unknown
  misc_feature (1)..( 3003): 2750-1469P.txt file - cDNA_ID_2717154; gDNA_ID_2214481; Annot_ID_133255
cacaaactaaaataaatttataactataatatcaaacatgtgagtaaaaaataaagaaaaactagaaaatcaccccgtgataaataaaataaaaaggatcagataaaagaagaaaaatatgtatgtggtaaatgaacaaatgataatgatgggaatgggaccaaagttgaacatgaatgtcgtgaagaccagagagtgggtgtgaattgtgaaatgtggtgctgattagttgagccgaataagcaaaaaggaaatggggacacgtgagttgttgggtctctcttcttgtctctatttttagtgagcccctctcttttcttctaatgagcccctttaatttcttatcataactatccacgtggcgtctcccctgccttttgtcttcttctctttgttcacatgtgattcgcttctgtttccacaacatttataatcccttactcttctcacatgctttggtaattgtttccatcaccacaattattgacttaaactactttttaaaagtgagataatatttcacttgcttctgatggttgttcacgaaacaaaacttatctgatggttatactgaggaggggaaaaagaactttatttcgtttgtatgtatctcgtgatccttctctttacgagttacatgcactagagattagtggacgtaatttgcgatcaacttcgactgtataattactttatgtgtttatgaagttactaacttttcttttttgttgaattctgaaaattacaattcgaatgaaagaacattttgtgcctatataatcaccatatggttgattgattactcaatgagcattagtagcatttattatacactgatcgcagcgccatataaaccaccacaatcatttggagcctttcgttctataggtacaaaacaataagatgggaaactaaactagtgtcctctcttatcctgcttttattacatttgactatgtaacccacatcatcaatagaagaataccataatggtttggcatcgatacccatgtcatgtgaccatcaccaaatctgaatgtcatctttacttaacatgacacgttcatgtgcataggtgttttaacatgacacttttgtctccatttgacgccggcgcaccatgtatatctatcaaagtcatgttaatttgtcaatgaagccaattagctcatcaaaagctggaccacgatcattttcgttcataatttcatttttctctccactagaatattcaagaagcaatcttcttttggcttctacaatatttcttctttttgatttcttatgttgtgtattttagctgtttacagcaaggatctttcgaacaaaagctttatatgaggattggttatcaattttaaataattagcaaaaaggaagccgtttatgtaatcagaactataaattattttatttagctttgtcatttgctacttttgctaagtaaacagatcaaccaacccattatattacgatactcgtaataagtcacaatatgtcaatttcttacaataatttaactgaatttatacatataggtctagagtgaaattagaaaataatttgcgatcaatacattacaataacaaaatttatgtaatgtattttacttacatacataaatcaaggatggatgctcatgatttcgtctctaagatttgcttcatctcactgacatttgtcgatcaagctataggaagttaaagaatcacacttttaatttgcttgccaatatctacaaagatcaaataaaataaataaaaacaaaatgttgttgcggaatctaaagtaacttgtcgtattaaaaatttgtttttaagtcgtagggaaatgtaaaactgacgtggcgcatctcgaggccaacgacttattggcaggccgaaggtgaattgtttataattagatttgtaaataaatcactgatactagttcgtctttaacctacataatatttctttattaaattaagtagtacatttttaattatgttttagttgctgttgagtacaataatcttgtcagtaaaataattgcagcaacctaacgagtttggagcaacgacttcttgttgcggccgcgagaagttagatgtgaaaactgaaaatgtgtgcatacacataactactatgtatgactaacatatttaaacaataaaaatgtatgactaccatatgtaataataaaagaaatatttttgattaaaaaacatatttttaatataatatacatacgagtattattgtacgaatttttttatacttttagactacattttcttttgttttatggataattttttattatggtatgtaagtcagaagaccgtttaaaattttaaatagacgaattggtagtcttagttttttaaaatcatattaagttcaagtgacgtatgatggtacgtaatttcgaaaatttcgtttcatgctgagaaaaataactagcgatgagttgtatcaatttgtttatttgtcaacagagttagatttttttgtcttttctcgacgcaatacaagaagttactcacttactctccaactcctccatacggtagcaaagtctagttctaaactacattttgatgaagaagtaagaattttcaaggttaatttataaaaatatgcagattacaaatcaaatgctaattttgtatgttacgcttacggctaaaaaagcggtgggaataataattcgcgaaaaggtgctctctgacgactgattcgttgatctagattctagccgcacatggtgggccatactctccggcccagtatacacacatccatgacatgtcatcatatattatatcataacatacatacacataaattgattagtgaccacatgattagaaagagacaaaaaataattgccgcccgataataataacttctttataaagcaactcttcttcttctttctctcttcactttctctctttttaacctttttctaattaccactttcttctccatatacaaaaaaaacagagaactcacaatg

SEQ ID NO: 26953 - DNA, 3000 bp, Unknown
  misc_feature (1)..( 3000): 2750-1469P.txt file - cDNA_ID_2717164; gDNA_ID_2214482; Annot_ID_133279
gtgtgccaattaatcatcacaacacaacaacactcacacacaagtcccgttgcttcatcaaaccccttttctttcacgtctctagcttcattcatttgattttattttactatttcatctcatcttcctcctcctatacgatctgtttcttttcttttctttaatttagggtttggtgcaaaacccttgattgtttccacctctcgtctactacatgatccatatatgtgtatggttcgatagatatctatattataacaaatgatcactaataagtcaccatatatatgataaatgtgagtcacataatcacaattgatgtttgttgttgactgacttggaccagaaaccacatcatcagggttccaaatccaatttacataattgctgagtctatacatattgttgatcggtttttacattttgtaaaatgtttatacataagagttggtatatgttgtaaccgaagttttaagctgatgattagaattatacatgatgggtttataactttatatatgtgctagaaattttccataagctttatcaacactgattaattaacatatacataattaatgtagttggattatctatgttcacaaaccgtgatactattgttttcttcttacaaacatttgattggaaattaaaatatacgtggaataaatgagttacactatagagaaagggtcgctatcgacatctgaattctaatggctacaaggagttaccttgtcatcgtttcgcttctaaaagttttggcttagaaatgaccattttagaaagacaagtattttcctatcatattatctattcatttaatttatgtcattatgtaaatatatatttaaaaagaaatcgtaaaagagtctcgtgtttgtgacagctatatctcctttgtcttcccccccccctccccccccgtaattatatatttacccgagacaaattgagattagtatcattttggtttttacaatatgcacataaaatcatgttataagcaaaatttaaaaaaaatatccaatattcgtacactcataatcagtagttccacttgcaaaacggtcattggtttgtttcctacatattaggaaaggattctgattgtacttgtaaatttaaggctaacataaatagttaagtatacaataacttagagtggtcactcgacccattatccctagtcctagttttagtataaatatggcataaattttctaaatggttatgaattttagcaatttgatttttcttaatataagaatttgacccaaaaaaactttgtagtagcatagttttgttaaaaacgaaaattgatcttttatatgtagcattaaattagtaaggtttgtttttcttcgaaaatatagtattagttattactaccaaaaaacggaatttataccttgtttttgagaaaaagtgatgtcatcatcaaactaacatttgattgttctctacaaacattacatttatacacacacaattttttttttttaagttcgtatttgaatatattatattttgttataaatttggacatccagaacaatacaaaagcatatgtacttatatacacatatgtttcgtcattttaaaattcattacaattatatatatttaaacaaaatcacaaatgaaaaaaataaaaataaaaataaaactaaaaaatatgatggtcctatggaatcgtaaatacgtatgcagaagtaaaatgtttagaaatataaacacggtttttacaaaaacaaaaattagaaaacgcaagaaccttaaaatccgtcgaaagtatcataagttacataattcatgtttgtcaagactcaagacaatatggtgtatgaatacaatcatatccattttattatcataattctcatgtttgaatgtccaaaaaaaaaaaaaaaagaggattttcattacgatcatcatcattataacacgtatatttctctctcgttgtttcttctccatgttggcacatcaatgttaaggacgactcattaattaaactccaagatataacatatcggatggaccatacgtgggatttagaagagaccaaaaggacaaaataatattgaacatatcttaagaagaatttacaataatatgttgtagtcagggtttagcaatttgatctaccccactctcctcttgaatgtgacaaaagaatcaaatgagaattaggtcacgggggcggctttatgctatcaaacatcacttgttttttttcttatctctcgatattttttgtatagtatttgatcaaataatagacattgttcaatcatttacatcctcatatatatcaaaatagaatactgctgagacaaaaaaaaaaacgcgtttatcattaaggttatgactacatatgcttacatgtacatatatatgcgtgacgtttgcatgcctaattataaactagttataaccaaaacttatttgttggaatcccacaaaaatgggagagaactcacgttaacaaaatatatgctcaagtttaacatattgatcaatgttgtttatttacattagaatcagacgatgtccgattttccgtaatgatcaatgttatcacttcaatttttttatttcactaacatgtaagacatgataacattttatactgtgttaatctttttatgataaaattttagttttatgtacttgattttttttattttttatttactaaatactttgatggtttttctgtgagtatgaaaaagtgttattgttgcaaaatgaaaaaaagtagtatataaccaagaaaaaaaaacaaaactaaatatatgtggaaaggaaaatgaatgtacgtacgtcgtaggaattaaaaagtatatgggcccattaagaggaaatggagaaacgtaaggcccattatgtttctctctaagccctacccctagtgtgtgtcctcttcttcaatcatcatcttttcgataccgaagcagcaaccttcgcgccgccgagagataacgagaaaaaatg

SEQ ID NO: 26954 - DNA, 3000 bp, Unknown; identical to SEQ ID NO: 11206
  misc_feature (1)..( 3000): 2750-1469P.txt file - cDNA_ID_2717174; gDNA_ID_2214483; Annot_ID_133307

SEQ ID NO: 26955 - DNA, 3000 bp, Unknown; identical to SEQ ID NO: 11206
  misc_feature (1)..( 3000): 2750-1469P.txt file - cDNA_ID_2717174; gDNA_ID_2214483; Annot_ID_183424

SEQ ID NO: 26956 - DNA, 3000 bp, Unknown
  misc_feature (1)..( 3000): 2750-1469P.txt file - cDNA_ID_2717181; gDNA_ID_2214484; Annot_ID_133330
ataaactttacttgtaaatgtgctttagaagtttctgataccaatgtgaagaaaacaaagtctgaaagttagattttttcttggttttaccttagtctgttggttgctctttgttggtttttttatttgaagtttatatttttgttctgtttagcacgaacctcacagtgggctgaagagttctcggaatagccatggatggggtgggtgaaagttcgactcaaaatgaggtagaagagaagcctgtgattgttagagttaagcgaaaagttggacagtctctgctcgatgctttctgtaagtttcttctctcttcctttgatgtttggtagagattctgtctttagcaatcgtgtggaagtggaaaaactgatattgctttggcatttagggttggagataaatgaaagaccactcaaacggccgactctggatttctcaaagctatctatttcagattcaggggagagaggtaattctatattatctcaggctttatgtgcttgtacgatgatggtttcgactcagtggagctttaatatgtgtttacatggatataggtccttctgtggcagaggatgtgaaaccgaagaaggtgctagtgcggcatttggagacagttacggactctgaaaccacagctgatattatccactctttctttgtgagtgtactttctggttaaattacaaaccctgcaggttattgttgttgtttgtatgttcttatagttgtcactttgtgctctgcaggagtctgatcataatgagaaaagttgcagtaaaggaaagtttgaggagaggaaaattgctttcaagaaagacaatgtatcttctttcattttgttttagtcctgattccagattgtctatctcttgaccgttgcttgaatgatggcttgaattcattttctttttggcctgtagagaaaggaacagcgcctgaccaaatctgtacaaaagcaacaggtatcgggctattggtcaagaacattgtcaaacagtttctctgagattaccatcttaagaaaagatctaacaccactttacatagctaagttgagacttctgtaatcatttaataataagttccactatctgattagattgcttcagagaatgctcggtttgagcaaatatggcggagtaggaagggaaacaaggaaggcatccatgagaagtgtcatttctttgacgttattcgtgttgatactgaagaaagacgagacaatgcacaagagtaagtcccctagtaatgtgcatttgtaattaagatctcagagtcagaaatagattagctgtagttcaataaacacagtatgtaaaggtttactctttctgtaggtttacatccctggaggaccagaaaatgctcgctagtttcttgcctctccttagagaatgtattccaacagcagctgaagagattgaagctgatatacaatctagtcacaccgaagaatacgtttatgattattatgctgtgaacgaagagatggatatcagcgaagatagttccaagaatcagtttcctctgtgcgtattcgttttcgtcctttactttttcgtctttgtctcttgtgtcacacctgttaatatggtttttttgttgtttttcagtgtcatagtagaggatgaagaagaattctgtgatggatctgatgaatcagactacgactctgaagattcaaacggtacactttaatcatccatatgactatcttcactcttatttaacgtcttagacccttgaagttctggttgtgtgtttcgtttgcttttcaacgctcctgttcgtgctagtactcgctagtcttttggaagcagaatcaaatcagggcattgttttcatttgatactacaatctcttttctcttgatatattttctctaatgagttaacgttgaaaacaagtatcattggcatttttgatttatggtttcactctgtgttgtataaaccgaaagtcaagaaagaaagaatacttactatttatttatatatttgtgtgctcagctgaagatcatccaaagactgattacccagaggaggaagaagaagaagaagaagaagatgatgatgatgatgatgatgatgaatcagaagaagaaaagagtgaagcctctgatgaatcagacgacgaggagacttcaaaacgacatgtgagaagtgtccttggagatgacgagtttgatgattacgcagaggatgtgtatggttacagcgagagcgatgaggagtttgagtcttagttaatgcctaaatgtgtctactattcttattgagagatactaaagagaattaccgtaaggctgtgaatcaaaattgtgtctccacttttaaacgaaattagaggtgaaatcactgaaatgcatgtaagggtgatgttttgaacagagtagatcatcatatatatattctacagaaaacataaaaaaaaaataaaatcaatacattttgaaagattatacataattcttagtttttttaaaacaaacatttgagagggatggaaatgcaaaaaaaaaaacctttataaatcaattcatgtcaaaggtatgttcactaaaaatgtatcttttccaacaaacacatatgttaaaccatacgtttttccaacctaatgtaagtaacacatttaccattttctattaatttattaatcaagatcaaacatcaaaaaaatgtgttattactttttagtttttttttttgcatttcagttttgtgtgaaaaaaaaaacaagaattggtatctcaagaacgtaaaagaaaattatcattactattttattatctttggcttctacatccaattatttacttgcttaattttattcatctgaattattttttggtgtaagaagaatgtttcgccgcaaaaaaaaaaatctgatccgacatcattagaacaaaaaaaaacattggcgttgaatataagctgcttctcttgttcttcttctaccttacgcttctgactgttattagagactatgtaaatg

SEQ ID NO: 26957 - DNA, 3000 bp, Unknown; identical to SEQ ID NO: 11233
  misc_feature (1)..( 3000): 2750-1469P.txt file - cDNA_ID_2717194; gDNA_ID_2214485; Annot_ID_133341

SEQ ID NO: 26958 - DNA, 3000 bp, Unknown; identical to SEQ ID NO: 11262
  misc_feature (1)..( 3000): 2750-1469P.txt file - cDNA_ID_2717198; gDNA_ID_2214486; Annot_ID_133372

SEQ ID NO: 26959 - DNA, 3000 bp, Unknown; identical to SEQ ID NO: 11262
  misc_feature (1)..( 3000): 2750-1469P.txt file - cDNA_ID_2717198; gDNA_ID_2214486; Annot_ID_183519

SEQ ID NO: 26960 - DNA, 3000 bp, Unknown
  misc_feature (1)..( 3000): 2750-1469P.txt file - cDNA_ID_2717208; gDNA_ID_2214488; Annot_ID_133408
tttcctcaaaaaaccaaactttaaaaggagaaagcagaactacaaaacctccaataaaagcatcttaaaatacatattgaaacggcgcctataacaggagaaacaataaatgatgacaaaccagaaggagaaagtgtcatccatacctgtgtaatatattctgccagttgtttccaccattcttattatgctttttctggtgtatatcccttgcatttggatcgactttgtttgctacttcaccaactgaagccatttccatcatcttatcagcaaaactgtttgcctctttcttgtttcccatcttacctaagccatctatcacaggcatcaatgctgcagggtcaaatccatatcctctgtctatcatcttatgcaaaattccactagctacttctagttcatccttcttacataagctctcaacaagatctttataaagaaaagtccccaactcaaaacctctatctaaaacagcttcgagcaactccgtagcctttagtagttgccctgcagcaagcaactcattgaacatcaagctgtacaggccttctttctgtccacagatacttacagcagtctcaaagacttcttgggccatatcaaaatcagggaccttacagaacgcttcaatcaaatatttgaaggaaaatacatttggggctatgttcttttgcatcatttcatcaaggaggttagttgcatcttcaactttttctccctcacaaagatactggattgcagtattgtaggtgcatatatttggtgaaatgcccttttctttcatctcatccatcagtccatgaatttcaaaaatctggttttttatgcctaagcccaggatcagtgagttataagtctctaggctcttatgacaacctttcttctccatgtctttgagaacgcgaaatgcagatgatattttcccctgtttgcagaaatgatgaatgaaaatgttatatgcgaccgagtccggttgcagtttctctcccatcatctcggcaaacaaattttttgcttcagcaaaccttccagctttgcacaaaccattaagtaaagttgaatacgtgatcaggtcaggcaaacagttgttctcgatcaagctatcatccaccagtccgatatatgaattgcctaagttaccaagagcagcacttccatgcacccgcattcccttaactatctcaatagctttatctaattccccgcttccacagagtccgtcaacgataatgttgcaggtgacagtgtctagtccataacctttctcattcatctttcgcagcaactcttccgcttcagatattctccccatcttccaaaggctatgtagcaaaatattgcaagtataagcatttggtaaacaattattcctcatcatctcctgcaacaagcttttagctgcatcgactttcccaacactgcaataaccatgaagaaggcagccataagttacagcatccgggcaaacaccatttcttttcatcaaaccaacaatagtttttgcatcggatagcatgcccaatttacacaatccatccatcaagatattgtaagaataaatacttggtcctattcccttatcagtcatttgcttcaggactgtttcagcctctataaacttcccatgtctgaccaaaccctgcagccaaatattgtaactctgcaagctagcgagatcatcattttctctaatcgactcaaagagggtcttggcatcttccagcaaccctaccttacagaaacctttcaacatcaagttatatgttatactattgggacgaggaagacccagatactcatctagctccatatcactgaaaattctagacgcatccaaaacctttccttctttacaaagcgctgatatcctagagttaaaagtgacaatatcaggcaccaaaccttcctcccgcatcttctccaccatcttttcagaatcatcattcctaccttctctacagaagctcgaaacaatggtgttatagataactttattaggcaaaaccccaaaactttccattgcattcaacaattcaagccctttatcagtcaaaccagctttacaatacccacgaaccaaaatcccaaaagtaaactcatttggcttacaacctttctcaggcatttcgtcgaacaactctcgagcagcatcaacacaacttgaatcacacaaagcacgtatcaagagattaaaagtataagtctgtggagcaatcccacacaaaaccatatctttatacaaccacgaaacgaactccacacgtcgttcctttatgcaactttcaagcaacaaattatacagataaacgctaggtttgttctcaggaaaccgcgaccgtactaactgaaactgcggaaacgccttatcaatgtgattcgatttcgcgaagatggatacaacagagagaagagacgaaagtttcgtcttttggattgaagaagagagtataagattgtgaagctcttggatttcttcgtgcattttggctcgaaccaggatacgagcgattgtaggagtcgcatctaaagaaatgccatggctttcttctgaaggagaagagaatatcctcttgaagattctccatgctaatctcggattgttcgtgttcttcaacaaagccttcacaagagattgttccatagaactactacagaactcaaaaattcaatttttccaaattggtcttataagcaaaatactaaattacatacggactaaaacgtataatgttaagaaatcgaggactattatgttaataacagaacatggttttacccaatttggtcttaatgtacaattcaaattataaacgggctaaacattaataacggttaaacatttggggctattatgtaaacaataaaagttatagactaaaagtaaacgcttttcttgttctttcttcgttccaaaaagtcgcaactcttcttcatcttcttcctctgacgatcattttcagaagaatctgattccgatcaaaattgcagaagaagatg

SEQ ID NO: 26961 - DNA, 3000 bp, Unknown; identical to SEQ ID NO: 26960
  misc_feature (1)..( 3000): 2750-1469P.txt file - cDNA_ID_2717208; gDNA_ID_2214488; Annot_ID_183574

SEQ ID NO: 26962 - DNA, 3003 bp, Unknown
  misc_feature (1)..( 3003): 2750-1469P.txt file - cDNA_ID_2717212; gDNA_ID_2214488; Annot_ID_133407
tatttgacaaaacgatgttaaggttgtatcacaagattaacatctcaaaataacaaaaagtggtaaaccaaatagtggtttgaaatcacaaaaagggataggcaaaaagttgtgtgaaataacaatgacactataatggatgaagatgaagtcaccttttaagtgtttgatgtgtaagtgttttgaaaaacaaacaactatcatagtttcatataaaattttaagtgcatttaaagattaaattatgcaatttaacccaaaaataaacaaattctcaaacaatatcaaatctacatttttcaaatgagattcaacatagatatggtcaaactttcaaaacttagaataatcttcaactattatgattataaaagtttaacctctataagaacataatataataataaattcatgcaacgcgtgagtattttttagttcatttaatcacactaataacatgtacaacatactaccatcaacaaaagattgtgtcgtactaaaaaataaaaattataacaccaaggaaagtaaaaaaaaaaaaaaaactaattgacttatattaatggatgaaaacccctaaaccattcacctacttatctcattcgttgttcgcctagttaacaaatttgatattgttcaatcaattacatctgagatatcttaaagagaaaatggtttattagcttgtttagtccattacatgcaaaagtatctaaaactcctgaaagtgaagacgacatcaacaacaactatgtcaaacccatataaagaagaattgtaacctcctagtgtttctcctgatcgataataccaacaacatataatgtcttacaaacaaccttactattagagttcgtacttctacgtacaaccatataatcatcaattttatgctcataaaagcattggttgtggcttttgggactttgaaaccttggacatgccacaacattttgatctcgcaagtctatttaacacagtaaatggagcagtaaagaagctgaaccactcttattcgattagaaaatttcatgctattaggatgccacaaagcattttgaaagcaaatatttgccaaatataactatatttttcaaataagctagatttctagtctttgaacaaaggatgcacaaaacgacatttgttgtgaaatagagggagtaataatttttttttttagctcctttagattcaatgaatcatatggttcgtagagaaattaaagttgaggttttgaagtgaaaatgataaaactttaaatagttaggtgatataaacaaaaaaactaaagcatggttcaactatagtttgatttttcaacctcaaagcttagacagtggtaggagaaaagtgtatcatttcacgaactctcacaaatatatctcctaaccgaatatttaaactgatttcagaattacatacatataaagtaaaagtagcaaatagataaaagagttttaaatagagatattcttttccgtacaacatgattccaaccttaaaataattatgtattctagaatctactagccacataatggacattcatataaaaataagattattaatattaataatttttatattttttttgctgcaacttttttggagggtggataaagtccattcaagtacaaatggtacccgtccattaaagcaaatttgttcattaaaaatcttttggattgggttacgtaaaatgcgactatattgccctagttcttttcatatttggttaagatttaaaactgtaaatctccattcatctttgtttgattttttcaactgttttaaatcatcctataatatataaagttatgaaaaactcaatctttttctccctatattgtgattcaaaattaaaaaaacggacatatattacccaattaatggaaatgatgtgtgttcaatgtcccacatcgactaaaatattcagataatgatttagaataatattatatatatgattaaaataaattcaaattcgaatgtataggaaagcttaccttaacaagcatccaaatttaaaattttgtatatgatttaattcagtctttagttttattgtttagttttaccgagaatattaaaattttctaatatcaataaaaggttttataacattataaacatttgaacaaataaaaataaaataaataacatgggacaaattgtattgtggtatacagttatatggtgagatgaatttttgaatcaacattaataaaatttagaatatcatcaatctgccgctttattatttttaatactaccaatattagaaatatctaaacaacctaattaagataagattgtatataccaaaaatttctctgtgatatacagttacttaataacaatcgtatattataaaatataaatttcttagaaaattttacaatttgcaaacttatgtatataataaatagtcatcaatttttaaactactatttttagaaaacaaatcatgagatgtgttatattacagaacaaagttatatgatggacgggtttgaatcaatatttataaattttttgaaatcattaatatgttgtttcaatacgggttaaattctcagtttattaacaattgttatgtggacttgtgatatatttttacttaataacgattataaactaaaatagaaatattttataactaaatataatttataaaattttatatatacaaattttaaaatataaattgtcttgcagtttacagctaattaaaatttagttgtgatattatatccaattatccatataactacacttttttctccacaattagggcgtgacaaatggcaacacttcaatcaaggaacagaacacaatgtgaaaccagactgttctcatttattttccagcaagtcaaaaagtcaaactcaaaaagtcctctctcggtcaactttcttcttggtccccatcttcacaaatcacaactctttttatttccaaagaccaaaaacctgagaacacaccggcgacctgaaaatg

SEQ ID NO: 26963 - DNA, 3003 bp, Unknown; identical to SEQ ID NO: 26962
  misc_feature (1)..( 3003): 2750-1469P.txt file - cDNA_ID_2717212; gDNA_ID_2214488; Annot_ID_183573

SEQ ID NO: 26964 - DNA, 3003 bp, Unknown
  misc_feature (1)..( 3003): 2750-1469P.txt file - cDNA_ID_2717227; gDNA_ID_2214488; Annot_ID_133399
cgttacgtgtacataatggcatgagattataaacaaattacaactattatattatttacgataatgtttttttaacttactatgatcaatactggtataagagattcaaatctttatagtatagcaaataaaattcatattaaattgaaccaaaaatgataattaaaatccaaaactatttcaccttaaatattttattttcttttatcaaactctaattattacaaaaacacacacaacacaatctctagatatcctttattcaaataatcaagaccagagttaaagaaacaagagatgattagaacaacaacatcaccaacaacaacaacacaacactaataacaacaataaccataagaactaagaaagaaaaaaagaacatcaaaagaattaaaacctcaagtaaagatgacgagaattggtatttacccaaatagcttcagaattatcagtcttcttcacttgcgtcttcttcactctcgtcttctgcatcctccatttcaacatcaccttcgtctccaagaatccactgttcaagctcatcttcttgtgcttctatgtgttggtgtatgtctgcagagtcccagtcgtcttccccatcatttccaagctcttctccacggcaagagacctgcaaatgtggtcgtctccttgccaaagcatctacgatatctctgtttacacttcctgtgatccctaaccatttaagcctcgggaaaaacggtttctttagccatttgaatgagagttgcgtgatgccaccacagtcgtaaagatccaacaagcacaggctacttccaggacattcgtcttcgtaaacccgggtggatgcaagagccatgactgaggcatcacctatgagtctacattctcttagttgcagttttgtgattggggctccagattttgctagagcaaaaatggcagcatccgttagattaggaagattagacaagtcgagttcccgcaacgccagttttgaggatccgtcaaataaggtagacatgaacttatcggttaaatttctgcaccctctgacagataaagaaactagggagtccaaaactccctcttttaggtacgaaagccctgtgtcgctaatatcagcgccatcaagaagtaaaaccttcagttttggcagatgagatacagctgtcaaggtttcatccctcaggtttctgcaccctctgaggtcaagattctccagcttgagacttgatgccagcttttgaattgcgtggtcagtaagaagatggcaccttcttaagctaacatgactaagcgaaagagtagttgctaagatgtcatggaagacaagatccgtcaatttaggtccatgatatatactaaacttggagaggctagcgcaagagtgaagaatagtcttgaaaccagcatctgttacccgacaaaagccaccaagacaaatggtttccattcccaagcatttgtcagcaagaaaaagcattccttgatcactaactcgccggaagtaagtagggtgaaactcctggctacggattagagacaggtgcttcagcttaccattctgattgatctcatgaagcccaaaatccgtgaggtctgatacttgtcttggatcctcaagaggcgcgtctcttatgtccaaatctatcaaagatggaagagatttcgatatcgccttaaccacagcatcagtaatacaatccactgagaggcgcaaccgctggacattttgtagcacagtagatgtagtaactcggttgctgtcttgccccgagatttcagttgatgtgagtagctgagtcatcatccttgacgtgatgtgtcctagctccagatgagtcaatctatcagataccaatccaaaaatgcgaccatcaccaggacgcagatacaatgagaggtcaaacatgagtgctaagacctgccaaatacaacacatatggcatgattccattacacagacaatcaacactagataataagatcaaaagagaatctattaaggattcaaacctctaaatgggagcaaccattaagtaaatcctccaaagcacaacggctaatacttcgaccaactttctctgctactgaacccaaacataggagcctgaagtttaccaatccgtcagacacagcaacagaaagattcctcatattatagcagatgcatcatcacacacatacctcaaatccttgcatttcctaccaatttcggagatgagatctccgctgaaatcccgacaattgtgaagagaaatctccctcaaagaaggacgtaccaatatatcaatagctgaattaccaagccttccacaatcaagcttgagactagaaagttgttgattcggaaacaacaatggtctaacagtttccattgacaatgaaacattctgaaatccaaaaagactaaaactttttatacagtttcagtttgaaatcgaaatccaaatcaaacccttaaagaaatgtggagacttacgaagatgtggaagttgggagtgaaggtgagaacacgagtgacacagctcttaagtgttttgcaagtagaagccaacgagcagagagacgcaacatcgagtttcgtcataatagtctccaagagagccgccggtaacagatccaggcttctctcgccatcgcaaccctcaacatctcctcctccgccgcatacgacggtggtggtagccatcaacggagtctctctttcctgatcaagtaaattgcggaaattgtggcgatctcgggttgtgtccgaatctcatctttaaaaagtccgaatttttagatccatttttcatggacattaaaatattgatatcagacaaaacggtaacggtttatttcggtttgttcagttagatttggttcggttatagttaaatttgattcggtttgataaaattatggctcggctcggtattagattcgggtcgggtcgggtcaaatctcaccgtcgataactgttatcgagttttcatttctgaagttcaaagctattcaatttcatcaatg

SEQ ID NO: 26965 - DNA, 3000 bp, Unknown; identical to SEQ ID NO: 11306
  misc_feature (1)..( 3000): 2750-1469P.txt file - cDNA_ID_2717251; gDNA_ID_2214489; Annot_ID_133415

SEQ ID NO: 26966 - DNA, 3000 bp, Unknown; identical to SEQ ID NO: 11306
  misc_feature (1)..( 3000): 2750-1469P.txt file - cDNA_ID_2717251; gDNA_ID_2214489; Annot_ID_183586

SEQ ID NO: 26967 - DNA, 3003 bp, Unknown
  misc_feature (1)..( 3003): 2750-1469P.txt file - cDNA_ID_2717255; gDNA_ID_2214489; Annot_ID_133429
acaagtgactctccttttccatgtcactaaatatttcaagagcttccatgtgatacttgttttgaacataaccagccatcatagaattatatgccacaacatctctatgaggcatttggtcaaacagagtcttagcgtgatgaacaaaacctaactttgcatacccatcaatcatggtagcccaagtaactacatctcttctcggcatcacatcgaataaacccttagcatcttcgattcttccgtgttttacatatccatctatcattgagttccacgaaatcaagtccttctcaggcatatcagcaaacagtttagacgctatgtcaactccatctgatgtctgagcataaccacttatcatagagttccaagatatcaaattcttcatctccataggcatcaaatcgaacaattcacgcgcggatacaatcaatccacatttgacatacccatcaatcatggaattataagaaacagagtctctcttcggcattctatcaaacatctggcgtgataaacctaaacaaccacatttcagatacaagccaatcaaacaattctgtagaaacaaatccgaccaaagtccagtttttttcaaaaacccatgaatctgcattcctccttttacaaaacctaacctcgaacacgctttaagaacaagtgacagtgagaatttgtccacggaaaccccattctcgagcatcaaacagagcaagagcagagcttgtctcggatcctttccatgagagtgagacttgatcacggcgttccataaaaatggatcctccacctctccaaatgaaaacgaacatacgtgatactcgtggaagacacaacgcgcgaaatcggcgagatacggacgtcgagaagaggcaaaagccagaacaatcctcgtagtgagatttgagtttttgatgattcccgtcttaatcaatcgcccgtggatttggttcacgtcatctgaagttttgcagcttccaaggacatgaatggtggatgaaatcgaacactccatggttgacttgaagacaagcatcagttattacgttcttctgttggagatgaaccggattgggtttattatcatcgttttaacggctatgtggaagtcgctgagcggatgagttaaacgccgtcgtttttgtatctgcctataaaagggctcttaaattaaggcccaataataaatattataagcccaatctcaatatctgtccaaagattttccaaacagcagtgaaactgaaacatttacccaaaacaaaatggaattaactattaagtcagactaacgttcgaatttaggcttatacagttatacttcaacacaaactagtagatcttaaattttaagttgattacattatgaccaacatgatctataggaaataatatatgtatagaaaagagaaaaactgatagtgataaataggatattgataagcaagtagttgataagcattgacttcctccataagtcatagtcaggatggagtggtacgacatatcgtacatttttctcatttatcaaattggttatagttatatattttatataattttaatgtatagttgccatttaaatatcgtgcgtctttaatataaaacgaaagcgctaatttgtcgtttactcaatcgttaatctaattaaatcatgtcaacgttagcttaagagtactttggtaggtatttggttcttctactatttcagcggccatggtacaggcatgtctcggcctaccaatgggtgttatttccttacacatttttgggctacactcatgcacaaatacatctctattgtatgcagttcgagtaaatttatctgtttagttattttttcgtgtaatctgatcaataaacaggttataagatgagaaatcaaatatatttgttaataaaaattttatacgaatattttacataaataatcggctaagttacttttactattttaaaagtctatgtgtgtgtctgattggcgaatataaacgagttattaaaaataaaggtaggaatgttgtacttttggttcatttaaaaaaaaaaaaatcattttcgctctatcttgaattttgattttaaactacgaaatgtatataaagatacatttttagtttttttaataaagatataaagatatattttcattgattaaactactaatatatacatccaacattcttatattatatatacttatatatgtaatttatagatattttgtcgcatatctgttagctttatatgttacgtgcagaataaacaaaactaggcggcgttaaattatgtttgtataggcttggtgtttcttatataacctttgattatagattcgttggttggcactatgaaagcgagtgtcaaagaaaaaagatagtatatgaatcgcgtcattaagttgaaataacaaaggctttaatcaaaagattgaaaatttagaaaagaaaaggaaaaaatcaaagattgaagctgaccatctcatgtaattattcaagttgtctcactaagtccacaatgtcagcaatcaaaaattatcctttgatctactacaggtatttttcacacgctagctacccttctgacgaaactgaaataagtaacaaaataaaaacattcaactgctatctattataacaaaaccaaatgattcaaatatgtaattcatgtctagataaattttactgtgtatatttatggatattggtttgcataggttgtgaaaagagcgtgggctaacgcaaatcgacgacataaattctcgaatttttattaggatggaattataaattagattttattgattgtaacaaagtgttttttataaaaaagaagatggtgaggctaaataaggagtaataaatggaagcaatgagaccaattgacacgttgttattagtgtaagcaaatgtcaacgcttcgtttgtccatttataaaacctaactacttcttcttcttcttcttcccaaatcatcaaactccatttcactttcactatg

SEQ ID NO: 26968 - DNA, 3003 bp, Unknown; identical to SEQ ID NO: 26967
  misc_feature (1)..( 3003): 2750-1469P.txt file - cDNA_ID_2717255; gDNA_ID_2214489; Annot_ID_183602

SEQ ID NO: 26969 - DNA, 3003 bp, Unknown
  misc_feature (1)..( 3003): 2750-1469P.txt file - cDNA_ID_2717263; gDNA_ID_2214489; Annot_ID_133427
tgtaattttttctctaagaaatgtgatacatttgatgtataatattttatactaaatcgtattgattgaggtggaacattatggtctatcattagaaaccaatgaatcgagtgacgaactatacggaaatggcatacagttgtcaactatatgaagagttgaaattatttacacaataatcaaatacttatcttattttcatatgatgcttgacacaagcatataagtttttcacaaaagaatttgattaacaattattgttcttcacaaatttttgtatatttgtaatcatgagcttatatactgtcttctgttttctatcatggacactacttcgttttgtcttcccgtgttaggtgagacagaagaatttatttttttatatatttgaattctctgaatttgaaatatgatcttttcagctggtggaattttttgaagtggcgagcttatcattttctgaatatgacaaaaaaaagtcttatttactgtagttataaatagtttaactaattaacacaaatgcgaatcgaaaatttgatatatgtgacgacgaaacaactaaactagtacagtataatcatataattaaagatttgatgcatttgaaaatgtacgcgtttgatagcatatcataattaatttgcacgcctatatgacatatagcgtttggaccaattttagatgtaataaatcaaagaacacatcgaacacacataagttcgattttcaacgtctaaatttacgagaagcaaaacaaaattatgtataataataaaaagactaatattaccactcacaattagacacgatatatagcaaaacaagatacatagttttgctcaaaaacaaaacatggatgataatcagtaaaatgcggtgcctaccaagtaccaacatacaattataatgattattgataaatttttgaagtttttgtaacaatatacgaaacatcgtactcatgcattcaaacaaaaatgggacaggctgggttagataacgtgtgagggatggatttctctagagacgaagccaaatataaggcgtgactttaaatgatatcacactactgtttcatcttataacaaatcaaaagagatgaactagtgatgtaattctataaaatttaccacttagatgtactgtgtatcggctaattaattggtcataaactattactttcaaatgagttctacgtactattactatagtttaaaagtaaagtaaaatcatattcaatcaacttaggaactcaaattaatattgtctaattaacacaatgtcatcatcatatagagatttgactgcactaattaagttatcatggacactttctttctgaaaattctcattttctcactcaaataataatttcattctataaatagataatgaaatacacacacatctatcatccaccaaaaatatcatccaccactacccacgaagtaagaaaattacagagaaaacggaatatcttttaagtagaccttagccttttgctttattctcttgctttatgtctttcttgtttctgtaaattcacatgttacacttagaggagagcgaggtgttggtccattttaccttttgctatgatcagatatagaagatagcaaaaacattaactcaagacaagttcacatgtttgtaaaattttacgtaaatttgtttattaattgtgttagaaaaatgttcacatgttgctactattgacttgcctccatcatcttctttgtcccatttgatgtactcttagccccatgcctcttggatgccttttttaccttttaatttgttcttatataatataaaatattagctacccttttttttgttattcatggaacaattatttgcatcaaatatagtaatttaatggaataatatcaagaagatcccatttatctttgtaccttattctccatgtgaacatataaagcttgttatcaggttatttgtacatgtaatatctaagggtgtttactgatgatgatcggataaactcgaggtttgatttagtcaaatatagttcttttctaactaaaatcccaacctcacaattttgatgtttttcagtaaatatggtcattaataagttatgaattcgctaattaatagaaatttataagaaaacatatatccaacatttatggatatatgaaaagttaaaaacaaatgatataaaaagtacaattttatagctggtgcactgaaaaagaaacaacttttcttaccattaaatccagggagaatggtatcattttcaattttgaaaaaaagctaagattcgcctaactattattgttttcctctgaaaagactttaaaagtaatctttaccgtataaagtacagaaaatgaaatgaactcgtggacttcaatgttttcaattttcatgagtcttttgttttccttcaatttccaaataaacttatatatatatactaatcaatcaaaaacaatccactcaaaatgtgaaactatacatgtagaatacttgatgtaacatgaacaaacaatcaaaatattgtagttaaaaaaatttactgttgattttgatcagtaatatgtgtaattaaaaagtgataaaaagtcaagtggtttaaaattatcataagagtaacatatggactatggttcaaatactttcattgcaataacaattatgtatagttagctactatatgaatgtcttaatacattgcaataacttacattggagattagtctatatacatttatatattaaaaaattagagttgtgatctatatagttctctatgttatcattttacattttcatagttgaactaactttttattattattatgttcacgatatctatacttttgtggtttaagcttttcttagtattaacaatcaagaactactattttataaatacaatggacaagattttttcttcaaaaccacaagagagagtcattttcattttcttcctcatctctctctctctcttctctccaaccaaacatg

SEQ ID NO: 26970 - DNA, 3003 bp, Unknown; identical to SEQ ID NO: 26969
  misc_feature (1)..( 3003): 2750-1469P.txt file - cDNA_ID_2717263; gDNA_ID_2214489; Annot_ID_183600

SEQ ID NO: 26971 - DNA, 3003 bp, Unknown
  misc_feature (1)..( 3003): 2750-1469P.txt file - cDNA_ID_2717267; gDNA_ID_2214489; Annot_ID_133426
acaaccacatctatggattatctctaaccggattaagatttttcaccgtgtatggaccttggggaagaccagacatggcgtatttcttcttcactaaagatattctaaaaggcaaatcgatttcgatattcgaatcggcgaatcacggaacggtggctagggatttcacttacatagacgatatagtgaagggatgtttagcggcgctagatacggcggagaagagtacagggagtggagggaagaagagaggtccggcgcaattgagagtgtttaacctcggaaacacgtcgccggtgccggtttcagatctggtgaggatattggagagacaattgaaagtgaaggcgaagaagaatttgattaagatgccacgaaacggtgacgttccgtttactcatgctaatattagtttagctcaacgtgagcttggttataaaccgactacggatttgcaaaccggtttgaagaagtttgtcagatggtatttgagttattactccggcgacaaaaaagccgccgctagatgatctttttttctggttgatgatgatcttttgatttcttgttttttaattgatttgagtaatttttgggaatttgttgtaacagatttgaacacataacccatttcggtaattttatttaattcatttattttacttctaaatgttgtctgttctagttgatttgatcaaataaaagagattaacgaaagaaaaaaacagagttgtcatcgtcaacaatcagaaatcgtatttagttcttccactacctagaacaagacacaacatatctggaatgtttgaagtagatttgtagaagttccatgcctcgagcattaaacgttttcttgatcctttgaagtgaacaatctgcaaaaaaacgagtaatgagactctgatgatgctttgagggtttatggttttagggatttagagtaccttgacatctaatggcatgccatgaaactgaccagcaccttcaggaggtgtccagttgtatagagcacatggtagaaataacactgaagctccagctatttcttctgtgaaagcttgtggctttgtgaatctctttgcgtcaaaggaagcatgagatttaacaaccgataccagagccaactgatcaccaagcatgcgcgaagctttcatgtatttggttttgtaagcttttaggacttcttcaagaaaaactttggccctgcattgggatcacatgtaagacaaagtcatcaatatgctgagacaagtatgtcttttaactataatagatttgcttcaagtttacgaaggataaatgcaaaccttaggatcccttcacgtgtgcctctcactgctataaatcctgaattcaacggctgatctttattgttcctgaatgtgagtgctagatggaagcttgaatgcttgtcaaatatagtcccgacgtcgtcaaccacagctatatcagaatcagtgaagatatagtggtttatcccaccctcattcttctcgagcttcatctcaagaaaggtctgcagagacaaattttaacaagaatcatgacccaatgagcattcatattctctcaacaattcagctacttcactaaacactttctaagaaatgaataaaagaaaattagatgggctcttaaagaaatgggtgccaaagagatagataggtaaaagcaacaaatatattctacctaggtatcagtgcgagtttgctcttacaatgtaagacctgattctttgaagcatcaggttaccccgtgaataatcaccctgaacaggctgtaatatcacattgctttgttggatggagagatcagaagctggatcagtcaatatgacaacattgctcttgggcatagtcacctaaaaacagatttttcagtagtaatcagtctatgagatagcaaacgcagcagctaagaaacaccaaaattgttaaatacagaggaaaactcagcaagttacctgaatgaagttggcgaatgcatttagaacagccattgacctctctggcttgctgtaggtaacattcccaacaacagaaaccggattggaggatttcacatttccgagcgacgtattataaacagtaaacaccgtcacaaaagaaacgccatttccagcaccagacacatgagaagttgaaccatgagtcttgttcagagccttcgtgcctaaacaaatatgaaattgtaaaacacctgtcaataccattctaatggtgcgtcaagttgcatgaaaacaatgctacaatgtttgtgaagcagaacaatggctaagtgtatgatgtatctcattcaaatggttattaaaacaaaagttcctgagattcacagagacgagacattgtgttcaaattgctggacaaaattgctcagatctgtgcctatacaaaagtgcttaattgtagcaaacctaaaaatagaagaatacgcaaaatctaacctcggcaatgaaatcgatcagacaagccttgtccagctacaggaccgagcacaaggtgatccaatttcttattaggaatggttcgcgcgtcgttcctcgtagccgaatccgaagaaaaatcaacaagtgaagagagatgaggaagaagaaagagcacaggaataagtaaaagaattcgacgccatccgctacaagatctcatgctccgataatctctccgggaacccattaatatcgtattttcaaccttcaacgcaatcgccgatcaaacgaatccgcggaggaggactgactactgaccgcctgaaaaaaactaaaccgggaagaacccaaactacgtgacgtttatttgaactgtcatcgaatatcatgccgtctcgtcattcacttatctgagtgggctttataatagaaaggcccagtacataatgtatatcgattcctaagttggcgaatacataatgttgctgcgtctctgtcgtcatcgacttcctcttcctctgactttgagcagctctgtcttcttctcgaaatcgtctcctgtttcttctgctttcatg

SEQ ID NO: 26972 - DNA, 3003 bp, Unknown; identical to SEQ ID NO: 26971
  misc_feature (1)..( 3003): 2750-1469P.txt file - cDNA_ID_2717267; gDNA_ID_2214489; Annot_ID_183599

SEQ ID NO: 26973 - DNA, 3000 bp, Unknown; identical to SEQ ID NO: 11337
  misc_feature (1)..( 3000): 2750-1469P.txt file - cDNA_ID_2717289; gDNA_ID_2214490; Annot_ID_133450

SEQ ID NO: 26974 - DNA, 3000 bp, Unknown; identical to SEQ ID NO: 11337
  misc_feature (1)..( 3000): 2750-1469P.txt file - cDNA_ID_2717289; gDNA_ID_2214490; Annot_ID_183639

SEQ ID NO: 26975 - DNA, 3000 bp, Unknown; identical to SEQ ID NO: 11375
  misc_feature (1)..( 3000): 2750-1469P.txt file - cDNA_ID_2717337; gDNA_ID_2214492; Annot_ID_133498

SEQ ID NO: 26976 - DNA, 3003 bp, Unknown
  misc_feature (1)..( 3003): 2750-1469P.txt file - cDNA_ID_2717367; gDNA_ID_2214494; Annot_ID_133543
aagaaaacaaacaagtaacctgcatccagaagaataacttgcggtcatcactgttgaacttcagaatatacaccctgtctgaggattgattaaccttttcaaatagagcttcatctgggaaaacaatttgatcctataaataggtatggtcaaggagaaaacttcgtaactggaacatctggtagcaacaattaataaatccttcagtttttgttctattcatgcatggcaaaaaataaaaaaacctcctaggtggatagagctaagaaatttgaccgtcttgggtcacgaatccactggtatagcaaagacttgatactaggagaatctctagtccttttctaaaattcaaaaaaacaagtgcagaggatacatcttctactgtattctggtttcgatcaagccactggaaatgaatcagtccctcgtcaccctaaaagaaaggataacaggattaaaaaacctaggttaacatttacagagaaccagtaataaacgtgttctgacaccaacaattagattccgatatgctttaacttcaataggaaaagctgatacactccaacgttcaatggaaacgaataaattcaaattactaaatggaaactaaaagcgtcgacattactctagctatgcggacaagtccttttcgtgcatcagggacaactcttgttccctgcaaagacatcttcccagcacgaaactcaagcatgatctcctgccaaaattagtccaaacataagtgtaagaaccttcgtaattagtctaagaacaataagagaaagataaacaccacctatagttacctgcatcacgggaaacgcttcgcttgaactcataatcaccacctctttctagtgaacactattcagtaaacagagaaatcagaataaattcagcttggtgctcttagatcaaggcttaaaacaagttcttctgcaaagtttattgacaacaatcatatgtatactaaagataacgaaatccgtgaaaattgcaaaaccaaatctcgaacagagcagattgaagcgaagataacaaaacgctagggttaccaatcttcgtagaaattgaaaaaaagagagagagagagagagatttacaaccttaaggctagtgtgttgacaaggttaaagaataccttagcagaggaaagttcgcgagtaatggattttggagagaaagaaaacgcttctcgtttttttttttctttcaattgcgtcgtctcttgtgttttttctttcttcttgtataaacaagggcccctataaggctacaaacaacaattcatccgaacaactccaagcccaatccgaatttttcttcattaggcttttaatttttgggtttgctgcaaacaaaacctgtaagtcaatttcgtttacaaatctaccattcatatccgaactatacaagttaatcatatgaactctaaagtcatccgcaaaataaacttcggtcatatcgatgacgtgacatcgctaaaaaggacatgaatttcattagtttcttgtgccataaaacataacaaaaaatgacatgaaaattaaagaaaatatccattgaaatatcgatttgggggaaacattaaggtttagagagtagttcatttggaagaattcgatatgggaaatgatggtatcgtgatccacttagattacagagtggttcgattgaggtcatattattaatctatattaagagagtcaaattgatttagagggtttttcgaaataactatcttttttatataaattttaaggtgcaaatgattgcctagaattaagaagttgaaagaattgaatgagcattcatctaatattttaccatttaaaatgaataagttggaaaaataatacaaccatttcaagttggaaaaatgaactaattattaaaaataaagttataacttgttcatctcatatttcgcagaggaatgagttgaatatcgcagaggaatgagttgaatagtattcaacttttttttttcaactcaaattttctattttttttcatcgttatccaaccatttgcagccttaatatattcagttcaagtgaatgatcagatcacttaacttagaaaactcacattatttattgcaaacttaatcacttgattattccataatctaattaggctaattctctaccaaacctctctcatatcacttaacgcagccaatatctaaatagtctgctaaattctcaatcatccatctttctatacaaaactaaaaagttaaattataaagtctacaagaaaagttggaaccctagtaaacaaacatacattttacaaacagaaaaaaagcacttgagaaaaagtaatacaatgaggtccatacacgtctgatttagctgtaatgttggtacgtccaaagaaactcaccgtccaaccacatcactacttaaccactacgaaatttccatcttattattcttctttatcatttcttattaaattcaatttaacttcttattttaataaccaaataaaaaagtttcaacaagaataaaaaaaaagtaaagtgttattcatatattcgacagtgacgaaaacaagaaactccaatcaaacccaaaagcccaaaacccagaagaacaaaaaatctctcttttgaaaattctccttttgcaaatcattcaagtgaagcacaatcatcttcttcttcttctccagcttcatcaatctcttctagactttttgcgtttacctgaaaaactgttttgatcgtaagtatctgattgcttcgatgtcgctgtcgaatcagattcccgtttactctcgatgaccctttgcttcttcttccactttttttccacagttttctgataactcttctcagatgagaagttctaagttacttcttctcaagttcttcttcttcttcttcttcaatctgacttcgcttggtacagtgtctttctattattaattctattgctaaaaaaaaaattctaggttaagtttaaatttcaattttcaactcttattacgatg

SEQ ID NO: 26977 - DNA, 3000 bp, Unknown; identical to SEQ ID NO: 11406
  misc_feature (1)..( 3000): 2750-1469P.txt file - cDNA_ID_2717371; gDNA_ID_2214494; Annot_ID_133542

SEQ ID NO: 26978 - DNA, 3000 bp, Unknown; identical to SEQ ID NO: 11404
  misc_feature (1)..( 3000): 2750-1469P.txt file - cDNA_ID_2717375; gDNA_ID_2214494; Annot_ID_133539

SEQ ID NO: 26979 - DNA, 3000 bp, Unknown; identical to SEQ ID NO: 11404
  misc_feature (1)..( 3000): 2750-1469P.txt file - cDNA_ID_2717375; gDNA_ID_2214494; Annot_ID_183774

SEQ ID NO: 26980 - DNA, 3000 bp, Unknown; identical to SEQ ID NO: 11396
  misc_feature (1)..( 3000): 2750-1469P.txt file - cDNA_ID_2717386; gDNA_ID_2214494; Annot_ID_133519

SEQ ID NO: 26981 - DNA, 3003 bp, Unknown
  misc_feature (1)..( 3003): 2750-1469P.txt file - cDNA_ID_2717398; gDNA_ID_2214495; Annot_ID_133549
attttgcgctaaattctaacatgctaaaacacattcattaatagacaaactaatatgttttcttcccctaaatagcaacattatttgtcttcttaccctaaatagtaaattgacaactttatataggtaaaaagcatatgttgaagatttgcttgcaggatttctttgcaataattaaccaaaaccaaatgaaataagaactaatatttctttggtgataatggaactcatagggtctacaacattttttgtttcttcacgggtgatacaacacaagctatataggcaaattggtaagtaggttcaaaatcctaaaataaaattttaaaaaacttttaagaggaaaaatggaggggaaagaagaagaaggagacatatagttttctgaaacgaaagaaagataataacccatcactgcagcaaaaggtatctctaaaataattgaagacaattgaaacctaatgtcaacgaactagccaatgagctcaaactccacaaatcaccacctcgacattctatcttgggaccatttctttctctctttactttacctctctctatataacttgaaattgagatatctaacaatttacaatggtgagagacaagaaaaataagatacatgtatcacatacatagagtaatgattaaatacgttttgtggagtttaaccttatttctgcggcaatggtggtagtttaatatttcatattgtgctcatcatgatgctatctaaacagtcttaatgcccaactatctacttattgcaatcttcacggcgatttacctgtgaaatttagaaaaaggaaaggaaaaataaatataaagaaacttttaagtggaaagtgacactacaatgagacctgcaaaaactcgacaagtttgaaataaacaactaaaaagaatccacacacagaacaataaacctttacaaagaaaaaaccaacaactttgtgccactaaatctatagagtgtcaataatgttgctgtacggaaagggattcacttggggtctacatgaaattcatggtgttctttgatgatgcattgattctctagaacaagaaataggagatacatcattcatattaaccgatatactctgaatttttaatacgaaaactagactaaaatgctctgttatcaatgtgtctaatatagaagaaagtatatcttacttacatgagaagaaaaatgtttctcctgtgtatttgtccactagagcgaccaaggtattgtgagctacgattacaataacaaaggtgaattagccaatgcccccaataattgggacaatgtaatcatgaaaatataaaaaaaacaataaagcaaacagaaaatagaatgtaacaatgaacaattaaaggttgcttctttagtcatgaaaaaggagtaataatgtttaggccactggttttcattgcacacaaaagtcacataagacagatacacgacgaagggtagttattcactgcaaatctattgacataattggttactgtaaactttttgctctcatagactcctttgagtcattatatcctaagactctacttgttggatggtagccacttaatgttactaaaaaagaaagtaaaagtagaagaaagaatgaaacatatcagtctacaatttcaacactctcctattccaataagcaatatcaataccttttcatttatatttattcgtaatgcctcctttgttcaaactgtcactccacattaccatcttcttcagcctttgcttccatttttcccgactatgtaggcgaggcccctacatctttcaatcacacaaaaaacagaacatgacgttattggaagaaacaacacatacccacaagttaacactatacatacatcatatcttctatgtttatttattgcaagtagcacaaagtggtatctatttttctgcacatctttttatgaattttccttttttatgataattctgagcaaagaacacatatcacctccaactaagatctaatttactggagaagaaaaatcatgataaggccttacttggtctatcaggaccaccaataagaacatcaaacttttatatgccctgttcaatatgtcatgctgaaagttgagatttctgtagtactgagataacgcaaagcggttccacatgcagctgtggtacttttttcctttcttaagcaatttacggcaagagaggatacacatgaacgtcaccagggagacctaaaatatgtatacacaacacgattattttctctcttaagatcatgaaaaaaggaatgctaggttacaacatgtgtttaggacagctctgtatccatcctgcaaagaagagtagccgatgctgatgtttggtcctaaggggtaacttacttccaagctttatagtcaaatttatatatactgcaagaactgacaggatcaagtgatgcaaaatggtcccaataagcatgatccaatagagtttaccagtgtagagggtggtgggcaagattgtcttctcttaaactgagctcaagtaccatgagacccaagtaggggccctagtgtacatgctctgacaataaacttagccaaaagacaaaataataacaagtaataactatgcagtaaaataaagtttttacctattatgcagtaaatcttggcagggagagaatgtatgtacccgcgatgtgaattactaacctaccataaaaaagatgagaaatagaagttagaaatacttttctagtaactttcacactatataatatgcaagaaattaattaaaaacgtcacaaagatatcttaatttgcagcaagagacaaaaagtaatggcaatccagctatatagtgaacacaagtatatgactgtaccgcctaaaacctttcctttaaattcccctttctacctctttttttttttccctcagagtagtactctaaacctcaagtttacctctacttctcttataccattccgcctcttattctttgcaatttctctcaacaaagtagaaatg

SEQ ID NO: 26982 - DNA, 2655 bp, Unknown
  misc_feature (1)..( 2655): 2750-1469P.txt file - cDNA_ID_2717402; gDNA_ID_2214495; Annot_ID_133547
aagcttctttgctatatcctcaaagtttagcaatccatgaaataaacaaacgtgttcacaacgtaattcagatataagccgtcactatttttccccgttcacatcagcctcacttgtagttttgtctcaatcgaaatcattgtttttatatttactacaaaaaagaatctaataattgagatcgaatatagaagaaaaatgaaatactcgttgttacatttgaaattcgtaacgtatagtgtctctgtctgtatggatgcgtgacatgtaacgttgttacaatatatcttggttatctatattttatttcttactagataaagcccgcctaaataagcgggtataagatgtaaatgtaatttttatcgataatatttaaattttgaatagtaaaataataatcgatacattgttcttgatatataattttgaatagtaaaatagtagtcttatgcattttattttgttatacccattcaatcttattgatgatatttgaagtctaaatagtaacctacacactttttctttattgtaatttagtatttagaagaaaaaataaaattttatcttatacattcaattttgtaatacaatttaactatctatttcataaaaaactcgattttaattttacacacttcatcttacttgataatgatttcatgtcaaaataatatatatatataagatcaaatctatatcttagttaatattaaaaattattaacaattaacaaaacataattcataataataaaacatttgttaataccatatatattaaaaatttgaccaataacatatatatatattttttttgttaattttccttttggttaagaaaaataaaatgtaatattttttagatatagaaatatgaattagtatatgttaataatgatttctttttttagttttctatttctttaagaaaaaaaaagttaattattttcttacacatggcaacatctgatcgatagacttgacacgtggcataatcttatgagttagtaactttgaaaaccatactttatataataagatttttttttgttaatttttcttttggttaagaaaaataaaatgtaatattttttagatatagaaatatgaattagtatatgttaataatgatttattttttagttttctatttctttaagaagaaaaaagttaattaatttattttttagtatttctatttctttaagaagaaaatggttaattattttcttacacatggcaacatctgatcgatagacttgacacgtggcataatcttatgagttaataactttgaaaaccatattttatataataagatgttgatttattcttactttttttgctatatctttccttatatttcatacttaatattttttttttgtttctaagatacatacattaactctcatatttattgtcttaactaaattttacttttatttgtacacgtggcttccccccacaatatttttgacccaaatccaaaaaaaaaaaaacactatcaataatatttcctcttaccatttatgtcttacacacaagtgtcaaaatatagtagaagacatagaaaatgtttagattatgattaaatatcacaaaacttttgtgacataaatcatgatccatatgcatccaagttctaataataggtcgattcgatcttgtaaaaaaaaaaagtaattaatagtaaaagattttgtattgaattttgagatatttttctctcactataaaaagatgaattgtgtagctagagatcataacaaactctgaggagattcaagctaaggtacatttacaaaaacttattttaaattacaatgggttgttgcattttcgaaactgatcctacagaccaataagtactattcagttaatttgaaaacacttacaaaaaaaactaagatataatttagcaactttaacattttttattatgtttgtagggacattaatgggaaactggtgtagttgtgtaacaaaagatgaaaatagtgataattctagtagctctcaaacttctacggataaagaaagtagtgtgcaagtttcttctgtgagcactacgtcttcttcagagatttcatctgaatgttcttcttcaaaatgatcatctcaaagctcccaatgatggaagcgtaactagtgagcaaatgtcgcatggatcatcttcttcatcttatcaataaaaaaatcttcaaaataaataattttctatgtcaatttttatattaaaagaaactttgttaaaaattatgactattaattaataactatattattacataatcttttaaatataagttttagttttaatttttaatagttgctttatgtcatgctgatgtgttgctacaacaaaattcttagcaaaatttatgcatttttttcttaaaaaaagagagttctataagtataatccaagatatattcttgtacttaatacgaataattaaagttatgattaatccataaagttctatttcgatgacacggtgtcgtatttgaagcgacgtggcaaatccttattggtctatatgacgcagaacgggaattgctctgaagaatcctttctcaggcgaacggagtttggagtcaaaatccagagcgcggggaaacgaaacgagccaacaaatccgccatg

SEQ ID NO: 26983 - DNA, 3000 bp, Unknown; identical to SEQ ID NO: 11445
  misc_feature (1)..( 3000): 2750-1469P.txt file - cDNA_ID_2717410; gDNA_ID_2214496; Annot_ID_133578

SEQ ID NO: 26984 - DNA, 3000 bp, Unknown; identical to SEQ ID NO: 11454
  misc_feature (1)..( 3000): 2750-1469P.txt file - cDNA_ID_2717413; gDNA_ID_2214496; Annot_ID_133577

SEQ ID NO: 26985 - DNA, 3003 bp, Unknown
  misc_feature (1)..( 3003): 2750-1469P.txt file - cDNA_ID_2717417; gDNA_ID_2214496; Annot_ID_133574
aaaagcacaatacaattacaatcccttaaacattatacataaggcctgatacaagtagcaacaattgttcgaagaagcaccaaccaaaatagcttctgaaacggtatccaaatgcttggtcaagttcgacactgcattttccatgttccgcttcgttacacacatgatatcagagaatgaaattccctaccacagaaacaaacatcagcttcagagaaaatttatcctacaaaagactttagtgatataactgttattggaactctataagataccttgaaccacatatagccatagcctaatgctcccaatgtcgctgccgggacaataaacggtgtaaaatcagctggaaaatgtagaagtgagaaagttagagattaacaatcgttcatcaaaactaccaaatcaaaaactagccgagagacaaacctccctgagctccattcataacagttatctgccgcgacgaagccaattgccgaacctccattgctaatcgttgcatctacaaaatacccgcacatttatatatgattgttccaaaaatttgatcttttttaacaaacagatgcacaaaatatacctgagtagtcatggcatcagaatcatcatctacatgatctccagatttctcaaatcgcttaaccaaagccttcgaatttgaagtcaaaagaacaaactttttactatgtcccttctaatccaaaattgagaagaacaaagaaacttttactaatcgtacctgaagctcacccaaaatatctgccatcttcccattcttaaccagaatcgtactagtataaccttcagattcaaagacaacaaattagccaaaagggtcttttaaatcttcaaaattggggaaaatcacaagctcgagaaaccctagatacctgctccagctagaatcaaaatcttcgataacccaataccagattgcatagccatggtcgcagactcacaggtgcaacaaaaggaagttgtcttcttcgtcgagttcgctcgccggcgtaagaaactgtcaggtcaatgtcggtttctgttgaacggtgtcgtttcctactttataactcagttataaactctttgaccttgcactaaacgtaatgaataaatctgtaccgtgcattaaagtatcttagtcaactttctagaaatattgggtcaattttgtaaggtttttaatattgtcgggtaaaaacgaattaacgaaaactcatctcccataaaaacaatttatttgaatctgggagtatttttttttttgaatcaatcaaattttctataaaaattaaaatatatataatgctaggaaccaacatcaaaagtttaaaggatcaatgctaatatataagatacattgactaatctactcattgtcaacactaatatataagatacattaaaatgttgttgatttttaactttttaatgattttatcagattttaggtataaacaaatgaatcatatttactattttaattagaatttagatgttgatataagactacactagatttagattcaatttggttgattagtttttctttcaaatatagtagttgatttggtcacgattaaatgaaattatggagttgttcaaaaaaaaaatatgcagaataattttcatttgttgatgcatatcatcgtagattatataaatacatctattgtttgaatgtttaattgatagatcaaatagtgaaatatgtatagaaaatgattacaaagcaataacattatagccaaaagcaataaatttatatgctactcgatgacatgttagagagaagaggcaaattaatgacacttcgactcttgaagaacgaattattcagtaattatctgttgtttacagaagtttttttcacgtcgaatacatttttttggaagttacagttttataaaagaactttaatcttagagagactttgtttttgtttttaaaaaaaatacataattaagattttaatatagtttctgaatgttatctaatactttaacgacacaagaaatttgttaagtcatacatttgtatataatcagatttaactattttcgagattagcaaacttttgacttagatgttgaaaaacaacaatccatccattagagtatctcacgaaactgaatagttatcgtgtaagcctaaatctagttagaggatgtaaaattgttactttttctgcagttgaggtacaaaagttcaatcagtttagttttgatgtgtctgtagatttcaatatacactttttttttaattctttttaatttcagatccttgggaatgagtcatctataacggtttaattgcatggttcccctcattaaaattgcttgggagaggacttacttgctgagtggatgcatcaaactctaacgtcaatagttttttttttttttttttcgcaaacaccattttaagtcaatagttgtaactaaatacaacaaatacatttttgttgaattagattatatgttttgcaagattttttgaaactctggagtagctaaaaaaaaaatagtatgcaatatatttttttctattgatgcgtatcatcgtacattatatatttatatattgtttgattgtttaattgatttatcaaatagtgaaaatatgtacagaaaatgacttaaaacattataagttagaatcaagagcaataaactcatatgctactggataatatgttcaagagaagagacaaattaatgatgcacaaactcttgaatatgaaattactaacgtcgattcttttctcgttaatgtttattttcatgtttcgaaaatgtttattttcatctcttgttaatgtcttgcaaaagttggagggctttcttataaacgttggttatattggggcacatttgtaagatgttaaatatgattgggtaaaaaacgaattaacagaaagtattctctcctaaacccttttcgtcatcgtaatcccgcggtgaagaagacgaagaagcattgagagtgaaaagaaaaacaatg

SEQ ID NO: 26986 - DNA, 3000 bp, Unknown
  misc_feature (1)..( 3000): 2750-1469P.txt file - cDNA_ID_2717420; gDNA_ID_2214496; Annot_ID_133573
attaagcaaaagactgtttctttcaccaaagcaaatcatgatcattatcacaatccatatactaccaagttaaagatccaaacctacatcttttctacatcaaaacataatcttaccacaatcataatatctttcaccaaaccaattgattttcatcatcacaatctataaataccaagttcatgataaaaagtagacctgcaacatttcaaatcaaacatatctaactaaccacaaacactatagaaagtcaaaaggctgctgctttcaccagatcaagtcatgaattcttctatcacaatctatgaagtagtaagtgaaagataaaaaccaaacctgcttcctactccaatcatattgacgaacaccagctgcaggagcaaattggagcaacaaaaaaccttcctttgtcagcttgaacgcaccagactggatcagaacatgaagaatggagatcaatctaagatcaaacaaacaatacaatagagtttttgatcttcgacaaagacacatacttccaaagccacaaactctggtgctcgtggttctatcgtaagagcagctttccctttgtaaatcgaatgacccacgtaaaatctaggagaagatacttcagctataaaaccaaaacaaacaaacaaacaaaatttcaaactttctgaatttcaaagcttcccatttttcaaagctcaaacaatgagtgaaaaccctaccgttttgcgaagaagacgagtcaccaaacctctgtttctcaaagtaatcactttgtcgagacttcaccgttaatttcaacctcgccgtcggttttaaaggaataatttttccggcgaatccaccggaggtgagaattgagtgagaagagagaaaacgagcatctgaaaacttatggtttatgaaggttttggagaaaaccgccattggaggagaagataacagctgcgacattgtttttcttttcactctcaatgcttcttcgtcttcttcaccgcgggattacgatgacgaaaagggtttaggagagaatactttctgttaattcgttttttacccaatcatatttaacatcttacaaatgtgccccaatataaccaacgtttataagaaagccctccaacttttgcaagacattaacaagagatgaaaataaacattttcgaaacatgaaaataaacattaacgagaaaagaatcgacgttagtaatttcatattcaagagtttgtgcatcattaatttgtctcttctcttgaacatattatccagtagcatatgagtttattgctcttgattctaacttataatgttttaagtcattttctgtacatattttcactatttgataaatcaattaaacaatcaaacaatatataaatatataatgtacgatgatacgcatcaatagaaaaaaatatattgcatactattttttttttagctactccagagtttcaaaaaatcttgcaaaacatataatctaattcaacaaaaatgtatttgttgtatttagttacaactattgacttaaaatggtgtttgcgaaaaaaaaaaaaaaaaaactattgacgttagagtttgatgcatccactcagcaagtaagtcctctcccaagcaattttaatgaggggaaccatgcaattaaaccgttatagatgactcattcccaaggatctgaaattaaaaagaattaaaaaaaaagtgtatattgaaatctacagacacatcaaaactaaactgattgaacttttgtacctcaactgcagaaaaagtaacaattttacatcctctaactagatttaggcttacacgataactattcagtttcgtgagatactctaatggatggattgttgtttttcaacatctaagtcaaaagtttgctaatctcgaaaatagttaaatctgattatatacaaatgtatgacttaacaaatttcttgtgtcgttaaagtattagataacattcagaaactatattaaaatcttaattatgtattttttttaaaaacaaaaacaaagtctctctaagattaaagttcttttataaaactgtaacttccaaaaaaatgtattcgacgtgaaaaaaacttctgtaaacaacagataattactgaataattcgttcttcaagagtcgaagtgtcattaatttgcctcttctctctaacatgtcatcgagtagcatataaatttattgcttttggctataatgttattgctttgtaatcattttctatacatatttcactatttgatctatcaattaaacattcaaacaatagatgtatttatataatctacgatgatatgcatcaacaaatgaaaattattctgcatattttttttttgaacaactccataatttcatttaatcgtgaccaaatcaactactatatttgaaagaaaaactaatcaaccaaattgaatctaaatctagtgtagtcttatatcaacatctaaattctaattaaaatagtaaatatgattcatttgtttatacctaaaatctgataaaatcattaaaaagttaaaaatcaacaacattttaatgtatcttatatattagtgttgacaatgagtagattagtcaatgtatcttatatattagcattgatcctttaaacttttgatgttggttcctagcattatatatattttaatttttatagaaaatttgattgattcaaaaaaaaaaatactcccagattcaaataaattgtttttatgggagatgagttttcgttaattcgtttttacccgacaatattaaaaaccttacaaaattgacccaatatttctagaaagttgactaagatactttaatgcacggtacagatttattcattacgtttagtgcaaggtcaaagagtttataactgagttataaagtaggaaacgacaccgttcaacagaaaccgacattgacctgacagtttcttacgccggcgagcgaactcgacgaagaagacaacttccttttgttgcacctgtgagtctgcgaccatg

SEQ ID NO: 26987 - DNA, 3000 bp, Unknown; identical to SEQ ID NO: 11451
  misc_feature (1)..( 3000): 2750-1469P.txt file - cDNA_ID_2717424; gDNA_ID_2214496; Annot_ID_133571

SEQ ID NO: 26988 - DNA, 1020 bp, Unknown; identical to SEQ ID NO: 11457
  misc_feature (1)..( 1020): 2750-1469P.txt file - cDNA_ID_2717438; gDNA_ID_2214497; Annot_ID_133584

SEQ ID NO: 26989 - DNA, 3003 bp, Unknown
  misc_feature (1)..( 3003): 2750-1469P.txt file - cDNA_ID_2717445; gDNA_ID_2214499; Annot_ID_133630
tcaaattcgttctaaaaaaaactgacataataccatccctttaaaaacacagaattttttttatcatctctgaaacaaatcatttacagtagtaaatgtcaacacaacattaattctgtttgttgttggcatttacaattgcaaaatcattttctcatttattattcgtatttattttgtcaagaacccttgtctctaaaatattcatagaaaaagaaaagagccattaattaatggcttgaagaaagattggtgtataagcgtctacgtgacctttaattaatttacttcccccaaaaaagtcaacattcaacatgtgaataaaaatcaatattggtttctaagtaagtaagtaccatattattaaattatttattttggtaaatacgcactcaatttttctctcaacggtgtatataaacaaaaggagtctcctttggaaaaaacttgcctatcattttgccaacgaacgttctttcttcttaatcacagctcagcctgacgcaaccgctcaggctgatctcttccaatttacagccatttcccagctcagatctctgatccggtgagatctctctcaaggtaatgcccctgcaattttgcttacttctctggttgtgatatgcatgttcttcgaattttcatcgtttgtgatttgaattctcattttgtatttgctgttgttggtttttaattcgattttccggaacagattatgggatttgtattcgaatcttcgatttgatgacataatgtcccagccttttatgtttaatcttgaaatgatggacttttatccgatctgggtttaaagctggaattttgattgtgggtactattaggtttcattgatttattgcttggtccaacatttttagcagctggtattgagctcttgttgtctgaattttggaaagaactatttttgttgtatcgttttgatttatttggatctgaattcattcacctttttctctgattattgttttgtgtcggttgcatccactttgattagatctgaatgaatcatttttttatgtgctcaagttattgtatggattgttctgtttctagcatgttttggttagacattgttaagatctgacgtttgcattttcaggaaaaggagttagagcatcatcaagatgaaggcactcattcttgttggaggcttcggcactcgcttgagaccattgactctcagtttcccaaagccccttgttgattttgctaataaacccatgatccttcatcaggtaatctatcttaaatttgccgctttagtctgccagttcttacctatgcctatgtttgaaccgaggcatgttttcttgtagatagaggctcttaaggcagttggagttgatgaagtggttttggccatcaattatcagccagaggtaagatactaatctctcttaacttttttttttgcagctattttctgtttacatatgtttgtatttaccatttgctctgtttcgacaggtgatgctgaacttcttgaaggactttgagaccaagctggaaatcaaaatcacttgctcacaagagaccgagccactaggtaccgctggtcctctggctctagcgagagacaaattgcttgatggatctggagagcccttctttgttcttaacagtgatgtgattagtgagtaccctcttaaagaaatgcttgagtttcacaaatctcacggtggggaagcctccataatggtaacaaaggtgagattatcgaaacataatactctccagttacgagataagtacgttattcatctaatgtggacttgcatgtattggttatataggtggatgaaccgtcgaaatatggagtggttgttatggaagaaagcactggaagagtggagaagtttgtggaaaagccaaaactgtatgtaggtaacaagatcaacgctgggatttatcttctgaacccatctgttcttgataagattgagctaagaccgacttcaatcgaaaaagagactttccctaagattgcagcagcgcaagggctctatgctatggtgctaccagggttttggatggacattgggcaaccccgtgactacataacgggtttgagactctacttagactcccttaggaagaaatctcctgccaaattaaccagtgggccacacatagttgggaatgttcttgttgacgaaaccgctacaattggggaaggatgtttgattggaccagacgttgccattggtccaggctgcattgttgagtcaggagtcagactctcccgatgcacggtcatgcgtggagtccgcatcaagaagcatgcgtgtatctcgagcagtatcatcgggtggcactcaacggttggtcaatgggccaggatcgagaacatgacgatcctcggtgaggatgttcatgtgagcgatgagatctatagcaatggaggagttgttttgccacacaaggagatcaaatcaaacatcttgaagccagagatagtgatgtgaaaatgagatattatatgtgcaacttttttttttttttttgtgtcctttcttcaactttgaaatcgctttcgtaattcttaatggcttttgaataagcatcaatcaaaacgctgtatatcttgttagggtcgtttgctgttttgtctctttttttgttttgtaatttataaaaaaatttattctcattttatgtgagatacttttgaatattcattaattataaagctttttttttgtgaagtaacattcaaaattcaatagtagtcattgtaaaaaaacttgaaaatagcatgtataatgcagataaaattttttaacatgaccattgataatccaaaaaggttttaaaaattagaagcaacaaatatccattggggtttctccaaatccaaggcatagaggaatattcgttagcgtggaaagactaaaatacccttaacttccctccacataatgtatacagtgacccgatctgaattcggagctaaaaacggtttcaatcgaattaaagtcaatg

SEQ ID NO: 26990 - DNA, 3003 bp, Unknown; identical to SEQ ID NO: 26989
  misc_feature (1)..( 3003): 2750-1469P.txt file - cDNA_ID_2717445; gDNA_ID_2214499; Annot_ID_183924

SEQ ID NO: 26991 - DNA, 3003 bp, Unknown
  misc_feature (1)..( 3003): 2750-1469P.txt file - cDNA_ID_2717448; gDNA_ID_2214499; Annot_ID_133628
ttcttctgttgttatgcttccacatgcaggtagcaagatatggccttgtatcacaaacaaagaaaaacagaaagattagcagctgtaccaaacattatcgggatcatctgattcatcacaaagaggaggtttagtcccagcctcacgactcaaatagcagtcgttgttgaaaggcttctgccagattgcaacgtatccttccttctttaccaatttccagcagaggctaatagtaagattcagcatttctggaaaacaaaatgtgagattaaaagagtacacatattggctgaatcaaagtagtaataaagaaaaaaaaaaactctccttaaacccacagagacaaactgtagtaaataataaagccacgtacaatgattactaactccaaaaagtttattaagaccaaagaattttatcaaccctgaattacaggcctactcaaagcagattaaaaggatgttacctgtccattgttcttccaaagcgggttcatgcttataaacaggctgtgcagcccaagcaaaatatcctccagcgcgcagcattctattgatctcaaggagcaaaattccatctttatcacaaagaatgaaacagcagagtgagaattttctgtacaagtaataaaagctagagcatagttcacacagggagttaaaaattacagtaggtgcaatcttaatctttttctgatgtattaggtgaagaatcaagcacaccatagaaccttaccatcacgagtccagttgattctacatcttgaacaatgaataagatcaaaagcttggcttggatataacaaacgccttgtcgcaaatgctgccgccatagcaggcacaccacgctcaagagcaaattgaatttggttctcatggacatcttttggtgcaacagacattgtcatgacatcacgagacaatagataagcaccaaaactcgccacaccacaaccaacatccatagcaaccctaatatgcttgccaaacgtaatatcagaaaccatctgcagacacaaactccagagctcaacatcagatgaaaagatacataaacagttgacgcgaaaaacaagaactactacttggaaaaatgagccaccttagacatctggtccaagtactgatcagccccatgaataaactgtgtaccacctccaggaaacttgaacttgttcttgtctcgtgaaatccagttctgacctcctttgtcttcaacaagccgagtatgaggaacattgctaaaccatacctatccataagtaaattccaaatactacttaaactaaatcccaagacatgttatccaaccaaaatgcaaaactcatgcaaacaaaggagtacctcgtcacggcttttaggccatggaatcggctgacggtaacctttaggaggtggaactaagcaattcaagcctttacctttctcaggacaatgacgctcgaatctctcacctcgctctgtcgatttaagcttctttatcacatcagtattatccaaacaaggtatatactctctcatactctcaggacacatcccaaatttcttaattctaaccctagccttagaatcaccgtcgcttttcgcctcaacgatctcagtctgattcccccaatcttccactgtatcactctcaacctcacccacctcaaaatcgtcagacatcacaccgttcgcatcaactatcccaaagctcttaaccggaccaggcggaggaggaggtgaaggagaaggaggtggaggaggaggaggattagcttccaccttaaccttctccgtgtccgccaccaccgacggaggttgttgtcgtattgtggcggggatttcaatctgggtatggttagtaggaattatcgctgataaattaaagactctgttactattcggtgaaacggagacctccgggatcgagctaccggaagtggaagaggagaagaagacgagctgttggtagccatcgtcggaccaatgcttgcctaagtagaagaaagcgacggtgacgaaaactaaggcggagatcttgatcagagttggggatttgaacagatcgccattagtgagaggcttcattagcttgcgtgtgaaggatcagcgatctctggatctgcgtagtgttgttgtgtgagagaggatgattagtgtaattttacagttgttgcttttggatttttctggcgttcggtaaaattatcactacagaagaatttgcagaatttagttaaaagatcagaaagttgcagagagttttatataaaaagggtcttttcaatagcatgtcttgttaaaatctaattcagcaaaaaaaaaaaaaaaaaaaaaaatagtacatgatagtttgttaaacgttatcggcaaatgatgaaaagattttactaaaaactggttttttttaatcatgtgattgaatataatcatatttataaaatatttatgttaaatgttcttatgataaagtgcgatgagattctaatagtaataaatatttgttttactattaaaattatatcacacagtgcggttcagtcttcatgcaaatgaatataatggttgaagcgaacaaatccgtatacggattaaaacgtttttcatttacctaaaaaatcattgtaaactaacaatggattgtttttacatacaaatataattgatttgtagcggtttgttgtccatcttgtagatgaaacggactaatcgcaaacggatttgtccacctcgactgcgataaccattcaaacaagattgaaaagaaagagagacaaaggtttaaatgaaattaagaatgtacaataatgttggcttatggtcgttggacactactttcgagcccattacatttaatatcctttaaaataaaaaataaagaaggcgaaaacagtttcccccaaattctcataattttcacaaacaacctctcgtcttctaggttaatccaatttcgtcgattcatgaagttcacaattctcccatcggaaaattcttcgtaatcgacgacgaagagatcatg

SEQ ID NO: 26992 - DNA, 3003 bp, Unknown; identical to SEQ ID NO: 26991
  misc_feature (1)..( 3003): 2750-1469P.txt file - cDNA_ID_2717448; gDNA_ID_2214499; Annot_ID_183922

SEQ ID NO: 26993 - DNA, 3000 bp, Unknown; identical to SEQ ID NO: 11499
  misc_feature (1)..( 3000): 2750-1469P.txt file - cDNA_ID_2717452; gDNA_ID_2214499; Annot_ID_133624

SEQ ID NO: 26994 - DNA, 3000 bp, Unknown
  misc_feature (1)..( 3000): 2750-1469P.txt file - cDNA_ID_2717462; gDNA_ID_2214500; Annot_ID_133653
ctttaaataatataatacaatttttcttttgtcaaaataaattagagtgaaagtgtaagaaaaacataggtgagtggtaaatatttcctattgagttatagagctctttatgtattttctgtttaatctgctttttcattcatactataatgaggaatcaaattgatgtgacgataacattgcgttgaggtttcatcatcaccgcgagaagtttcggtttgtatactttttgtaataatactgtgtggttattaattctcggcgaccagtcatatccttagcttcatgcccaagtttctatttactactttgtctttgtttatttttccctttttcaacaaaattcgatatttttctaattttgagcaccttttttaaatacaaaactaggtgacttctctagaatctctcgtttcctaaattccttcacgtgttattccttgtatggttatcaaaataacaaaagtgttggaatgatttcttcattcacgaaatgacaaattatagtgtgacacgtgcgtggaactagccagctaggaacaacattctagagatgtgaaacttgttaggccaattttgaatttttttaaaagcatgaacatgacaaaaaaaagcatgtgccaaactaattcattttcaacttaaggtttattatgggttggcagcccaaacccattctacacagtttgggcccaatttgtcttcgagtgatgtacaatttggcaattggactcacataagaacaaattttgtgtaacccctacaatagatgaaaactgcaactctcttctaaagtaaaggactaaagtcaacctagtcccttaaatgaggtttggaaaattctttgtctgcctcgttcacttttattttgcctcgttttatgtatctgttgaaggaacaccacttggttgattatggtacgaaaaacatgttatttggactttcaccaaatttatgtcgatataaaaagatcagtacaaatttgttattgattttatttttagaggctacatttcctatggtttgtgaccagactatagctagctacaatttttttattgtatttttattgcgaaaaacttagttgcatatattattcactaaaacagagattttttgtatagtaaacagtgaaggtaaaattgttagcaaacaaaaattttgtagagtcaagaaaagaatttttatatatatatatatatatattttttagaaacaacatatttttaataataaaaataggaagcttcaaatacagcattgaaaagagtttaacgaagaatttttgttttcgattgtatttaaatttatataatatatacaaacaaaaaaaaaaaaaaaaaaaaaattgtcacgtgtgcgtttggtagctgtaaatgaatgcatcttacacagtagcccacatgtcgattttggtttttcttcattttttcttcaccacatagctgttgtcttcaaaacaatcaacgagttttttagatttgttgattttgttgttttggattattgttgattttgccattttagatttttcactttatctataaaaaaaaaaaaaactattttctgccacttaaaagctaaaattttgagaaactttttaaataaaaatatgtatttgagaattttgtttcattatgtttccattttttttttataaaatacataataacaaatattataccctaaaaaaatagaaccaagtaaacctaaatgtgtaaattgtaactttagatataattttttcggcaaatctatgaatgccactaaaaatccttatctggtaattgattcatttatttatttatttatcacactatatcacatcatttacgttcacaatattcaacatattaggcggacaatttcttttgtcaacatcacggatctagtatttccttttgacatatctcgatctagaagatgaaagaaatagatatataggatgaaatgaatttaataccatctaaaagaacgttcctattatatatgctaatgtatagcatcaaaataccatttgtacaaagaaaaacaatagataatcgaatttaacagagttagattgataaatggtatttctttagttgtcacgttttgaaagcgtgattctattctcatgtttaaacatttgtcttaaacgttttgttatatatcatagacatgttagagatataactgaaaaaaaatcatttaaattagtttttgagtattttataattattcttttgggaatttcagtcatccaaaatcattcaacaatgttgcgccaaacagaagatggttcaaccactataatcaaaccatttttcaaatgatttcgttttttttgtttattttttggcttttgtggattacaaaccaaaacaataatttaaattatgatgatctctactttagtctatataaatacaatgaccatgaaaaaaatacactatgggtttggctgttttcgttccaaatgttggcatgacctccaccgataatctgttgttgattaggtatttttaagtctgtcaatcgtgaatcgacatctgattgtcatcaaactcttattctataagatgcaaaagtagtaaagcataatcatttattttacataaacacattgtttattacttttgtacatgttgcaaaccgtcgcacggcgccgaaattcgttccctatctccttcacttcaaaagtcactgaagacatcaaaaagcaatattgtcgacatttatccacaactcttttaaaaacgtgtcttattaaatttatcatccaactagcttagcatgcaaggttttattatgtcgagtgtcgacctcaatattcaatagaaaaaaaaggctggaataaaagaatatcatcgtttcattttggttttacaattttccctatttatatccccactcgtccttgtttcttccaccatctacaactttcattcttccactacatttctctccttgagtatcttcttatcctattttccaaattccaaaacaattcacaaaatg

SEQ ID NO: 26995 - DNA, 3000 bp, Unknown; identical to SEQ ID NO: 26994
  misc_feature (1)..( 3000): 2750-1469P.txt file - cDNA_ID_2717462; gDNA_ID_2214500; Annot_ID_183964

SEQ ID NO: 26996 - DNA, 3000 bp, Unknown; identical to SEQ ID NO: 11519
  misc_feature (1)..( 3000): 2750-1469P.txt file - cDNA_ID_2717466; gDNA_ID_2214500; Annot_ID_133646

SEQ ID NO: 26997 - DNA, 3000 bp, Unknown; identical to SEQ ID NO: 11519
  misc_feature (1)..( 3000): 2750-1469P.txt file - cDNA_ID_2717466; gDNA_ID_2214500; Annot_ID_183956

SEQ ID NO: 26998 - DNA, 3003 bp, Unknown
  misc_feature (1)..( 3003): 2750-1469P.txt file - cDNA_ID_2717474; gDNA_ID_2214501; Annot_ID_133666
tgtctttagtctaaagaatgtgcatatgatatgggagccagtcttacggcccaaaacttacaagcaaagcatgtgcgcagttttggagtctgtatttcgcagaatagctagagatattcttcttctagacgacatggctgctgacgaaactttcgaggtagctgtttctccttgctagtcgcttctgcaatgttatattttaactgcgtaatgaaaatgtttgcttatatattctcagctacaaaaactgatttatctcatgttgaagaatctatcttctgtactcgattccgtgagatctgcagatgagacttctcgtcctcttgatgatatcataccatctttgcgcaaaacccgtaaactagcaggcatgtcttttctttcttttttcttttaaatatccctcagtttattgctaacttgacattggcgcagcgaagttttcttaccatggcttttcttattgtttatcattttccagaactattggatatgcctctcatgtctataacttcagcttgggaaagcggggagttatttagatgcaatttcacaagaacagaggtacaatctttttaaatcgtttgacctcgtgtcctactacctgatatatggattaaggctatttcttatggtgattattggatctttgattattggttatggtgattctgaaagcttttggaatgtacttggttacaggtacaagatttcatcaaagctatatttacagattcgccgctgagaaaagaatgcttatggaggatagacgaggttaaccagtagattggaaatgataaaacttaaaaaaaaaactcaagacttgtgagaagaagcaagtgaaagcctattttggcaaaagagccatgaggtattttaatgtcagcagcttgtaacatcgacgacgcactcttgtgtaagaatatatatgtaaagagagttttagctgatgagtttaaaactttaggtttaaaagcgtgttccagattttgttgtacatttgggctttagattcaacaagtaaaacgctctgggtaacaacaattttccggtacaaattctccaaatattgcattttccagttagctaaaaacttgaaaacccttaactaagaaactaatataaaaaaaataaaaataaaaaagaagaaactgataggatattgaaaaccgtaacacatgaaaacactaaatatttctatgaaattattgatacaatgattttcaatgaaattaaacttttgatatacttattcaaatataatgtatgatgtgtttagatgctaatattatattaaaaactatttcataaactaatattaagttatgaacactaggaaaatattttggtctcataaaccaacaaaattacattaagaaatagagttaagagacattggtatttttccttttttttttttgtcgacattggtatttttccttatgttggccacatgtttaaaatgttaacaaaatcacataacggtcataattaagggcccgaaaaggaaaaatttcattagaagatcttattagatttagtgatctatcaagaacttgagatgacgtcatatatttctatttaataacaccacacatctatctatctctaccttctctcttactttcaagtttccattctcacgctcattgtctttcctctagctctctttctttctttcttcttccccatctttaggtttcttgcgtacaacgttacaaattctttttacaatttcccatgtcttccagagaatcgaagagaatggatgaatctgatgatcctagggtttcagagtcgagtgaattctcaaacttcgagatgttgatacaagtcgctgtcatggtttacgatcatgagtacggtactcatgacgaacacaagtcaaagaccattgacgaagatacagagacagaagcaagaatctttggagatacaatacctagaaagaacagaactcaccgatcatcttcttcttctaacaagacgataacaccatggacgcgtgtgatcgaacaacagagatcatctgaactacaaaaccctaacccggaatctgaaccttcttcttcctcttgcgttacccacttcaagaaacgtcgccacatggacaaagaagagagtactcgcaagagactcaaaatcgatagtcctttagaggtggaaccaattcaaacatcaccaccggaatggcttttgaaagtaatgaagagagaagagaacagctacaatccaaaattgatctcaacgagaaaactctataagactgatctcgctagtcttcaagcacgtctctcagtaccttttaaacaagtgaaaagtccagactttttaacagaggaagaaacaagaatcataaaggaacaagctttcttcctctaaactctttggtcaattccttcttctttctattcgattgtgataagatctttctagagatctaatcagaaccttgtgccgcggatttggagaaacatcatcatcatcgtcatagaaatcctgctctttcttcgattctgtaagagttcttcgagcagactctagattcgatttgtttttttccttttcgggtttgtttcaaatcaatctcaatttcagggtaaccaaagtttgagcttattcattttgattctgcccggatctctatacatgtcaattacagtctttttacattttcttgatttggaaaccttttcgggatttaattgattagcttaagattacaagtgatgaaaaaaaagacagagactttagcaaatgttttctctcatctcttaattgctgtcttaattacaatcttcttgtttcagttactgttttgtaagacattgacattataatctacttgtttggagattggaattatgagaagagaatctttctgatgccaaatgtcattgaataatcatttgctaatgtttcttttaccatatgattcatgatctctttttcgttttatgttgcagcgactaagctttgaaatctgcttgttccttgaaaatg

SEQ ID NO: 26999 - DNA, 3003 bp, Unknown
  misc_feature (1)..( 3003): 2750-1469P.txt file - cDNA_ID_2717478; gDNA_ID_2214501; Annot_ID_133665
attcaacataaaaattactttgtattaaatacttttttggtaaccaaaaagttttaaatgtaagaatatccaaactcttttcgggttaacaactacaacaagttaaaatagttcgtttcctatgttaagttcaaattcatgttttgtatttaatcttatctacggttgtaaccgtttatttaatctatctcatttatgtatcattccgggacttttcggcatcgagtacccggtttctttcggttgtaatcgcattcgaagattaatataatattgttgacaaaaaaagggtttcaaattcatgacttcgaagctatattagatgctgaattttggttaaacataataaagcaatttatctttccttgggtaaatgaatagaccgataaatatgtgaccctattagaaggacctagtgcatggggcgttactttgggaatatcatttgtaaattgtacatattgtataatatcattagttgatacagctgatacatctcccactacgttgcatgcatacaaaattataatatcatttgttgcatgtcccagatctgagcacaaaactttacgtaactagtgttgctaatataatgctaccacatgaactggctggccggtctaacaaaatccaagctagagaagataactaaattccacatagaaatagaaatattcgatcatatctagtacgaatcctccggtcccgtcaaacacactagcttttattttgtttctaccaagcacattcgttttgacatgtacgaccaattaagcacctacatgtattcccacgttatctagaatctaacaacagtggggtgacaattataaaggcgagatatgtacgcctagccagagacgagcaacacaatgcaatgtgcctagatatatttcttcttttatcaataacttttttttcttacatccattttttatttaacatctatttaacttaaaacatttctctctctcttttgtttactttatatttagaaattttacttttatgaaacattcttcatggcttttttgttttttttttcttcattatttgttttgtttacaatatctctacaaattttgaaccaagatatggtataatgtacttatttaacagtactatgttaatttttgttttaatttgaagtaaaacttataacgaatttttatttgaatatcaaaaaacgaccatattttaatattttctttagttgttttggcctctaaaatattagaaacggctttgattagagatatctttatttttacaaaaataataataataagtatggttcaccaaacaatgcgcaaacccgacaaaacattcaacggttacaaatgactaaaccaatcagaaaattctttatttagcaacaaatcttcactatataatagcgcaaatgtttattgggaataagaagtaaaaagtaaaaaagtttatcaataaggaaaaatgggtatatccaagaaaacagttgtacaatcatttgctcttataattattatatctatcgtcatgagcacaacggaggcaaacagtataggcgctccagctatgcgagaagatttacccaaaggttgtgctcctggatcttcagctggttgcaagatgcaaccggctaatccgtataaaccaggttgcgaagctagccaaagatgtcgtgggggttgatactatgagatataatttttcttgaaaaaagaagaaaagataaaattacataaataaaacttaatttttcaactaaattagtaaaactataaaatacaaaatttttgtaactaattctatgagaataatgtttttttaagtagcagcaagctgagactggtacgtgtatggtaagctagtattgtctaacttagcaaaagataattgtatattaccagtcatttgttatatttttggatatttatgtagaaaattcatgtgtattgttatataagaaaataattaatatattttgttgttttttttaaataaataatgtacttataatagaggtaaaatgtgtaacgctaggataagtacattcttgtcggatccaagaaagttagtaaaccatatatttaaggcaacaggttcttcttcggatcataatctctctcattaaggggaaaaaagaaaaagcaaatagattaagagaaaaacagaagaatcggaaaaaacttgagaaaagaaaatggaaacgaaaaaaaagtaataaataaatagccctatatataaagaatgcatcatgcatgcatgatcaagcatatatcctcatcttgttgatcactttgtaaacatcatccacatcatcgtcgtcgtcttctttcaccgcctccacacaccgctcattatcgtccccgaggctgccatcgccgccgccgcatcctcctctactgacgtcagcagcagcaccagactcgactctcatgaagaaattgcataggagaagtgttaagaagcaacatataataaattctctagatgcagccatggatcagacactttctctctatctctctttctcttgtctgaaaaacaaatgataatatagattaatccaacttactttaaaagcttttgttctttttatttactatgttcttttgttatgcttttctcttacaattgtgcttatataagaaatggaatttactattaatggagtagagtgatttcttttgagctggtcttaaggctaagtaactgttgcagtattttacttgaatattcatagcaaaaataaagaaaatcatttaaataagtggtacgttagtgacaaggaacaaaaaaatgacatgttttcgatgtcaaaaaacatacattattacaagttcccgatgaagacttgggccttgagcctaacattttatttgataggcccaatagtaaaagtaaaataaaaacgtccgtgttcaataaggtccatcgtcaccgccaaatctatcaccgccaattactctctaatcggaaaagagccccgacgacaacgaccaccgtccctccgtcatg

SEQ ID NO: 27000 - DNA, 3000 bp, Unknown; identical to SEQ ID NO: 11534
  misc_feature (1)..( 3000): 2750-1469P.txt file - cDNA_ID_2717485; gDNA_ID_2214501; Annot_ID_133663

SEQ ID NO: 27001 - DNA, 3000 bp, Unknown; identical to SEQ ID NO: 11533
  misc_feature (1)..( 3000): 2750-1469P.txt file - cDNA_ID_2717489; gDNA_ID_2214501; Annot_ID_133662

SEQ ID NO: 27002 - DNA, 3003 bp, Unknown
  misc_feature (1)..( 3003): 2750-1469P.txt file - cDNA_ID_2717493; gDNA_ID_2214501; Annot_ID_133661
ataggtgcatatccagtcaaacctcaggagctctatatgttggtgttgtgtattttctaatattatcttcttcaattcccatctcttctgctctttcaaaaatcttgtgatttgtcgaaacgcttccaaaatcacacaatttccattgtccatctgagctcaatagaagattctcagccttcaagtctctgtcacgattagcaacaccaatacagtatcaattcacatcgcttgctaatgtaaaaacgaaacgaaatctaataatacaacatgtatacctgtgagcaatgcgtggggattgacaatgcattgcaaagacagcattacacacatctctaaaaatcgtaagagcttgtttctcttcaaagtaaccagcacctctattctcaagcacatccacaagagatttaccacaaaaatccatagccaaaagagcttcttttttattcctccccatatccaagataccatgtgcgtagagcgtgacaacatttggatgtcccttgagggatttcagaaccgagatctctttcattacgagttcaagtgactcctcgtcattgcatatcatgtgcttcaaagcatattgctttgacgcgtgatttacatcttgagctaagtaaacactggagaaacctccttccgcaatgacatttctaacttgaactttcagatttcctatctcgagaaatcgaccttcgagacccgcaggttctttttgagcaaaaggtttaaacttccacatgtttgaatcagtggaagtaataagaatgctgcataaacataaaatctgttacaaaaccaaacaaacttcggagaacaagatatcatgatcaataggagatgccaagatcctaatgagatattcaaatacacagaacaaaaacaaagataatgataagcacctaatctgctacacaattgctcagttaagaaaccaatcaaacagatctattcttatatgaccaataaagggagctaaaagctgaatccttgatcagagaaaccagatcaacacacaataaaaacataagaacctaaggagagactattgaagagtcttataactcgaactagatccgattaagaatctggcgactatggtcagatatggtatcaaagtacaagacgttatcatcaaccaaaaacttccatgtaaagctacagaattcagctcaaactcacttcacactatacctacaatcagattctcctccacaaagtttttacaagagaagaacactagcgagtccaacgattaacagctccgatgaacacaaaatctaaagattcccagatagataatcgagatcttaacccacaaagctcgggagaaacagagaatcggcagatcaatcaaatccaatcgaaagagacaataaaaattatacctttgcaaaaacccagatgctgaggagtgccaatccaatgagtaaaagaatatatttaccctaagaatcgaaatcacagtagctgcattaagatctgcgttcacttttgcgtataaaggaaacaactttaaaaggggtgattttgagagagagatgatgaagaagaagaaagcggcaaatccgggaatagaaaggaaagtgagataagaacattttggttatggttttgtataataagccgtaaaattaagacgtgaacctgaacgtggaccgtgaccctcccaatacctatttttatttgattatttcacatttgttgacgcatttgtacattttatcataaagtttgtattttaaacgttatgagatacatttaggtaatttctgttgcaaatatagagatgattttacaattttacacttgttgatttgctctaattctagaatgcatgttcttatcagaattggctacaatcaaatcgcgacatgtgggttcttgaacttaataaaaagcactgaaaaatgattagagaattcggttctcggaaggagacttgagggacatttaccggtttactcaaagctataacacaaggtttttcttccaaaaaaaaagcttgaacttattgtaactttagattatcgatggcttgagcacattattgatcatcaccaaagggaccggtgtcgaaactttcacagatctacaacaccacttcaccaaaaccaaaacaaaataaaccctagacaagatacaggagacgaacggtgaaaccctagacataagccagccaaccactgctgtagaaaccgacgtacggatgctggacacaagcggacataggggtaatgttattggattggatttcagaatgtcattccttaaagaacctatcttaagagaaatgttgtgcatcaaggatttgcattcagcattaagattgactatgttcaacaattcttctctgaattttatatgaaaacagcttctaaaaaaactaaactggcgctatctattcccatgaaaatgatattaacaagcccatgtcttcttagaactcagtttttattttttgttgggtctttggactattttgggattaatgtgaagttgatgtaaactttgacgaaattgttttaaatgaatgtagtatcgtggatattcaccaggaatgccgctttgtctcttattgttgtgttaataagtagaaaatgaggtgagtaaaggaaatatatgaaaatgatggatatatgctagtaaagacgattggaatattataatatttaaagttttgagcaaggtattagaatacttttttttttattaaagtcattaaaatgcacttcgtgctttgttatggacaatgacgcttgacgaattcagaaatataaaggaagtaaatgttcataatattataaactttttttaactaatcctataactaaactaaagatgccccgcaaaatatgagtgcaacacaaggaaatcacaaattccctttcacataacacacacttgaagcttctttcctataaatagaatggattggaaatggaagaagcataaaaaaaaaaaaaactaataaaattcacaagaaaaaacactcatatg

SEQ ID NO: 27003 - DNA, 3003 bp, Unknown
  misc_feature (1)..( 3003): 2750-1469P.txt file - cDNA_ID_2717530; gDNA_ID_2214505; Annot_ID_133742
tctagcagcaacatagatgaagaaactaaattataaatccttaaattaacataatatttcattcctcattttaaaaacttggtcttgaaccccaaattcaataactactcacacatatcgttagaaagaaagataatgtaacatgtttaaatcaataaatatagagataggggttcatgaaaaaaaacaatgtagagttaaaagattagactcgtcaatttttatatagcaaaaacaaagttttggataggaaaaatatgtgaaagaggtctttaaaattcgagcatattggaaacaatatatatccaaatgggccatgtccggagtcaaatcgaatttgggcctaaaatttatatgtggaagtggtctggcattctggtatatcctttggttcggcattaaagattagactcgtcaatttttatagcaaaaattaaacgaagttttggatacgaaaaaagatgtgaactaggtctttacaaatccaacatatggtcctaaaacaatataaatccaaatgggccatgtatgggccagagtcaaatcaaatttgggtctaaaattaatgtagaagtggtctgacattatggtgtagccattggttcggctagccttggacaaaaaaacaaaactgaaccaaaccgaaccaaaccaaaccaaactaaaaaaagggtccggttgggttatggatacaactaagtatccgaatggatctcagtcacactatcagttaataaccgaactgaaccgatagataattatataattatagattgtttggaagtagaatctaaatacctttgtaaatcttgatgctagcaaatctcgccaaacaaataaccatctcatcactagcttgttcagaggcattgaaaatatgctcggtagtaattgatcccacaaagtaaaaggtaacctttcatcactacagaaaagaagaataatcaaccaaaatgaattgaaaacatcaaacataatttatttatgaatgagaatacaaacatctcatatctgtgttcaaaatcaatctttttgttcgctaattgttgacataaagagtctccatttcacaaacgtttatgatcaacaatttcttgtacaagtaaaagatcataataataagtaacctacgggtaggcaaactgttttttggtttagggttggttcagattttatggttttttggttttacaaaaactgaaaccatatagtaaaaggtatagagactaccacaacacaaagagctgtttaaaagacttattcttattgataataaacttttgttacaagtattatctcagttcttacttgatctaatctacccaaaagatcaaccccgactaagaataactaagctctaattctcttctctgttttttatcactaacccgtgaagacgaagagaactacacactcaccttcaagcttttgcacggctttgaagtttttacttagtatcgaaaaatatcccagagtgctcaaagcggctcaccctctgctctagaatatttatatcaattccccagaaccctaaccttaggatctccgagaatctcttgatatggaatcttccttgtttccaagcctattcctttctttattcttcgatataatatcttctatattttctcgatgaaccttgtctttgacacctctccaagttaacttccatccttggctcttcacatcattcgccttagcttgccacgtttgctctcgcatccatgtctgcacatcaagcgtctgatgaaacctgatgcagcgtcctgaaatccatcaacgatctgatcaccatcagctgattgattcactctgcatcttcatatagaaatcgtatgtaatttagtttggtcaaactttcggtatcatgaatcatatccctagttgtaactaatggcatggttctcaaaaaattcttatacccaacaagaaacatagtgcattatgtcccaattgatgtatttgttcaattggtttcatgaaacaatacaacgattgtctaaaattgggtagggaagagtttaggcctgacctgaatatttgctgaataaggcttgggtcaaaacttttgtaactgggctttgaacaccttattgggcggaagtttgcaaagcccaccagataaatatttgcttgatgagtctctaaaagtcttgtaaagattgatatttaatctatgtttatggttaaggttatttcagaatattgtggagagcaagtaaaaaaaacaaagataggaaattatgatataacaaatgtggatgatttaggtttaggaaatagcattttgttcaaatatgtggagaatacaccataaatgtttattttcttatagttatccaagaggttaaatggtttaggtaatcgtaattaaagatcaatacgctaaacatatgtaattattttttgcgtcagctggattttattatgtcaatttcaattacttaaatcctaatgccataattcagtagcaatttaaataataaaataaattaatttggatatctattcaaatgtactgtctcttcgaagataataatcaaactttaaattcaacaaatatcatcaaagcatgaaaattcaattgtttccagctacgtattaatagctttaatgtggaaaaagaaatattaatagcttttttcatggaaaaaagaaaaaaagaaagaaactttacttttaatagtatatttttgtctgagccaataaaagaaaaataatattttggtttaacatatttgtccctcgtgatagatttgattcgttcgttctccttctccttcattaaagacttcacgatcccacacctccacacacattgactcacacacacacacttctctctccaagttcagaaaaaccaaaaatgggttcttgtcggaaaaccacttctggttttcagcaaacccacttcttgtaataaaacagacaaaactagaaagaagcaaaaaagcttcgttttttttttctctttctccaaaaaaaaaaacccccccaaatatg

SEQ ID NO: 27004 - DNA, 3003 bp, Unknown; identical to SEQ ID NO: 27003
  misc_feature (1)..( 3003): 2750-1469P.txt file - cDNA_ID_2717530; gDNA_ID_2214505; Annot_ID_184096

SEQ ID NO: 27005 - DNA, 3003 bp, Unknown
  misc_feature (1)..( 3003): 2750-1469P.txt file - cDNA_ID_2717537; gDNA_ID_2214505; Annot_ID_133740
tgtatatcatgtatacttatcaacactgtctattttctatataattttcaagggacagattgtccccaacattaattttcttctgtttatattaattctttagtttctaagaaaacattacaacgagggggtatagtgtatgtccccattttcatgacaaaaacgaaagaaaaataacttttagagaaatgtggatttgattgtgaactatacgtggaaaattatttgcatatgactattcgtttttcttacagcatcagtgtttgtttattatctttacattataaatatatagatatacatattacatatcggttgaaaaagaatatatatctgtatacatatatggttacatgcatgtatagaccacattgtgaaagtagtaataaaaatatataattacttcttttgtattggcgggatcagagatctaactaaaataagttagaaacattctattatggagaagccaaaaccccacatgggtagttgaaatttataagtatttaattacgtaatattttatttgtttattttttcaatgtctctttatcctcgactaataaaattaagttttttaatctcatatgtatcctgcaattatgccttaaaatcttggtttacaaaaccgtccatagtagcaaataatatctattctcatctcacttcgtatctctttttatgatcttgatagttttcttactaagtaatttttataacgttacaagacaaagaattatttggtctatacaatcacacttgcatagaagtttcaataagattgcataaagaaatcaaaataattaaaacagaaataaaactttcgtatatatttttacagaaaatatgtttcaataagaatgcataaaaaaattaaaagaagaatagagtttagaaaatatcttccattttatatgattttgaaatctttgatgaaatttagaaaataaagtttcaaaaaatgtataaaagttataaatgttaagtttaaacaatgaccttaaaaatctatatataagttttaaaaaacgtgtattgactaataatgcaatcaaggaaatcttccgtggtaacttctggaaacttcaaaacttcaaactattagacttcttgttgggcagtgaacggtgttgatcgacactaagagagttacggtcgacactcttgccttggttagaatccgaatttgtccttcaaacttgatttcttcgatttagcttcagaatattccataaactttcaatgtatccctaaagtgcaaaaacctgaaaaaaactagaaaaaactctagaaaaaaaaaaaaactctaaaacctatatctaaatcatacctaaaatcgaagaaaatcgaggtatatcagaatagacgaacaactataaattgagagtcggttttaatttcatctactacctcaagtgtggaatatgaaagaggttcctcatttgattttgaagaattaggggcactttagatggtttaaggatgaactattttgttcacctccttttatttcagctaatcataatctaccatctaataaataaataaataacaaaataactcatttaattatcaaatctaagttctaaccactattttatccattcaaaacaatatataatctcgtctaattataaaatctaaattctaattcttttttgtgaatccaaaccgtcatttaatctcgtataattgtaaaatttaaactctaaaatgtattccaaacgaaaatatatttagaagtaaattgatatttggagtgtatatagaagtttcgttttctggtaagaagctggtaattagggaatgaattcgattaaactatttgtgtgatttgttgtattatcatttatcataaatatttgattgtcactattttgtcaaaaatattaaattgtcattattgtgttcaggttcttagtacctcaaatcaaacagatcaagggtttaagtgtttaaccaaaccaatcgaattattcaaaaatctttataattaaatgactgttttaatacgctaaaccacttaattgtttatatcaatacaggatctcattatggcacaattattaaaataacagattttatcatattatttctaaatgagcgttacgttttaaactttcaattttgtatatacactataggttttgtgacaggtcgattattattgataaaagcattgggtttactgtatattttctttttctttttcaatttcttttttgctaaaatgttcattttttcttttcttatttgattctgatatgcatgattatttcagggaaaatatctacatatcatattaacaaaaaaaaatacaaatccattctataccatatacgttacattgtgaaaattataataaactcaagatatatatatacatatacatcatggtagtagtagtagtagtacacatttaatttcagcagttgcaccaacaactgagtaaaggacaaaaaactataaaattttgccatctgctatttaaatcattacgtattactagaaaatgatgtggaattcgacaagaatgaataataaaaattaaactcactagagacaactttcattaaaaaaaaaaaaaaagacttgtatcacaatcatatgaaagatgaaacaaatttgcattattatcatttttataattgaaaaaaaaacctcaattcgttgacccttcactgtcctccaatggcggcccctacgccgttggccttgcctctctctctctctctctatatctctttcttgatctctctctataaaagctcaaatagtccagcaagcaaaataatccaaaaagaaacaagataagaagaaaccaaactcgcaaagaaacaaaaaggaaaaaaaaaaaaaaaacgaattaaaaaaagaagaaataaatcctcctttttaacacctcattccctctttctccggcactcaaaagagaccaaagaagaaaactttagctctcctttttgtgttttctctcttttctttgttggtgttccgacaatg

SEQ ID NO: 27006 - DNA, 3003 bp, Unknown; identical to SEQ ID NO: 27005
  misc_feature (1)..( 3003): 2750-1469P.txt file - cDNA_ID_2717537; gDNA_ID_2214505; Annot_ID_184094

SEQ ID NO: 27007 - DNA, 3003 bp, Unknown
  misc_feature (1)..( 3003): 2750-1469P.txt file - cDNA_ID_2717541; gDNA_ID_2214505; Annot_ID_133739
tcttccaagaaacatatagaattgttgacacaggaaacatcaaatataaaaaagagcagaacaactgagtgaagaaaacacacacacagcgtcctctcgccgcaacccaatttgctttagttacaaacattccttcctcctaaaagcaacctttcttggttacattacgatctaatactttggttttgaaaaaaagtgatttaaaagaattccttttccaattgatttgactatcgacgacacatagtgtagttatcgagttcttacagccaattataaaaatgaaattagatccaaaatagccatatgaaccatttgaccaaataggaagaggaaaataccgtcattaattttttttttttttcaaccactcgtgtttccgttttctttttcctgttctttttgaacttatacaaagtaaaatttctactcatatgacttagaaaaccaaactaccataaaaatgagaattaggtaagtaaaaattactccatctgttcctttttgtttgatcttttagaaaaaaacacaaatattaagaaaatatattaaatattacttttaaatatattgttttttgtgttttacaattttcaataactataaaccaatgatattcactaatttgtattgaagtttacaatttatcaattataactaataactattgtattgaaaatctaaaaaattaatttttttaaaataatttttttttctaaacaattaaacaaaaaggaacagaggcagtattagaaaccctctaacccaacaaaaaatgtaatgtataatgtgttcataaacagcaccaactacccattataattatttcatgaacacaattgtggcagaataataatgatatgtcaaactgattaatgcttaatctttccgatttcagcctgtaaatattgaagtagccgacaacaagaattgaaaatcgcacaaattaggataacgtagaaaaatcatgttcgaaatggtaaaagttatgtaaacttaatttgaaccgagttatgtagaggaagaagaatgaacgtagacatgcctaagtgaatcttggtatgatggcttttgaattattgaagaaaagaagaataaaagtgttagaaagaataaattggcattataataaggaataaattctaagtgaatttagtattatatagtttttttgtaacactttaatactgtccgcgttatggccgccccatatggcccttaagacattaactagaagagaacatacccgggggagtttcatctattttttttggatactaggctatatgtttttttgttttttttttcctttgcgaaaagcctctttatttttactttggtgttaaccaaattccatttgtatatcatctttggttaacaattgtgttttcttgttgctaaataacttttaacatttctataaaaagaaaagaaaattaaagtgttaaagtattgccttacgccaatgtacaatgccgatgtaattatagaaaaatgacaaactgtgtttatatagaaaaataagagaggaaacttattatttacgatattttcactcatgctattttttttttcaaagaaaccaatttttttcttctcaccagataatagctctcgaaaaagagatagtatttagaacactactaatcttttttctatttgttttcactagaaaaatgattgcttagtaacagtctaaaactgtgtatggtaacttttttaatgtcaaatttgttggtccataagaaaaaaattatttccaaaatttaggagaaatgaaggcgctattatacaaaaaatacaagcaacgcatagtagataaggtggtgaagcttatcaaatttggtttaattttgattcttttcacttaattatgttctcattatatggaaagatggtgatgaaatatatgtgtgaaactctaaaatcggtgaatttttcttgttgctcaatttaatctacaagaggttatatgtagactaaattaaaatttcaaaatatatggtttattactttttagataagaaatgtcttaattttatagtttgagttgtactacattgtttttttaacatctataaaagaatgaacatatgttttaatatgattggtaagttgttttgacattttcccatatccacatataactttattaaaagtgatatagtgtacactttgaattcattataagatataatagaaactaaacggataatatgagagatttcgaaatccaacaaggagctaagtgtgaaggaacacgaatgaaggacagaattggaacaaatggttattggggggcaacagaagagaataatacccttcatcatcctcttctcttttatacctacaataatgcaatcgagaatcactttaagccctcaaggacgctctcgttatttccctcctaatgatccttgacgacttttttctccttcacatgaaacagtttcaactttacgttaatcgatatcgaacgtctatttccccgtaatgtttgaacgttgatattaaaactatttttgtaaaaccgtgcatcttaagacaaaacatggtgtccaaaccaaaaatatgtcttacctgatccaaataaattattttcaccctcagaaaattataatgcacaccatccaaattaatgatcatgtcttgaagtcttctagcaccaaggctatttcgtcggaattcatttctttggttttaatttcttttactatatcctcatgttgcaaagaaagttgatggaatcagaatctatctacatatacattctgatcattaatgcctataaaatgacatgtttctcaaacaaccaagttcaccaattcctttcgcttaccagtctcttgtcttctcaggttcgatcatttttttccttcaattttagctccttcttcatcataaggcttttccacaactaaatcattactagatcttgagtaagttggctgagtgctactagttaacttttcaggttgttagagatacatagatagaaatatg

SEQ ID NO: 27008 - DNA, 3003 bp, Unknown
  misc_feature (1)..( 3003): 2750-1469P.txt file - cDNA_ID_2717549; gDNA_ID_2214505; Annot_ID_133735
aacttgtaacctaaccaaatagttattcacctaactcatagaaaataaggttagttaatctagtgcatatacttaatagtatttacccacaataaattacaaaagttgatcaccaaccattaaaaagaatacaatttttttttatattcagtattcatttaataaaatacaaatttgttaactatgatcctaaagtaaagttaatttcttgtttccgatcctcataaatgaaagaatcagaagttatatagttgaaatatatatcaagttaaaatggtaatcgtcttcttagcttgacatggaagagaaacaagaaaaacaaaaaacaaaagagtgaaacctgtatttgtgatcataaggagatacaacgaatctcctaagcttaactcgtcgattacttcttgcaccaagtgaaggtaaaattccagtagaaagactaaaatgactactctctctcgaaagctgttcaatctcatcttggacttgtccgcataacaaagcccctcctctcatcaccgacgtttttttttcttggcttcctctttgatggttccttttttttgttcttttggtttcggcaaaagaggcaaaataagcagcttaactcttggctttattggtttcacatttttttttcactcgttgttgatgagtgagaccttttttttttctttataacaaaaaaaaactcttggctagttggctttattacgggtgtgtgtgtcatttctgactttggatcccttcactttcaaggaattaagttttctctcggcaacacagtggttggccccactttcacgtcttaacccttactgtagcattaatggtggcttctccatttcaagataaaataaaatatcattcttgctcataaataattgtattaacagaagaagaaaaattagaccgaagaggaagagttgaccaaaaatttatacatcagagcatgatctcaagtttttcaatcattatacttactattttattgtttgtttgacttctaactaaaggaaaaaaaaaacacatatagatgtaggacacgacttaaaacttgttttaaaatattttaggtgatcgatcatataacattcttgggctcatttgtggtatggagatttgaagtgagatattgattgcaacttatggtatgattggttgcatacttgcataaagagcaataaatgttaaactgtcatacttttattttaacgagtaaaggaaaagcaaatcgtaaaaaaatagtttttctttgtttgggcataaaagaaaaatattttggttcatcatccctagatcgtaagcccttttgttcaccttttcctcgtctatcttactcacttcttgtccatcatcgtatatatagggaatttaagataagctagacatttagcctttaggatatgataactaccattgtttggggaggaagctacttaggatttaagtagataatgtaaaatgatgagggataataatgaactttggataactatccattttcttgaaagagaagtaatgtgatggataatcatcacatttataacagttacctcattaaagtggtcttattactacaaatatttgttgctattttttccttcaagttctggatttctcaaatttcatatagttaaagttttaatttacaagatgtctactgctatagataaatcataaaggtttgattgctatgtcgctaggggaggaagatgaccttttaaatatatttgatctacttcaatattgctctagtgaaaagagtgttgtgagtttgataggaagaattcgtaaatcggattgccaaatgatggagctaatcctagataagccaaggaactggcaaaagtatgaaatcatcatagagatggctatttcctatagagaatgttagatgcgtaacaaccaattttcttttacttttagaattttctttatttactaatatttcagttagaggttagcacacttcttgttccatcccataactgttcgggtgtttccaaattcctatcttatataggaatgtattctcaatatgggacaagttggtatttccaaatagaaactggaggggttccctaagtcctgattgtgacaaatacaactagtatatatatatatatatatatatatatatatataatattctaaaaacttaattgatttaatttatgtttagttgttctaaaatggattatgtttctttgttttttcaagttttaacttttcactatataacacactttatcattttttcttgtttggaaaatatttatgctagataaattgaaaacatgttaattatagagcaagagtttatattttattttattgtaacaggttctaagacctttttttatagaaaacattaaattaagataattattaattacatgactcgcgctctgaccagttggaccaaatatatatgaaacacaaatttagtttaatagtattttagagtatttctctctttttttttatgagctggtatttctctaatttacaagtgtgttgcatataaaacttcattccttttttccttttgtatcattgtatgggtctttgactcttttttgggtcctttttcgtcgaccattagcgtctccactttacctcctttgtttccactcacaattgtaactacatgggccacactggcccatatacattcatccaatcgggctatcatcatgtactaagcccaactcttttgaccggtgatcaaacagttatgatcaattaactccaattccttcgtatcccaaaactcgtgcctttgtaaattatccaatacgtaaaataaacaaagaataaatattatttctaaaaaagatatgcttcaacaaaaaaaatttaaaattggatattccaaaaacaaaaccacgaatattcttcatttaataaaataaaacactaatattaatattatcaaaccaccatcaatcctgtaaccaattttcacttttgattgttcttccttattctcagctaaccatg

SEQ ID NO: 27009 - DNA, 3003 bp, Unknown; identical to SEQ ID NO: 27008
  misc_feature (1)..( 3003): 2750-1469P.txt file - cDNA_ID_2717549; gDNA_ID_2214505; Annot_ID_184086

SEQ ID NO: 27010 - DNA, 3000 bp, Unknown; identical to SEQ ID NO: 11596
  misc_feature (1)..( 3000): 2750-1469P.txt file - cDNA_ID_2717553; gDNA_ID_2214505; Annot_ID_133734

SEQ ID NO: 27011 - DNA, 3000 bp, Unknown; identical to SEQ ID NO: 11596
  misc_feature (1)..( 3000): 2750-1469P.txt file - cDNA_ID_2717553; gDNA_ID_2214505; Annot_ID_184084

SEQ ID NO: 27012 - DNA, 3000 bp, Unknown
  misc_feature (1)..( 3000): 2750-1469P.txt file - cDNA_ID_2717561; gDNA_ID_1620463; Annot_ID_157823
ttttaaaatactataagagtccaacaatcatgtgatgcaaacctcaaattccgagcttctctagaataagaataagctgctttgtgtgatgatcataattatgcatgttgattgatttttcctaaatctaaaaaataatcaaatattccagttaacagatctcagtacatgtgagaggacaattagacaaaatctaatgtactatttgtttagagaataattggttagttaggttaaggaaaaaacagagagtataaaatatccccaatgatgacctcgttctacagccaaaatgctgtaaagaacattcaaagctaatatacacatgcatgaaacatatgattaagcaactaaaaccatgattattagtcctacgcaattgccaaacatataaaatgattacaacacatacttttaaaatattccgttgcctatgattttgttttgtgttgtggtactcaactttggatttggatctgtgatgtaggcctgcagcttttatttcaaataatatatatatattttatttccgaaggaaactaagtaatcgaaatggtgtattcaattcaatatttcacttatcatgtaaattgagaaactaaggtaagactgtaagagaatgctcatacccttctgcactacctccaaatagacgaggctctactgaaaaaatcggaataatgtgaaataacaagttgctgtttggacgccatatctcaatttgctatatctacaaattaacgataccaaagtgctagtaggggctaaatgcagaaatttaagccattcaccattacggatagaacatgaaattctcatttaagctatgctacttgaatatgttctcgttaagaattgtttcaccctagtgcaagatccgcggtcatgctcaattaagtgctaaaagttagactagtagaccaaatttgaatccgatatatatattaccttggtgccgaactcaaacttagacatgctcgaacctcaacaccaagaacactcgatgtttttgccaatacttacataaaagctattggaggatcactaataaatgattgatcatcaatcatcatgctttgcggactctctttttcgttgaggggtaaatgattacaaataaacatgcgcgcgtggatataacgcacttggtcagtgcgtgtggcacaagtcagagtgaacacgtgggacagccagatcacactgaaacacaactccgacatcttgtcggatcttatgtaaagcgttgggtcccacttttcataatatctctcaccacgaaacccatctttttgctctcaattattgtcgctcattgccgtatctcttcataatttcactatatacatgtctacgttaggcggaaattattaaattgtttttggaattttagtttacatgttatttttttctaaataaacatgaaatatatttacaaaagtatatccaaaccatcatttttttattgtttacatatacactaatgacacttttatttggattgtgaattatgattatgcaacgatcactagtagtttactagaacaattaagtttacatgcttcaggcattgtaaaacaactatttacaaaaactgaagttagtctacaactagtttttgtgaaaagaaaggaatattagacgataaaaaagtaggcagcagttaaaggaatcaaataattaacaagttagcattgattgaggcggatggttacacatgataaggagcaggcgagtgaggaaacaacacaacacgcacgatcacgctgttatgacccacatgctcctatctccatgttactgtacgcaaagtggttatacatttacacacacttgaccaatattgctcacatttaaatttttatttctaaaggaaaaagcacaaacatttaaaggttttactgacggaagaaacgaaaaaaagtagtagctttaaaatgtcattgttgatgaaagtagaaaccatgatgatgatatttatgtgcaaatattcatctcacacgtatatcattggttcataaccgttggttggtccacaactttgaacaagttcagattctttttgattgtgttttgtaccaaccactccaattagtcaatattccattatatccaacctcaaatactattttcccttttctctttaaaaaatatttggacaaataattggctacactattggagatttgactcagctcggtatgccgtaactaatcaagatactattttctatactttcttttattgatatccacataatacatgtactttgagtataatgacgtgtacttgattaagacaaaacgaagtacgagaattattgtatttatcaactttgagacatactacatgatatggatcatgaaaattaacacaagtagtgcaaattgcgttatccatatacaaaaaacatcgcaccttgatgattcacttaattgtagattactttctcagagtggtccggacatttctattggttttaaagacattggctttaaatcttcagacacaaaacacatatacatgtgtacacttgaaaacatattggccatcttatttgttttggacaaactgccatcttattatgcatgggttcttgtaaggaataaactaaaaatgtttgtgaaagaaaaagaaaaacacaaatattgagaaagtacaaaaagaaagacatggcaaaggccaaaggggggacacaagttggagataaagtaatacaagtccaaaaacaaagaaacaataatgatggattgtaattagccacctgacaaaatctctcatcattcaaagtactatattaatcccctctcttcttcattaccatctcacatctctctctatttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatg

SEQ ID NO: 27013 - DNA, 3003 bp, Unknown
  misc_feature (1)..( 3003): 2750-1469P.txt file - cDNA_ID_2724435; gDNA_ID_1620487; Annot_ID_158493
cttgctgaaaagtgccagcatcagtgcatctaaatgcattggcatgaaaccaagaaacaagtccgaggtaaaatatcaagaagcattagatgagatgtattatatagtacaagtttgtctacacttgttcttcagattcttgagttttttgcagtacggggaatcaaacaatgatacggttgatgctctgtctcaaaaggtcgcggctctccacacttgacttgtttcagagattgaggattgaaacttgttgctaacagtagacggctgattctacaagtcttgtacacatctctcagagaagacgaagaagaagtctgatcttgatagagatattgagagacatgactcatgagctatgaacaaaacaacttaaccttcattggtcttcaatttgtccatcaagtcgagttgtattaaaaatggatggagaatataattaaagaagaattgtgttaacccctggatttatgcctgacaagtatttgactttatcaggcattataaattatagttaaagtgtgtgttttcttcatgacccatatgtgcctaacctaacttgatttactgctgaatttcttctttttagtcgtcccatttactttttctttgttctcttttggtttacttactaataatctctttagagctggtgaaaatgctgttacaagctctacatatcataaataacttgaaaagatcaactttaaagtagtctataatatacaataatgggatcaattacgaggaaaccatagtaaagtatggtctcttctgaattcaggcatattctcaagtgattataaggatgggtattttctttttctctaaaagactaatttatccttttattgtttcttcattctttcttccttcttcaagctcttgattcagatgcgagtttgatgaagatggcttagttgctcatgattcacaatcagattgttttacagttgagatggatcgatctgtgtctataattaaagcctttgggttccctaaacatcatcccttagggtttagttttcttgcaacaaaacttgtttaattagttccattggattcatcgaaaaaggttggtcatagaaatgttgtgtgaatcatcggaggagaaggaaacgagatttgattgttgattgattcaaaattaaatctgggtatttatcgtttgtggagttatgggtttagtaattataggaagttccgataatgagtttatttttaatttggattttcatatcatgggttatgggtagttatcgtcttctttgtacttctcaatttcaatttggagacagtgaggttgttgtctcacgacggagaagatgaagatcatcatcaacacattcgagggcaaaatggtcatttacagaccaaaaagtacccagacttataagcccaaataaaatatgtttctattctaatttttgggtcaaaatatgcccatatgtacaaaaacccctacaataatgttgtaaattttagtttcttcttttactctatagtctaagtctatatccaaattgactgactaagtttatttttgatatgatatttgaagtttgaacacggtaagtatattataaatttaccatttgtaactctatagtaaaatagtctcttgtccttgtgacgtaagtgaatccatcttgcattacgttatagatagatacttttgtaatggcattcccgaaaaagggttttgtagtgttatagtttaagcagctttcactacaacaaaccattcgcatgcctgacattacctttttaacatggagctccacataattctttctttttcctttttactatcaaccaatagtgttttgtgggtaaaatggatataaaagtaaaattccatgaacatacttgtactattaatctcgagataaatcctagactcctagtgtttatgttcttgtggtcgtcgtcgtccaactagttcttgcttcaacaaaataagaaacaaaacaaaaccaaattaatagagactcctagaaatcaaaggactaaaaaacacttggaacaaaaagacagaagttagacttctttttcttttgagatagaatattttttttatttcatggaaataagagtaaagttgttatacaactctttatttttctttatcaaaaaaatgttttattacaactcaaaagtttcatgaaaattgacaaaacagctaaagtataagtctataaccataataaaactaatctgacgacttttttcttatagctatattagtgattgaaaaaattgcatggtctcttgttttccatgacatttaagttgcgaaaaattaattgcattatattgtaaactaattaacggaaaagtttatctgcattacgagacaaacacatgctagtactataattttgtagtttatctgcattgttgaaatcggactctgctaattttattgattatacagattacatatcaaatctagtaaatatgtagcgtttaaaaataaaataaaaaagtactcaaatatgataagctaaacttaaacgaatccttccaaactcttatgtattgaaattattaacaaataacagtgaacctgtcgatcacttgcctctgtgatctttcaagtttcaatgcaaagaacaatcgtcccgtgattcacaaccctcaatattcaactaaggttaccctaataagtaataatccaatatgatttcattattcataaaatagtcgccagcatggattacgattaaaaagtttattttttctattattgtcctacacactgaaaaatggagtgttaacgaagcataagaaatgttttgtaattttaagaatgtttgatcacaaatttttttccactgatttttttacattattaaaactaataaaaaaactgacttagtagtattaaattggtatatatcgagatcccatttgtgatattttattacacatctcttccagtctctcactctttgtccctctctctttctctattactctgtctcctctgttccggcgatg

SEQ ID NO: 27014 - DNA, 3000 bp, Unknown; identical to SEQ ID NO: 5513
  misc_feature (1)..( 3000): 2750-1469P.txt file - cDNA_ID_2724473; gDNA_ID_1620797; Annot_ID_168519

SEQ ID NO: 27015 - DNA, 3000 bp, Unknown; identical to SEQ ID NO: 2897
  misc_feature (1)..( 3000): 2750-1469P.txt file - cDNA_ID_2724570; gDNA_ID_1620613; Annot_ID_161965

SEQ ID NO: 27016 - DNA, 3003 bp, Unknown
  misc_feature (1)..( 3003): 2750-1469P.txt file - cDNA_ID_2724591; gDNA_ID_1972164; Annot_ID_179691
attctctgaagcactttgacaaccatgtatgcactggtagagtcaagaccagaagttggctcatcgagaaagagaataatcgggtcatggattatatcggttccaattgagacccttctcctttctcctccagacacacctctgtgtccctcatcaccgatcacggtttttgctgcgttcctcaggccgagctgatcaatcagagcttgaacccgtgccttctttttcttcttagaaagcgagcttggaagcctgaactcagcagaaaacatcaacgtctcttccacggtgagcatcgggaagagaagatcatcttgcatcacataagctgatatgactttatgcaggctagattcaagaacttccccatttaaagtaatatcaccgcgtaggctctcttttgaaatccgattggctaatgcatcgataagcgttgatttccctgacccgctcgctccaagaacagccatcatctctccttcccgggcttcaccagaaataccattcaggagcaccttagtattcatctccatatcattaccatcaaaaggtgaattcccacaacaaggaaagggcttaaacttcttcttgatcttcacgctgtaagtcaagtctttgaaggaaagaacaaacggagaagaagaaggcacacgagaagacggaaccgaggaccagaaattggacgcaaccgcaatatccatagcccgactctggtcatccccctcatcttccacactcatgagaagttctgcaagtgtgacagacacccgcgcagtgtctctgtgacatctctgaagctccactgacttgtggatattgtaaaacagagggaggccatcgccattgacccgtttggccggagataatataccgaacaaaccagacatcacgtgaattattgtctggttaatgttttggcctcaggtaatgtgtctaaaggtcttacccacagaacaattttgatcgactttataggatatttggatgggagaatgagggagaaacttgtcaattagtttggtgatctctaagtatctaactttgagttgttctgggttttgtagcttttcatatttacatgtacatagcttttgtttatattttcgtatgtatataaattgtaagttacgagtaggtgaggagttgggcaaatccatccacatttttccgttattgtatgtattttttcttggggcttaaggtactctgtaaaaaaatcctattttaggtggtttttgtttacaaagtggaaaagtttactccatggaattacgtgtttatttcatctgtatataatgtatccggagtttatggaattgcaataagtatagcttatgtaacatgtcaggaatagaatttctccttgcacatgtatgtatgtcacgaatttcttaatctccttttgtttattatagtcacgacccgcgagttttctataatcacttacaagctctaagacttgttttttggtgcgtgagacaataattgactaggggttaattggatttccaactattttgaatcagtgaatatcttcgtacagtaactaaagcacgctacgaatatactgtttgttgtatcaaaatcaaatcatccaacattttgaacatttatttagcggttactaattaacttttgcaattagttaatatcaaacacataagatattctcataattaggatttggcatggtactatactaagattgtacaaaggcatgccattatgcataatgaagctaatggcgtgttatctttcaattgtttgtttaatcatgcacaccattttcgtcatataaaaaagcgtaagtgaagcctatttcatttcaaaaaaaaaaaaaaaaaattataaggatcattgatttgtacttttgtagttggtgaaacaaaaaggaaatgaatgtgaaaattatggcagaaaaacgtgcagatgttcggctttgatgttgtagagctacacacgaaaacacaacaaaaattgtcattaggaatatgtaatggaaactttatataacgtgatgagttagatttaggcatatggaagtttggtgtagctgttatatctgttttcttgattattttacttttgataacccatttttacaagagttgtcaagaaataatagaaaactatatacttagtatcatcagcttgtctctatcaagttgaactaatgatttatccaatgaaatacataacatttcttatggaatgtacactttcacacagagaatgagtttatattattctggttaagtttagtaagactttctttatgtaaagattgttttgaaattttgtgtttggtagaggatattttgctaagtttcccaacataattttgttaacactttgagatttatcaggtaggactagatcaaggaattgaatccctcaggtttgagatttcgttcaatgctaatatttgttaaatcgtacgagaaatttttactctcgtctgttgagtaacagcatgagagagttttcattcaaaaaaaaaaaaaatagcataagagcatatctctaggcataacattttgtgggctattaaggggccaaacttgggcatccaattgttaaaagcccatattttgtaagcctcgaggagttttttttgtttgtttccacatttgcctaaagttttgtatatgttcattgaataatatacaaatcaaacgcaaatcacattaatgatcccctcaagaatatatatataaaaaattgcatatattattaaacaattagtgaaattacttaattagattatctgataatcacatatagattttagaagcgaaacatatatatttgctctataactaaaacaaaataaaaataaaaaagagagcgaaggattgcatcaagtaatcgccgtgtaactaactacttttgcattcaccatcgctcttacgtttgaatctatccagatccaaagctcttcttcttcccggcaattctgagatctcattttcaccggcgacgagctttaatcggagaacgatg

SEQ ID NO: 27017 - DNA, 3003 bp, Unknown
  misc_feature (1)..( 3003): 2750-1469P.txt file - cDNA_ID_2724595; gDNA_ID_1620355; Annot_ID_154467
ggaattatgtgggggaaaaagtaaagaatggcacatgaagagagttttgcgtaattcccaaaagtaaagccagaaagatttttctcccaccccatgtgcttactctccccagtccccactttttcttaattaaattcatatttcttccatttttatttttcggcttttaatttcttagcatacttttaaaaaaaaaatattgtcacactttttaggccgattttgactgagttacacaggtcaataatgctcccaattcggcggactatagttattttagtggacatttgtgttaactaattttgtggcaaaaagaaactcggaacaaattaaaccataactgatttagactaaattatataatgtaatggccattatgtattaactaaagacaaaagtaatactacgatctacgataatacaaaaaaaaaattcagaatatcgcgtcattatcaacttgacaccaacttgtgagtctcccaaactcaatgattatgtggtcattatcggtggtgtttttaaaaaatactatgaaaactcgctctcactaatatcaagtggcttacacacttgattgactaatcaatagtttatcactactactataatgtttcaggctagattttccatcacgtgccaaaaaattccttcaaacaatttagcaagctaaccatcaaatttaattacgaatttttttctttcatatccacgtggcggatattcaaacttaattatgtgtaacatatgaatgacgtaaataatctatgcacatctcgttttactgttgtgtgttgctttaaaggctatcatggataacgtgtgtatatgaccttcgagaaaattttgaagagatccattcaacaaaacatgcatgacattttgaatatatcccaattattaaagactcaataattttcagaagtatattttgggtataaacaggtaaccgtacgtgttgctacacttgctattgtccatctataatgtgaaaaatatcaatttaaacattactgtttttatgtagtttttagttcatgtagtatttgattatctggagaagaagaaaaaaagatgataaataaaaaaattgtcggcaatagaaaactgagtttaggtcaaaatagttatgtactatagttattaccgacgtaaacactgataaattgaaaacgatgcatcactggtttttgacaaaatgtcgaattagaacaaacatgactcagtgtattagaaagtcaaaatatacacatttcctcttgaatagtagtattagcttgataactttgtttatcttaatgaaatcgtattaaagaagtttagtgccgagattaaatctcgagtcctatcactctatcaggcactagaatatataatgtcccactaaattcgataacaaattatctttaaagttaaagtatctttataattgtttttatatatggatcacgggactacaagaaaaaaagtagacgtgacaattatcttttctgtgtttttttctcgttatctctagttttgtttgatgcgtatgtatataatttggacaatactataataaagtatgcttaataagattctccaatcgtttttatattattcttaatataaaatcaaaagagattgatgatttcaaatgatgcctacaaagaataacatccgtgtcgttaatagaattcacaaggaatttatatattctaatgtacattcgacttgaaatcaaaatcatatggacattaaacaaaaaaaaaaaaactagaaaaggattaaaaagagtaaagtaaaattttgatggttcgaaattagaccaaagcgtatgaaacatcatcttttgagtaccatatattttgcaacttcaactaattaagagtgtagtataagctgggagttttggaactcaaacatcataatccattccatcatctctaaacttgggaaaaaatcccacagctaccgtattatatttgggaaatcgtataaaccaaaataagaaagttgttaattttttttaactataattaacccgacacttagaaatgtgtatcaaaaaagtaatgcaagaattatcattgacaagtttcaacaacagaattattgaaagatttactttatttgaacaaatctcactattaactttgtttttgtcaagcctctagagataggttaaaactttaacaaactttacttaacaagaaaagactatgacttttcaaaatgcaataaaaatactttaaagaagaaaagattcctctcgtctcttcctttgttcacatcactttcatctttattttctttattaattaatcatttattactcctctttcaaaaacaaacattttttatttataaaaaattcatacggcgctaatttcaccaccgctcttcctaattgattcttcaaaatccatgattactattgacccccaaacaaaaataatataaatctgatactatttggttagctttaagcatataattctcatctataactccaatcaccaaatcaagaaccgcctttagttaataaattgttcattaattttgctaacaacaatatttgtccacattacacgttccattcataaaaaaattgactccaatattaattgtatttttttacacctcgagttttgcagaaaaataaataaaagctcacatttttattttctccctctctctctctctgtgtctgtgtatgtgtggctttaccttttgtacctaaacctctcacactctctctctctggcttgctgtttactctcatcgtctcctttacttcattcgtcttcttcctctctttcccacaagctcccattgatgtgagtttcttatcacttttctttttccgatttgtcaattccttttttgcactgatttgtgcttcgcttacacattgctagtagattccccgatctgggttttttcttattcgtgttcatcatactaaagtttggtgcttttttgtgtttgtgtagatagagagagagatttaaggaaggaatcatg

SEQ ID NO: 27018 - DNA, 3000 bp, Unknown; identical to SEQ ID NO: 14758
  misc_feature (1)..( 3000): 2750-1469P.txt file - cDNA_ID_2724601; gDNA_ID_2684224; Annot_ID_191883

SEQ ID NO: 27019 - DNA, 3000 bp, Unknown; identical to SEQ ID NO: 14758
  misc_feature (1)..( 3000): 2750-1469P.txt file - cDNA_ID_2724601; gDNA_ID_2684224; Annot_ID_137519

SEQ ID NO: 27020 - DNA, 3000 bp, Unknown; identical to SEQ ID NO: 14724
  misc_feature (1)..( 3000): 2750-1469P.txt file - cDNA_ID_2724724; gDNA_ID_2684220; Annot_ID_137430

SEQ ID NO: 27021 - DNA, 3000 bp, Unknown; identical to SEQ ID NO: 8597
  misc_feature (1)..( 3000): 2750-1469P.txt file - cDNA_ID_2724728; gDNA_ID_1971820; Annot_ID_58312

SEQ ID NO: 27022 - DNA, 3000 bp, Unknown; identical to SEQ ID NO: 8597
  misc_feature (1)..( 3000): 2750-1469P.txt file - cDNA_ID_2724728; gDNA_ID_1971820; Annot_ID_176130

SEQ ID NO: 27023 - DNA, 3000 bp, Unknown; identical to SEQ ID NO: 8597
  misc_feature (1)..( 3000): 2750-1469P.txt file - cDNA_ID_2724728; gDNA_ID_2926158; Annot_ID_139602

SEQ ID NO: 27024 - DNA, 3000 bp, Unknown; identical to SEQ ID NO: 8597
  misc_feature (1)..( 3000): 2750-1469P.txt file - cDNA_ID_2724728; gDNA_ID_2926158; Annot_ID_198558

SEQ ID NO: 27025 - DNA, 3000 bp, Unknown; identical to SEQ ID NO: 11001
  misc_feature (1)..( 3000): 2750-1469P.txt file - cDNA_ID_2724771; gDNA_ID_2214471; Annot_ID_133070

SEQ ID NO: 27026 - DNA, 3000 bp, Unknown; identical to SEQ ID NO: 11001
  misc_feature (1)..( 3000): 2750-1469P.txt file - cDNA_ID_2724771; gDNA_ID_2684240; Annot_ID_192572

SEQ ID NO: 27027 - DNA, 3000 bp, Unknown; identical to SEQ ID NO: 11001
  misc_feature (1)..( 3000): 2750-1469P.txt file - cDNA_ID_2724771; gDNA_ID_2214471; Annot_ID_183010

SEQ ID NO: 27028 - DNA, 3000 bp, Unknown; identical to SEQ ID NO: 11001
  misc_feature (1)..( 3000): 2750-1469P.txt file - cDNA_ID_2724771; gDNA_ID_2684240; Annot_ID_137771

SEQ ID NO: 27029 - DNA, 3000 bp, Unknown; identical to SEQ ID NO: 10721
  misc_feature (1)..( 3000): 2750-1469P.txt file - cDNA_ID_2724793; gDNA_ID_2213670; Annot_ID_132763

SEQ ID NO: 27030 - DNA, 3000 bp, Unknown; identical to SEQ ID NO: 12373
  misc_feature (1)..( 3000): 2750-1469P.txt file - cDNA_ID_2729568; gDNA_ID_2214546; Annot_ID_134575

SEQ ID NO: 27031 - DNA, 3000 bp, Unknown; identical to SEQ ID NO: 12373
  misc_feature (1)..( 3000): 2750-1469P.txt file - cDNA_ID_2729568; gDNA_ID_2214546; Annot_ID_185410

SEQ ID NO: 27032 - DNA, 3000 bp, Unknown
  misc_feature (1)..( 3000): 2750-1469P.txt file - cDNA_ID_2729594; gDNA_ID_2684256; Annot_ID_138119
aagaggaaatagagacagcttcccttttaatacaaagccatgaaacttggaccgggaagaactatatcattataaatcacgcacattgtccaaattcatatcagtagcagatattcacctccatgacgagaacctttgccttgagagcatcagcattagtttcatcaactacaaaatccgacgttgtatctcccgtaaaagcaacttcaggagttattatgctgtctgtaatctacaatccacaatccaaacttattaaacaggcttatatactttggaaagaccattgcaaaactattgactttgtgatagacaaacataagaaaaaattgacaagcaatattaagcaaatcaaagacaaacctcaacacctgaaaccttcaagttcttaatttcatttccagataggccaatatattccttcttgagtttatatttagttgaatacactacataaccctgcaaaatatcaaacgaaagcatgaattcaacgaagacacataacgctaagatatcgaaaatctcatgcgagtttactaaaataaacctggctttggatgacatggaatgtcttaaaggctttgactttgagatctttccttataataaactcctcccctgcatgaagaagtgtccaaggtttaacaaaaaagccaaatcttggctgcaatgaatgctagaggttgagttaccacctatgtccaagccaacaagattgtgctttagctctgaagaatctaactttctgtgaacttcgaataaactctcaacagtttctttaatggatgcgggtactataatcgttggaggcttcattttgtacaagcctctagtagcaacatacattggtaatccaccctaacataacaatacgaatagtttagctcacaatttgagaatgtaacacccaaacagtaacagagcaataggctaatataacataacaatttagctgacaattagagaatgtaacaccaacacagcaacagagcaatatgctaatgataataaacacatggtggctctcaacaagggtttatcaaaacagtaacagagcaataagctaatgataataaacacatggtggcagtctcaacaaaggcttatcaaaattgttcttaaaacaaaaagtcaaaagaaggatctttgcaaaatataatccgaaatttcaagtctttttatagaagattcaagatacttacgatatgatccatgtgagagtgagagatgaagaggaagtcttgagaaattgcgcgatgtgggcaacgaccaatgtcgaaagctatccgaagagatggaaatatgatgcacgtctcgtgcccaccaatcgacaatccctcgatcgggtaaccttcaatttgcattgctttcttcttctccatctcactgttccttagggtttatcgaattttggctgtgctcttcgttttcaaatattgatcaccaagtgttcgatgaaatgtctcacaatcacaagcttttttcttccatgatcattttttttttttttaataattttatggattgggcttaggcccataacggttaacgagactacttcactggagcgggaaccactaggcactggttaataaatttcccacgtgcctctggtgcaaaagttggtctttcgtattcaacgacagtgcaagggtatgattgtaaatttacttcgaatgcttcattagaacgtcgcggtattcttacacttgttttcgaagtaatctcgacgactataacaaaatctgagcaatttcaattaaatatctgttactgttgtattttaaaatctagactactgatgacataaccaaatttttagactaaattaccctttttcttctattttaattatcgcatttaatgattttcagctttttttctttatagattgctctcttaactcttctttaattttccctctttcgagttctgaatttttctgtaaaaattaattttagttaaactaaaaatgtttgacaaaaatactaaatttcagagaagatccaacggctagaaatcaactgcgtaagattggagttatggagatgctcgcttactttttggttaaaattagaaatattattttgcgcaaaatatttattttctctttccgtctggtcactgaaagtctctgaaaccaccaccaaagagaaaaacagttctttagagagcatcaaagctccgaggaagagagagagagacgctatggaagcattgaactaacacaactctaaatttctaatttacggtatattatctccttctttgttattgtttttgtttggtctgaatcggacttggatttagaacggagatccgacggttactccaactttaaaccgactttattttaagacattgttcgagtagtgttgggttttagaaggatctctctgtttgggatttgttgtttgactctgtcggtgttttttgtttgtttgttgttgtttttcattttggaaagtggattttgagtcatttagggttcttctttttcagtctgagttccagatctggtaatttcacttcataaatttatatggtaatcattgttttttttttttgttctttcttgattcttacatttagttatcattaggtttatctttataagcttattattagagttgattagaacaagataatgtgttactctccttttttgccataactaattaatgaattaaaagacttcttcattttgactattgtggtagactagtagttgccatattcacatactaatattggcttgtgttgtttcttgggcaatgcaggtttgttttagttctatacattatggggaagtctacaaaatggttgaagaatgtattgcttgggaaaaaaacttctaaatctagtggttccaaagacaaagaggtaacgcttttgtaagagaattctatattatgtatgtgatgattaaatactgtatgtggagaatttggatcataattgagaaaacagtgatggttttaggctaccaatttgcttatg

SEQ ID NO: 27033 - DNA, 3000 bp, Unknown
  misc_feature (1)..( 3000): 2750-1469P.txt file - cDNA_ID_2729623; gDNA_ID_2684256; Annot_ID_193134
agcttcagggaccagtcctttctggaccatccgatggataataccggcagcctcataaactctatcctccacacaaagacagtttattacacgtccaagcgttgtgagagatggaataaacccattttccatcatctccagtagaaacttgtaccccaaattgacatttcccgttttgcaaaaaccatcaaccataagccggtatgtgtatccatcaggaccaagacaacgatcaaccatctcttggaaaagcttttccgccatagtaacatttagcttctcagtgaaagcatgaatgatgatattatatgttggcgttgaacttgaaaccttataagcctcttccattttccggaacagcgtgtatgctccatccaagtctccgtttttgcagaacccgtcaatcaacgttccaaatgtaaccgcatctggattcacactcttgtttttcatttcctccaataaccccaaggcttcatctagtttgcggtatctacatagactctccagaagtatattaaacgtgaataagttaggggcacaacctttctccaccatagttttatatgtttccatcacatcttcaaactttgaagttttgcagagaccatttaacaaagagttgtaagtgtacacgtcaggatcaacaccgttgtccaacataacatctaatatctcaagtgcgttttccattttcaactgtgtagaataaccatgaatcaaaatgttgaaagtaaatatgtcaggaaagtaccctttggagatcatgactttaacaagaccatcagcatcagaaacacatcccatcttgcatagtccatttacgagtatgttaaaagtctgtacctcaggaatcaaacccttttcagacatttcattcgccaactgagcagcctctagaatcataccctggttagacaatcccttgatcagtgtgttgtaaagaataacgttaggctttatccctttccctaaggcctcattaaataaagctaaagcacggtttgtttcaccttcatgacacaacccgtcaattaaggagcgatatgtgaactgatcaggcacaaatccattgaaaacagcatcacctacaatcctttctgcaagttgtaccatcccacctttgcaatatccagctattagtgtgttataggtataactatcaggctcaagcccttcattcaccattttccccaagtaaacctctgcctcctgaaacttggaattcttacataagccatatataagattgttatacgtgatgacatcaggtttgggtccctgttctatgagacaacctaccatacgaaccgcaccatcaagctcacctctctgacaaagcccttgaatgaataaattataagtaaacagattcggtaaaacacctcttttgataaccttatcaagtagtttttcacactccttaacatctcctttcttgcaaagaacacgtagaagcttgttgaacgtactaagacaaagcgaaacacccgatgcaagcatcttcccaaacaactcatatccctcagccttaaaattctcctcataaaacccaccaaccacagtacaataagcaaccacattcatctcacagccttgagaagacatattattaagaagcctcaaagcagcgtgaggccgactggtcttacaaaacgacttcatcctaatcgtaaacgagtaaacatcaggcgtaatacctctatcccgcatcctcatatacaccttgtgagcttgatcaaagtaaccactatcaaccaatacactcataatagcattataagagaaaaccgtaggctcacaatcataaaaatccatcctttcaaacacattaacagcttcttgaactttccctttcctaccataattcttcattgccccaacataaaccccttcaagcatatggttaccaacattctcccgcatatccactaaaacctcttccatggcttcgaattttccataatatccaagcttttcgatgacactgcggtaagtagataaagtatgcttgaaaccaacctcttttctcatcgaattgaacatttctagagctttcataggatccttctgacattttataactgcagttacatgtttcggaagcagaggaggacccataaaggagaataatcgtaacctaatgaaaatactttgaatccctaaaatccagatacgagagaaatagcaaagaagacagaagaaccctagacaattctcagcggagagaataaaatcgagaaaaaggtagatcctttctcaatgaggagactcagaaaacaactggagaaatcaattacaatggatgaaagtaaagttcactgatgagcttcaacggctacaacgctgggagtagtaaacccatcgcactcggcgaagaagcgcgtaggaataatttgaataaataattatgttttctttctagaacacaaaagttgatatggccgagttggtctaaggcgccagattaaggttctggtccgaaagggcgtgggttcaaatcccactgtcaacatttcctttttttttttgtttttttcttctcaaattgttttattttaaagtggatatattttgtcaagttataatattttagagcaataatgttttagtggtcctgaagtaaaatcatacgacacaaaaagggaaaaattaaatgacttaatccgcttttattaaatcaactattttaataggataacttaaaaaagcaagtgaagagaaaattctaaagtaccctaatattgatttttaaattgactaatatacccttatttgcttcagctggcgcaacctgattggtccacataaacccctcaaaaccctaagttcccttttgcccactctcacacttcacaagcataaactctcatcgggagctagggttttagctgattctcttgtgacggaaccacaagaagagaagagaccaaaaggaggagccaaaatcctctctttctttggaattagggtttcctcaaaggaagtgaactgaaaatg

SEQ ID NO: 27034 - DNA, 3000 bp, Unknown; identical to SEQ ID NO: 27033
  misc_feature (1)..( 3000): 2750-1469P.txt file - cDNA_ID_2729623; gDNA_ID_2684256; Annot_ID_138108

SEQ ID NO: 27035 - DNA, 3000 bp, Unknown; identical to SEQ ID NO: 15040
  misc_feature (1)..( 3000): 2750-1469P.txt file - cDNA_ID_2729657; gDNA_ID_2684256; Annot_ID_193119

SEQ ID NO: 27036 - DNA, 3000 bp, Unknown; identical to SEQ ID NO: 15040
  misc_feature (1)..( 3000): 2750-1469P.txt file - cDNA_ID_2729657; gDNA_ID_2684256; Annot_ID_138096

SEQ ID NO: 27037 - DNA, 3000 bp, Unknown; identical to SEQ ID NO: 15031
  misc_feature (1)..( 3000): 2750-1469P.txt file - cDNA_ID_2729691; gDNA_ID_2684256; Annot_ID_138085

SEQ ID NO: 27038 - DNA, 3000 bp, Unknown
  misc_feature (1)..( 3000): 2750-1469P.txt file - cDNA_ID_2729695; gDNA_ID_2684097; Annot_ID_190170
acgtgattagacacttttttgaaagtttatccgtaattaggcactttgaataattaaaattacttgttcaccctcatatcgtcggttttctataaccaaacaaatcaaatccattttcactaaaccaattcagatttacggagcccacgattttgtagttgcctttgtgatttcaattttttttccagaatcgtaaaaatccaaatccaataaaaaatcctaaattacaatttctcgaaaaggggactccggcgacgggatatccatctcctccgtcactgtccaccaccagtgcttttcacactacactctcgtttgctctttcaaccgtaaaacaccaaacccaattctcttgtcatttcctctaaatctctgcaatttcttaaatcgatttggatttactttgcctgaaaaacccttaactcgtaccgtccaaactcaatttcaatttcaattgaggttacttcgagaaaagttcaagaatttcggaacaactaaggtaaagttttgtcatgttgacttcggagatcttgttcgtaattctgtgataatgtttgataacttctctgcccagtttgtttgaaattcagtacttgaggttctctattggacagaagatgaacatatggactacaacacttggacaatccgtaatggacaaccacacattttgtttgcagcgtatgtgtcgttacaaaattgaaaatcattgtccacgactatacatgactgcacaacttggtgtttgataattcaaggaaaaagccacataaaggttctatttcttaatcttatattttggaagaaatcaaatcattgatttaagaaataatatgtaagcttggatgctagagctttagctgatcgtatggccagatttggatattgatttaactttgttcttactgctactcaacattgattgtctggtatgaagttgtaaaagagtaatttgacttatccatttgtgttgatataattagtcattataatgtgattagtcaatagaaaaccttagagtacataatatcaaacttttaactttgttaatttctttaggcgagtgggtgaatacatcagttagagttgcttttgcacatcatgtgatcatcgttattgatgtcatccaaagaaatctgtccattcatacgcaaacatgaaggtactgttgtttggacactccttactttaaaaccccaccttagtttgcaagtcattacttgactaatttactttaaaaacaaaatttaggttatgaacattgtgtcagatcctattttcgatacaagtgggaacatccaagtcaacaaacctacaatggggtaccaaattttattaatcgtctgctccttgttacgttggacatgattttttggatactttcttacattttttccttattgaaggtcgtgtttcttatggtttttctgaccatcttcatttctacttcaactcaatcagaacattttggagaggcttcctgcatcccaatcattgaaagatccccaaactgaaaaaaaattctaatgaacaaatgaaggtctacatgtacactaaattatctttatgatttacagtccttgtaatattggacagtattttttggatagatatttaaataatcttcttattggaggcatcaatttttgttggtgatctagtatttgataccagttccaaacttgaccaacatactcaatcatctcccacacataatcccaaagttgggttatctccaatggaagtatttcttatcatctacaactgtctatcgatgcactctatctatcatttgtaaatatgtcttagtaaagtatcataatttcacatcatcattatcatatctttcagtataaaatctctctctatcaagatatggatctacacgatgttgtggataatcaggtaggcataaaactaaataactagaacatgtatatttattattactgaaaagcagtcaatttttactacaacattcttagttctattattaattgtttacagaaaacataagattgctatcaaagtcttgttagttatgttgtgaaaccaatctctgaagacctaacataacgcaagttagttatgtttgcagataaatccatcttctcgtccgtttaattgttatatgatcggacggtcattatttctcattaacttctatttaaactgcaaatcttaacacgttcatttgatccgaattaacccattattctacacgtgtttggtacacacaattacaaaccaaaaccaatgaccggttattcttcttttcgtgattcagtttatttggggtataatggtctattttcactccaaaaacaaggaaaagtgtctcaaccttggaaagtgtctgttttgtctaaactttttttcaaagtgccttattacggaacattccctattaattatataaaagatagaaaaattattttcactgctcaatccacttcttaaccaacctaaatttctgtagctactcaaataagaataatatcttatgtgattataaatcaaaattaaaaagttttttcttacgtaataattatgtttattacgctaatattaacatgtaataattacaatcaccagcttcatctttaaatcagattctctaatttttatgtgttgagatatagtatatatatatacacatttatatctataatagtaaaacaatctctttctccttaccaatcacactgacacgtattagtccttaacaaacacaaaaaatcctaagctcatgtgtattctttaacaaacttatgtttttttatttaattttttgtatttttctttaggatttgttctaaaaaaaaacttctaaaactatcaatatacatgttctaattaaaaaatatatatatttaaaagtcaccattggaaatgtccttactgtccttacagatgagtatttgagattactcttgcctgtgccctgagaattttttcctttgggactcactgagattactactaccaaatccaacaatg

SEQ ID NO: 27039 - DNA, 3000 bp, Unknown; identical to SEQ ID NO: 27038
  misc_feature (1)..( 3000): 2750-1469P.txt file - cDNA_ID_2729695; gDNA_ID_2684097; Annot_ID_137065

SEQ ID NO: 27040 - DNA, 3000 bp, Unknown
  misc_feature (1)..( 3000): 2750-1469P.txt file - cDNA_ID_2729730; gDNA_ID_2684098; Annot_ID_137076
tacacttctatctcaccttgtttcctaataacacagcgcttcacacccacgcgccgtcgtcgaaggtggcatttgaagtaaacccttgttcgaagaaaggaaaatctaagcagcacagtcacacacacaagttatgaatcatgaatgacataaaattggatctgagttttagaaaagaaaagacagtgttgagtggatcatcacgtgcgtgtgacacgcgtcgccgtcatcagttttggagtgggacactatcgttgaaactaaactgatctacgccattcattgtttgtgtctctctgacgaaaggactgaaatcccgagaaatcagtttttgtttcttcatataacacactttgacttttcgagagcgtttgagttatgattatttgtacaattacagtcacgtcatggtcaacgcttcgacttaaatcggggatatttccataccacagaagatgagaacggtctttaaacaatgtcgtgacggctctaaaacgcaccaccgtaacatccatgtaaaagcacgtcttcttgatcgctagatacaatatttacacaatatacattttgtcacgtgaatcggtgaatgtgatttttttttgtaatcgattagtatgaccatgcacaagattaacaaaaaaaaggaggctgggaggctggttataaaatattcgtaagatagctactatacatgttttgtcatattgagccacgcataagatgaatacagctacatttatttttgtgtatccatatttttatcctgatcgtgttttatcttcgtacgtttaccttttttgaattgatcaaccggtctaaggaacattcggctctaagctatcgacaagtttctttcattcatccgagacacgtatgacttggaaatgttgagttaagtctgacgtgtaaatttgtggttgtcatattcgaaaatttagtttcaccgcaacacgttttataaagtttatctttttccattttagatttaatcaactgtgtttataaaataaaatcataaagttacattttagtaaatcaatgcggcaacattctgatttcaagacatactaaaagtctttacgtaaatttgaattttctattcattataatttaaccaaagaaaagaagcttatgcagctttggacggtttcgaatgatttacagaaatacatggtatcatatagcccaataaatacaaacagacatcgctggtgccagaaaaagtggaatagtcgatttgaaacttctaatagaaagaaagacattatgtatgaaaaattgcctcagaaaaaaacccagcacaatgtactgtatatgttttatatatgtatctatagaaggaaaagataaagttgaaaaatatttcctccaaaacatttgcagtgaaaatatatagatttgccatctaaagtcttttaatatctcttattaaaaaaaaataagttaatgtatattacatcaaaatttatctagtatacaatttcctctaaaataaccaataacatgaaataaaaatgttaattaaattaaaatcaaataattaatttcataatatttattcaaatttaaattaaacagctagtaagaccaattaatttaagcaataaactaaaataaatgtaatttcaaaacctatctgacaaaagaaatcattaattttgattatttaaatttaaatatattttaacaactttaaggccaaaaaatttataattagttgtaacacatacatagtcaataattataaaccaaatcataaaatatatgaggcacatacttttttatttttaattgagattttatatactagattatataatttttaagtggaaattgtttttaaagagagatatttgttgggttacacaaataattattggttttaagtgttttgcattttgcaattactagaaaacaatatattttagagtatctaaagttatattttgcacataattaaattttatataattgggattttatatactaaagagtgtcagagtttttaagtgaaaacatattttagacagggacatattttgaattacactaataataaatgcttttgatactttttcattttataattattagaaatcaaatatatagatactttttaattataccatgatttcaaaattaattatgtggtaattactaattacattgttaactaaaaaaaggaaaaggacataaacacatacaaacacaaaataaagtttttgcacatttttcatgatgattaatagtcagtcttacaaatatatctttcctcttttcaaaataaaataaaaatcaggtggattctcaatttgacaattagagtggaaaacactaattgaaatttctgtaaagagaaagaaagtatattcgaaaaaaaaaaaaaatcagaagaagaagaaaaaaaaggctggcaaaaaaagaagaattttaaagtggctaagcagaaaaaagaaacaaaactaaaacactttttatttattcctttcagcagtcgccagctggcattatacgttttgccacgtgttattttctcaatgaccagtaatctaatgacgtggcacccacttgcttcacgttccacttcttctccataaatacagctctcacaatctcttcttcagctttctccattttcacctctctctctctgtgttttttttaactccgtttaaattttccgtctgaattttacaaaggaacactaatgtcagcttttgacggcgttgaaaatcaaatgaacggtccagattcatctcctcgtctctctcaagatcctcgtgagcctcgctcattattatcatcttcttgtttcccaatcaccctcaaggtttcacttaacaaaactcagattttcaatatttaattcgtattttctaaaatttaaaccacactaatctattgttgactagttttgactctgttcttgactctgtttttttattggtttcttgatattagttcgttgatgtgtgttaccgagtcaagatccatggcatg

SEQ ID NO: 27041 - DNA, 3003 bp, Unknown
  misc_feature (1)..( 3003): 2750-1469P.txt file - cDNA_ID_2729738; gDNA_ID_2684098; Annot_ID_190196
gccttaagcttaaagatccaagcttttggatataatatctagttacatgtatatatatatatatgtgtttgtatatttataggtatatagtatattatcgtgtgcgtccgtgtgtaacatcactatcattacccaacatacagcttttggaatttcattggacccaagagccattcgatccctttcttataattaaatataacgaagcttgtaataggctttggttttggtcccaaatacaaaactttaaggttgtgccttgtttgtctaaggttttcgcaatagcttccaaaaagacacgcttatgtttatatacatttcattttccttcatatcattctcttctctgccacttctccatcttgtttcttactcatttctctaacaattttccaaattaaatacgtttataggatcatcgtggatggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaaggtaattatattaatcaacgtggattttgtataatgattatcattgattaatcctttgcatggaatgacagtaaattgtctagttatgacataagttttgaaaaccaataatatgtgatgaatttggcatgcgaagtgattgagagagcctactttctttgacttgtatgttcataaacggagtgtgaaaagaatttcacaaagaaattaagagatgtatagtacaatcataaatcataatacttcttttgaaattaaaccggttgaaaagtataatcatatcacatttagaaattactttactacataattttcaatattctcttttttttttaaagaaacataaaatttctaatattttgaccttttgtaatgtaagaaatttatgacattaatatttagttttacatttgcagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggtatacacattgaaagactctgactgatacgcgattcactatcaaagcaatcatccaaaaactactaataaatagtacaatacatactccgtctatcaaacctaagcaataatgttacatgtttgacgacatttgattcaataatgtttaaaattaaaaaaaaagaaaaaaaaaaaaaacaggactaaatcaataacttgttatctaaataactttatatgtttgtgaactataggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaattaaaaaaaaacacacttctatatattgatttgtattctatgatttaattgttccatctggaaaataacatttataactgtctatttgtaaaagaagtttgtgtttattacgtagaaatttgttgttgaatttcacaaaggtggatttgttttttttaaaaattagtccctttgtttttctattcatttattctgttgtccaaatttgtaactcatccatacattctacccccattaattttttatttgagtggtggcctattagttaagagaacttgtaatttctgatcagactcctaactttcaaaatttcaaatcaaacctcaaatttgtaactcaaacccaaaatgcacgatttgaatcgaaatcatatgttcaccatgtatataattaattaatgtacgtattaatatgtactacaaatgtttacatgtgaagaaggtgatgaaaaaaaacaaaaaaaaaacataaacacaaaaaactttttattcatattttttaaaaaattgaccatgatcaatattgagcatataataataaataaaaaaaatgagttaaaaaataaatttaattgagaaaccctctcatcgagtaagaggtttcaattaagaagtccaagtcaaaaccttctgatccacgtagaaggtcttaaaagccaccgtcaaaaatctacaaggccaacacgtttgccgttaaaaattaatttctaatttcttcttcttcttcttcgtacgttaattaaaatctgaagaaacaaaatcgtgaaatcgatctctttaagcatcatctagggttcatcactgaaatcaaaaatgcaattaaatctctacaaaatctctcagatctaatcccagatcgttgttggtttcttctccgtaaaccaatcccacatatgaattaaagattcgatctcgaaatcgttggcttttgttgttgttgcattcttcggtgatg

SEQ ID NO: 27042 - DNA, 3003 bp, Unknown; identical to SEQ ID NO: 27041
  misc_feature (1)..( 3003): 2750-1469P.txt file - cDNA_ID_2729738; gDNA_ID_2684098; Annot_ID_137074

SEQ ID NO: 27043 - DNA, 3003 bp, Unknown
  misc_feature (1)..( 3003): 2750-1469P.txt file - cDNA_ID_2729742; gDNA_ID_2684098; Annot_ID_190195
tatgattagagaaaggaaaattagggatcgagggacatttatataacgaaaaaagtgaatggtgtgaaagggttaatggatagatggtcttgggatttgaacaaaaggctctctctccctcgcgcagtagacaaataggcatgcatgtgaatctgactccaaatcaagtgctacctcttttgccttttctatttttggtacccaatatttgttataattttcattttttctgttttatatatccattctcctcgaattctgtgtctaccttgtcatatgttaagtattttggatttttctttggactagggtcaaagagttactgagatgacgtcaccttaagccgaaaggtgatgaggtaaaagaaacgacagccaacggctttgggtggacccgtgcaagcggataaatcagatgaggaacaaatgattagttatgtgatagaaacaggtctgaatcttacgtgtcttacattcgtaatgacacgtgttaaggacggcgccaccaaaccagacaatgggagctggattgctggagaaagacttaagaacatatgaaacatattcctgtgttttactcttctccttattttttctttcataatataatgttcatatatacacgattcctgatgttttaatggccaatgttcgttcctttaggtttactataaatctgagtttagtttaatcatttaagaaaaagttgagattgtggtttcgagtggatctagctagactcacattataaaattagctgcggtggtatattgagtgagatttacgtagtaatccataaatgtacatgcgtgtaaatcctttcgacgttgagatgtttatatacttaataagttaatagtaatatctctttgacaaaaaagttaatagtaatatctcaacaactttgaggtattacgtgtcttatctatgggttaataagacatactaaaactaagacacatttcatcagtacctgatccagcaaacatataggaatatatttctgtagttcttcttcgggtttacaaatccagtcctttttaatccttgaattgtgaatttccaacaagccactcacaatttataactaggttttattactgaaaatatcttacatggtataagaatttatggtgtgtagctgaacatagtgttttaagaaaatagattaattatattcaaaacgtaatttttttgtcatctgattttattgataatacatggaatcgtgttatgaaatattatccaatcaaactgaagtttttggatatattcggaacatccatttgacctaattacgccacataaaaaccgttaatctaaaggatttgtcttgtgtgatgtaataataactaatgagcaatagacaaataaaaaaaaggtttggcttgtgcagtaactgccggtaaagtggagaagattggaaaaactttaaacaaaaaattgcggtaagagagagagagagacgccgaccaaaaacaaaccgtagatgtctatcccacgcgcaatcaaacctttccttcatctccttcttcttcttcttctccttcttcttatatcatcattttgcacccacatgtcacacacttaccatatacatataattaagcatactcgcataaacctatatatacactctaagatttctagctggtccatatgcatgtgatctaatcaaaagccaaactctccttgtctttgctatattaacaatcatttgatccacaccaccagagatttcaatcttcctctccttcttccttttgctactctcttttagatcgttcttgtgaaaatcgcttgcaaataacaagcccttcgtccaatctttattagctcgtaagtttcaccccattgctccttttagggtttttttgttttgttgctgtactcacttcatgcacgaaccagatgatgatacatcggcgtttgtgttttacgtttttattattcaaaaatacatacatattacatatagtatcgttttgtatcgtttcatatcttgaatagtatacatgtgtgtggtcctgttgagattgacccacaaatattagagtaaactggggaattgaaatcaatcatggtggggatttcggaatctatgtgtgtttctaagatattattgtttcttggaaattaattgttgttgcaccataatataatttatattatatagatagtctaggaaaataactcaagacaaagagtgtgtaacacactccaacctcagtgacttccacccgtcaagcttttcggctacatagcctttatatacgattattttacatatagttacagatatatacagtactgcttgtatatttttggtcttataatactaccttatgtcattatatatagtacatattatacaaagtttcaatcttttcatttataagcatcgttcggtatgtagaaggcgaaacaaacccttaaacctaatatttttttctggtccaaaaactttctctatcaagcttttgcattttttcttttaaaatagtaacagctcctccattgttgggtggtcccataaaaatacatcataaccatcatcagcaacatataatagcgatagccttaagcttaaagatccaagcttttggatataatatctagttacatgtatatatatatatatgtgtttgtatatttataggtatatagtatattatcgtgtgcgtccgtgtgtaacatcactatcattacccaacatacagcttttggaatttcattggacccaagagccattcgatccctttcttataattaaatataacgaagcttgtaataggctttggttttggtcccaaatacaaaactttaaggttgtgccttgtttgtctaaggttttcgcaatagcttccaaaaagacacgcttatgtttatatacatttcattttccttcatatcattctcttctctgccacttctccatcttgtttcttactcatttctctaacaattttccaaattaaatacgtttataggatcatcgtggatg

SEQ ID NO: 27044 - DNA, 3003 bp, Unknown; identical to SEQ ID NO: 27043
  misc_feature (1)..( 3003): 2750-1469P.txt file - cDNA_ID_2729742; gDNA_ID_2684098; Annot_ID_137073

SEQ ID NO: 27045 - DNA, 3003 bp, Unknown
  misc_feature (1)..( 3003): 2750-1469P.txt file - cDNA_ID_2729746; gDNA_ID_2684098; Annot_ID_137072
caaatggttcaagaagatcgaagaaggaaagaggagcagcgaggatgagatcatcttctccaatatcggtaaatatgctgtgagttcaagcacacgccattagcacacacccacgcctaaacccttggtgtgacagttaaaattttataaacaagagatgggttttgcctaaattggtcttacaagcatctataactaaaggtttcaattcaagatttgcattattttttattgaatcttctatttttcttccttagttggtttgaagctttaaaccctttgaaaaacaagaaatggagactttgaaagttgacgaaacacacatgttttattattagtcaatagtaatttgatgaggtggagttataacattgatgataatagatagtgacaacgttctatgttcatcttttcctcaatcaatcactccaccggtagatgagatgtcaaattgaaactgcgttatgtcactctcattactctttttgtatacgtttctcatcttatagctaatccgaaaccaatttatttaaaactttataatagcataaaacctcttaacttcaaacaagtttcaactttcacatatcttatagggatcatggtaaaaatggttaaaagttaaacctgatttgcattacaaacagaggattacgtgtataagggctataaactatatattacctaaaaaagaaaactagagttgacttattgagtaataaaatcgcctataaatatcgtaacgaaagaaaaaagatcccaaaagagacaaaatattaatttgttaccatagttacagatttctttcgaataatcaatcaataaacaaaactctttctctacaagtcctaaaatccttagagaaagaaagaaataaaatagaataagagaacttgttgtagcagttgaagcagaaaataaacagagtaacgaatccaacatcacaaaacaaaacacaaactgtgtgttgtctctcttctttggtcttctcttcttcttcttcttctttttctttttaagtatttttattttttggtttcttgatctcagaaaaaatggctctgaatagtgtctcctctgaagaatttaccttcccatcgctagcttctcatgattcttctcaccattccggtcttgattcacctcctttgtggaaacactcaccggttacttcctttcgccggaaagattacgactttggtttggcaagattagtcattggaaaagacggtgatcatgatcagaggaagagcttctcgtacgtggagatgagaagtcgttggatcgacgacaaagaagaggagaaaatggatatgttatgggaagatctcaacgaagaattgcctccaagaagtcagagtttgagaattgtacatggcggcgacggtggagagaagaaaacggctttgtttcccgatgagagctctgccgtggccgtggggtgtgggatgaagttatcgaagaagacaaagaagaagacgaatctgaacgttttggtgttgatgagggttttgaagaagcttattgtgttgcgaagttcgtctcagaggtcgccggtgaaaactcatccacggtgattgatctccaccgtgataattgtgaattggggggttattttgtggaattcagaacttacggggcttttgtggagaaaattggaattgtctgaaaatgatttatttgtagtttagtttgggtggttcacaaaaattaattttagggtcctaaatttttaataacacatctgaagtcttttttggttcttcgtcttgattcatttgcctgttccgtggggtttggtttgaatatgtatgaatttataagatgaaaaatgaaagaggtcagaatattagggtgcaataataaaggaaggtaaaaaagatttgtatttgaaacattccacttgtatatgatatcactttttaaatgtgtgataaaaaagatttgtaacatctaaaacttttgggggtctttattttaaaatgagtctttatgaaatacaactttagtctgaatcaaaaaggttttctaaaaatgtcaaaatgtttgtagtcttgtacacttactcactagtcacttggttcatgccacgaaccgacctccctaaaatatttctccaatttgttttctctttaagttcacaatagtagagttttgttttctccctaaaagttatttcgaagaaaacatgttttttctttttcctttttaataaatcgaagattctaaactttagtctataatccctcgaaccgaaaattagaatgaattttaatcctcatgggaaaaaaaattgtacagtagtttgttcttctctttatactaacgtgaccaactacttcttggtttaaaacaaacatgtttaaattatcaatttactaaaactatgattctatagtaacatgtgaaatgagaaacatttcaatgtcaaaagtctggtccaattatcgaactacataaaaacattgtaataccttttatatatatgaagaccaccattaatgtcgacagaaaagatagccatgaatcatattcaagcatcaaaactgatttaggtatctccggaatcattgggagaaaaattaggtgaccttcatatgaaaaagatagagtagacttttttatttaacactacttggaagactttcttacctactctcactatagacccgattcgtcagaaccgggttttggattcaatttcggataacccctaaattggtacgccaattctcagtcactcggaaaaaaaaaaaacctcacctttgtccacgaatcgcaagtgggtcatagaaaaatcgaagcttttgactgatctcagtcactttagtctctctgcccacgacccttctcgtctactaagggttatctccatttgcccctcttcctgacaactttcaggtattacttgtcaataagatgtgaaattgagtatgtgcatcagatgtttcctctagattgaactgattccacctttgatatgcgcagacacgaaaactgatg

SEQ ID NO: 27046 - DNA, 3003 bp, Unknown
  misc_feature (1)..( 3003): 2750-1469P.txt file - cDNA_ID_2729754; gDNA_ID_2684098; Annot_ID_137070
gttaccacagtgaccgatgcgagtccagattcggtcgccgtcgtcctttcattgccgccggagtcgcactcgtagccgtctcggttttccttatcggattcgcggcggatatgggacatagttttggagataaactcgagaacaaggtaaggactcgagccattataatcttcctaaccgggttttggttcctcgacgtggctaacaacaccttacaaggaccatgccgtgctttcttagccgatttagccgccggagacgctaaaaaaacgcgagtcgcaaacgcgtgtttctccttctttatggcggttggaaacgttttgggttacgctgctggatcttacactaaccttcacaaaatgtttcctttcacaatgacaaaagcttgcgacatctattgtgcgaatctcaagacttgtttcttcttatccatcactctcctccttatcgtcacattctcgtctctatggtacgttaaagacaaacaatggtctccacctcaaggagacaaggaggagaaaacatcaagtctttttttctttggagaaatctttggagctgttagacacatgaaacgtcccatggtgatgcttctaattgtcacggtcattaattggatcgcttggtttccatttattttgtatgataccgattggatgggtcgtgaagtgtacggtggaaactcagatggagatgaacgatcgaagaaactttacgaccaaggagttcaggctggtgcattgggattgatgtttaattctatacttcttggtttcgtgtcacttggtgttgaatcgattggtcggaaaatgggaggagctaaacgactttggggatgtgtgaatttcatactcgccataggtttggccatgacggttcttgttactaaatcggctgagcatcaccgggaaatcgccggtcctttagccggaccgagcagtggtattaaagccggagtatttagtctctttaccgttcttggtatcccattggccgtaagtacacttttgttttgtccttttgttttcttcacaattttaggtttgtaaccgattcttttttcttgtgtaattattatgacagattacttacagtattccatttgcactagcgtccattttctcaaccaattccggtgccggccaaggtaattttcatttatttaaaatgttaagttacaaatctaatggtcagattctgataatgtaggacatattagcatttattgagttcaaacgtttgatttgaataattaattgaaaagattatgtttccaattttgtgtattattgtatctatctattcaaaagtaattctttcctttattgcataggagaaaaaagggagtaaatatttcctttgtaacttttttcaaagtcttttcttgttaatgtggattatctaccaagtttatctatagcatttaatagggtgagatttattaacttaattatattaattaagatttctatgtaatctgctcttatattttcattatccataggtttcatcattcatgcacctaatgtttgaaacgtagacagtttcttttgcaacataagtaaatatttaaatttaacgaaaacgtgtttctttttacaggactttcattaggcgttttaaatatagcgatttgtataccacaaatgatagtatcattctcaagtggaccattggacgctcaattcggcggtggaaacctaccttcatttgtggtcggagcaattgccgcggcggttagtggagtcttagcgttaaccgttttaccttcaccgcctccggacgcaccagccatgtcaggggctatgggattccattagttaactagtttttacatatatatgaatttccatctaatacagtattgttgtgcaaaagtgaaacccccaaaaaatggataaagtgagaaaaataaaccttggtcgtctgtcttttactgttctttagttttttttttttttttacttttgttattgatgttagtcaatttgttttcgttttgtttggacgttaataaattctgtgtttgactacaatttttttactgttttttttgcttcggtgaaagaaagatccaactagagaaaataatcccaaaacaaaaaatcaacattcaaaatctgagctcttttctaaaattaaattcaaaacatgaacttattctatgtaattttttttttttgttttaaagacatggccaatgggcctttcactcttgtcaaacccatttgagtcgggctttagtcataactcattttaaagattaaggaatatgaggccagttcttttgtcacaatcctagtttaagcttgtctcacttaccaattacgtctctcaaaagacaaattttaaaaaatctataatctctactctctaacatgtatatatatatgataaactcgttggctattacaacttttaaatcacaaatggcctgattggaaaaaaatgtatacataaatgataagtttgtcactgattaatgcgagaaaattctaattatttgcattaataaaattagcgtagttaggttttaaaaaggtttatacaatacattatacatatttataaatttaaatgtttttaaatttatattaaatttattttattatttagataaatcttaaataaaaagaaaccaaatattatttgttattttttcgtgaaatttatctttttaatatattttttattttagtaaaaagaaggaatggtggcgccggaaactgaccgtagggtcagtctaattactctctcagcgtttctctttttggtcctcaaatcttcaccttcaagatcttcttcgtccctcgatctccgatttcaaatctcgtttctccgttcaagcaacctctctgaattcctagtctcacagcaggaattagtactcggcgaagcgatttctgcttcgatctctacatctgaagttccgatctgacgaaatttagggttcgtctgggtcgaagttaaataggaaaaagatttcgaattggcttgagaatg

SEQ ID NO: 27047 - DNA, 3003 bp, Unknown
  misc_feature (1)..( 3003): 2750-1469P.txt file - cDNA_ID_2729758; gDNA_ID_2684098; Annot_ID_137069
gccgaggatcaccggaaaaccgccggtgatttagccggaccgagcgctagtgttaaagctggagctttaagtctctttgctgttcttggtatcccattagctgtaagtacacttttgtgttgtcttgttaaaaaactttttgctttgcttaaactaacattaatcgattcgttttttattatttacagattactttcagtactccttttgctctagcatccatattctcaagctgctccggtgcaggccaaggtaaatatatacatctttaatattaaagttactaaagttacaaatatgtgggaccgtaactattatattttggtttcatccaccttatgcaattataacataggtatttaaattgtttttgtgatgttttgatttacaggactttcattaggagttttaaatttggcgattgtgataccacaaatgatagtctcactaggaggtggacctttcgacgccttgttcggcggtggaaacttaccggcgtttatcgttgcagcaattgcagcggcgattagtggagtattagcgttaaccgttttaccttcaccaccaccggacgcacccaaggcaacgaccatgggaggattccactagtttactattttttttttttaatgaaactcatcaaatacagtattactgtgcgaaactgcaaaaacccaaataaaagaaaagaatggataaaatgataaaatctaataaaccttgggtcgtctgtatttcacccttttttagttttttttcttctttttttataacttttgtcacttattttaatttgaaatagaatgttttttttttttgcccttaaataagatttgtgtgttgagtacaattgtttactgtttgcttcggtagaacaaatatccaactagaaagtaattccctctaccctcagaaaagaaaattttgataataatgtatggcaattcttttatatatagggaacaagttgaacaatttatgtagtttagaacggtttaggcgataaataaccattaataataccagttaaattaattaatatgattaataattttaaaaatacttattaataaatattaaaacaattctcatgtaagtacataaaatataaacctagaagatattaaaatattaaatattaaataagaaaccttaaatattcttgcaaacaactagtccaatcaatatgacatttttgtattctataaacacactgtattataatataaactatacagtatgtttcttagcacagtatgacacttaacaacttgatgatttatactaggcaacaaccaatgtttttgaagatcatacaatatcatttataagtatatcattttttatattacaaaatgaaagattgttttggtcaacaatatgcgggcttgaaccctcagtggcgatacaacattttacatatctatatataagttttttccaccaatttttagaatatttgcctaaaatataagaatgtttatactgcttaattagtgagtaagaacaggtagtccatatccattttatacaattcggactcagttgtcacgacttcgttaattggcaactttggcaagtatgttgatttcagaacacatcgaatcaacaaaggacagtctattgtgttaagttgcaaacgatcaaaacaaggctggcgtaacataaatgaaggcctttgggctaaataaatataatagatacatcaaaatacaactttcaatttggacagacttgaagccttctataatttggcctggatcaatactccttttaagactaaggtgtatcagcccagtcttttgatttttgattattttttttgtaaaccgaggcaagatttttgataggcaataatcctactttataatacattcggagtgtgtattcaattaaacattttaaatgatttgtgttaaaataacaaattcagcctcacaatttaatgttaaggatacaatcatatcatcctttcattacctcttatgcaatttaccacaaatgattgaaacctcttattcaactagaggttttgaaatattgatatatatatttggattttgtaaataattaaggtttttaaattatgtcatttaattatttgaaaaatgagggtaaataagattttgtacatgactttttttaaggagttttaagtttggcaattgtgatactacaaatgatagtagtgtgacagtgtcaccttggattccattaattttctatgttcccttttcatgaaattcatcaaatagacaaatacagtattattgtgcaaaacccaaataaatgaaaaggtaaaatctaataaaccttggaccgtctatttcacccttcttttagtcttcttactgactttaatttgaaatagaattggtttttgtttttggccttcagtaaacattgtgtgtaactaaagtcttcttttgttaacaagaaagacccagaagatcacactagagaaaataagtcctttttatggcacttctttttgaattagatgggggaaaagttgaattactttactttatttttatttaggtaaataaattacttaatatgacttcaaaaaatagacattaaataaaatttgttaaacttaattaatttgatatttgattaattcaaattacttagaaacattttaattctcatgtaaagatactgaccaaaaaatattaaaaagtatatactactaaaataaggacgtccgttaaattataaaccttaaatattcttgtaaacaactaagtttagtcaactaaaaaaaacaaaacaaagaggagttaatgacctactgccacgtgtcctcacattgtcatgcactcacacaaatgagatttctaactgcgtctcttatctggaaaataatctcattccttcttcttcctcgcctataaatacaactccaatgtctcatctcctacatcacaaaactaaatccccactttcacaacaaaaaaactcttttctttttgtctgctcgtttttcttttcataatg

SEQ ID NO: 27048 - DNA, 3003 bp, Unknown
  misc_feature (1)..( 3003): 2750-1469P.txt file - cDNA_ID_2729762; gDNA_ID_2684098; Annot_ID_190189
ccctgaaactataaggaaatgaattgcattgatctagtgtccactttgttttgcgggatacattgattttatttcataaagtggatgtaatttttcttttacttaatgagtcatgagtaaataaataaaaacgctacaaaaagtgatgcaaatgttttgaaccttgttaatgatgtttaatgctgtatatttggctaaggtcatataacataacatttggtgatttataatgatttatattttggtaactaatttctcatgcatatatcacatatagaaagatatgtctatatatatagaaagatatatatatatatatatatatatatatatatatatttgtactccatttgagggtattttctgataaaatatttcatagtcattcacctaactaagttccagaatttggttatctacctaattgaatcttgaattaagattgattatttatatataaacgaaaaagagtacgtatcctatggatatttctataattccaaaagataatttaggtggccttaataattactcttgcttcttcttcttctttaatattttgtatatatttttctgtcattaatattttgaaattatgtaatgtaccatataaacttttgacattatgttttcagatatattcttctgtggttacactaatattgatttgttttccgaaaggcattcaaaaaaaacaaacgaaaatagagagaaagtcgccctcgaaatatacgttgcttttcttttcttatgtgaagaatagcttcttcttctttgtgtctactataaacactaataatctttttttaatatgattatttttatttatttttgggcaaaatgtttttttaatatgatagtattactatatatttaggttgatcggaagttatatcctctctcattggcctatttttgactgttattttctctatccaaatatatctatcaacattgaatcctgccttattttatcgattcccaaaacacagcttaaccaatttggttttatttcagttaagttttcggttcacaaccaatatgttggagtgttactaatcagatagacgggtaaaataaattgtttgcacaacctattcatatagttaaaataagcgaatagagagataattgaaactacagtgaaaattaacaacaaatggaacatacgtccaagtagttgagacttgaggagtagaaagacaacgtaaggagttgacaaacatgtgagccatttgagactaattcacagacaactaaaatccaagagttatactagtaaatgctttggttattttaatatattttcaagtcgtctgcccgttgaaaactggagaaaatgtatatagagtactattcagctcgaagacaaaaatgtagtgactaaaattaaaatgcttaattggtcggataaacaatccaaaataaatgggaaatgagttttgagttgcgatcgtatcttgcattacaagaagcaaattttagggttaaagtttctgtcacataactccgttacacaattcgcttaattttggatatttgacagaaactaattaatatgtaaactttaatatatatattggattttaggcaatttaacaactaattagtggcggacaaatactgattattttccctttatatatatatatatatataattgaatgcttctatatttgttattttgttgtcacaatgtttttttttttaaaaaattaaatttgatatccttcagtccatcactagttaacaacattgccaaaatatactatcttttcgtcgaaaaaaaaactcaccatacaaactaagtgatttttcagtagtttgtgatcaatgcaaaaatgataaaattaatttaatgtttacaaagctgatgttgggtcgaaagacttggacgtcaaggataacatttggttctaaaatatatggacgtgaaagatagcataccatctttgggactgttcggataagaatgtgtgtgcattagttttggaaagtgtttggccactcggatctttttgtgataatctccagactatgaatattgcggaaatataatccatgatcagagaatatttggcgatgcttgatccatgaccgtaattggagccggatatgttatgatttgatctacaactattattacgctagataagccaattaattatggtaggtgatcgtgaatataacttcactgtccgaaaaagaatagtgtatatgttgccctgaaccatctatctcattaggtgctatgaactagtgagttttaagtatagagggtgcatataagtcgtttttccatcttaaatcaaagacatttcttagtatcttctagatatttcattcttttagtaccatataaattagggatttggacaattcacaattatttattttaaaccaaacaaaataattgttctccgataatcagatgtgacttatgtgatatagtacatataaatatacacactgtttaaatttgtctacccaatcggaatcatagaaactttattgtttacccaaacaaaacggtactgaatatcggaactttttttattaaaaaaaaactgtgagagagaaattgaatcaacgtccaagtcacttgatgcaagaaaaaagcgaaaccaattaaattcccgtaaaaacagaacacaaaagaacaggagagttaatgttctaactgacacgtgtccctaccttgccatacactcacacaattaaaatttctaactctgtctcttatccgaaaaataatcatctccaagtgtaataagaaaatcaaaataaaactctcatttcttcttcttcctcgcctataaatacaactccattctctcatctcctacatcacaaaacaaaaacctcacttaaaaaaaaaaaacagaagacagaaaaaaacaaaaaaaaaaagaaaaagaaaaataaacaaattttcttttcttttttttcctctaaagtttctattttgtctattcgtgtttttttttttacttcctgataatg

SEQ ID NO: 27049 - DNA, 3003 bp, Unknown; identical to SEQ ID NO: 27048
  misc_feature (1)..( 3003): 2750-1469P.txt file - cDNA_ID_2729762; gDNA_ID_2684098; Annot_ID_137068

SEQ ID NO: 27050 - DNA, 3003 bp, Unknown
  misc_feature (1)..( 3003): 2750-1469P.txt file - cDNA_ID_2729791; gDNA_ID_2684093; Annot_ID_137025
aggatgaatggatggggaatcttctggtgagttaacagaactggtttttgatgatagtgatttgacatgggaaatggtaagccaagtatctgaaaagctaatgagtctaactattgtactaaaggcaaaagaggactagcatcgtcttcaagtagaactgaaaagggaagaatacagcctcatgctccattccaactccaagaacatcttagagcacgtcttcaactccaatggctttgattgatgaggatgatcaaattgaagaggatttcgaaaaagaagataaggataatgaattgtgtgtggaagatgatgaggaagagttttagagtttcagactcaaagttttatctttgtcggattggattctgtttgttttcatttttatgtttcagagtttcaggctcacggtttagcttttgttggatttgattttcttttttcacacttatggtttaagtttttcttgaattttctttttcagacttttggtttaagttattgtttggattttctttgttatctcttttttagactcacaaattgttctaaaatggctttatgtatcaatgaatacaactaagctattgttttttaagttgcacctcatacggcaaaggctctaaggctcatgcgcctagactcgaggctcaaacaagcacctcaacgccttacctcaccttgtgctatttaaaacacagtttaagcctaccttgaaatagtcaaagttgttcatcagggacaatcgagtgagagtgatatattacaatacaatggtgtccatatccttgtttctcaagtaagttcggtttcccatttatacctaacaactacctccctcttgtgaatctggttgaacctaatcaaagctcttttggcgagttctgtcaatggcctatattttcactcggcacccagactttcaagtagatttcttgccaaagtacgaggatcttgagtcagtgtacttgactctcttcttctacctcatcaagacactaagcaagtctccataaagcttgtctgcggctgaactaaccaatgctcaaaaccaattgacagaactgaagaaattaggcttcaagctagactggttgaagtcaaagctcaaggaagtttccttggagaggaagaaagcagttcccgacagttgtcatgtcctcgaagaatgggtcagaaatgtgaaacttactttgtcggatctccaagttaaactggacaaggacaagatcaaatatgttgatgttgctgctagagtttttttgtttgggttcatcagttttcttacctcttctcaatatgaaaacacttaactcactagctatgtgttttttttatggatttattgcgtggacatctttcacattcaacataaacaaggaggaggattctctgattcacttgttgtcacttcataaacatgattcacgcaccagctcactttccatttccttgctctttttttttttctttcttttaattcaaattatctatcttttggtgattcgaaatggagtttggtatttttgacacttgtatcaatccgctaaaaaaaattacttacattcttcttaattaatagattctacaatctctcacgtaaagtttacgctaaccatgaatctctctactagtttcttattgaattacttccctacctatagctgtagacattaggtatctccatgatttcaaccctagaagaatccataacaatattaagtaccttaagtattttgtaaaattttcttgtgattgaaatagatcttaactacttcaaatttttatataagaatatataatatttttgaaattttattcgctatatattatgtttggaaatttgcgaattcgaaattacatattatgtttacacaagatgttgttgtgtctggatggacaaaggaaaatcgcagttgcaggcgcaggcgccgcctaaatcctgacgacattggaactaaaggtgcttaaaaggttgattgaaagtgaaacagacatcaacattaggataattcatgtattttttaaaagttgcatgataaagtggaaaagaatcgtttttcactctaaaaaaacttttcaaagagaaagaaactttttcgatcaaagtccaaatcgccgtccagtttttcactccggctttgtgcccggacaaggtccggttccttttccagcatcgatcggctttcatggcggtggtggctggcttgagagcggttttcctttgcttcgatttaatcattttggtttttaggaataataccctcgactttatttaaattcaagttcaaatataattttttcagccataagtccggttccttttccagcatcgatcatgatcatattttttcgacgttgatttcgttcaccagaatcagagtccaagcaggtagaagacgatgaaaaagattccaacatgtggcattgttatagcctaatagcttgtcacgtttgtgtagagaagagaatctttcttttttttttcgatattgaagactgggctttattgggctttcatgtttgtaaactcaatgtacttatagttgaaacaaaaaaggaatttattataagaaaaaaaaaaagatgttgttgtgtccgttcaactaataaaagcccaagtactttttttttttgttgcgttggttatttatacatttgcaaaaaaggtcccatatttatttcctttttcatttcttatcaaacttttgacaacgatcatccaggtcccactctgcttcttaaccattctttaccaaaaatcaattgttctctccctctcagcttccgaagtcttcatctttctcgacaatatctaaaccttgtctgagaatcatttgaagaagatctttcatcatcaccgatccactttctgatgtaagaaaactacagtcttccttccttctcacttctcttcttatcttgctttcatggttagggcaagtttgatttaagcttatgtggatgatagaactagtgtttatacttgtagttaggtcaatg

SEQ ID NO: 27051 - DNA, 3000 bp, Unknown; identical to SEQ ID NO: 14308
  misc_feature (1)..( 3000): 2750-1469P.txt file - cDNA_ID_2729795; gDNA_ID_2684103; Annot_ID_137103

SEQ ID NO: 27052 - DNA, 3003 bp, Unknown
  misc_feature (1)..( 3003): 2750-1469P.txt file - cDNA_ID_2729823; gDNA_ID_2684103; Annot_ID_190309
aatttctcacaattaagatttgtgtttacctacaaaataataataatacataaattagcgcataaaataagttcaagtgttattcgattttattatgaccaaccagtaaaatagaacaatacatcaaataaagagatacaattttttttacctttttaagttttttcattctttttttatttatctttttaacagttttgtaatcgaatctcaagtcgaattgtatttaccaatacaaaattacatgtgttttatttttaaaacatgagtcaattttaacttatgtcaaaaaaaatcattaggctaatcgagtatttaataaatagatggctaatcgaaaaatattatgctgctaaatatagattattctgtgcaaatttcatcataaatcgaatattttgtgtatatattaggctaatatctaccaaaaggaattttgaacaagtaaaccctagttgatatcgtgctaagctcttaagcgaagatacaggtcaaaatcgcggcaaagcatcggtggctcgagtgacccaatccactccaccaaacttctttgggaatcccaaaggttgctactttactcctcaaatgattcgcaagctctgttcttcattctctcgctccatcatcttccccaacaaacccatcttcatcccccgctcttttcctcaaccactccgtcactcttctgctctctcgtactcctccttgaaaatgaccgatacccatatcccaggaaaccctaattcgtcccctatccaatctcccaccaaacccgagtcgcttcgttccctcgaatttcaattgggttcttctttcaccgccgatccaatcatcccgccgccgaatcagatcgtcatcgttattagcggtccaagcggagttggtaaagacgcagtgatcaacaagcttcgtgaggttcgtgaaggtcttcattttgttgttaccgccactagtcgtccgatgcgacctggtgaagttgatggtaaagactatttctttgtctcgagagatcagttcttgtcaatggtggagaacgaagagcttcttgaatacgcacttgtttatggagaatacaaagggattccaaagaagcagattcaggaatttatggccaaaggggaagacattgttcttagagttgatattcaaggagctcagacgttaaggaggatacttggtaactctgctgtgtttatattccttgtggcggagagtgagcttgctatggtggagaggttgattgatcggaagacggagagtcaagaggagttgcttgttagagttgctacggcgagagaagaggttaggcatctaaagaactttgattacgttgtggtgaatgccaaagggaggcttgatgatgcggttaaccgcgtggaatcgattatcgatgctgagaaatctaaagttcatcaaaggattgtcaggatttgatgtgcagaggtactctacttgcttgcttgctttaaagcactccactttccagtgtctgattgatagaaaaaccttgacttgcttagattcaattgagcaataagctttggaaagttcgatgcactagtactaagtttttatgggttttcataatgatatgctgtcgcaatgacatcatttgttagagaatctagataaccacctggctaaattagttgattaggcatgtttcaatatgtcttgaatccttgaaaacacttccaagtataaggaagaaaggtagctgctttgctgagggagtttcttgcaaaagttcataggcttgtattgtatagtctgtaagtttgggaactatgttttgggaattgcgggtatacggaatgcacatttttctgtaattgttaacgttttcatgatggtttcttgcagatgccattgtctgtaacaacatattggcttgctgtctccagacacggatccatcgaagaccgagacaattttattatcggtatgtgcggcaacccattccaaccaaagatttagatgaatcctggcccctgactacagagaacccttttgattaagcatcgtatctttatacatagctacatggattatgttatcatcatacagtatgtgattcatactcgcattttgaattttgttactttataaatgtttatggagcattgttcataataatttaagtatcatctaacttttcaagatggcggctgagttccaacaatctcggaacatgtttattgtatccaatttctaaaaccagtaagtaaattgatatggtgataatgatgttgacccaaatataagccttactgccttagagcttgacacagaaagagttatgccggaagcaagtcatcaccataaaccataatcaagttcctctcaagaaatattttaatttacgattagttcatacattattctagtgcattacgtcaactcttaatttccagtaattccatgacctatgtgaacaagaaaatgctgacttcaatatccgcttattataatgagtttgacgtatcttatgatgttaatcaataattgctaaccgaattttagattaataattttataaaatagctttttgttttgcttgtttaggacaatcaatttaaggtttggtttgtacgtgacacaaggcaacataaagggtttaggggcggcttttctagaacacaagtcaagcaacaggcctctcataaagtcaatgacagaaaattttcttcttgataattatttacaaggaagatcgtcttcttaatataatgattggatgaagaaaataacaccttttttattattgtttgacagaaaataaaacaggaatttgaagttacactttcttgcactcttccttttcgatttttgcctcattgttgtcttcttctccactctttgcctttcttaagtcttgctgtctcttatacacacaaatagatgcaacatatatatataatcatgatgccttttctcatttgtatccatcatcaacgaaatcctaattaataacgaaaaggagaattctcgtaaggtataatg

SEQ ID NO: 27053 - DNA, 3003 bp, Unknown; identical to SEQ ID NO: 27052
  misc_feature (1)..( 3003): 2750-1469P.txt file - cDNA_ID_2729823; gDNA_ID_2684103; Annot_ID_137095

SEQ ID NO: 27054 - DNA, 3000 bp, Unknown; identical to SEQ ID NO: 14303
  misc_feature (1)..( 3000): 2750-1469P.txt file - cDNA_ID_2729831; gDNA_ID_2684103; Annot_ID_190305

SEQ ID NO: 27055 - DNA, 3000 bp, Unknown; identical to SEQ ID NO: 14296
  misc_feature (1)..( 3000): 2750-1469P.txt file - cDNA_ID_2729831; gDNA_ID_2684103; Annot_ID_137093

SEQ ID NO: 27056 - DNA, 3000 bp, Unknown; identical to SEQ ID NO: 14306
  misc_feature (1)..( 3000): 2750-1469P.txt file - cDNA_ID_2729846; gDNA_ID_2684103; Annot_ID_190299

SEQ ID NO: 27057 - DNA, 3000 bp, Unknown; identical to SEQ ID NO: 14294
  misc_feature (1)..( 3000): 2750-1469P.txt file - cDNA_ID_2729846; gDNA_ID_2684103; Annot_ID_137088

SEQ ID NO: 27058 - DNA, 3000 bp, Unknown; identical to SEQ ID NO: 14293
  misc_feature (1)..( 3000): 2750-1469P.txt file - cDNA_ID_2729850; gDNA_ID_2684103; Annot_ID_137087

SEQ ID NO: 27059 - DNA, 3003 bp, Unknown
  misc_feature (1)..( 3003): 2750-1469P.txt file - cDNA_ID_2729858; gDNA_ID_2684103; Annot_ID_137085
catatcatgatttaatgaaatttactttaattcttaaattagaagttctgaaatagcattaaatacaaagtagcaacctaaaccttactattcgtagactgtttactcactcagtcaataaacatttgaaccgtttaactaattatgcattagctctcatagaacaaaagaccaaaaatctataaacatgcatatatacacgaatacgaatcaatgttgagaatctatagtttaagtagtagtcgacactaagaacatgaagatgaagaagcttcttaaagttgtgtttctcttggtcgcttacttaacttgttccattgccatggctagttaccatggttgtaacagggttgcagagaaggcaacgagaatgaatgtagtcggagaagattcaagaaatgagtttggaaactacgaggagaagaagaagaaggcgaatttgtggtcaggtcgaaagttagcttctggtccaagtcgtagaggttgtggccactaaatttttagttggggtaataatttaagatatttaatttcatttctctaatttatgtttgttggtatcgtttagtaatatgagtattttagtgggttcttataacctaatgaaaggatttgaatattcatacgaatttcgcttcactataaaatatatgtgactaaagatttttaattgcgttcatttcattgtgtaaaaagaacaaaatgccccctgttttcatttgctttaccctctatatcttcaatccgataagtagctctctgttttcgcatcacggcatctaatgacgtaatgacaaaaacttaaaaaccttaaccaagaaaaaaaatcaaaagtgtttatttgtataatagatattaggttttgaagtgattaacgtaaaagtgaagaaacggaaggggaaactggagaagggcaaggcctggtttttaggctaattgatctgtatgtcaaaactccgattatggctccgatcaccggagctgtcatgtaaatccataagtcttcaaaatcccatgccaccaccgccggtccaagtgatcgagctgggttcatcgatcctcctgaaatcggtctaaccataccatattccacaaaacgttagcattatacgatcacatgaaataactattttccaatactttacggtgataatggagttttaagttaagtacccggtaataagcactccaagggaaatgactgttccaatcacgaaccccgtcaaattacccaactgcacaaaataacatataaaattaaatgcatataagttttctaatcagagagtttgattttttttattttctctttggaaagaaataaaatttcataattaagaaatagcatgtaaatgtcacattttaggtgttattcttattagaagatatttttttataacaagcggactagaggagtaacgaagatcgatttggtcacttacattttgatgaggaccacaatgcaacgcggaggcgagaaacacgacgatgctcgtagctatgagttcaacgaaaaatgcagaaacgcagcttaaagcaggttttgttgccataatgtcagcgtttactccgtacactgacaccccaactaatgttgccgccgttgcccccaatgtttgcgccgttatatacaacggaacctggcatgtgacacaacattccaaaaaagaattttcagttttcataaaaaataatttgtaaacgtccaaacaaaagattaagttttctcgtctcatcttcgttgataaatgaaaaaaacacattatttgatcttggtctaaacgctaagataaacaaaaacaaacgatcaagaccaagataattcaactacaattcttagttggtcaaacgccgtgttgagatggatgcattatacctgagaccacgggaatccgccaaagacagcgaaagcaatggtgatggaagggttaagatgggcgccagagatgtgtccgatggagtaaactacgaccaccacagataatccagcggtgacggcgtactctagcaatcccacgtggccgccggataattgggtactgcttatgaccccacacacactgaacattagaatgaatgtccccaccaattccgccattacctaaacattagtccggagatactattaattagcattttatttctatacaaacattttaatattttcaaaaaaattatttgtaattatggacatagccaattctttagtttaacacaaaagtattgtgagatattaatcttgttgattctatgattttgtgtatatatgaagcttacaatgcgtaggggattgagatctatatcataagggagacatccgaaaagcctttgtctcgagggatgatcttcatctctcaaagtagatggagttgagccagcttcttggtcgactactcttgaccgtgcctcaccattcatcttcttaattccttcaagatatagtgatcaagaactgaggaaagtcacaatcaaggtggcttgatccgctttatgaatgatctaatggaacaaaaaaagagagatagagagaaaaacgcaaagaagatggaaattaaagagtaattattttatttcaacaaaaagaagaattagtagagtgctgctatattcctttggttaagcagtctgaaaggagaagagggtgctcaacacttttcttgtgttcaattttcacttcctacctaccaatatttcttaatgttaatttggtgatttctaagtcatctatttattttaatcatcttcatttcatgtgtaaaaaggttgactctcttaaatcttttcacttaaaaaaacaaacaaattgttgcaccagccgggaatcgaacccgggtctgtaccgtggcagggtactattctaccactagaccactggtgcttattgattcatctatccgaactaaactattaaatattaattacgaatctagggttatttatctttctgattaagagttttcgtctgtacaagtggaattttgaaaaaagaagcagagagcgatg

SEQ ID NO: 27060 - DNA, 3000 bp, Unknown; identical to SEQ ID NO: 14292
  misc_feature (1)..( 3000): 2750-1469P.txt file - cDNA_ID_2729868; gDNA_ID_2684103; Annot_ID_190292

SEQ ID NO: 27061 - DNA, 3000 bp, Unknown; identical to SEQ ID NO: 14292
  misc_feature (1)..( 3000): 2750-1469P.txt file - cDNA_ID_2729868; gDNA_ID_2684103; Annot_ID_137082

SEQ ID NO: 27062 - DNA, 3003 bp, Unknown
  misc_feature (1)..( 3003): 2750-1469P.txt file - cDNA_ID_2729878; gDNA_ID_2936559; Annot_ID_194375
cacatagtgaaagcgtgcaatgcttataaaaatggagctcttgttggatcaatggttaaaggcagagactgagtccaagaacgtgaacaaactagccagagcggctccaagaagtttaggaccgatgtagctagctttatgaagacattggttgatgaattcgttaatttagagcgaaaccaaaacgaaaaccaaaaccatctgagagcaatgctaacaaagagacccagagcaataaaacaaaccttaggagaagcagattatcgaggtgagccaaagctgccaaaccagccaaactgtcaaatattatttaaatataaattttgaatatttttttaggatgatctatggatatatgatatcaaatttatggtacaccgcaagacgatattttataactaaatatttaaaattttaagttgtatttgttttgctaatattgtttaaattgtttaatgtttaaaattgtgtaattgtattttaattgttaattttaggatttcacccgtagtataccatcccgtattaatattcactcaaacccgtcaattctaatatttcatctgttgtataaagtttaaatatttataatatttaaacttcttataaaagaatcgagatgcatctgttgtatatgttttgttaatattgtttgcgagatgcatctgttgtataagttttgttaatattgtatgttttgtttagtatttaagattgtataattatatttttgattcttaattttagaattttacccgtaatatattattctgtattattattgatccaaagatcgtcaatatatgattttatcagtagtataaagtttaaatatttataatgtttgaatttcttataaaagaatcgagtgaacttcagatcatataagaggagcttctctcataatattagatgagaggagcttcaaacaacatgtactgaaatttaaatttaatccaaaagtaacctgatatgggttaaaacggaagtcatatgagttgagataagtttgaaatcaaagagtttgaggcatcgtgggagatgatggattcagggaaagtttgtggccgaacgttttcatatgcgaagagacgatttctttctctatgttttaggtgacctggctaggtgtaggtgtggcatcctcttacataattttcattttgcttgagagacctaaaacaactacttttattagtaagagatatagattattcatgttaataaataattaattaattactattcataattttgaatttaatttttgcaattaatatttatattaaaaccaatttaattaattttatagaaaaatcgtgagaaataatttatagggaattggtagaagatagcttttctacaaaacaattgataggaaatcgatcaaaacatttctttctggttccttgcactctttcctacttctgaaattttgtaatgacatctgttttacttaggtttggtttcgaatgaattgctggttttctcgaaaacttttctccaaaccgggttagcggggaaagatatggcaaaaatcatagatttaatgacattactattcctctgcaatttatgagaaaataggacattagtgttctgtttctgacgaaacctcccatatgcaaaccaaattataaggtgaatcaatgataggtttcattggcaaattggtttcaattaaatagatatctcttgaagaagagacaaaatatctatgtacagcttacgcaacaaagctagggacttgtcatgattctggtagatctttacgacaagtaggacatgtgagatgattcttaagccaagcgtcgatacaaagcgcatgatagatatgtctgcaaacaggaaatactctgcattcttcattaacgacataaccactgagacaaatcgcgcattctcttgattctagtgacttttcttcatcctcctcatggttgccttgtccaacaagcaacttcggtagtagggtttcgatcacgctttgtttcagcccgcgcttttttccttctctctcgaaatctggtaaccgtagaccggtcgagatgattgtgtggtaggtaacgattctagcacgttgttggcctctttgtactccgatttcgagatctaggtcgagacatgttcctaagaatggtcgcagaatgcaatcgatgatgacgtagattacaagaatgagagctgaggttgcaatgagaacaacgagcaagatgcagagaccgatgaaaacagcgagaccaagaacgctgatgagactaatcgcatcatcttcttctgagctcatgttgattcttacaagaaacaagttccaagggttttgtccaaaatggtgattttcaggtgacaacctaaagatttaaacagctatatatttttagtcatgatagcttgttgtttaggataaggcagtgaggaaggatttgtgtgtattctaagtttagggtttggtttcaaattcatatctaaagttttctgatttttttctctcaaaattatcctaaatcgttagaaagagttccattccatttgatctgttatttgcacacaaaagtcctacatgttttttaaaaaaatataaattatgttgtggatttggtcaaaatttctttggtgatttgaaaatttttcattttatatttaaaaggtaatattttcttaatggtgatacatatgaccaaaataataaaaggatacatatatgttgttgttttttaacactgatacatatatgttgttattcttttcctttgtgtctgaaaatattttcactttatttttgacaaaatattatttacgcaaaaagtgttattaatccaattagattccataattaagttattcagcaaattgacctttgtaaggaattaaattggtcataaagtctaattaaaccggtccaaaccggttctgttctcgctggctcggccaccgcttttcaacagaacaatctgtctttttctctgtctcactctctcactcactcaccggagcaaagtgatg

SEQ ID NO: 27063 - DNA, 3000 bp, Unknown; identical to SEQ ID NO: 14315
  misc_feature (1)..( 3000): 2750-1469P.txt file - cDNA_ID_2729878; gDNA_ID_2684104; Annot_ID_190375

SEQ ID NO: 27064 - DNA, 3000 bp, Unknown; identical to SEQ ID NO: 14315
  misc_feature (1)..( 3000): 2750-1469P.txt file - cDNA_ID_2729878; gDNA_ID_2684104; Annot_ID_137130

SEQ ID NO: 27065 - DNA, 3000 bp, Unknown
  misc_feature (1)..( 3000): 2750-1469P.txt file - cDNA_ID_2729889; gDNA_ID_2936559; Annot_ID_194377
acttttatggaggagaaagacccaaagttctttcaaggaagagcgattctttgtcctactaatgaggatgtgaattccataaacgagcatatgatgagtatgttagatggtatgttaaactttaaccaaaaactattgtattttcgctgaaattacttaatctcaaatagcgtttaactaaaatttggtattcattatgtttgtaggtgaagaaagaatctacctaagttctgatagtatagaccctgctgacacaagttctgcgaataatgatgcttattcagctgattttttaaacagtgtcagagtttctggattgccgaaccattgcttgcgcttgaaagttggttgtccggtcatgttgttgagaaacatggatcctaataaaggtttatgcaatgggacaagattacaggtcactcaaatggcagatactgtaatacaagctagatttattacaggtaatagagttggtaagattgttctgattcctaggatgttaatcacaccatcagatacaagattacctttcaaaatgaggcgtaggcaatttcctctatctgtagcttttgccatgaccataaataagagtcaagggcagacactagagtctgttggactttatttgcctaggcctgtgttttcacatgggcaactatacgtggcaatctctagagtgacgtcaaaaactggtacgaagtttttttaagccaccattttaattactataatatgtatacgattattaatcttccatttatatcaggtttgaagattcttataacagacaagaaaggaaaaccacagaaaaaaacaatgaatgttgtttttaaagaagtgtttcaaaacctacactaagacagtcatggaaagaaagttatgggattcctattcaaccaggttaataagttaagaaatcaaaaacgtttttcagtttttttatagaattacattcaacgtaatatttggcactaatgaaattatttaacaaattctatctttcagatttagttgcatcaaatcaaggaataaagatgctcaagcactgtcaggacgtgttaaatggaataagagttagtaaaaaaaaattgttggattttcttaactatgttatagttcgaaagaaacttatggttttttaatttctttattactctgattatgtctaatattcgaatatgagattgaatatttctttactatataaatacatgacgcagtcaacatcatccattcaaaataagattttaggaatcaggtgctaacctttatacacatattaggatctgaagttgatgtcgcctgctacttcatgtttagtttgtccttcttatatagatttacactaatccaaaagcttcagctggtgcaaacctgcatttaaatttgtaacagattagagttcttcttaagagaacttacttgataatataacaagttaaaccttaagctgtcttaaacatataagtagctttttcaatctttaaatagagtaattggattctcgaacagcaatatataatatactacttacctttcatgtataatctttaaatagagctattggattttgatggtcgtaagaagccgcagtcataggaagtcatgtaatttccaaacaatttttttttgtcagcattccattcagttttaggtatagttttttatttattaaatttgtaaataattaaattagacataatagaatctagagcctatatatcttcattagaccatattaggcccacgactaaaaccaacacacaatacataaacaaattcaaagttgggccaaaaactatatgttctcaaacaaacaaatcatttttctttccaaataaaatacgtaatatagcttggatacaaaattttcacatttaatataaactaaatattatatatttaatataaatacgatattttaaaacaaagacaatctaatgcaacattaatcattatattcaaatagtaataaaagtaaaacatattatagcatcacttttacacttagataattaaaacaaagtattcaattttattcatgaaaaatattaatgcccgtgctgtatagcacgggttatgatctagtgtatgtataattggataaatataactttttatgatcattaacttaaaaatcaagtttcaaaagcgagaggagcaccaatcttagcagcagtggtctcaacacatttattccacatccgtttgctcctaggaagaatcgcagaagcaacatcttttagctcataagtggcgaacacaaaagtcatcaatccttcgtgacattctcttccaatcttcaaaaagttcacacaacaatcctccgaaacgggcttgtcgtcgatcaatccttccgtcatctcaacattgcatttcgagctcattttatccgaacaatcttggagaaatttgatgcgccgggtcgtcatgtggcttaggagttcgtggtcgtactcgtaagctgcagcgggttcgtatgccaatgattcaggagatattggactgatctcttcttcttgaccaatagtttgataaaccatcgatgtggtggctatgagaaacgttatgagaattgctttctccattttctttttcttgtaatgaagaagaaaagctttaacgaagtagccttttaatggtttattaatttgtaacgagtaacgactagctttttatgtttctggtcattaaaggattgtttgatttttttgacatgtttacatatgttacttacttgattaataattaagtcacatttcagtttatacacattttttcatgttcacgccaaatgcatagacttagaaggggcttttgtgttataatgggcctatgggcctatgggcctattgggccaaaaccattgaagcccattttaagaggagactcacagcaaaccctagcaaaaacactcgaagccactctgtttcttcttcctcctctgtttctttcttctcttccatcgttcgccgttaaggaaaacaaaaatcagagatg

SEQ ID NO: 27066 - DNA, 3003 bp, Unknown
  misc_feature (1)..( 3003): 2750-1469P.txt file - cDNA_ID_2729889; gDNA_ID_2684104; Annot_ID_190373
gtttacggaaatacttttatggaggagaaagacccaaagttctttcaaggaagagcgattctttgtcctactaatgaggatgtgaattccataaacgagcatatgatgagtatgttagatggtatgttaaactttaaccaaaaactattgtattttcgctgaaattacttaatctcaaatagcgtttaactaaaatttggtattcattatgtttgtaggtgaagaaagaatctacctaagttctgatagtatagaccctgctgacacaagttctgcgaataatgatgcttattcagctgattttttaaacagtgtcagagtttctggattgccgaaccattgcttgcgcttgaaagttggttgtccggtcatgttgttgagaaacatggatcctaataaaggtttatgcaatgggacaagattacaggtcactcaaatggcagatactgtaatacaagctagatttattacaggtaatagagttggtaagattgttctgattcctaggatgttaatcacaccatcagatacaagattacctttcaaaatgaggcgtaggcaatttcctctatctgtagcttttgccatgaccataaataagagtcaagggcagacactagagtctgttggactttatttgcctaggcctgtgttttcacatgggcaactatacgtggcaatctctagagtgacgtcaaaaactggtacgaagtttttttaagccaccattttaattactataatatgtatacgattattaatcttccatttatatcaggtttgaagattcttataacagacaagaaaggaaaaccacagaaaaaaacaatgaatgttgtttttaaagaagtgtttcaaaacctacactaagacagtcatggaaagaaagttatgggattcctattcaaccaggttaataagttaagaaatcaaaaacgtttttcagtttttttatagaattacattcaacgtaatatttggcactaatgaaattatttaacaaattctatctttcagatttagttgcatcaaatcaaggaataaagatgctcaagcactgtcaggacgtgttaaatggaataagagttagtaaaaaaaaattgttggattttcttaactatgttatagttcgaaagaaacttatggttttttaatttctttattactctgattatgtctaatattcgaatatgagattgaatatttctttactatataaatacatgacgcagtcaacatcatccattcaaaataagattttaggaatcaggtgctaacctttatacacatattaggatctgaagttgatgtcgcctgctacttcatgtttagtttgtccttcttatatagatttacactaatccaaaagcttcagctggtgcaaacctgcatttaaatttgtaacagattagagttcttcttaagagaacttacttgataatataacaagttaaaccttaagctgtcttaaacatataagtagctttttcaatctttaaatagagtaattggattctcgaacagcaatatataatatactacttacctttcatgtataatctttaaatagagctattggattttgatggtcgtaagaagccgcagtcataggaagtcatgtaatttccaaacaatttttttttgtcagcattccattcagttttaggtatagttttttatttattaaatttgtaaataattaaattagacataatagaatctagagcctatatatcttcattagaccatattaggcccacgactaaaaccaacacacaatacataaacaaattcaaagttgggccaaaaactatatgttctcaaacaaacaaatcatttttctttccaaataaaatacgtaatatagcttggatacaaaattttcacatttaatataaactaaatattatatatttaatataaatacgatattttaaaacaaagacaatctaatgcaacattaatcattatattcaaatagtaataaaagtaaaacatattatagcatcacttttacacttagataattaaaacaaagtattcaattttattcatgaaaaatattaatgcccgtgctgtatagcacgggttatgatctagtgtatgtataattggataaatataactttttatgatcattaacttaaaaatcaagtttcaaaagcgagaggagcaccaatcttagcagcagtggtctcaacacatttattccacatccgtttgctcctaggaagaatcgcagaagcaacatcttttagctcataagtggcgaacacaaaagtcatcaatccttcgtgacattctcttccaatcttcaaaaagttcacacaacaatcctccgaaacgggcttgtcgtcgatcaatccttccgtcatctcaacattgcatttcgagctcattttatccgaacaatcttggagaaatttgatgcgccgggtcgtcatgtggcttaggagttcgtggtcgtactcgtaagctgcagcgggttcgtatgccaatgattcaggagatattggactgatctcttcttcttgaccaatagtttgataaaccatcgatgtggtggctatgagaaacgttatgagaattgctttctccattttctttttcttgtaatgaagaagaaaagctttaacgaagtagccttttaatggtttattaatttgtaacgagtaacgactagctttttatgtttctggtcattaaaggattgtttgatttttttgacatgtttacatatgttacttacttgattaataattaagtcacatttcagtttatacacattttttcatgttcacgccaaatgcatagacttagaaggggcttttgtgttataatgggcctatgggcctatgggccaaaaccattgaagcccattttaagaggagactcacagcaaaccctagcaaaaacactcgaagccactctgtttcttcttcctcctctgtttctttcttctcttccatcgttcgccgttaaggaaaacaaaaatcagagatg

SEQ ID NO: 27067 - DNA, 3003 bp, Unknown; identical to SEQ ID NO: 27066
  misc_feature (1)..( 3003): 2750-1469P.txt file - cDNA_ID_2729889; gDNA_ID_2684104; Annot_ID_137127

SEQ ID NO: 27068 - DNA, 3003 bp, Unknown
  misc_feature (1)..( 3003): 2750-1469P.txt file - cDNA_ID_2729909; gDNA_ID_2684104; Annot_ID_190366
tcttgttctcttgaagtcaaattttggtgatgagattgtaatctttatttggaacatatgtaggatatagtgttttgactttcaaatcagttttggtacaaaaatatgtgtcggtgcgatttcttgtagtggactctttctcagatctgattcaagaatcttgtttcttgatcgatatggagcttcacattgtgatttgaagatctttgtagactttaagacctttgtagataagcgtagcttactacattgttagatctcagattagtggttttttgatgcagaagaaaatggctgaagatctatcattttgcttaagtttcttgggctcttttgtttgttgttttgcagggtaaggttgttccggatggtgagaaggaatttgagcattgtgagtatggctcagacatagctacaagttatggagctggtgcatttgtgcttctcttcattagtcaagtcattattatggtggctagtcggtgtttctgctgcggcaaagctcttaaacccggtggttcaagagcttgtggcattatgctcttccttatttgctggtaaaactctatacttaacacaatctctataatttatgactttgacttgacacatcattctacacttggttttgaacagggtgtttttcttgattgctgaggtatgtttgctcgcgggatcaatcagaaacgcgtaccacactacgtacagaaggatgtggaacatcgaaaaccctcctagctgtgaagtgatccgtaaaggagtgtttgctgctggtgcttcctttgctctcttcactgctattgtctctcagttctattacatctcctattctcgtgcccgagacggttaccaaaccccacattactagtgagtagtgagatccagaacaagaaaagctaaaccctgaatgagtttgtccatttatccactcactgatcaataggatattaaaatttgatgatgttagtcattttgcttcttgcttgtatcacaattgtttttttttgttttcttgtgatgtataaaatcttattaatatagacagctattctacatttcagtatctaagcttattgttacagtgtaagttttatacattttagagttcataacctggaaacagagcttgtgttggatcattcatgtcgagtaacatgtaggccattcctccgataccttcaaagagagagaagggtctatctcctccatgcatttgaccttctgagattaacttctctgatttatcgagtaggaaagacgcgaaagctttagcgcggtacaaatactttgggtttcttgttaaccggtatagagaaagaaacacgtatgtgtttccgctgataccgtgacagattcctactcgtttaagcaatccacggctccacacaacttctcctgcctccattgctgcctctacaaattccttagtgttataaacctgacgatatccagaaaatgagttttgcattgtggttttacttactgataagagtacttcaatcaacaaatgattacctgagctgcctttacaagtgtgagagcaacaccaggagcaccgtgacaccagtgaacaaggcgatctgatttgcttccttcactagataggtaattcccgctaggaaaacggttttgtatcatatagcttagtgtacctttgacatctttgatttcatctggttcaagttccgtatgcatcaaaacattcatgatcccagctaaaccgtgtgcagccccccagtacctcttcccgtgccactcatacatcaatggacaagttcctttattcccgagttgtcttcctgccctgaagatttcctcaaccactgatctctgaagatatagagatatcataaaatcttgaactttcttgagtaagtcaattaaccaaagaaattttataactttattataccattcgttcagatgatatactctcctgaccaatatgcttattcaagaacaaacacgcccacaagtatcctgctctaccatatagcaactcatatggcaagtcactaggaagcctaatctgttaaacagatcaaagttgcaacactcaagcaaagtatagaacaagttatctattttcactagagcaaaagaaactgtaattagtaattacccctcggaaacgggctaagtaacgatcatataactggtcatcacctaaacacttcgctgcaacagcaccaagagcacatacaccagcatagccacatataaatgtcactcgcctgatagaaaccacaatcattaccccgaaatgaattcatgaaaattggatcattgaagaaaattcacttactcagaatctcttgaagctacatcacaagcttcaacattctctaagcatagcttaagatcatcttcatttctagtaacctgataagatttgaacaagagataagctgtcccaagaactccagtatacaagttataatctcgaacacgttttccagatcgttcccatgtctcccagactacctaaaacagaatcaccacacaaacaagagaaaacacaacttcactagactaaagaaaagtcataaattcattataactacataacttcattataactcaaaatcatatataatcaaattgaaaagtgagttactttatctttgatgcttagagcatatctgtgaagcttctctgagaatgatttgtacggaagtgatagcagtttcgtcaacgaatctttacattcggtaacagtttcttcttctccggataaatcttccggtacaaactccggcatctcatttcggaaaaaccgttctcccatatctctctttctctcagcggttgctgcagaggaccgcgaagaacagagactaacgacgaagtgacgaagtgacacatcgttaccattattaatgggccttaagttaagcccaataatgaccggcccatgattttttctctctgtttcgtctctgaccttaaaacacttgctaaaaccctagagaaaacgtctctacgcggaaaaacaaaaaaatg

SEQ ID NO: 27069 - DNA, 3003 bp, Unknown; identical to SEQ ID NO: 27068
  misc_feature (1)..( 3003): 2750-1469P.txt file - cDNA_ID_2729909; gDNA_ID_2684104; Annot_ID_137122

SEQ ID NO: 27070 - DNA, 3003 bp, Unknown
  misc_feature (1)..( 3003): 2750-1469P.txt file - cDNA_ID_2729916; gDNA_ID_2684104; Annot_ID_190364
atcgctgacttcgtttaatatttctcttctacctatgaaatactgacacgtgtacgaatcttagattatattttggcttttatataaaagtcatctcttagcaatattaaatattaaataatagttttaatatttttaaaaaatagaataagagattattgttttggatgctctaaaaactcttagctaaaagacagtataacaaatcaaaaacacatataactcaattattggtctatttatattaaataattagaatataaatataaaattaaaatattattatttttatatttttagaaatttccattgtgtacgcacgtttatgacttgtgagcaaacctcatgagtttttatattgtttattcatggcaactaagaaagcagaatttccaaattatcaatattttattatagttggcacttctgggatctttgaagatcagtaaattttggtttacttgttttgaactactaattggtaattacccaagaacactaaagtcctgactctcttgaaatacaacgaaaaaatacagaaaactaaaaatcttcaaaacaaatgataatacgaaagaaaaccaattaaaatgaaaacaactaaagaagcaactttgacggaaaaagctataagaaaactaatagtgttaccatgaatataccgcaaggcaattggccttcctcaatactttggatatatatgtgtattgtggatatatatgtggatccaacttttacagtttttcgtaggcctgggattacggcaggaaccgagcaaaccgacccgattaaaccgataatttcggttatcggcgaaaaccgaagatactgtaactaaccgttcggcgaatttaattttggtgttcggatttcgggtcgggtcggttcggcaatcggaccgatcggtttattaaaatatgcaatcatatataagcttaaccctagtcaataaccctaatttgttttattttgcttcttcactgcctcttacaaaccaagtgagtccttctccgatctaaaaaacattcttctccaatctattcatcatcacatctcttctccttcatcaattcattatcatctattcatctttatcctctaaaaactcaatcattcatgtctaaatctgtcctcgacgaacttaaacgtaagatttgttcagatttgattattggtgttacttgtttttttttgtagtctcgtgtctttgttctctagatcttaggcttgtgtttatttcaataatttagttgttttctttcttgtttcagtgagaaagcgagaaaccgactcatcaaccttgtttaatgcaatctcgcttaaagctggaataagaaagtttgagatcgccgtggacgaggccgtcatcgcccgagcctcatagtcggagtcgcagccgtcacactacacacagctttttcaaaaccctaaaatttttacaagtctgggcttattaattgtgggttgggcttattgattgtatgttgggttttgttaagtgtattgggcttttattttgttgtatttgtaatagaccaatttcttttttaatgtgtaaaccggataaaccgaagaaaaaaaagaatttggttcatattcggaacatattttttaggctataaccgacccgaacaaaccgacgtccgaaccgacccgaaccgaatttcaattcgggtctattcggtgagatttttagaaaaccgaatttccaccaaaccgaataacccgatccgaataacccggtttaaccgaactcccaggcctaatttttcggagcaaactcgcaatatattgatccaaaatatctaaagagaattgatctctgatgtaaactcatgtaaaaacttcacacttcaaataaaaaccattagtccacccaacttgattaatatgaaaaaccattaatatattttttagtagttcacttttagttatagtttagccgactaaggttacaaactttccaccaataccctgagaatctagacatgaagaagacaagaaaacaattttttatattttggtttttttttttttttgtagtcactacgcatgaagaattgaattcgtgcagtagttatcatttaataagatacgtaattatcatagacttcttctcaagaaatgaaactaagaatagagtcttgacgaaaaaaaagagaggtgagaatagagtctcctccgttgacaaagacaaaactcgacaacgaaaaaaacacaagggaacacaacaaagtaatgtgccaaattcgaaaagcccatgtatgtaatattgattgcgtgcggatgcaagatccgggtttgttgaatcaaaaatactggaaaaatactagcatcggagtgcatcgattaatcaaaaatactagtccaaagatcatcgacaacgtggaccctatatgaggatgcaactcggagtgcctaacctggaaaaccggattccggttaaaccattgcacatttatttacatgaccgctaacggtagatccgccgttttagactggtgactgttatgattatctaatatcgcattcaattccattaattctcattataactcttcttttaatctttcgttaacattcctaattttacgtttcttttcccacaaaaccagtttttaaaaacttaacgatttatatttgtttagggaaaattagtataagagctttaattattaaacaagttatatatgatccctttaattaacccgtagataaagcaaatgaaaccccccacctgcaccacgttattagtctattgacgttagttcatatacttaagtgaaacttatttttttaattaaatcgtgttgtaaaaggcaacgaatttgcgttgtctttttttttttattagtaaagaaatagtcatttcattttctttaattcggtcacaagtctcttgacattttcgtctatatatatattagtattatcaagaaaacgatccatcttcgagggaaagagaaagatcacaagaaaagctctctcagaataatcgcaatg

SEQ ID NO: 27071 - DNA, 3003 bp, Unknown; identical to SEQ ID NO: 27070
  misc_feature (1)..( 3003): 2750-1469P.txt file - cDNA_ID_2729916; gDNA_ID_2684104; Annot_ID_137120

SEQ ID NO: 27072 - DNA, 3000 bp, Unknown; identical to SEQ ID NO: 14312
  misc_feature (1)..( 3000): 2750-1469P.txt file - cDNA_ID_2729923; gDNA_ID_2684104; Annot_ID_190360

SEQ ID NO: 27073 - DNA, 3000 bp, Unknown; identical to SEQ ID NO: 14312
  misc_feature (1)..( 3000): 2750-1469P.txt file - cDNA_ID_2729923; gDNA_ID_2684104; Annot_ID_137118

SEQ ID NO: 27074 - DNA, 3003 bp, Unknown
  misc_feature (1)..( 3003): 2750-1469P.txt file - cDNA_ID_2729978; gDNA_ID_2684110; Annot_ID_137151
atttaacaagtttataatacaaagatttaagtaaactgaatactcgatcgctcatttgattacaggtttggtaatgatctaacgtgactagattgacattaaagctaaatttttaaaaaaacatttgttaatgactacacatataaaagaagaataaaaagaagacaactacaaaaagcttgtgaaccacatattgaagtccacgagaatcgcatttgaaaatgaaacatcaatcagtttgatgtgacttgacaggttacaattatttaaacatggtatatgtcatacacttaagttgttgacatgttccctttaatctgattaaatgatacgactacgaataataatgtttattcaacgacatttgggtagaaagcgattacatctagtttataactatttttaatctaaagtaattaatttttaattacattctcattattataattctttcaaacacacattggtataataataataattgtgtttttttttttatatagaaaaactctgcaaaataataataaaggaagttacaaacacacattggtttaataataattgtgtttttttcttgggttgtcatttgacaactatggttgttgttaactttttttttgataaacgatgaccaaagaataagaaaaccattttctaaccttcgaccgcgtttaatgcgtgtgtctttgtttatagtatttgtaaattgtaaaaatgtcatataaaaagtgggaacccatattaaaaaaatagaagaaccaagcgaagaatctgagcatgtttaattcacgacgcgttaaatgagtcgtttactcgtttaccaataatttttagtttctcatacggtgactaataagattaagactagattaaagaatatttgtgacctgtcatttttttagacatctatgtgacctgcaactttatatagtcaatatcaatggatttagcgtaggtgatcaactatatttgagcatgtatattaattacgaattatatgcattcactaaatctataaagtattacttacatgtcatgacatctgtatatatatatttactccattatcaatacgttttgaatggaccacgcgattgtctagcatttccttgacgtcaatggtcttgtattggttagtcgtcttccatctacgaagggacactaatcagtattacttgaactcttgaagtttgtttctgttgttttgcacaaaaaaaagaagtttgtttctgttgttagatagacattgaaagaaatgtatttttttttgtaatgataaattactatatatggatttgatttataaaatgttagtggtaattttgtttccacaaactcaagtcatggatagctatgtttttgtcacgttcgaatacttgtttcatttgtatgcatgtgaatatggtaaaatcaccaaatgtatggtggatgaatgcccttgtcgcatccaaaaagaatatcccatcgtttacatttatcttattttttcttttcataaactattttgtgatctttaaaatcacataaaatttatcgacaatggataaaagaggtgcacaagagaaaacatacgttggttaaataaaacagtaatatgatcatgagtgacaatacttaaaactgtattcgaatatacttatttcgtttcaaggtgtttaaaaaacatttaaatgcaaaatctttctcaattttatatggtcagaatcgtcagctgactagactaatataaaaaaaatgttcaaagttcgattagagataacaaggattcagaattctcaaattacatgatgttttatttctatcataaaagtaaaaatatcaagtgttttcttgaaactattgttacttgaactgtatagaaaaataaatatctttgaaaaattagaaatgagcagacaaaatctttaataactactaaaaaaaaaaatcaaaagaaaaagacatgcctttcacgtttatgtgcgatgcaagacccacaactcatttatctgaccaatcgaaaatttgtttcctctcttattattccttcttcagaggaggctaatttattattattaattaatgttttttaaaaagtttactttatttatattattttagttacaacgtaaaagttaactttattaccaagacaagtaaacaaatttcttatctcttatggttggcttatattgaagcttttaaacgtgttgaataaattgaatctaagaagatcaaactaacaaaaacattataagttgaaagatgaaatcacaatatagatatataaagtaattatgatcctaaaagatggtaaaagttttttccgacatcttgagattagtaaatattttggttagaatccccaatcacaataaaaaaaaaagtttatattagaacaccaaacaaaattatataaacctcaattttattttgatttctatctccgtaaaccaaaaaagccacacaaacccctctaaccttctagataactttctcgttatgctatttttttaaataacctatccaaaaaattgttgttcgtgtttattttattaattctgttttgtttttcaactatttaatccgatcttatgtgcataaatatccgtcggagttaatttagagttaaagaaatagattagcgtgtgagctcatctctcttaaatctctccgctctaaataagtttgttggaattatcctccgcgtttttgttaaatcgattcgttccgcgaccttatccattttcttcatctctttctctctaacttcgattttcctttttctcgcgcgagaaaatttctggattttgtctgcgaatcacgaatattccagcgtttcttcgtcccgcattggcgtaggatttttgtcgtgtttccgggattcgaagaacagtttaaagagtgaagaagagtcgagaggtgtttcggagtcttggaagaacaagcgagatcgtgttttttttgcatagaatctgcgaggtttcgaagtttctctgtggagtttttgttggatgagagatg

SEQ ID NO: 27075 - DNA, 3000 bp, Unknown; identical to SEQ ID NO: 14341
  misc_feature (1)..( 3000): 2750-1469P.txt file - cDNA_ID_2729982; gDNA_ID_2684110; Annot_ID_190601

SEQ ID NO: 27076 - DNA, 3000 bp, Unknown; identical to SEQ ID NO: 14341
  misc_feature (1)..( 3000): 2750-1469P.txt file - cDNA_ID_2729982; gDNA_ID_2684110; Annot_ID_137150

SEQ ID NO: 27077 - DNA, 3000 bp, Unknown; identical to SEQ ID NO: 14340
  misc_feature (1)..( 3000): 2750-1469P.txt file - cDNA_ID_2729986; gDNA_ID_2684110; Annot_ID_190600

SEQ ID NO: 27078 - DNA, 3000 bp, Unknown; identical to SEQ ID NO: 14340
  misc_feature (1)..( 3000): 2750-1469P.txt file - cDNA_ID_2729986; gDNA_ID_2684110; Annot_ID_137149

SEQ ID NO: 27079 - DNA, 3000 bp, Unknown; identical to SEQ ID NO: 14339
  misc_feature (1)..( 3000): 2750-1469P.txt file - cDNA_ID_2729996; gDNA_ID_2684110; Annot_ID_137146

SEQ ID NO: 27080 - DNA, 3000 bp, Unknown
  misc_feature (1)..( 3000): 2750-1469P.txt file - cDNA_ID_2730014; gDNA_ID_2684110; Annot_ID_190591
atatcttcggtccttttgtttacaagaaaagtggtggaccattcgcaattttcattttttctttacgtcgtaaagatatatacttcatctgctcaaagaaaacgtttgtcttaaacccttctccgtcttggggttttctttggattccatacattacatatacacaaaataatcagttattatttctaacttatgtagcaaaaatgggtaactgcgtattcaaaggcaatggtggttcaagaaaattatacgataaagatgattcgttgataaaagtggtgactccaaacggtggcgtgatggagcttcatcctcccatcttcgccgaattcatcaccaacgaatttcccggccatgtcatccacgactctttaagcctccgccactcatctccaccgcttctccacggcgaagaactctttcccggtaacatctactacctccttcctctttcttcttccgcagccgcgaccgctcaactggattcctccgaccaactatcaacgccgtacagaatgtctttcgggaagacgccgataatggcggctttgagtggcggtggttgtggagtgtggaaggtgaggcttgtgataagtccggagcagttggcggaaattcttgcggaggatgtggaaacggaagcgttggtggaaagtgtgaggacggtggcgaagtgtggcggttacggctgcggcggaggagttcattcgagagcgaattcagaccagctaagcgttacgagtagctttaaagggaaattgtggtaaaatttcgaattatgaataaactacgtttatgttttaatctgtttcacgatttaagcatttaaattagtatgttgatttccgtattcattgaagacttggaacgattatataagtttatcaacgtagatatatttgaaatatcattgttatctctcatgaaacaattaatttatgaagtcgtagactcgtagttagagattatttaatcttccctattcaatgccaaaagtctagaagagcaaaacaaaagggagaaactcttttatttcaggcccaatgacacaaagctggccagaaacagtttaagattaggctaaagttataagtccgacaagcacgagtgctaatatatatagttatatgacgtctcaccattaagggtttaataaattttgaaacacctcaaattaagattgcttcccatgcaaacttccttcatcttctagaaaaattacgatttgtaatacttcaattatatcattttagttttttgtcactaattatcatcaatttatcatagctccgtgccgcaacaacgttcgttttaatcagattatatattactctgctataaactcagaaccatgttagaaaaatgaaaaagacatttcagaatattcattaactcaaaattttaatctcatgatttaattttttattaacaatgttatcctatagcacatggcaaatttgaacggcccttgcgtattaatctattataatctcaaaaccatgtgtaagaaaaaggaaattcagaaaataaccttttgtaaataggcccccacaaaatctacaacatacgtagatacctcctcgcttacagttgtaaacaactgttcatctagattcatgccgtcattcaagtttaaattaatacaataatttaaaattttaatttggatgaatcgaatccaccgtcgtttcctgaataccagataggttaactttatgattagttcgagtgaaccacatgcacaatattcgaatcttagacattcgttgcaatgttaacttcacatatatttgataaacgcttcttgaatcagatcttaatctctttctttctctccatcttctaaggaggttgtggattatcatgtagtatatcattatcttcgcatcaccttcaacaagaacaagctacgagctttaaagtcgtatttaacacaataatgtataaagtctttcttcatcacatcacatacattttttgttgccatcacccttcattcactttttttgttaacactattcgtttctatataaaataaaaataaaatgaggaatgtcttgtccatagagatttttaaggtcgagggtcatcggagcgatgtgggcttgcttcctacattatagttgatatgtggatcccgcgtggaccatatttttacccaatagctacgtgcatggtcccaccgctctctctcacgcactattccgaaattgccataaacaatttcaccggacaaaaagagcaaataatttcgatgtttaataaagagaccattagtatatttgacccaaaaaaaaataaaaaaaaaagagagacattactataacttttattagatgaaatattgcaacattgtatttataacggatctaatttactgaatcatattttttttctttgttaaagagatactgaatcatgcagaaaaatagatagatttttaaatactaggtgaactcatgacgaatcaaccattacgagagatttctggataaaagcaaaaacaaaacaaaactaacatgctaatctaggcaattagtagagcgaaaagtcggcaaaaccaaaggccgaagaagcttgatcgatatacttttttttttttgttttggctggatatacttggtatgaactaagaattaagtaaaaactcatagggagtaatttttcgagaagtgcattcactatgagtataaaacagacattttcaaattattaaaacaagctcttagaggctcatatgtttaattgtaagtggcggctcatgcgaacttataatgaaaacatcaaatattcggaaaaataatactccactgttaaaaagaaaacttaacaaaggaattaaaaatatgagagcaaaagaacacatgcattttctcatgcatgtactattatttatttttttgcagagttgatgtaaaaaatatacacatatatatagacatactttggttagttataaactcgttctattttcttctcctttttctatctttagcaatg

SEQ ID NO: 27081 - DNA, 3000 bp, Unknown; identical to SEQ ID NO: 27080
  misc_feature (1)..( 3000): 2750-1469P.txt file - cDNA_ID_2730014; gDNA_ID_2684110; Annot_ID_137141

SEQ ID NO: 27082 - DNA, 3003 bp, Unknown
  misc_feature (1)..( 3003): 2750-1469P.txt file - cDNA_ID_2730032; gDNA_ID_2684118; Annot_ID_137180
gcattatataaatctctaaataatctcaaagtaaaagcaatcaatcaacctatagatccgatcggccatgttctataaggattgtcagaacttgttgagctattaaaatactccgtacaacttatttgattaatatgggccaaatccgaaaataaatggaccttatcgaatattttgttcgaagtccaggcccactaatcgagtgcgaaaaaacaaaaacaaatgcggtgagcgtggatcgaacacgcgaccttcagatcttcagtctgacgctctcccaactgagctatccccgctacttgttatcgaagctaaaataataaaataaatacaaatatttgtaaaagcgagaatttgtgattttttttggcaataagtagagaatagttgtgttccacgattcctcctctcacgttcgaagaccatttcttgttctttggacgaccatcggcgacagtgttaagtctagagtcttcttcttcttcggcgtagttttttccccggtaagtctccgttcatcgccgaatctgtatccctctttctctttttgtttacttgatcgtctctttcgattatgtatatcgcgatcggagtccgtcatctccagatctgtgtgtatgcgcttaatttcgttatggatgtgacatgatttcttgtgattcgtttccttagggttgatagatctgtatcctgcatgatcgttatagatagtgatctagatttgtcttttttcagatcgaaatttagatctcttattgttaatcatgttgattttattgaaacttgctcatacgaatgagatccgagagcatttggaaacataggattgctttgcgttgtaattgttttctcaagtgatggatattgaatctatgtgattgatgcaaaatgagttccagagaatttataatcctaggattgcatgataacttctttgctttgtgattgttttctaaagtatttattccatatgaatgctgcaattgagtatgcgtttagactgaaggtgttatttgaaaactctgaaacaggcttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtgagtttctaactttgcatactctttctttcatctaattattattcatctctaaacttagtatgtgaaattgacacattgttatgcaatcatctcaagggcttaggttgaatttttcgtatcatggttggattcctagattagattggaacttgaatatatagttgcaagttttttcatttggtttgcatgcggtgtacttctacttgctcaagggcattcatctttgattcatggtttgtgtatgattcatagaatgagtgcttgaattttttagatctgtcgtattgacaatacctgttcttgctaggtttcaatgtggagactgtggaatacaagaacattagctttaccgtgtgggatgtcgggggtcaagacaaggtattgtgattacagtcctttaccagcattcgacaattactatagctaaatccttgattctccatgagctgtcctattttactgaatggcactttcactattccaatataaccttttttgtttgcttgctcatccagattcgtccattgtggaggcactacttccagaacactcagggacttatctttgtggtggacagcaatgatcgtgaccgtgttgtggaagccagagatgagcttcacagaatgttgaacgaagtaaaactcaaacaaaaatctccttctctaatgttacattatgaagcagttggcatcattttgtttcctttttgactgttgcaggatgagttgagagatgctgtgcttctcgtttttgctaacaagcaagatcttccaaatgcgatgaacgccgctgagataaccgataagcttggacttcactctctccgtcaacgacactggtgagccaaagaaaaccaaaccaaatctctttatttaccagatacctatatcgtaacatgaaaagctgatgtaaatcgttggtggggtttgttgaacaggtacatacagagcacatgtgctacctccggagaagggctttatgagggacttgactggctctctaacaacatcgcaaacaaggtatacaactttacaatttttgaaatcgtattagtaagaaattgattgttaaagacttactcaaatgtgtgattaacttgcaggcttaggagaacaacgtgtggtttggtttttaatcgaggagagtcttgtcttcttccttctatcttttgttctttcgtctcaaactcttatcatttcatactctttgttcttcgctctaataatttacaagtttttttttttgttgcttttatcctataattcagactcttataaaatggggcccaatttcggcggatattccaattttttttttttttttgccggcatccaatttctttaggcttctgcatttaccgaatatatttctttgagatggcccaaattcgtgagatgaacttgaaaaatgttggaacagaatccaaacagtattcaaacggtataactaagagaaatcaaaatcaacgtattttgattcctatatgtcatcaagtatactaataaaaaaaaaaactgaatttagaactaatccgcaaatctgattggatgggggcagcaccagtacaaagagctacagttcccgatttaatcataattaaatacgttgtaagaaaaatgaagaagaagttaattaatagtagatctccactacacttttaacaattacatacactcaaaatcttagcggcattttttctaaaggtttcccaaagaaggagagctcactttatctttcgtctctcttcttaggtctagggttctggtggagaagattgtggttgtttcttagggttttctgagagaaagcatg

SEQ ID NO: 27083 - DNA, 3000 bp, Unknown; identical to SEQ ID NO: 14436
  misc_feature (1)..( 3000): 2750-1469P.txt file - cDNA_ID_2730040; gDNA_ID_2684118; Annot_ID_137177

SEQ ID NO: 27084 - DNA, 3000 bp, Unknown; identical to SEQ ID NO: 14434
  misc_feature (1)..( 3000): 2750-1469P.txt file - cDNA_ID_2730044; gDNA_ID_2684118; Annot_ID_137174

SEQ ID NO: 27085 - DNA, 3000 bp, Unknown; identical to SEQ ID NO: 14432
  misc_feature (1)..( 3000): 2750-1469P.txt file - cDNA_ID_2730060; gDNA_ID_2684118; Annot_ID_137170

SEQ ID NO: 27086 - DNA, 3000 bp, Unknown; identical to SEQ ID NO: 14430
  misc_feature (1)..( 3000): 2750-1469P.txt file - cDNA_ID_2730073; gDNA_ID_2684118; Annot_ID_190866

SEQ ID NO: 27087 - DNA, 3000 bp, Unknown; identical to SEQ ID NO: 14430
  misc_feature (1)..( 3000): 2750-1469P.txt file - cDNA_ID_2730073; gDNA_ID_2684118; Annot_ID_137165

SEQ ID NO: 27088 - DNA, 3003 bp, Unknown
  misc_feature (1)..( 3003): 2750-1469P.txt file - cDNA_ID_2730077; gDNA_ID_2684118; Annot_ID_137164
agagagcaaaatagcgttacaagttgcgaacgtttgactcgcttgacgagctttgttactgaacttccaattatatacggccacgtgttagggttggatctggtttttgcctaaatgcttagtttacatgggccaagcccaataagtcaacgatcgatgcattaattatttatactatagttgtggagaaaagatggatttatattctaatccagtttcgcagtcgatccatttgcaacttgaataatggttaggtcatggaataaaaaagctgtattttattactcatgagtaaaatcaatcctcacatgtcattataactcgacctagtaacagcccaccttaatggcccactaaagcccaaatttgaaataacggtcaaatcttaacatttaagttaacaaatgataaattagtagtatatgattaaactcaaatctaacaaggatgcaaatgatcatcgatcatcacatgtcaattaaaatttatttaacgttgtgtaacgcatataaaatgatataattattaatttcactaaaattttgaatttttttttatgaattgtcgggaagcggaaaagtgttaccgcaccacaaaaatcaacgatgacgtaccaacagtgaatgatttgacccccaaaaacccacacagtctctctctctctctctcaatttgggattcgagacgaaaccctagctctgatttttttcaattccgatggaggcgggagagcggcgcaatggcgattcgatgagtcacaatcaccgcgcaccgaagaagccacgtctcgctgggttattaaccgagtcagatatcgactctgagttcgctcaccaccagaccggtgttgccagaatcaacaacggtagcttcgggtgctgtcctggctccgttctcgaggcgcaacgcgagtggcagcttcgttatctccgtcagcctgatgagttctacttcaacggtctccgtcgtggacttctcgcttctcgaactgtgatcagtgacctaatcaacgccgatgatgttgatgaggtctctctcgttgataacgccaccactgctgctgctattgttcttcagaaagttggaaggtgtttctcggaagggaagtataagaaggaagatactgtagtgatgtttcactgtgcgtttcagagtgtgaagaagtcgattcaggcttatgtctctcgtgtgggaggttctactgttgaggttaggttacctttccctgtaaattcgaacgaagagattatctccaagtttagagaaggactagagaaaggtagagcgaatggtagaacggttaggttagctatcattgatcatataacgtcgatgccgtgtgttttgatgccggtacgagaattggttaagatctgcagagaggaaggtgtggagcaggtttttgttgatgcagctcatgccattggtagtgttaaagttgatgtgaaagaaatcggagctgattactatgtgagtaatctgcataaatggttcttttgtccaccgtctatcgcgtttttctattgtaagaaacgtggttctgagtctgatgttcatcaccctgtggtgtctcatgagtttggaaatggtttgcctatagaaagtgcctggattgggactagggattacagttcacagcttgtggttccatctgtgatggagtttgtaaacaggttcgagggagggatggaagggataatgatgaagaaccatgatgaagctgttagaatgggtttaatgctggctgatgcttggggaacgaatctagggtcacctccagaaatgtgtgttgggatggttatgatcggtttaccttcaaaactctgtgttggaagtgatgaagatgctattaagttgcggtcatatctgcgggttcattactcagttgaggttccagttttttatctcggattgagggatggagaggaaggagtgaaagacaaagacagtggactaattactgcgtatgttcggatctctcatcaggtctataacaaaactgaggattatgagagattgagagacgcaataacagagttagtcaaggatcagatgacttgtcaaaaccttcctgcattgtagtaaccaggtatgcttcagattcacaatcttgcttaccatctagagttgattgccatgcttaacatctgttggcttctctgccttcaaaatggtggactgtaaaaaagcagacaactttagatcttttttccatgctctaggtgatgattgcttgatcgtatatgaaccaaaccaattaaggtattgttcttctaaacatatgttttggttttggtggcagatatactttgataatccacaagagcctcattgagactctttcatagatcaactgccggtgtaacaataaggcgatggaagagccacgggcaaagattccggaggtaacatgtattgatgagcttgtggaggagcggcttgcaatggaagaagaagctaaccttgagaggccctctctttttattagtcttttataacgtttaacggctttgtatgattattgcaaataaaatcatgtgcgtctaatcttatcttcctcaaacattctgcttgcgaatctcctgtcgcagttccaataatttttccttattgaaaactttttccctcacattgaaagcatattcatagatatgtaatgacacctaatttatcattgttttgtatgattctggttcgttttcacatctatgtctattatgtctatttaccaacttcaaagttcaattaaaaaagggtcaaaagtactaaattgattccgatgaaacctgtcaggtcaaatcctactaaataataaccaatgggtattcctggagaatttgaaactcttgagatttgagttaacttgataccacgtgtcatccatcaggcggtttatcggagaagaagagtcttaaatccggcgagtaagaaactccgactgttttttgattcagagctaagcaaaaaaagcgtgattgtgttgtggagtagaggaagaagatg

SEQ ID NO: 27089 - DNA, 3000 bp, Unknown; identical to SEQ ID NO: 14427
  misc_feature (1)..( 3000): 2750-1469P.txt file - cDNA_ID_2730084; gDNA_ID_2684118; Annot_ID_137161

SEQ ID NO: 27090 - DNA, 3000 bp, Unknown; identical to SEQ ID NO: 14426
  misc_feature (1)..( 3000): 2750-1469P.txt file - cDNA_ID_2730091; gDNA_ID_2684118; Annot_ID_137159

SEQ ID NO: 27091 - DNA, 3000 bp, Unknown; identical to SEQ ID NO: 14424
  misc_feature (1)..( 3000): 2750-1469P.txt file - cDNA_ID_2730095; gDNA_ID_2684118; Annot_ID_190858

SEQ ID NO: 27092 - DNA, 3000 bp, Unknown; identical to SEQ ID NO: 14424
  misc_feature (1)..( 3000): 2750-1469P.txt file - cDNA_ID_2730095; gDNA_ID_2684118; Annot_ID_137157

SEQ ID NO: 27093 - DNA, 3000 bp, Unknown; identical to SEQ ID NO: 14522
  misc_feature (1)..( 3000): 2750-1469P.txt file - cDNA_ID_2730110; gDNA_ID_2684126; Annot_ID_137204

SEQ ID NO: 27094 - DNA, 3003 bp, Unknown
  misc_feature (1)..( 3003): 2750-1469P.txt file - cDNA_ID_2730122; gDNA_ID_2684126; Annot_ID_191108
tccattgaccacaaaaaaaaaatcctgaagttgtggaaaatttccatgaaactcatgtacccaaaaaccctttatttttttctacactcaagtttcaattaactcttctacgattcctttgaaaattatggtaatgtaggatttcatggaatttaaacttcaaagttcttcgatccccttcgagtctccaatacctactagttccataaaattattttgatagttaagattgacattagatctcactcatatattattacttcattacttaaacatggtatcattccaaaatattatttgcttccataagaacttttgtaattaaaagtcaagacaaaatatgcaactagtaccagaaatactaattcattagaaatggagttcaacaatttgtatgattatcagaaattctaatttattcactagaaatggattcaaacatttaatttatgttgaaaacataacatattaccatcgatctatatacatgtatagtgattgtcacatacacaactatacataacttatgagaaatatcttattctacgaggaagagacgacagaagaagaagagagacgagagatttgatccatgaggaagagcatgcgatcgtgatagtcacgtgcctgttctaaagactcgacctccagctccgccagctgcgagcagagttgctcttccgcctcctccgccacaaccgttcgctgccacaacttaatcatttctgtcttcatctccgccacttctctcgagagctctatgttcctcctccttagctcatccatctcttccgccgccaccgtcacgcatcctcctcggttcgccattaagattctttgtgtaaaaggatttgattgtggttctaactttgtttcttgatttgttgagtgttagggtttgattatgtttctttaataggcgctttgtgtagcttttgcatgtccaggttcaatgtatctgcttcttgatttttatttctcctcacttttgatttcggtcaatattttctccttacttgaaacttaaacatactcatggcttatgtatgcatagaccaccccaaaagagaaaatttactatttttttcgaatgttcaatttttttttttcgtttttttatcacagtttcgctaggttcgatttaaatattttttatatgaaacttaaaccaaattaatttcgaaatttccggtttatccatgttattaactagttttaactttaaaattaataaacaaattgccgtctatacaactataaattgataaatggataaatatatgttaacgtgtaaatagaatagtaattaataattctaatgccgtggtttacacaaattcaatttaattatttataaatctctggtccgtcaaatttgtaataaaaatgtgttggtctgatctctgatgtatgtatgtggtatatattgattacattattgagttagtagggcttgaaataggtgacgtctgaagccaatcactatagtgtttctcactttcttgtgatattgtgagtttgtgacaaggatttattctttagattattaactaacaagttaataatttgggaaaacgctgccgcttaatattgcgttacttatattatgattgaagaactattatgggatatttcacgacatcatacatctacaaccactataaaatagaaaattagtgtactatcaccaaaaatatatttctcctgttccatgaaatttgatgttttagatttttttttgttccataaaaattgatttcttaggttaatattattattatttttattaatgactaatagagagaggaaagaagtagaaattatattattaaattaacaaaaaaataatataaataacataaaagttaattttcttaatttgggtgaaaaacccaaaacatcattcttttaggaacatagagaatatataatagacatttacaacttatacatttgttgataacatgcagtatgttagtttgaatacatatttttcacaacagtaataataacagttgttagaagactaaactacattgtaagaatcgctttctcttgtaatgatacaatataacatataacatttaaaataaaataaaaatctgtaggttttaaaatgttagctacgtagtccataacttcaaaaaaccaatggttttgaactcattccatagtgatgattgcaaatacatattatctggtttacaaaaaaaaaaaaaaagtgttccaattatctagaaatgttgggcctaatgcttaaacagtaagcccatatacttaaacatccgacttggcgcatttgcttcaccttctctaccaaaaaagcgcgtgagattcaggttcactgtatacattaagagcctattgtcttgtctcctgtaaaaccagaagaaaacaaaaattcaacaaaggataacaaggacgtggctattcttcattggctgcattcacaagagtcgaatattaattagtaatttcacagtatagtacattaagattaacgagacctattgtctcctgtaattgaggcaacaagataagggtaaaacgagaaaaacaaaagagaacaaagacgtggctatttatcattggttgaattcaatattaatttaattagtaatttcacagtgttctcaaatcgtgatcgtgtgtgtttcttctacctctgaaactctttttgtttatgttgatcatcatcatcgtcatctgcgtgtaaaacacactcacgccatcgttgacgtctcagatcttcacataaaagcttctattatcaaactctcttcctcacggtaaccctaactatctgtaatttatctctctacactttcttcatctcttaatcaccttaatcatcttaagctttgtatttctagatccttctcccaaaacaacgattcgtgatctccgttctcatagatcagtttcggatttggatatttcttagggatttgtgtgagatatttttagaattgtttcgatttagggatttgtgtgaagaagatg

SEQ ID NO: 27095 - DNA, 3003 bp, Unknown; identical to SEQ ID NO: 27094
  misc_feature (1)..( 3003): 2750-1469P.txt file - cDNA_ID_2730122; gDNA_ID_2684126; Annot_ID_137199

SEQ ID NO: 27096 - DNA, 3000 bp, Unknown; identical to SEQ ID NO: 14513
  misc_feature (1)..( 3000): 2750-1469P.txt file - cDNA_ID_2730133; gDNA_ID_2684126; Annot_ID_191101

SEQ ID NO: 27097 - DNA, 3000 bp, Unknown; identical to SEQ ID NO: 14507
  misc_feature (1)..( 3000): 2750-1469P.txt file - cDNA_ID_2730133; gDNA_ID_2684126; Annot_ID_137193

SEQ ID NO: 27098 - DNA, 3000 bp, Unknown; identical to SEQ ID NO: 14506
  misc_feature (1)..( 3000): 2750-1469P.txt file - cDNA_ID_2730144; gDNA_ID_2684226; Annot_ID_192002

SEQ ID NO: 27099 - DNA, 3000 bp, Unknown; identical to SEQ ID NO: 14506
  misc_feature (1)..( 3000): 2750-1469P.txt file - cDNA_ID_2730144; gDNA_ID_2684126; Annot_ID_191097

SEQ ID NO: 27100 - DNA, 3000 bp, Unknown; identical to SEQ ID NO: 14506
  misc_feature (1)..( 3000): 2750-1469P.txt file - cDNA_ID_2730144; gDNA_ID_2684126; Annot_ID_137190

SEQ ID NO: 27101 - DNA, 3000 bp, Unknown; identical to SEQ ID NO: 14506
  misc_feature (1)..( 3000): 2750-1469P.txt file - cDNA_ID_2730144; gDNA_ID_2684226; Annot_ID_137589

SEQ ID NO: 27102 - DNA, 3000 bp, Unknown; identical to SEQ ID NO: 14505
  misc_feature (1)..( 3000): 2750-1469P.txt file - cDNA_ID_2730148; gDNA_ID_2684226; Annot_ID_192001

SEQ ID NO: 27103 - DNA, 3000 bp, Unknown; identical to SEQ ID NO: 14505
  misc_feature (1)..( 3000): 2750-1469P.txt file - cDNA_ID_2730148; gDNA_ID_2684126; Annot_ID_191096

SEQ ID NO: 27104 - DNA, 3000 bp, Unknown; identical to SEQ ID NO: 14505
  misc_feature (1)..( 3000): 2750-1469P.txt file - cDNA_ID_2730148; gDNA_ID_2684126; Annot_ID_137189

SEQ ID NO: 27105 - DNA, 3003 bp, Unknown
  misc_feature (1)..( 3003): 2750-1469P.txt file - cDNA_ID_2730158; gDNA_ID_2684126; Annot_ID_137183
ttaccaaaactgatacgagaatattgaatctctatgggctatgtatgtatatcagagtcatggctaagccatgggcacattttgtaaacactaatgttgtagtttcaactttcaatggtctaattgctgaacttcgacatgtttttaccatggcagcaaaaggtagaagtagctgattacaggaacaatgatgtcctttgaaatgaatgaccggaaaagtaagttcacattgtgagttctataaatattttctgctattggaagacatacctgttacttagttatacttaattcttcttttgcttatcacgttcttgagttagtagatcattcaatgtcatgttgttgttcggaaccccatttagtttcagtatatcttattaccaggttacgaagttactcatgctgtacttggatatacttaaacgtttcttatgtgatttgaaacagaaatcgggttaggcctgacaggatttggcgtattcttctcgtttttgggaatagtcttcgtctttgataagggattacttgccatgggaaatgtaagtatctcatgtatctttgtttctatactttgaccactattattgcatacacgtacagaactagtatgagagcttgtttcttttcatattttctcagattcttttcatctcgggggttagtctaaccattggcttcaagtctaccatgcagttcttcatgaagcgtcaaaattataaggtttgtttctgtctttgtctacattatcaatagcttgggccagtctctgctggatttttacagatttctacttaatgtcatctatgtgtgttcatttggctttatatgttatccactcagggaaccatctcttttggcgtcggtttcttctttgttatcatcgggtggcctatcttgggaatgatgttggagacctatggctttttcgtactcttcaggtacttttgcctattttcttcttctttactggtattgcttgaggaaatgtaaactgatactaaaaacgttttgcttttgcagtggcttctggcctaccttggcagtctttgctcagaagatacccgttctgggttggattattcagcaaccatatattagatcggtatgtgtccaattgcaaacaactatagcaaactttgcatgaaattcttagatctcgaatacaacacatacaaaactcataatgactcccagttttgcctttccaaattacagttgataattctctctttgtttctgatgatcttgagttgctaggccttttctcagtttggcttaactttaatagtaattctgttgcatagtctgccaattgttggctaatgcgattactttacactttttttttatgtgatgtgtagttctttgacaagtaccggggcaagcgagtgccggtctagtcttccatcccgagcagagagacgattcactgagctagatgcagctgaacaggcgattaaagtttttggaagaagaagtttcgtgatcctgtagaaaactaaaaccataggagaaagaaaataggaaggaaaagaacgtacaatttgaagctgtgtgtctatgtttcaggtgaagtagatgaatcttcgtccaggttgcaaattgcaacagaatgttaaaaatgtaatgttttatttttgggttagttataggttacacctcaattttggaaactaattaaagagaaacaattgtttctattcacaaaaactttttgtaaccattacgcattacataattttaatcatattgttattaacttaatggttctatttgaccaaaaacaaaaacttagaggttatttgacaaacagattacttaaagagggaccgaaaaataaaaacacaaaagaactgagtgaatcaactaaagggtaattccggtatttcaggaaagttttaaggacgacccctactaatggataaagtagaaaccctagtttgaattttcacggccgacctctctctctcatctactaagctctcctccgagtattgttggcttcagaccaaatcttctccggcgctgtagcgtttcccccggtacggattcattcacctctctctctctatcgctctccctctctctatctctatctatctgttgttttctctgaatttggtttccgtgttcttatgaattcgatggtttggtgtttcaatttcgttaatttcactgataattgttggtcttttggctctcttgaggtgaatatacttcgctatggtcgtgggggtagtttccttgacttcaattagcttttttatgtcgaatgttcttgagttgtttaaggtgatttttgattaaattcagaaggtcttatgtttgttagaatctgtcttttattcattgtccttactgaggaaatttttttacttgcattgaaaagaaacataatttaccaagaggttctatgtaacgatgatttgtgggtcgatctgtattttaaatagtcgttaaaagtagaatttttgttgtatgtttgaaaggaataatggtttgagtaaggaagaagaacaaggtagatgcatgagtctatgttacatgatgtcatgacacatgctttctttatgatagatggcaagagcttggaacatgagcattgcaatggttcatagggatatagagagggattggggagatcaatgtggatattgtttttattattaatggagattcatgggaacgatctggagaaatatatatatttcaatattttaaatagcttttggagcatattggagcaaataagcatttggagcttgtggagcactgctctgacccaggattgctctcacttggtttgcttcatatatattttggtcttaccatgttttctttttcttttcttatcatcgtctcattttgatgctggggctatgtcgaaagctgtttgagtggaggttctttgtctatagcagtaaattttgatcctttatttatttcgtttcctttttattctcatgtgcagtttcccctttttaacctttgcaaacaatg

SEQ ID NO: 27106 - DNA, 669 bp, Unknown; identical to SEQ ID NO: 14503
  misc_feature (1)..( 669): 2750-1469P.txt file - cDNA_ID_2730160; gDNA_ID_2684126; Annot_ID_137181

SEQ ID NO: 27107 - DNA, 2427 bp, Unknown
  misc_feature (1)..( 2427): 2750-1469P.txt file - cDNA_ID_2730164; gDNA_ID_2684202; Annot_ID_137238
ttcacaagaagcccaattatgattcaattagaagcccgcaaaaccatgtaattagaaatttctagcaagtttagattcacagaaatatgttgttataacttataagcatcaatgtagctaattttggaagttgccagccactatccacaactctccttcttcatcatttcaagacatcaatctaagatttactgattaagcttagcgttctttatttccccttgcactaaataaagctcttactgagttattttattttgtatctttgctatccatcttatattcagctcctttgagcaaaaatcgatcgtgatttggattctcccacaaatcctaggggagttaattagccacgtaacaactttgaaagtcaccagtctctccccattcctcatctaaatatcaaaagtcaaacgttcaaatccccttgagtccttgacgttaattttttgttatagaaaaacgaacggaaaaagaaaagtgagattagaagatcatttatagaagagaacaaaacaacgatggttgttatacgctcacaatcaagatccccttgatcaacatgttgctaaacgcagacaaggactcgcggagacaacaatggttgttacgtattcaaaattaagaaacaagctaagaaaaaccttcatattcttaagcatacattaaaggctacataatcaatagtactgacaacgatcataacttcaaaataatgcattaatcacttgagatttaccaatagttggattttgaatctcgagttctaactccaaagctgcattttcattgtttttttaatactcatccatcgtacggcgtttattatgcgatctaccacccatgtgcatgtatttatctcacttaatggttttattattcaattcttgtaattcctttttgtttttcaaaatgagatgatctaccacccttgtgtatgtaattatctaacttaagtatttcatttacgttactcatgataacactcgatgatctaaagtttagttacattttatagaatgctatacttcacttagatatcagatgtgggttcaaaaccataaaaaaatatataaaatcatgacttatattcaacgcattcgcggagacgttgatattgtttcacaaaaataggaaattaacacacgcgtagaaatattcatgtatctatttgtgttcatacaaattaaagatgtttaaaataagatattgttaaaaaaaaagatattgttaaaaaaagaaaagaaaaaagatattgttataataagaaaaatataaatattgtcaatagtagcatgtaatatgagaaattgaatcaaacgtaaaatcgtgatcataaaaaataaaattcaaaagtaaagaaaaacatgcattgtccattttttttaatacttgaatttgtttaataattaatcctcgagttacgtacgttcactagttatttccaatcgacaaacaaattcaacggtttcgaaaattctgaacagaaataaaagatgtagtttcatacaaaataaatgttagttttttattttgtttgtgtgatgatattcagccttccaaaacatatttgttggtgaaagacaagtttttggctgtcggtagtacgaccatttaaattaaggaaaatcaactccaagattcacggatgtataaaatccaccatttgaatactgccacgtggcagtagaccaccagaagacgtgtacaagtgtgtctcctcctctccatgtataaagatgaccgttgccacttgccagtgccacatatgatcgtcggctccggtgattttcgctctctctgcggccacacttgtttgcttggtctctttgtaatactttaacatcacttagtatattgcatgtttcattctttctttctctgattttgttttcgtgagatattaaagagttcataacatataatttcgatgtcagaccgtattaaaaaagttttttttgtggattagattcacgatgcattttaatcagtggagtttaatgaaagaattagattcttaataattttgggtacatatgcaatttcagattttctttgtcataaaaggaaaatttcatttctttttgcttgttttgtgcattgcgatgtttgtctaattcagataagcacatagcgttttcctattttcagctactaaagtacccaaaaaacataaagactttgagattcttctctacatagtgggtgaaaaaaagactacatcataaaaaaaactacacgatatgaagtcatttatatgtgttatataacttcctttgtgtgtggttaggtcatataaagacctgttgcaaaggctaacatctgatcagagcgacgtggtttagaatctccgagtgatttgaggggatatggaggaagaaagagtggaaggctcgaaaaggccatttcaaggtatcataagagatg

SEQ ID NO: 27108 - DNA, 3003 bp, Unknown; identical to SEQ ID NO: 21416
  misc_feature (1)..( 3003): 2750-1469P.txt file - cDNA_ID_2730172; gDNA_ID_2684202; Annot_ID_191248

SEQ ID NO: 27109 - DNA, 3003 bp, Unknown; identical to SEQ ID NO: 21416
  misc_feature (1)..( 3003): 2750-1469P.txt file - cDNA_ID_2730172; gDNA_ID_1971889; Annot_ID_176807

SEQ ID NO: 27110 - DNA, 3003 bp, Unknown; identical to SEQ ID NO: 21416
  misc_feature (1)..( 3003): 2750-1469P.txt file - cDNA_ID_2730172; gDNA_ID_2684202; Annot_ID_137223

SEQ ID NO: 27111 - DNA, 3000 bp, Unknown; identical to SEQ ID NO: 14555
  misc_feature (1)..( 3000): 2750-1469P.txt file - cDNA_ID_2730192; gDNA_ID_2684202; Annot_ID_191240

SEQ ID NO: 27112 - DNA, 3000 bp, Unknown; identical to SEQ ID NO: 14555
  misc_feature (1)..( 3000): 2750-1469P.txt file - cDNA_ID_2730192; gDNA_ID_2684202; Annot_ID_137215

SEQ ID NO: 27113 - DNA, 3003 bp, Unknown
  misc_feature (1)..( 3003): 2750-1469P.txt file - cDNA_ID_2730206; gDNA_ID_2684202; Annot_ID_137210
atagccgaatctagaaatacttggcgggagatggaattgattggggcgaacaagcacattatatttttaagggtttccttcgacttctcttttatattttagggctaaacgaaagctctgattccttaaggccgtcagccaccgccgaagaggagcttcgttggtctcttaagaaagaaaagaaggggagaatatggcttatcaagaagcaatgaagcccaatcccacgaaggctggtttggaagaagtgatggcatctctgacatcagttcgatacttgtaaaaagtgtgaagctatccaaatccattacaaaactgtttcattacggcgatttttggagatagcttttctcgttttttgcatgttgatctgactgatctcagatatctcatcggaaccgtagtaaatacatcatcatctacttgcaagaagtgcatttatcctgtttgtatgaatccatgtctttcccctacttgtgatggtgtctagctcaacttaattactctttagccttaataatgaacagtcttatcgatcctgcttaattaaatattgaatggaagtttggtttgtggtaggttcggcaaattttgcctaactagtacataaatgattgatcaagtccactctttatagactgtagtatataaattattataattttgttaaccttgtaacatgattttaaaaattagaacccacttatttatttctctatcaggatggtatgttaatagaatgaactatagaacagatcaacagacagtaaatgaaacttaaagaaaaaaatacaaatggctcatataaaatgaacttgcagaaatacagtttgatcacagaataagagagggtttatcaatttggcttctgcgtcatttcggcaatggcgggtcgcagagacaggatccaacagctccgtggatctcgaattgcgattgccatctttgtcggaattcttatcggctgtgtctgttccgtcttgttcccgaacggcttctttaactcgggatcatccttgattgctaacgaagaacgcatttcgaaatcaacctctacggtactgagagagatcttatgctttaaacatctacaaattcctttttttagaaatttttctgtaatctcgagctctcgatttgtgattagaattagtgtttgttggaatttgagaatttgagtctcttgcgtttgttatgaagattcaaaatcttcatggatttttgagtagaactacaaattgcatgtcttgaacatttgagtttaactggtgaagtttcattttttttctctgttttttgaattgttcaggatggattggcttcatgtgaatcatctgaacgagtcaaaatgctcaaatcagacttttcaattatctcggtaaagaacgcagagttaaggaagcaggtaagagaactaacggagaaggtacggttggcggaacaggaaacagagaatgcaaggaaacaagtcttagttttgggatcagagataaaggcagggccttttggtactgtcaagagtctgagaactaatccaactgttgttcctgatgagtctgttaacccgagattagctaagcttttagagaaagtagctgtcaataaagagatcattgtggttcttgcaaattcaaatgtgaaaccaatgttggagttgcagattgctagtgtaaagagagttggtattcaaaactacctcattgtcgcgttggatgattccatggaaagtttctgcgaatcgaaggaggttgtgttttacaagcgagatccagataaagcagtggacatggttggaaaaagcggaggtaatcacgctgtttccggactgaagttccgcgtcttaagagagttcttgcagcttggttacagtgttcttctatcggatgtggacattgtcttcttgcagaatccttttagtcatttacacagagactctgatgttgagtcaatgagtgatggtcacgacaataacacggcttatggcttcaacgatgtgtttgatgaaccatcaatgggatgggctaggtatgcacacacaatgaggatatgggttttcaattcagggtttttctatctaagaccaactattccttcaatagacctactcgatcgtgtggcagatacactctctaagtcagaggcatgggaccaagcggttttcaacgagcaactcttttacccttcgcatccagggtacactggcttacacgcttccaagagagtcatggatatgtacgagttcatgaacagtaaggtactcttcaaaacagtgagaaagaatcaagaactgaagaagttgaagccagtgattgtgcatctcaattaccatccagataaactcgaacgaatgcacgctgtggtagagttctacgttaatggcaaacaagatgcgttggatagctttcccgatggttcagattgataaaagagatggatgcttgttaagcaagatatcgaaaaacccaatcatcttcttcttcctcgagttaagaaaaaaggtaggctaagtttcatcttcccacatctgttgttataatcagttatccttttaggttcctagttcttcttctctactaagaatcttgtgtagcctatagctgaaaaactcaagagtcttattaacaatactgtattgttgaccacagtttcttatttagtcagaaaagtctctctttttttaactatgcattatttcctgaccacaaaaaaaaattatgagagagacaacaaacgagagattaggcaagaaagagagatatggaagaacaaggaagacaaagagagtgtaagagttttggatgtatgtgggttttatccacaaacaagactctttaagattcttctctctgtaatgaccggaaaatcccatttttttgtggtttcaaatcaaatggaaccccactcttacctctgtctttgtctttttcttaaagccttttgtttcagcctctgtatgtatctccctctccggagcaattgcaaattctgtgtctttgtgctatg

SEQ ID NO: 27114 - DNA, 1458 bp, Unknown; identical to SEQ ID NO: 14551
  misc_feature (1)..( 1458): 2750-1469P.txt file - cDNA_ID_2730213; gDNA_ID_2684202; Annot_ID_191230

SEQ ID NO: 27115 - DNA, 1458 bp, Unknown; identical to SEQ ID NO: 14551
  misc_feature (1)..( 1458): 2750-1469P.txt file - cDNA_ID_2730213; gDNA_ID_2684202; Annot_ID_137207

SEQ ID NO: 27116 - DNA, 3003 bp, Unknown
  misc_feature (1)..( 3003): 2750-1469P.txt file - cDNA_ID_2730229; gDNA_ID_2684203; Annot_ID_137263
tgcaacctgtctttcaatgcttttgtactttttgcaacttcagttgttgactgtaattctctgccctaattgaaactgctctgtatttactctttactgaccattggtaaccttctccgtaatgtagacactggatgttcttctaagggtgctaattgaatttccaaaggtcgagcctttgcggagtaaggtatgagtttagttgtattttattaagtagacatattgtaatcagtagtgttgcatattcttttccattaagttattgattcacaggtcagtgattagcttgttccccttttctgtaggtcacatcattcatacaccgtatggttgatacccttggatccgctgtgttcccttatcttcccaaggctttggaacagctacttgctgacagtgaggtaaaacgaaaatttcaaacctccccttattattcaatgctccactgctttcatttcctttaattaatattaagttgatctcctacgattcacttacttacctgggagtaatatctactaatcaagatacgtcatttcgggcaatgatgctgcacactaatttgattacttcttcaacaaaaagtcttactgtgtatgtgtattgttgcagccaaaggaaatggttggtttcatggtattactcaatcagcttatctgcaaattcaacagcgctctccatgatatactggaagaagtatatcccgtggttgctgttaggattttcaatgtaattccaagagatgggctcccttcacgccctggggctgttactgaggtatttcgtttgattttctttcttaactcaattttatgatctgcaattgtaacttgagaacctgctgatatcgtagcatcctttacatccagtcatatatccttttttttttggtgtaggaaatgagggaactgatagagcttcaaaggatgctgtatacatttcttcatgttatagccacacacgatctttcttctgtatttcttacgccgaaaagtagggcgtatctagatcctatgatgcagctggttttgaatacttcttgtaatcacaaggatattaccgtacgtaaggtttgtaacactttccctttggttgcatattcatttaattttgatgatctttttcgcttacttattatccacttgttttactctttgccataaaaataggcgtgcgtgcagatatttataaagcttattaaagattggtgtgccgagccatatagcgaggagaaggtaggcttgttaaataatttttattaaccttcttttcttcatgaaagaaggacaaatgtcataatcaagaactatttttgctttcaggttccaggttttcagaatttcgtgatcgaagcgtttgcaacaaactgttgtttgtacagtgtgctagataaatccttcaatttcagtgatgcaaatacggtaagcttaagaaacttcaattctcttttcattttggagttttatctgtccgttgcagttgtataaacttctgaattgtttccacaactgactgggtttcttccttcgctatgcatcgcagcacgcattgttcggggaaatcatcacggctcagaaagtaatgtatgaaaaatttggtaatacgtttctcatgcatcttatgtcgaaaagtttcccatcagcacatattccacaagatttggcggagcagtattgccaaaagttgcaggtttgttaagttttactccctcaaaacgaccataagtagataaaaaattatctcgtcttgtgcttaaacatagtctctcctttccgtgtttggtattccagggcaatgatatccgaagcctcaagtcatactaccagtcccttatagaaaatctccggcttcaacaaaacgggagtcacgttttcagatagcattcgaaatacagctagtttcatagaaagaaaggtctctcaggtcaattccgctacgagctctaatggttttaccaagaaagctctcttcctcaatttttgtacatgacaggtttgaagtcatgtgcttaatataatgttcatctctttacaggcttctccagatgtaaatagtatttgtcaatgtctacttgagaggtggcaacaaggttcgctttcaccatccagatcaaattagatcaaaagcttgagagagattcatactgttgttgatgttggttcttctcaaatctgcagttgtatcttcttacacataatcatgttctccgactcgaaccaagggccttacaagttgttccagtgcacacacacactctgaggcagatcagctgttatttcttattgcgctttgttgtgagattgtgtctataaagcccttccttttttggtcctatctccaagttttgatggtcttataactctctgcagtcgatgttttctgtttttctttgtccatgaaaatactttagaaaaaaactatgagagatcataaaagacagacacacaaaacaattttggctgaattttgttttcctattttattcatttaattaatatgaaattgtattatttttcgatattgaggtctcctcttattttctaacttattttgagacaccaaacacagattgttcttttgacaattgaagtggcaaagaaaataaaaagaggttaaaaaaaactaagataaaagagatcgaaacaatgaatttgttatatttcgggatggcattgatagataatttaatattttgtgtaaactacgtatttttacccaaaaaatctgaaatctatatgtttttaagtgttaaaaagtgtcatatccgtaaaattttaataaaaatagcaatttccaaaattttatatgaaaaatagcaaaatcaacaataacccttaaaaaataaaagagggttatatttatatattgtaacggtgaaaaatcgtcatctacttcttcttgaaaccctagttccaaaatctgcacacacactcagaagaagaagacgtcatctctctatctctgtctttctgctaatttcacgaagaatctgagaatatg

SEQ ID NO: 27117 - DNA, 3003 bp, Unknown
  misc_feature (1)..( 3003): 2750-1469P.txt file - cDNA_ID_2730233; gDNA_ID_2684203; Annot_ID_137262
agcatattgaatcggaaaattattttgtatttgttttttctgaccttgtcttcctctccttgtctgtccctccttcttacagctattatcccataagtgagcttcatatctccctgtccatctatgcctgtatacacgcacaacataaatatgtgtcgacacaattatacataatctacaaaataaaatgacaaatatacataagtaacataattgtggcattcacatttttcttacgtgtaagtttgagacatcatttaaaccaaaacaaatgtttgagacgtcattatttaataacgtacgtaccttgtaactccacgatactgagaagttctttgtccataactatcaaccgacttccgaggaacggattcctttacctgaggtttaacaaccaatctcttccgcttctcatctaccttaaccggttcttcgacccgtgcggatacattcgattcgttgatcaaatcagaacaagccccatggctcaaagccaatgatagcattgagccattggtgttataaccagtctcttcgttactaaaatgactaatattattgctcgtaccagcctcttcagtaacgtaatgactcgagagtgggaatgctggagtgccttgctctaaccaagatttgaaaaccgagaccgaaccgaccctctcaaaacctccataatcattgctaaggttcggatctaggttcgggtaatgtggtgtaactacggtttggtcgtggagaaggtaaccgggtgggtttaacctgttaaccacagtggtgcagttgacattggtttggttatggtttataggatactcggtttgatgagagtttgagaggagatcttccacctttggaacgtcttcatcatgatgatgatgatcaaagttaatatcatatctccaaactacacataaaatagaaatcaaattaagaatattaatagtggccacaccaacaacatatatataccagggggatgatgtgtgaagaagagagtaccatcggaaccgtcatgcctaagttcttcttcttcactattgcagattctcaaaggaggtgtcaatgaaaatcccaaccatttcttcatctctctctctctctctagctgtctttctcgctcttagtttatatgtatagggtttcgttttatatgatttgtagtctcatacgtgcgaatatacattaatatttttcataagtctaaaacatttaataaattatataattaaaaaggtggaaaaaagatttgagacaaaacaggtggcggtgaagttttgtcgtaagcatgaaagaaaggaagaggaagtttctctctccctcactctttcacattctctttcacacacacttgcatctgacttctagagttttgtgcccactctccctcggatcttttcgatgtatacgtatatatatatgggagatacacatgacacactacaatgaaaattttcgttctttggtatttgattaacttttccgtaaaaaaagcacacagtagcgcttaaaaaagtcagtattttgtttctttcgaaatatgttaattagacaataatacatttcttttattaatgtctttctttcgatataatttgggatattttttaataaacttaaagaacattacataatttaaaagtaaacaaaatttgtactaaaattagtagtattgcaaggaaatttctccttagacgataaaaatgtgtttttgattgctcattcaatcgatccgtttgaaaatgattctaactgtgatggagaagcctgaaatgatcttgctgttttcgcagattagacaaagatcaatctaaaagataaaagatatatatagctggagtgtttggcaatatgctatctaactcataaaatttgcctcaagtgtgagaagcggataatgtgacggtataacctttgaaaacagacacacaaaatatgatagaacaaaagaataagtgatctctcttatttggttgattatattgcatatgttgcttatagatagaaaatgaaattgtgttccaagctgttaaccaagacttagtgggtagtttgtccatactcgccacccacataacgaaatgtcgttctacacaaaaagccacaattgttttctttaacaactgaaaaatgaatttgtgattttatatcttgctacgggcatcggaaatattccaacctcttctacgaggtaatcgacaatgccattacagaacaaaccttttcttacaattacctagtttgtagtatacaaaataaaaatcgagaggtcttagctacagaagttgtctccatgaataatttcacagtaagtagtttagttatatgtattaatgtgacaatttgttttataaaacattagattaagaaagtgaaaaaacaccattatatttgctaactcacaaaacatttatacatgtctatcttaatctatcagtatgcaacacctaaggcctaaggtgagagagattcaagcccatgggctgatttactgaattcagatgacggttaattttcaattcgctggcaataatatttatagttctctgggaaaatattctgcaagctaataaaaatctgtgtataaaaaaaaaaaaaccctacagctccgtcttctctccagtctcacaattttcctcatatttataaatccgtaagggaaattttctagaaactcaccaaaaaaaagtattctttgaattcaaagagaaacccaaactagggtttccataatcccttttctactatatctcccactctcataaatccgatcgctaaaatcgccacgatccttactttctggtaagctctcaagcgaaacccactaaaagtttcgtctttttcttcttcgcatcaaaatctgataagggaagagaacagtgaaggagagaagctagctgacgatactaattcaaggcattgtttgacttgtatgcaacaaaccaggactggattttgaaatctcggtttttagggtttttgtagtggggttaagttaacacaatg

SEQ ID NO: 27118 - DNA, 3000 bp, Unknown; identical to SEQ ID NO: 14582
  misc_feature (1)..( 3000): 2750-1469P.txt file - cDNA_ID_2730254; gDNA_ID_2684203; Annot_ID_191301

SEQ ID NO: 27119 - DNA, 3000 bp, Unknown; identical to SEQ ID NO: 14582
  misc_feature (1)..( 3000): 2750-1469P.txt file - cDNA_ID_2730254; gDNA_ID_2684203; Annot_ID_137252

SEQ ID NO: 27120 - DNA, 3003 bp, Unknown
  misc_feature (1)..( 3003): 2750-1469P.txt file - cDNA_ID_2730258; gDNA_ID_2684203; Annot_ID_191300
acataatcaattggagtgctctcatcaatgtcgtcacttgttccatgagtctctttgtcatggtgacgactcttggacttttcatgatgacccattgcctctatttcttctttaactcgttcaaacacatttggcgatttcacagtcttctcctctgtggaaatacccaattaaaacaaagggtttagattcgtgtttcataagagacaaaacagagcaacgaatcaaaaatagacttatcatggcgtgtttctattgtttctttagagaaatttccgatcaaaaccatccattaatagacgtgtaattttgattgtgaaatttgaggaaacgaacataacttgatcaaaaagtcttcctttttaacaatatgcataaacctatgatgagatctgatcgttcattgtgtttacctgatcggttttgatccgccatcgatggtttttgtcttcttgatcttgcagctttctatttttggttcctgattcggtggcgttttgcgtcagatgcaaaagagtctttacagtataaatcaaaatcgatttcaacttaaatgggccttgttgggttataatgggcctttttgtttgtaagtgagtccaaggaaaaaaaacaccagaccagattgaaattgaatcacttgcaaaagcaaaattgattactctgttttggttttggatcagatcaaccaaaggaagcgaagaagaagaagactttatacactctcgacgctattgatttcgtctgtgcagttttgtttctctatcagttagttttaaagatgagttcttcagagagtgtggaaaacgagtgcatgtgttgggctgcaagagatccatctggtcttctttctcctcatactatcactcgcaggtgagattcatatgatttagtgatcattttcaagcaacaatctttgacacacaatcatcatcatccaggtctgttacaactgacgatgtttcactcacaatcactcattgtggagtgtgttacgctgatgttatctggagtagaaaccaacatggagactccaagtaccctttggttcctgggtatgttttcaaaaaccaaactttagattatgaaattgcaccttactagtggaattgatattcatttgtttttccttattgtaaggcatgagattgctggaatagtgactaaggttgggcctaatgttcaacgattcaaagttggagaccatgttggtgttggaacgtatgttaactcctgcagggagtgtgaatattgtaatgaaggacaagaagttaattgtgcgaaaggagtttttactttcaatggcattgatcatgatggctctgttactaaaggaggctactctagtcacattgttgttcatgaaaggttgttataatctgctttcctctcttgccatttcatacttttgaaagttgttagtgcctatatgagtttagtttgagtaggaagcaaatgatttctcagtactagtttcttttgtgtttcaaatattgaatacaataggtactgctacaagatacctgtggactatcccttggaatcagctgcaccattactctgtgctggaatcacggtttatgctcctatgatgcgtcacaatatgaatcaacctggtaaatctcttggggtgatcgggctaggtggtcttggacacatggcggttaagtttggcaaggcttttggacttagtgttacggtttttagcaccagcatttccaagaaagaagaagctttgaatctgctaggagctgagaatttcgttatctcatctgaccatgaccagatgaaggtagtgaaatgacttaattagtttcttgtgattatttaggattggaaccagataatacttaacttgtgaatctatctatgcaggcactagagaaatctctagactttctagttgacacagcatctggtgatcacgcgtttgatccttacatgtctctcttgaagattgctggaacttatgtattggttggtttcccaagtgaaattaaaatcagtcctgccaatctcaatcttggtatgtttctcaaaaggtcttataatctccaattttacatacatactctttaagatactgtcatactgaaaccaaagatgtctggacaggtatgagaatgctcgctggaagtgtaaccggggggaccaaaataacacagcaaatgttagatttctgtgcagctcataagatttatccaaacatagaggtgattcccattcaaaagataaacgaagctctcgaaagagtggtgaagaaggacatcaagtaccgtttcgtgattgacatcaagaactccctcaaatagatgttgctcaaaggaaggaataatggagtctgtaataagagaataatactcactgctacaatctttattacgtattttctcgtttttcattagtaaagcaaataaattaagactactgagaagaaattgctcgtaagcttgggtaataagaggaaaagagatttacaaaaactacaaaaattcccaaaattagactttaaagagttatgggtaaaaaataaagaaacaagaactaaggtggccatctcgtaataaactctatatatatgtacctaactcaaattaaaggagattaatatcacgcgaggcatgagagataaattatttctttttccaatgtatgagttatttaatttatgtggacgaaagcgaaatgtcaatgaatgttgttaccgttaaattaaaaaaaaaatgatttttctccttccttccccaaaatttcaaatttcaaactcttctcttcttttaacaattgtaaacctttttgtcgacatcattcttcaggccaccaaagttcccagaaactttctctttcttcttcttctccttcttcttctctctcgagtttttttacaaatatattctcgaacccacctttctccgccggatctgattccaaaacctgtgaaagtctccagctttactacagatttttgaagaacaacaaaagggtttcaaatttgagcaaatg

SEQ ID NO: 27121 - DNA, 3003 bp, Unknown; identical to SEQ ID NO: 27120
  misc_feature (1)..( 3003): 2750-1469P.txt file - cDNA_ID_2730258; gDNA_ID_2684203; Annot_ID_137251

SEQ ID NO: 27122 - DNA, 3003 bp, Unknown
  misc_feature (1)..( 3003): 2750-1469P.txt file - cDNA_ID_2730262; gDNA_ID_2684203; Annot_ID_191299
tgcatttgttactgctaggtccccatcctataaatgttttccttttcaactttttttttttctgagtaacttcagagaatccttcaacaaaaaacgagaattactacatacatatcaaaattaggccgaaaccaaaacttacttgtggaaaaaatggcatatgattaggacattggacaagccgttgtaatgtcgtggtcaaagtccatactattgattacttcaaccaacagctcatcgtatccgttggtttgtatgactttatcaaccgaaataatactctgatcaaatcccaaatcggacgaccaaaaatcgaaacgtggagggagggatgaggacccacaaagaggagtcccacaacggaatttaaatcgttggttcatttaaaacactaatcaacgtggtggtcctctttacgtgcaacccaacacggcttggtgaaaccaatcaatccgccaaattaaattctaaattgtaagtatgtaatttattactagtatacattttgttgtattattgtagtattacgtttgtaaatatatttaagtatcatatgggcttgtctggttttaatgcgacaaatattttatagaaagaatgatagagtaaagaacttttgaagactttagaagattagaaaatgttttatttgattgatagtgtttatatttttatatctaaactctcaatccccaatatatttcctaataagaaacgttttaaatttaatatccaccggatgataaacaggtgtcgtatgctattacgtacaattcttttttcctaataggacataagaatctagtaatcatataatttctttggtcccgccgtatttatacgacaaatcaagctaactataagtctataatcaatagtggacacgttatatatcgtgtataacatggagtgtgtaaaatcattagaagactcaagtaaccatttgggctttagttcaattttcatcagttttacagtttgatagtctccaataatatctttcgttccactaactaaaactcgatttaaattatctagtatttgttttgaggatatatgcatccgaataaagaggattcaaaagtatcaaaaagtgtcaaaagaagaatgaaaaaatcataaatggcatagtggtgacgattgtaactttcttattggagtggttcgatttccaaaatcatggggaaaattaaaagttaggcacatcacattcataagagtacaagacaactctcataaaaccaaaagagtcgtttcgtttggtgtgctattttaccaatcgttaagtctatttcttttttatttcctcccattacaacaaacaaataaagttgaaaagaaaaacaaaaaaccaaatgatattttgtctattgactccaacaagataaagtcaagaaacaatcttagtgttcttagatacttttattaaagtctctgcaaaatgctatatggtcttcttctatagagaaatatcttctggttagaaatcattggttttacatggttctatagaaactctctcgaacatatgaatcgattaattctttctgatcaaaccaagtagattgacgagttcacaactttgtcatgaaaatgtcttcatctccacaagatctacattattaaatctctatgatcttcgagatagattataaacttggttcaccaccacctcactaacccgtgagggacatcaattcaaataaagttacaaatcagagtacgttacaaatacaatgactaagaaactcggtttactccaaaccggcaaaactcctctttccttataattcataaaccaaacatcaccatcttgaccatctcttaaaccaaagacttaacaatctcaattcgagttcacacaaattagcattcgattgtgacatttgcaaatgtaatggagataggacatagtattcatcactttaaaacactcttattgataaatccaagagtcacttaactttttctggtaatcgctgttaaagactccaactcaaaaacaatcacattattccaagtcttaacattctgatacgattcattacaagaaactgagtttatctaagattttcttctcacttgtgcattaacatatatacacacaacataacacagatatgatacaatttcacttctttgaagaacgcttgggagtaacagcattaaagatagcttcaatctcttctttcagtcgttgaaagaaaccaggtcctttcacataatcaattggagtgctctcatcaatgtcgtcacttgttccatgagtctctttgtcatggtgacgactcttggacttttcatgatgacccattgcctctatttcttctttaactcgttcaaacacatttggcgatttcacagtcttctcctctgtggaaatacccaattaaaacaaagggtttagattcgtgtttcataagagacaaaacagagcaacgaatcaaaaatagacttatcatggcgtgtttctattgtttctttagagaaatttccgatcaaaaccatccattaatagacgtgtaattttgattgtgaaatttgaggaaacgaacataacttgatcaaaaagtcttcctttttaacaatatgcataaacctatgatgagatctgatcgttcattgtgtttacctgatcggttttgatccgccatcgatggtttttgtcttcttgatcttgcagctttctatttttggttcctgattcggtggcgttttgcgtcagatgcaaaagagtctttacagtataaatcaaaatcgatttcaacttaaatgggccttgttgggttataatgggcctttttgtttgtaagtgagtccaaggaaaaaaaacaccagaccagattgaaattgaatcacttgcaaaagcaaaattgattactctgttttggttttggatcagatcaaccaaaggaagcgaagaagaagaagactttatacactctcgacgctattgatttcgtctgtgcagttttgtttctctatcagttagttttaaagatg

SEQ ID NO: 27123 - DNA, 3003 bp, Unknown; identical to SEQ ID NO: 27122
  misc_feature (1)..( 3003): 2750-1469P.txt file - cDNA_ID_2730262; gDNA_ID_2684203; Annot_ID_137250

SEQ ID NO: 27124 - DNA, 3000 bp, Unknown; identical to SEQ ID NO: 14580
  misc_feature (1)..( 3000): 2750-1469P.txt file - cDNA_ID_2730269; gDNA_ID_2684203; Annot_ID_137248

SEQ ID NO: 27125 - DNA, 3000 bp, Unknown; identical to SEQ ID NO: 14579
  misc_feature (1)..( 3000): 2750-1469P.txt file - cDNA_ID_2730273; gDNA_ID_2684203; Annot_ID_191295

SEQ ID NO: 27126 - DNA, 3000 bp, Unknown; identical to SEQ ID NO: 14579
  misc_feature (1)..( 3000): 2750-1469P.txt file - cDNA_ID_2730273; gDNA_ID_2684203; Annot_ID_137247

SEQ ID NO: 27127 - DNA, 3003 bp, Unknown
  misc_feature (1)..( 3003): 2750-1469P.txt file - cDNA_ID_2730281; gDNA_ID_2684203; Annot_ID_191293
tccgggatccagaattcgctgatcagctcatccatcgctccaacattgacctaaaggtttctcttttcttcactcacctctttaaaatcactctcgttgaaccatatattaaacctagacatcgaatttgagaccaacccggagtgcattatgtactctgtcgtatctgcttagtttaagatccataaaaaatcaaaacttttggcaataggttttattagtgttgcctcttatcattggttataggattagagattccttggatagattataagtttttttttttattgattcaagtgtgcaatacctaaagctagcttggttgagttggagatttgaggtggaaagagtagtactgtccttcattttgctatggatttcttttacttggtggtagtcttatgaagaagagtttgaaaattttgtgtgtttcaatacttaataggataagtggcgtaacttgagtgttccccctggtactcaaagtttaactaataaggcacggccagcaaaagtcaaagaggaaggcgacactccggctgcagatgcaaatgatgctgtcactattccacggcctattcctactattccacctcctcccggtcggcgtactttaccttctgagttgatccctgatgaaaatacaaagaatgctcctaggtttgtctttctttgttctctatttctcatacttgaggccagaaagtatgatgagagactagttccataaatgctagtctatcaactctgagtaataatcttcatcatgtattgctaaacttctgatatgtccctattttcaggtatgacggggtgatatttgaagctctctctgctttagccgatggtaatggatctgatgtcagttccatttatcatttcattgaggtttgacaaatttctctctgctatttattatgcacagatcagaaaattatatgtgctcgctttgtaaactacttaacagattattagagacatcatctatatatgtgggagggatagttatgttattggcacgtgtaaactctatcttacattgacttgtgcaaatggcttattactactatcagcaatcttagatgattcgtccttctcaaatgagaacaccgagttctaaatgtaaagtcttatactactaattatttgtactttgacgttttatagtatgataatacttgtcgtgaagctgtccactatgcatatctgaaaaaatgttagaactcttgattttacttaaatttggtcactttctgttattcttttatcacatttggctatataatagcttttgtattggaccttacgactgagtgctaacaatggtttactgtggaaagagcagcccaggcatgaagtaccgccaaattttagaagaatccttagtacaagactgaggaggcttgcagctcagagcaaacttgaaaaggttagcaccttcaaatctgtaagtcttgaatctcacttttcttgtgttttttaatgagttcccattttcttttaaaattcccaaaaaaaaccatcttcatcaattggtgtttaaaactatctggtccatatctgtctgagccaatgaagcatggtttagaatccactgaattaataactgaagcagtgacaatgttctttaaagccttctcatgctatgtctttggtttttctttctgtgttgttcaatccaacatataacagatacagaacttctataagatacccgatccatcaggaacaaaaataggtgtcccaaaaccaaaggagacacatacgaagctgcgccaagcaaacaatcagacctctgctgattcacaacagatgatcgaggaagctgcaataaccgcagcctgtaaagtcgtagaggcggagaataaaatagacgttgccaaactagcagcagaagagtttgagaagatgacaaagattgcagaagaaaatagaaaactcctggtcatagctactgagatgcatgaactatgtaagaaaaagccagactcttttctcattattggctaagcaaaacaaaacaaaacgtctctaactttggtattatatggtctgttttgcaggttcctgtggggagactatgctcttggcttgaattgaatctatgggacattccttgtagctctcttcagttatctccgtaatggtgttgataataatatataaaaagaaaactaaattaatttactaggcgtggcttttttggttttaaattcctgaacctacatacatatttttacattagcgaagttactttcgtataattttatataaatttctttacatcgaattttaatgttaatttttttttgggtccaaaaccattaattggagtaataaatatattaaaagtttagagggcaaatcgggaaagaagatatttaagttgttttccttttcctacttggaataagcaaagtaaaacctaaaaaaaaaaaaagaccgtaagtagttacaagggtggaagtataaaggagcagtcttttcttcttctttcaaccccacggcgcagatcctacgagtttggtctttgtctctatcttttcaatctttctctctcaatcgctcttcaatttgataacagcaaaggtttgtttgaatctctcttctttttgtatgatttgtattttggatccccattgtgcttgcttttatagaagttataggttttgatattgtttgattcatgtttgcttcatcctaatacaatgctgattcgtaaaggatcggtttttgtacaaggatgatttagatgttctattactgcgacttggttatgttttggttacattaattgaatccttaggattatgcagttgactttacgaagatgaatgcttgatttgcttctgctctttctatctctcttggtgcttctatgtttttatcaccttttacgtgtttgttatgtgatctcagagacaacgagttcgattataaattgtaatctgttttttttttctaatgtcgatttcatatttttgttatgcttgtccagtcatg

SEQ ID NO: 27128 - DNA, 3003 bp, Unknown; identical to SEQ ID NO: 27127
  misc_feature (1)..( 3003): 2750-1469P.txt file - cDNA_ID_2730281; gDNA_ID_2684203; Annot_ID_137245

SEQ ID NO: 27129 - DNA, 3000 bp, Unknown; identical to SEQ ID NO: 14576
  misc_feature (1)..( 3000): 2750-1469P.txt file - cDNA_ID_2730291; gDNA_ID_2684203; Annot_ID_191288

SEQ ID NO: 27130 - DNA, 3000 bp, Unknown; identical to SEQ ID NO: 14576
  misc_feature (1)..( 3000): 2750-1469P.txt file - cDNA_ID_2730291; gDNA_ID_2684203; Annot_ID_137241

SEQ ID NO: 27131 - DNA, 627 bp, Unknown; identical to SEQ ID NO: 14620
  misc_feature (1)..( 627): 2750-1469P.txt file - cDNA_ID_2730299; gDNA_ID_2684204; Annot_ID_137303

SEQ ID NO: 27132 - DNA, 3003 bp, Unknown
  misc_feature (1)..( 3003): 2750-1469P.txt file - cDNA_ID_2730307; gDNA_ID_2684204; Annot_ID_137300
ttctcatattcaaacacaacttcagatctttacacaaccggtgatcagagaacaggttctgctttttgaatatatttgtctgaagtttattacctcaatcaggctatcttgagctttatttaatgtcttgtcttgatgaatctgtagctgaggattcgtacatatttcttgtcaactggtttgagaggtttccacaatacaagcatagggagttttacattgttggagaaagctatgcaggtttcagtttctaccttcaagctctcatcaatgacattaaaatggctgatgtcttagtcttgagtttctctattggacaggtcattttgttcctcaactgtctaaacttgtccatgaaaggaacaagggcttcaagaacccggctataaacctcaaaggttttatggtaaagattgaaacaatttcagactttttacaagtttgtgaactctgggatttttaaaagtctgcttattcaggtgggaaatgctgttacagatgactatcatgattatataggaacatttgaatactggtggaatcacggtctcatatccgattccacgtatcaccaactaaagaccgcgtgctactcagtatcatctcagcatccttcaatgcagtgtatggtggctctgagaaatgccgaattagagcaaggaaatatcgatccatatagcattttcaccaaaccttgcaacagtactgtggcacttaagagattcttaaagggtcgctacgtaagtttcacacatccgaaagaattttcaggttgtttgtttctatgtgctaatatgctgcaactttgtattggtaactcagccatggatgtcaagagcttatgatccttgtacagagagatattcgaatgtgtattttaaccgcttggacgttcagaaggctctccacgcaaatgtcactcgcttatcttacccctggaaagcatgcaggtcagctgaaaacaaagttttatttctggtttagaagtataaaaacttgatcgaaattttgatattttctttgtctcttgcagtgacattgtaggaagctattgggacgattctcctctgtctatgcttcctatatacaaagaattgattactgcaggtctcaaaatatgggtcttcaggtaccaattttgtattgaactttgtgatgttcacttgtagtaaatgaatgtttacagatgcgactagtgtagaagatgtatgtaaagtcttgattacaagtgaagattgcttgatcagtctgcctacattatatgcagtggggatacagatgctgttgttcctataaccgctacccgatactctgtagatgcactgaagctagcaaccatcacgaactggtacccgtggtacgaccatggcaaggtaaagaaacaagagctctctcatgttaatttccatgcataatattcagatattgatttgaggggtattgtacactttgtaggtaggtgggtggagtcaagtttacaaaggacttacattagtgacagtagcaggagctggtcatgaagtgcctctacaccgtccccggcaagcctttattcttttcagatcctttttagagagcaaaccaatgcctatgacttgagataaaaccttgaatggacctcttctccaacttcctgttctttcttcttcatcatcaataaaccaaagtgttttttcattcactgtcttcctcaatcctcagtgcatccaaattcaacagaagactgattagctgtctagtacaaatcataagcaactcttctttcttttttttgtgtaaaatctttctcaaacagtttctctatcttttctccattattgtatgctgcaaagcaaagtctttcaactacgaatcataatactataagatagtttatatagagttcgattccacaactaaacaaaagaccaaaccatgaacgtgtaatacaatgcagactcttgtcatttggttaagagtcactgaaagatctctacaaggtgctgccgtcacttgaagactctttctctttctctcttcgatttcccaagacgtggaacaaccacaggaccaccacgcactctttcaagggcaaaacttatcctcaacggtcgacccaataatccctgtaacagagagaatctcttcagaaaccattcataatgatagcaacacaaattcttttctttttttggttttacctttccatccatggcgtcttttgcagatagagcatcaccttcttctgcaaaatcaacaaaaccaaatcctcttgatctcccacttcctttgtcatacgcaatcctaactgagaacacatttatatttgacacattaaagaatctaaatgaaattgcaactcaagcacttcatgtgagagagtaagagctcttcaacccaaatcctataaactcatattaacacatcctacaaacgattagataaccaaaagtcataaccaaagactcgttcaggcttttcatcgaacacctggaagagtttagaaatgacaaataccttctgcaacctctccaaaggaagagaaagcgtctttgagagattgctcatccacagaccaggacaatcctgcatacttacgggtatcaaaaatcattcattatcatctacatatgtaaatgtgggtactttgttacaatactcttaacctccgatgaatagcttggaactgggcgatgcagaagaagaagtgcaaaattgaggaagaaaatggaagctagaagaaatagagtgttgaggtatcgctgaaactcgtctcactaatagctcaataccatttttcatcatgatcacaaaaacttgtttcttcaaatttaagctttgttttgggtttgaagttttttttatttatataagtgaccaccaaaaaataaggagccaaacaaaaaaaaaacttattttattattgaaatatctttgtggatgaggaaggagtaaccgaaaaggataaatcatttcttcttcttcttcctctgctttcttcctaaagcctactccttttcaatg

SEQ ID NO: 27133 - DNA, 3003 bp, Unknown
  misc_feature (1)..( 3003): 2750-1469P.txt file - cDNA_ID_2730313; gDNA_ID_2684204; Annot_ID_191359
agaattgggggaagcaaaagaaaccaaaattcaattgacttaagacaaactcgtaaaatgatgggaaaacctgaacaatgcgatagagggctggcatgggttgcagatcatagtaaggaggtacacaagtcaaaagttcaataatagtgcatccaacactccaaatgtcagaagcagcacaaactcctgacaattcaataacctaaaacaaagtttgggtatccgtcagtacacaaaggagaaaacatacttgtcagaataagaacaaagtccaatttcaaaatttacatatggaattttgacctatacagaatatataatggtaaaagatacatatattttatcaaaggtgtacctcaggagccatccagtaaggagttccgaccactgagtgagtgttaaaatcagcctcgttgagttttgtggcaactccaaaatcagcaagcttaacaaggccctgaagtataatatagtcaagtaatagcctagaagatcttgtgcatcccagaatacaacagattttgaaacggaaaagcgtaccaaagacatgagaataactaataagatccacaaggtacagaaaaacacacctccttggttgtcaaaatatttgcacccttgatatcacgatgtatgacaccctgctcatgaagatatactaaaccttccaagacctgtattcactagttagtacataaatatttttttttaaaacttaactcaactagaaaaagatatatacggacctgtgcaatgtaaacagtcaccaacgactctgggaaaggtccaaatttattaggtttaataatgtttgcaagagagccattctcaacgtacctgcaaacacataattggacttgaaaatccagaccgtagtccagcgtggaccaaaattaaacacaaaagtattacttactccagaataatgtgaaggtgagtctttgtcttcaacgatccgagatacttgacaatgtttttatggttcaagttctgtattgaaatatcatcttagaaggtatagaggaagattgcatcttaaccagcataaacattgtgtaatggtggaagaaagaagctacctttaggagatcgatttcttgctgatgaaattaacaaccaagaagcatcaaaacaaggattcagtcagcatagcagtggtaaggagatgagagatcacatctagtccataaagacagaacaaataacgaagatagatacaaagtaacaaaccattatggtgttaagatcctcttgaccaatgttttccaaagagacttgtttaatggcaacaaagtctccattctccaagtctaatcctatataaactcgaccataagctcctttaccaatttcatctcctagcatctgcgctcaaaagtcataaagaacaaaacttggagtagtgagtccacaaaagatttcaaatttggtagagcaaaagcaaaattagtaagaagaaacccagaattgcggaagaagaaaagctcacgtatttgttgtcgagagtctttgatttgtggaactgggatgacgtcatctgtcgcgccatctctttctcgtcagcaccaaacaaaattgctactcaaggaatttgatccatttttttttacgagggaaaattcacaagaacaaaattaaagaattagggttttaaatcttgagaaaatttgtaaggattcgagatgggtttgaagatcaaatgccagccttaatacagttgtgtaataaattacgacaaaattaatcaaattattttataaaaattaaaagttttttttgggttggggaaattgacgaactgtattagcggaagtcagaatacttttgttcgatttctcaggcgccagtatccttattttattctagggtccttacttttttctttatttacgatttcacccctttatttctaaaactataaaaattcctaaaaagcttttgtggaatacacttaaatttttaaaagtgaaaatgagaagatgaagaaagatatacgataaataacaagagtatatatcatagtatacctacttctttagacatgtcgaaagggaatgctttgttgcttcaaatttagtagatcgaaaatacttgttaatcgcttgagttaccaaagccaaaaaagtgaaagaactatagatttattggtgaattcgatattgtttcgctttattggtgttaattttcatttgttacatagagaatctatgtggatagtatttaatatttactaataccttatcatcaatttagatttggaaaaattattataacgtttttaattggcggatttggtatacattgtttcaaatggcgtaatcagaattatcagataagattttggataattagatgtttataaccaatcaatattgtaactttcataaaaattaatttttttacacaaaaaaaaaaattagataattaatttattaaacaacgattttaatagtttttatatgtaacttattgatcattttctttgtagcataagtttgagtggaaacaaatcatatccagcctccgcgcccaaaaacatatcacacaacagacaacaacactcagctatttacacatttacattgatcatggttaaaaaaaaaaaaaaaaaaaaatcaaattttggatattgatttttttttattttactagaaacacacaaaaaaaaaaaaagacaatttagttctagcctcgataaaaatcaggcatgcccaattgcccatcatgtcagaccaaaataatgtcggataaaaaagcccatcctagaaattgggtaaaatatgaaaagactgtcaagttaaaaaagttatttttcgtttgaccaatccaaaaagaaaaacttgagtctgacgacaagacagtagtagtagtgcgctgttctgttaagtaactgtaaggttagtgtttgacttcgagaaatagtaaatgtgtctgtaaaacctccaaatcgtgaggaaatccagagttccatcagatctaactctcttagatctgattatcatg

SEQ ID NO: 27134 - DNA, 347 bp, Unknown; identical to SEQ ID NO: 545
  misc_feature (1)..( 347): 2750-1469P.txt file - cDNA_ID_2730313; gDNA_ID_1591814; Annot_ID_151541

SEQ ID NO: 27135 - DNA, 3003 bp, Unknown; identical to SEQ ID NO: 27133
  misc_feature (1)..( 3003): 2750-1469P.txt file - cDNA_ID_2730313; gDNA_ID_2684204; Annot_ID_137298

SEQ ID NO: 27136 - DNA, 3000 bp, Unknown; identical to SEQ ID NO: 14615
  misc_feature (1)..( 3000): 2750-1469P.txt file - cDNA_ID_2730316; gDNA_ID_2684204; Annot_ID_137297

SEQ ID NO: 27137 - DNA, 3003 bp, Unknown
  misc_feature (1)..( 3003): 2750-1469P.txt file - cDNA_ID_2730324; gDNA_ID_2684204; Annot_ID_191356
tgtcaacacttgggtttacgattttgctactggatggattttgttgtgctcccacatttgcttcgattctgtgtgatctctgcgctaaactaattgctaattcacggttttgaggaaattatgggttctatatgctgttaaattacttaggatgcgaaatttgatgctcgcttggtaaattacgtgattggtcttcgaattacattgaaactattgtgatgctacttgcacattgtcattctctaatatctactttaggctagaactattattaccatgatagttctgacttgttacaattctgaactcgcttcattataggactattccttttgcctggaatctgataacaagcggctattttgaactctcagtatatggggtatgtttctatgtttttcctctagttcaacttgttcctatccaatccagacttttcatctatagtacttgaattcacgagtgactgtttgcaatgttgcaggttgtcttcagcaccgtttctctcctttttatgggaaagttcctggaacctgtctggggttccacggagttccttaagttcatctttgtggtgaacttccttacgtatctctgtgttttcgttacagccattgccttatactacataacgaggctggaagtttacctgtaagtaacctaccaccttacacataccaagtgtctactgcttgtttattttccttctcttacttaagtatgaagggggatgtccccattatgaaaatttcgttgaaatccttgtgattcttttgcttccctgctcgttaagtttaatatttaccactgaatatgataaatcctctctactttgttatatttcattattatccactctataataacgtgttctttgttttctcctggctagatatatgccctttgctggttttcatggtgtcttggcaggccttcttgtagggataaagcagataatacctgaccaggagatattgctgttaaagataaaagcaaaggtaatgttttgctttctagtaagaaatgatagagctttgacattttctcactttaactttttttaatcgaagttctcacatcctattcttacttctggtttatgtgtgcagtggttgccctcaattatgctaattttgtcaatagcctcaagcttcttcacactagattcagcagcatatcttcccactttgatatttggtacatatatgggctggttatacctcaggtacctacagaggagaccagaaacaaagctcagaggtgatccaagtgatgactttgccttctctactttctttcctgaacttctcaggtgaacgacatttctccctttttactgtactttcgagtttgcccacaaatcaattcttgcctcatatgttgttggtaattttgtttttcaaaataaaatgcaggccagtaattgaccccattgccttaatctttcaccggatgctttgtggaagatcaaatgccaccagtgaagaccatgattattctaccagtggtgcaccattgccaggttctgattctgctgaagcatccaggaggaggtaaaaaattattttcttttcctttttctctctttcctgttccacttcaaatcttcaatggtagtttagatgcaacgatcttactaaattccctgctctttaggggttaatgcagttcatgtcttcaaaaattagtatacaccgttttttattggcttgacactgttgaaacataatttaagatctagttgatgcaagagataatgaatgatcctgttcacttgattctaagaataaatagtaatggctcgtcatcagttttaatcaaaatgtaagagttagtcttacgagtgagaaaactagaaaggcaaaaaacttgttataacacaaaagatgttgttgttgcagagaaagaggggcaagagctctagaggagagactaggaacggaaagattggttcctgcaaggaacaaagatgaattgcagagtgatggtttagataacgtataagtggagattgcaataagcattttgaagaagctgttgttggttcttacttgtgttcatgtggacagtttttttttgttttttttttttgttaatgaaattggcgtttatacagaatcagcttcgtaaattcctttgacagctcagaaaggtagtacatttccttggacaaaccaccaattagaaacaattttcttggacgagaggatataaaagtagttatacatgttttcacttgtctctaaacttgttattgaaacagtcgtaactcgtaatggttcactctaagacacaaaaatgtttcttaattgaatgaaaaccaatgaacaaaaatgatataaaaaagaagtcttcataatatacaagagagagggagatgataggtcagaagatggcccataaaagaagggattccattgactagatgtattttgactatatgtttttttttttttttgtgttaagaatactgtatatgaaaatagaaagagagagaaaagaaaaggaaatgacgtcagcattgacaaggtaaccacgtcgcaatgtagcgagtccctccagatgtctggtttggtagtcgctttaggaatcaaacgcggagctccaataacaatggccattaccaaactcttcaatttctctatcgattcttcacacaacaacattcctctttcttcccccctttttttcctcgttttcgatttcctcgtctcgtctcttctttctgttgtcttcttcttcgttttctcacgccattccccccaaaaaaagaaacatctcttttatctctctctctctctctcttcgtcgtccttggcctatactacattgaaatccgataagttctgaaagaaacccaacacagtaaatgcggcttcgcgatctaagctatggaggaacgaatgagaaaaaacatagaatccaacaataaaatgtgagaaaagagacagagaaagaaaggaaaaaaaagtgaaatttggaagaaagaagaagagagaaatg

SEQ ID NO: 27138 - DNA, 3003 bp, Unknown; identical to SEQ ID NO: 27137
  misc_feature (1)..( 3003): 2750-1469P.txt file - cDNA_ID_2730324; gDNA_ID_2684204; Annot_ID_137295

SEQ ID NO: 27139 - DNA, 3003 bp, Unknown
  misc_feature (1)..( 3003): 2750-1469P.txt file - cDNA_ID_2730328; gDNA_ID_2684204; Annot_ID_191355
taagagatttttataaggctgtttttgtaaaaaaaagaagtaattaaatgttgtgataattgttttaatgacgtgtcaactacaatatttgcacgaaattgaaaatcacaaaatcgaaaatccacttttttgttttgtttctctctttggccgacaaataaaaaaaaaacaaaaaacacaactaatcataggcttctccatcttcttgtctgcaggatgatgcaatttttcagacaattttcttccaaaatcttttcgtaattctgttttatttttcaacgttttaggtttttaccaatccgccgtagttatatccaacattaatttttttccctcttctcagaaaaaaataaaattcaactcatctctagagtttttaggttcttccaagaaattgaatttggaaggaggctttgatgggtttgaattttccataatcgtcccttgtttacggtatttttctcaaggaatccctgaaaaactatttcttggtctttgtgtaattgtctggtgcaaatcaagttattgtttttatcttgtgttgttgattcagactcttgttgtttgaaaatgctatggctcgtgaggggatgttgttttgattttgggaaagtcttgtttgaatggtcacggcttttctgaacattcgcgtgttctttcttgtctcggctctgcttcgaaatgtctctcggccaagaaaatgttgatcctgttgaagtttcaggtaaaatcctacacaatcctttaataattattatccaccaagtttttaaacttgtaaaggtttcaaatttttgcctttttgttttatagggtcgcatgcttgcttatatgaacttttatgttctgagacacccaaatggactcctcttagggttgaagatttgcaaacatcttcttctggtaattattacttaatgatggagataaacattcttaagatatgttttaagtgttagttggagacaatctcatgtcctgtttgttttgttttagatcccagagatcggttggagaagttgctgaagcaacctgggaataaatattgtgctgactgtggctctcctgaaccaaaatgggtgtaagttgattaatacttctgtgttgtttgtacatttcttttgatgaactggattgattcatttcatttcgttttagatcgttgagtcttggtgtatttatctgcattaagtgttctggtgtacacagaagtcttggagttcatatatcaaaggtactttcttttcatagacaatcttgatttttctctgcttctgtgtgtttctagagtcttttatcgataaatttgattgaatgatgatcgcaggttctatcagtaaagctagacgagtggacagatgatcaggttgacatgcttgtaggttacggtggaaacacggcagtgaacgaaagattcgaagcttgcaacatcgaccagtcaaagaaaccaaaaccagattctactaatgaggaacgaaatgatttcattaggtgacattttttacttaacaatttgttataatggtattgtatgtataatcatcttgtccctaaatctttaaatctttcagaaaaaaatatgagcagcaccagtttatggatccaaaggatggtgctttgtgcacttatcagcagcctagcagaacaaacacttcaccaccgtctttatgttctgcaagccaccgttctacaaaaaaccgtattggtcatgcatttaggaatagctggggaagaagagaatctgatcacaaaggaccaaagaagagcaattccatggtaacaatcactatacatacatacatacatgtttgggtagttactgttgccaacgttagttaatttttgtgggtgttttataggcaggtatggttgagtttgtggggttgattaaggttaacgtggtaaaaggaaccaaccttgcggttcgagacgtgatgaccagcgatccttatgttatccttgctcttggccaacaagtgagctctctaccaaatctctctagacttgtatgatttgaagttaacctcggtctttttcaatgtttgtttgttgtagtcggtaaaaacacgggtgataaagaacaacttgaatcctgtgtggaatgagacgctaatgctttcgatacccgagcccatgcctcctctcaaagtggtaagaacagagagcttttccaaactcggataaacactactactgaaccgagcttgatatgtaaattttttgcagctagtgtacgacaaggatacattctcgacagatgatttcatgggagaggcagagatagacatacaaccattggtgagtgcagcaaaagcatacgagacatcgagcataaaggaaccgatgcagctgggaagttgggtggcgagcaaagagaacacattggtgagtgatggcataatcttacttgaagacgggaaagtgaaacaagacatttcacttaggctacaaaatgttgaaagaggtgttcttgagatccagcttgaatgtcttcctctcactcaatgatgatactttcttcttcatccctcttctttttttttttctttaaaagatttatttctaaatttatagtgaagaaaagatgctgctactttcttgttgttccacctcaaacaaaacctctgtaaaaaaacaacaccatgatttgatttgatgattcttcagaaccaatcctagtttcctctaccggaagatcaaatacaaagaaaagcaatcaatatatcatcaactctctgcattgacagatagattggtattaccgaaacacccttcatcacttccaagttccatcagagcccaaaaacccatatgggggtataatcgtctcgtaaataacacataattaattgtttttaatacgtaagtgtttttttggggtcaaaatacataagaatttatgataattaagtggataataactttttcgttaaaaataattaccgtgttattttttgtttgttgttgttgttacttgttacattaaactataatttatatatg

SEQ ID NO: 27140 - DNA, 3003 bp, Unknown; identical to SEQ ID NO: 27139
  misc_feature (1)..( 3003): 2750-1469P.txt file - cDNA_ID_2730328; gDNA_ID_2684204; Annot_ID_137294

SEQ ID NO: 27141 - DNA, 3003 bp, Unknown
  misc_feature (1)..( 3003): 2750-1469P.txt file - cDNA_ID_2730349; gDNA_ID_2684204; Annot_ID_191348
agaccaagaaattcacattaagattcgcatcttccatgccggagtttgacgtggtaggctcttgtaacggtttgctctgtttgtctgattctctctacaacgattcactctacctttacaatccttttactacaaactccttagagcttcccgaatgttccaacaagtaccacgaccaagaacttgtcttcggttttggattccatgagatgacaaaggaatacaaagttttgaagatagtttacttcagaggtagtagtagtaacaataacggtatttacagaggtcgtggtagaatccagtacaagcaatcagaggttcagatcttaaccttgtcatcaaaaacaacagatcaatctttgtcctggagaagcttaggcaaagctccttataagtttgtgaaacgttcatcggaggctttggtcaacgggaggttacattttgtgacaaggcctcgtaggcacgtgccggatcgtaagtttgtatcatttgatcttgaagatgaagagtttaaagagattcctaaaccagactgtggtggtctaaaccggaccaaccatagactagtgaaccttaaagggtgtctttgcgcggtcgtttatggtaactatggaaaattagacatatgggttatgaagacttatggagtcaaagaatcatggggaaaagagtatagcattgggacttacttgccaaaggggctaaagcaaaatctggaccgaccaatgtggatttggaagaacgctgagaatggtaaagtggttcgggttttatgtttgttggagaatggagagatcttgttggagtataagagtagggttcttgtggcatatgatccaaaattgggtaaatttaaagatcttcttttccatgggttgcctaattggtttcacactgttgttcatgctggaacattgtcttggtttgatacaccccttgatttatggtaaaataattaaagttttgaatttttattacatttagagttttgagatttgggtacatcttcttgccccctttacataccaactaagtacattcttttgtacgtaatgggtagattaaggtgtatttcttttcaagttcttgtttcgtttctgttgaatttataggttccttttcatgtcttcggtaaatgtaaatataatttctaagtgttagcggtaaatgtttccggtaatttggttctacactataaactattacttattgtttgggactaacccacgatcgtgccatttgattttattgctttattattgtatgttattatgttttgacatgctcgatcaccaagcaatgcagaaaaaaaaataaaaaaatcttgtagaatattctttagatctatagaattcatataacaagatattagatgacgacgataaagcaaactttaaagatatatcataaaaaaaaaagaggctttcgcaaatcacgcaaatcatatagttttcactaaaaagaaaaatttgtgtattaataactaaacgatcttcgatctaaatattaaacccatgtggaaagattccctatcgcctgaaaataaaatgaaaactctattcatcggaagatctaatcataataatatcttactaaatatataaacatctatataaaacttgaagtatatgcatttttcgtggtctcggaattataacatttttgtacatgatcatgatggcgaacgtaattgggtctataaagttacaatgtgaacgaccagaaataatatcgactgactcgacaactgcaaggccaaatggccgtttattctaggttaccgcgatacctctggagtatactgtatacgttctctctaaattctggcttttttttgggtgaatttaaaatggaatcacttcaccaatatgtacatgggtcaactccaaaactgaagacgacgaagagaagcggaagaccgcaagaatgccaatcaacatcacaaattgtttatcgtcttctctcttctcttccattccacttattttcagaatttatcttcaatattttcaaattacatcaatagagtcatgtagtgaaatagatatgccgtccggcactataatgctaattagcaacaactgttttatttatttttcatgtcatgagtttgactatcttatttcatgaatctataaaacgaattaggttttggtacggtgtcgtgtggacagtaacctaatgcatgttgactaatatgggattaattaatacatgtgtaacgtagaaaatgctttcccaaaaaaactagcatatgactttggaaaggcattgtcaatacttctatagcgtacatgacttcggagtttcgagtctatataggaaataacactagtgagagaatttgttatggaaaaaatcagtgtgtgatgttgagataggagttaaaacaatcaaaagtgacataatctatatagacataatcacgtgattataactttataagcaaaacgggataggttttgcatgtctaggtagcacctattgtttgattggtggcaataaattccatatgttttaaaattgaaacacaaaaaaaggggcagaagcatatgcccttgtttgtctcatgttaggttggatcccaaaatcagaccggataaaaccgggatatatcattaatgcaagtaataatgattgaagacgagattagaggactaattccgtaattacaaacaaatgattttattgacaattcagtgattattaaaaataaaaaacataacaacattagtggtcattgtcgttgtcgtggctcgaggctatcgtctctcctatgcgcgtggaagaaatagcaattatgctttcttttgtatttgattattatccgttagtgaccctcacgatctctttctctctcatataactcggatcaccacatgacttgatcttcttgccgttaccaaaaccaaaatccctaaatttgccctcatttccctctgattagatcccttaccccgacaaagacaccaaaattcttgagggcgagagagctgattgatg

SEQ ID NO: 27142 - DNA, 3003 bp, Unknown; identical to SEQ ID NO: 27141
  misc_feature (1)..( 3003): 2750-1469P.txt file - cDNA_ID_2730349; gDNA_ID_2684204; Annot_ID_137287

SEQ ID NO: 27143 - DNA, 3003 bp, Unknown
  misc_feature (1)..( 3003): 2750-1469P.txt file - cDNA_ID_2730357; gDNA_ID_2684204; Annot_ID_137285
tgtttggattagtttggttagcgatggatcaatatgaatcatgttaattattagcggtatgaatttggctttatttcaaaactttagcgaatacaattaacttcatgtttattattcctaaactgataataattgtataaattattatggatttgtatttcatgaaaaacatatccttatttatgaaataaaactgaatataaaatggaattgtataaaagcaaaagataggagcatctttttgaccctagtgtatgacaattgagttttagtgagaagtgtttaaaacttgtaactagcttaaatgggtttagtgcatttactattgtggagtttctacaaaaagctaaccaaaatgtgaaacgaagaaatcaataaacacgtttccataaagtagtgtaactttttagggtaactagttgtaggcaagaccgtatgtaagaacaaaacagtaagaactttgtagctttcaagaaaccatcaatcaataagatacctgtataataagaaaccttgagcatctttttgaccctagtgtaagacaattgagttttagtgagaagtgtttaaaacttgtaactagcttaaatgggtttagtgcatttggggactaattattgactaattatttctaaatggtgcaaaaaaaaataaaacttcaaaatttcaatgatattattacttttcgaataattattaaaacattctcgcataaatgcgaatccacacaacaattactacccaattcacgagtcactcttcaggttataaactccaatcctgaatggactccgtcttatctataaaatatccatataatttatatgtcaaaaaaatattgcaaaattttttcatcgcaccctaatcaaagcgtcttcaccagattggatggatttatggtggacaagcgactttaatttatggacccggtttagcaacttcagtgcaagccgctggaaccaactttccgctgagaataggcttgatgttagaacatgccgagacagctggtccctctttgccgttgtggaccaagttgatgtcagagagagcaatattggtgcaaggcactcctttgctgcacattagcttcacagccacctttgttgctgatgtacccttaatgcccttgatagtcacgtctgacaacttcacttgcgatggtaccttcatgtaaattaattggagtgagatttaacaacttgattgatacatatactatcaaacaaaccaaaatatgtattttatgtattagattcgattcggttacataccccagctttgcagtggccataaggacagtactcttggtcgatgagaacgggaaggctaacattgtccattgtgatatcttcgaaaagaatgttggaggcgatgccggggggagatcctggccatgtcttgatgcgaacaccattgtcagtgttcttgatgaggcatttcctcacggtgactccttttactggttgctcattagggtatcttccaagacttccaatggaaattccgtgtcctggtccacattctacgttctcaacaatgagattttcggtaccatctccaatggaaacgcagtcatctccggttttgatctttgccccaattaagttgactccattggaccttccgatgtggataccatcggtgttgagactctccggaggtgcatcaataccaatatccgaaagagtaatgttcttgcagttaaggatgttcatgtggaaaagtttgctgtttgttgatgtaatactattaatctttgagtttgttagaccagtgaatcggatgttctgttacaaaaaaatcataatattcatcaagtcattccatgaaaataataacgtttttagtgtaattatgtaaaattgaatgtgcttacgatagggagagagttgcatttgccagttttggcacaatcattggccttccaagcgagggacccttgaccgtcaaaaatagctttgtttccattcaaagtgaaatcagctatattttcgaaatcaatccatccggcatgtggcttagtggtcttgaccgtagccggagccttgaaattgccattcaattccaaagtgactggacctttgcatggacctttgaactctaggctctctaccatatactcaccttttggcactgtaattgtgctccctgctgcacaagcttctttccatgcagccgcaaatgcctatatatacatgcatgaatcaatgtgaaattctttcttaaacaatacaaaaacgaagtataatataaaatatacaacaaacatttggtacgtaccgcactatcatcagttttgctgtctcctttggctcctgatgctttaacatcaactgctgcgcctggtttggcacctgatactttagcaccaactgatgcagctgcaccgccaactgctgtagctgcattttttgctgtatcttcaactgctgtagctgcattttttgctttatcgacaaccggtgtcccgtttgctattgtggtggccataaccactagtagcacaagaagcactccgcttgctttgtgagaacccaccattttttattctctttttattgattttgttttattagttttttttcttcttttgtttattctcttcttcttttgtttttgtgtttattgatgttttgttctgatgattcgagactccgttttatagaggagcaaagggagatcgaaaaccacaaactcatgccttgctaaaaataattccgaggattgtgcttcaggtagaagaatgaccaaatcatggaggccgataccttttgacttggtatgttttctatttatggacttgataatgtaaacatctcacacaatttggtaatttaaaataaatcagagtttgttgcaaaagagagagtacatattacataatcatttatctaattgggcctatacgtgaagaatggttaatgggcttgggtgtgagatggaacaaatgaataaaaacgtaacccattagacgagacaaaccctaaaccctacggaatg

SEQ ID NO: 27144 - DNA, 3000 bp, Unknown; identical to SEQ ID NO: 14608
  misc_feature (1)..( 3000): 2750-1469P.txt file - cDNA_ID_2730365; gDNA_ID_2684204; Annot_ID_191344

SEQ ID NO: 27145 - DNA, 3000 bp, Unknown; identical to SEQ ID NO: 14608
  misc_feature (1)..( 3000): 2750-1469P.txt file - cDNA_ID_2730365; gDNA_ID_2684204; Annot_ID_137283

SEQ ID NO: 27146 - DNA, 3000 bp, Unknown; identical to SEQ ID NO: 14607
  misc_feature (1)..( 3000): 2750-1469P.txt file - cDNA_ID_2730369; gDNA_ID_2684204; Annot_ID_191343

SEQ ID NO: 27147 - DNA, 3000 bp, Unknown; identical to SEQ ID NO: 14607
  misc_feature (1)..( 3000): 2750-1469P.txt file - cDNA_ID_2730369; gDNA_ID_2684204; Annot_ID_137282

SEQ ID NO: 27148 - DNA, 2989 bp, Unknown; identical to SEQ ID NO: 114
  misc_feature (1)..( 2989): 2750-1469P.txt file - cDNA_ID_2730377; gDNA_ID_2790; Annot_ID_145930
  misc_feature (2398)..(2398): n is a, c, g, or t

SEQ ID NO: 27149 - DNA, 3003 bp, Unknown
  misc_feature (1)..( 3003): 2750-1469P.txt file - cDNA_ID_2730381; gDNA_ID_2684204; Annot_ID_137276
cctgtttcgttttcgatttggattacacgaaattcatgtgatatgttgcttctttgggttttgtaaaatgattgctggtgaattgtattgggaattttgtgcagaggaaaggatgaccagagaacatcctcccgagcctcttgatttcttcatctggactgttgaggtatattcaatcaatcattccttctttataagcctttcatgatgatcacttcttcaattcgcatgtttcttggaattgagctcttcattattagacttgttggttgcagaatcatgtttattaaattattcagcctatttttgatctgaattcagcctatttaaccagttacagggttgatttgatatttcttcaggtatgaccctagtttgccttaggcttgttcttgttgtttgatccaattacactgattgatttagtttactatgttacttattttttttgctcttttggtactctgcttgttattacaagaataaatctcaccttaatgattgcaattacatcaggcaagctcgaatttgacgcacctctagctattgaagttccattagtggtcatttagtttactatgttacttgtcgctctagtccaaggaatctgtgtttgttgatgtacatatactccggaagtggttttacctcagggtgtgtagactgcagagtgatgttcgcatatgtcacttgttgatttgctcttcagaaaaggttgaatattggatgaagattagttgatgaaaactcgataacctgtgcctgataccaaaaatagttaagagttagtccactcatatggagaagctggaggttgtgtgttgctgaatggttttgttctatcagatgctattatggattttcttagttatgctcgtgtgtaatggcgagcatcttgtagatgagaagctttgttctttttttcttcaggatgttgggtcttggctcgaggagataaaccttgggggctaccgccagattttcaaagaaaatggtgtcaatggagaatatctagaaagcatgtctgtgtttactaccgagcagatccttcacttcataaggaggcatcacatgaagtggggagacttcatcaccctctgtaaagaactcagaaggattaaaggtactctatcgttctctctataactctcagcttaagttgttgcaggaatttaactatggaaagaaatgtctttttttttacagtggcttgcttgaaaggtgagcagagagttagacggccatggtgggcaccgtcttgtctatccgtagtctttgttaaggcagccaaacgcaaccgacagtctcgtgttgtatctctcaagcttgaatcttgacattacactttggctgtttatgtacgtacttgtctctcttctcttctcttgttttcttttcctttttttttttttttggtttgggtttgtttgtggcacatgcactaggaagaaacaaactcaagtcaaaaaagctgtttggcttggtgaaatcttgcaagcgggaaaaaaattatgcgttttgtactttggtggtgtatacaaagcttgctctcagatgtttaatatatggcttgtgcaatctttatgtgacagataatagtgtgacgaatccaaagtagtaatttgattatatgtaatgtggaaaccgattgaaacccaggcgatattgagaacgtagtaatttgattatatatgttatatgttccaatgattttggacactaataaaattatttaggtcacaaatttaaaaactctatcggtggttaaacattttcagagatagcgtccattcaaacattttcgtggtgcaaattttcggagaaatatggtagagatttggcgtatagctcatctcatgttcctctttggagattagtacgtttagtaccctatcctcttggacgaaatctcttatcgagtatcgagtccactttatcttcacagaagtgagtaagtgacaaacaatgggaagcgaccacaacttctaagagaaaatagatattttatacattctttcttacaatttttttgcagttgaatttatcatctacaaagtgtaaaattatggattgagcaatgcaatttttagaagaaacaattaatggacagagatataaagttttgtaaaaatctttaaaattaataattatctttgaggtttttacaagtttattatatgtccctttccattatttatttttttcgttattgacattgcttacatacagtccattattttaagtttctcttaattttattttatttattagatacacacttatgtgatacatattgatatcatctttaccaaaaatcttgagcttagccaccaacataaagttttgacaataactcgtcatcggatttttcctcagtctatcaaaccttatcaagtctagtcgtctagaaggggaagacatgttcaaacggggaatcagatttatcgtcgttatgtgagtttattttattccatatatggtttctcgctcgatacgtttgatggtacaattcatcatgcgtattctcacttcaactttaatcgaagccttgttcatattgtataatcaaccgttgatacgtgtcaccgcatctggacatatcacattttttgttggatttcttatactcacccctttcgtgatccgatcaaataataaaactgtgtttttggtacatgttcttgttgggatagcgtttgtatgttggtttattttcgtgttagttatcttcttcattgcatacattctaaagcaatatgatttcttatacaagccaataaggttttaatcaggattatccttaattaatgtattcatacttaccgttcacaaaataattatgagaaaaccaaataccggaattacccttcaaatccagaagcttcggctttggcctaaaaaccctactaaaccccaatcgtctctcttcttagctcagagtgctaccgaaatcaaaatccaccattcttttctcttccgagattttagaagtttgcgacgatg

SEQ ID NO: 27150 - DNA, 3003 bp, Unknown
  misc_feature (1)..( 3003): 2750-1469P.txt file - cDNA_ID_2730385; gDNA_ID_2684204; Annot_ID_137275
caccggaaaacttcagagttgtgtcttctattgaattctccgggaaggtaaagaagattagtgggttttgattgtgctgtataaagatgtgtactttgtttgagctgtctcttaaaccctagcaccaatccgtgaaccttgaagtttgtcattccggtagaaattcctcagcagttgatctaattcgttctctgtgtagtattagtgatggggctttctcttggggaacaacatttcattaaaggtgggattgctcaagatcttcgaactgatggtcggaaaagattgacttaccgtcctatctacgtcgaaaccggtgttattccgcaggtagtgtaatctcctagagctcgtccgcttctcattgttgcttcccagttgtttaacagatatgttctttctcttgtttttgttggctctaggctaatggttcagcgagagttagaattggtggaaccgatgtgattgctagtgtaaaggtacttcctttgttctctctgctactgttctattgttgaatgggaagtgctattgtagatgttacccagtaatcttgtgtaattgcaggctgaaattgggaggccaagttcacttcaacccgataaaggaaaggttgcagttttcattgattgcagtccaacagctgaaccgacatttggggtgagcttttcttttatttcgtttggttttggttctatctagcacttgtcacacccgttctatcgttctattggtgtttctcttactagtggaattgttcaacatgagattttggttatcattacttttcttcagaatctcctaaattctactgtgttaagtctttaggcggctaattctttgtgatatgttgttacttaggggagaggaggtgaggaattgtcttctgagcttgctttggctcttcaaagatgtcttctgggtggcaaaagtggagcaggtctgcaatcatgtttatgcaatgcttttttttacctgcacactgttacgctttctgtttgtaacgtttatagcaattcatgttttggtaccaggagctggaataaatttatcttcgcttttaatcaaagaaggaaaagtttgctgggacctttatattgatggtcttgtcattagttcggatgggaatctattggatgccctgggtgctgccattaaggtaattcttgtgatgtgtgtttggttttctctcttaacccttagtctcaggttttagttacgaatgttagtgagtaaatcatacccatcaatcagaatcatgagaaaggaaaggccagagaatataggaaacgaaagggaatgggtctttagttaagtgtatatagattagctcaatgtagttgtcttgttattggttttagtagctttacgatatgtttccaattgatagtttaagcaacccaaaagtcatctttcctcaaggctgatcacatgctttaatgcacttgttgactatactcctgcaggctgctttaaccaacacggccatcccaaaagtcaatgtttcagctgaagtagcagatgatgagcaaccagagattgacatcagcgacgaggaatatcttcaatttgacacttccagtgtcccggtcatagtcacgttaacaaaagtaatcgaatctcacttttcttgattcacatcgacatcttcttatgtacatttcgctaatcttttaccatgctgtccttggtttttgcaggtgggaacgcattacatagttgatgcaacagcagaagaggagtctcagatgagctcagctgtatctatatctgtgaatcggacaggccatatatgtgggttaaccaaacgaagcgggtctggcttagacccaagcgtcatccttgacatgatctctgttgccaagcatgtgacagagactctgatgagcaaacttgattcagagatttcagccgcagaggcctgcgaagacgaatcttgactcttgagtctcagagaatcaaagtttcaagatgaaacatgttagcaagggatcaacaatatttgtatctgtggaaaatcttatacgaagtcagaacagattaagctaatcaaaatcctttttcctatgttctaatgttccatgctttgtgatagtaaaggtgatatttttgccattatagtattagtaacattatatctcatctagggattattaaaagaggcgttccttggatctctgtgtttaaagtgaaagacataacaagttacaaaaggatttgtgatattttgggaggaggaaatgagaatggagatgaggtcagcaaatgaaattaagtggacttggaaaaaagagaagattggtggtccatgattaagctcaaaggtcaaaagagtgtgtgagcagtgttggtcacgtgtatctcagcttcgggtttggtaaaaatggctttgaaacattcaattgttttctgtaaaactcccaaatccgatactattcacatttgtttcctccttcatttcataacaagcaagctggcagagaaaatttggtagtcatctattatgtcatagaattatgatatggtacatactacaaaacaacaaaaggagggagcaaatagaaagcgttaaatggcaaaactcaacgaatttacgtatattccgatgaactaactaacaatgatattgataactgtttttgcgaatcaactaacatcgtttccacatttaaattgtgactagcataaacaattaaaaagtaagatttgaaaatcagtcggttaactaattggaaaagaaaatgaaactaaattgattgactaaagtgattttttcttttcttattggccactaactcttattttgttttcattatggaaaaagagtcaaacctaatcaaatatatttagtctatgatttaccctaataaaatatacacaaaaaaattgataactacagtacttaaaggtttttaactgtaaaagttaattttgacagtaaaaatatttatttctaaaaataaaataaaaaaaaaaagagaaaaagatttaatagcaaaaatg

SEQ ID NO: 27151 - DNA, 3003 bp, Unknown
  misc_feature (1)..( 3003): 2750-1469P.txt file - cDNA_ID_2730390; gDNA_ID_2684204; Annot_ID_137271
gaaatagcaaagtacctgcaacttggaaagctcatccacgaattcgcgcggaaacaagtctgacctagttgaagacaactgtcccagtttgataaacgttggaccaagctgcaatacactctctctcaaccatgaagctgtttctcttcttctgcttttctgattatataacaacaggtgaaattaataagaatcaggaccaacaaaacatcaaccaatgaatcatttaaattagactaaaatgatgaaaggtttacctgtttttcttctgtgaatcctccaacataagcccatttcgaattatcgaacaagatacgaatcctcagggaaataacaaatgaccaaacatcaatactgcgttgaagtgagctataattctcatcagcccagctaaaaccttcatcagaaggaagaaccctaactccttcaaccggtggaggaaggtacgattctgttgttttctttggtgccttaaccaaagttgacgccgcaccattaatgtttctactactaaccaaactcgctccattaacacctttcccagccgatccattcacaccatctttcctcttcaccacctcactcgcaggaaccattttgactgaacgtccattgattccaaccttagagggcaattccgactgtctcatctcaatacgaaatctcttagacttgctgccataacactgagtggcttccccagtgaaatgattctccaaagagctactgaaaccaatagctttggtgactcttgcggtctcaccgccatagcagcagctctgagaagctaataaagccgccatttccacctaatttacaagaaaccaattgaatagacacaatcaaacaacaaaattcaataagctggattcataaaactggaatgcattggagaaaattatgcggcaagcatcatttgtataatctaaagttctaaactataaaagtatgaccaacacaaaatttctagtgatagaactccattaaatcatacttgagcctattcaaaaccatcgagttcaacgacacctctaaattattgatttgataagagaatcacaacgattctcagccatgaaaaagatataaataatcagcgaacattaacacgtactatagcaagaggaacccaattttactacaacccaaacctgttctgaacctgggatacccaaaagtaattaagaaaaacaaaacaaaaaacagagtagaaattaagaaaaatggaacctttatcaaagtcctgaattgggttgactggtgagacaaagatcaacccagacccagaaatttcgtagcaggaatctgtagaatcagctgtattaagtagaggaatttcttggaacagagtcgagagagagagaggtaagaggactaagttgcgtaatggtgtcgtccttatgactaatgagacgtgtgttgttccaccgaattttccaccttcctaccaaaatcaatattgagactttgtgcgtaaataggaaaaaaattggatttgataggacagggaaaataatctttgtaacttttagtgccaaaattaagacaataagagttttggaagatgcgtgtccagcttctacatctcacgtttattgtgtggacagttcgaaagagagtgttgagcatcttttctaacaataaaattaaaaggatataattgctcgttagtaatccacttaaaggggtttaaccaatttaaacggtaaacttttttaagagcaagcaaaacaacaatggttcatttcaaaaaggaaaatgacaaaactacatattaacatatgaacaaaacttgtgacgcttcaccacatagtttggcttctacatgatcggatcataggcagctccaaaaccgaagttccacccacccagactactattggaagtcattactctatcacaaaaccattcgtctagtttcttcttcccaagtatgaaatgttgcatttgcgagttcggctgaaaacgaatatttcttgctcttcagtagcgcctcctgagcaagtaatgacttccattcaccgctcaactctttcctttccttggctctaaggctcctcaacttctgtaacatctgcttctgtgcatagttgcttaaatgctgaaacagtgtcgtctcaagcgcatcctgtaaagcgcacagctcatcagcagcaccatcttcctccttctccttctcattagcctcattctccatatgtttgtcaacattttcagaaggtaatttgtcatcataagagtcgcctttttttgcaaatccatcaccatttccaggttcactgtttgtcactgcttcaactacctccctatccttcccaccagtctcattctccatagttttgtcaacattttcagaaggcaatttgtcattgctcccatcaacacatcaagatttatctttgccccatatcgccatggacaagtcaaaagcttcagaatcttgggggttactaaagctaggcagcaggatgaatcattatgttggaccgttagtcttcttttttttgctttcataaacttgtaaaaaataaataacctcttgtcaacaaatttcatttacatactccaagcccgtgggccaaaaggatcgtacggagccattttttgttggtccaagactccaagcgaagaagactatggacttcttgtattattagccaaaattaaaatttgaagttaggtaacaaatttatggatttaggaaaatacgtttataattgtattttcttatttagacattgcaaatcccatgccgttttcttttgttgttttgtcaatttcatgccgtatgattaaagtttacaatgcattttgtataagacaaatgctttttgataaaagaatattaaggtacaaaaaaagaaaaggaaggtaaaaagattcctttttccctctctttgggccttaaatagagacagagaccgaaagaaagaggagaaacctcacacaaaattggtcctaaacgagtctccttcagtcgtaatttgcagcagagcaacgatg

SEQ ID NO: 27152 - DNA, 3000 bp, Unknown; identical to SEQ ID NO: 9936
  misc_feature (1)..( 3000): 2750-1469P.txt file - cDNA_ID_2730397; gDNA_ID_2684204; Annot_ID_137269

SEQ ID NO: 27153 - DNA, 3000 bp, Unknown; identical to SEQ ID NO: 10158
  misc_feature (1)..( 3000): 2750-1469P.txt file - cDNA_ID_2730409; gDNA_ID_2213627; Annot_ID_195928

SEQ ID NO: 27154 - DNA, 3003 bp, Unknown
  misc_feature (1)..( 3003): 2750-1469P.txt file - cDNA_ID_2730409; gDNA_ID_2684211; Annot_ID_191533
taggtatgtgaacgttgaggttatcagttgatgttttttatttcagctgtttggagtcatgggtgatagttaagtttatcagcctgtaattacaattctttggtttcttgaagggactctggcaaaatacactggaggacaggtgtactattatccaggtttccaatcatctgttcatggagataagttaagacacgagcttgctagagaccttacaagggaaactgcgtgggaggcggttatgcgaataagatgtggaaaaggtttaatagtttatgataatatattcgtttttgctacctgctatgtcaatatttgctaatgcattggtgtgctacttgtgatcttatatatttttgcatgcaggaattcgtttctcgtcctaccatgggaacttcatgctaaggtctactgacctgcttgctcttcctgctgttgactgtgacaaagcgtatgcaatgcagctatctcttgaggagactttgctaacatcccagactgtgtatttccaagtggctttgctgtatccttgaatagttgatattttaaacatacttgagtttaaacatacaacacatcatttagcttttagtaatccttaacagaactaagatataccgcctcttgtggagagagacgtataagggtacacacatctgttgcaccagtggttacagatcttggggagatgtatagacaagcagacactggttccattgtgtctttatatgctagattaggtaagctatattcaaatttttttcatatgctacttttgatactatttaatgacaatttaaattctgcagcaattgagaaatctttgtccgcaaaattggatgatgcacggaatgcaatacagcaaaagattgttaaagccctcaaagaatatcgtaatcttcacgcggtgcagcatcgcttggggtccagattagtatacccagagtctctgaagttcttgccattgtacggattggcaattactaagtccactcctcttctaggtggacctgctgatacttctcttgatgagcgctgtgctgcaggcttcaccatgatggctctgcctgtcaaaaagctattgaagcttttgtatcccaatttattccgtgttgacgaatggctcttaaaggtttgtgtatttttatctcaatgtccattatcaaacatcagtgttcaagaaatagtaaataatttgtgaattcacatgcttgcagccatcagcagcccacgatgactttaaagacgtattaaggagattgccgctggctgcagagagtttggattctagaggcctttacatatatgatgatggttttcgattagttttgtggtttggccggatgctttcacctgacattgctaaaaatcttcttggggttgactttgcagcagacctctcaagggtatgtatttttatccacatatatccttacatatgaatatatgaacaggcggtacattcgatgatgtatatgcatcattagtgtttttcaagaatttgaaacatgataatatgtgtgaaacccttgtctttcttcgtgttgggtctcttaggttacctttcaagagcaagagaatgggatgtcaaagaagctaatgaggttggtaaagaaactgagggagagtgatccttcatatcaccccatgtgttttctagtgagacaaggagaacaaccccgagaaggcttccttctcctcagaaatctcattgaggaccagatgggcggttcgagtggttatgtcgattggattctacaacttcaccgccaagttcaacaaaactaagatagctcacaatggtaaggaaaaaaccatcataatacttccaataacatgcttaaagtaccacatcatgttcgacgcatcttatgaagcggttttactttcagacaactcgggtgctaggatgccacctctttgtaaccattgaagaactcttgagctcaaaaatcttctacttaagcaggatcatggcggccttcttccttgggccataatgtgttgttttggataaagaagtgctactttttgatttttcttcatttgtttttctatatagaccttttttctcaagattaggcttttatttgcctaaccagaatggttatctccgtaagattagtcgttttttaaatcttttgttgccttttttttttgtcctcattcgattttttgttgatgtgcgtctgttctagatttattttgggagttgcagttcatgaatctgtcctaattagggttattaacaagaagatgctactgttaaaattttaaaatatttttatgaataaataatgttgtgaaaaccttagatttggatgaaacgcatcgttggtatacatcggtaaagttcatacataaacaatacggtgattgatcgctgtaagaccaactgttcctgcaatcacaaatagataaattaggatttcaatttttaactgctgtaattctgattcaaagattctggtcggttgaaccgggacggggaaaatagacgtggcaatgtcttattggatggtactttctagaaggttacagaataaaagcggtcgtcggtataggggtcaaagtagcttaaacgacgtcgtagaggaatcttcgaatctcccaatagcttgcctttataacaaacctctctgaaccattgctatccaagaaatctttcagatttgcgcatatcgacaattttccgagcggccagtttacgtattttgtttgtacgtgatcaaatctccctcgctttctcgctatcaattttatcaattatgtgttcccgattgtttctagatttggattttctatttgcggatactagttcttttttgttcggaatcgattatggatttggtcttaagatttgcggaaattcttttgtaggtctgatatagtttgttcggaatcattcttgttgctcaggtcttagatcattgcgattgtaaattttgattttgattttttttttcttcaggtagttaacgtgtttcaaggactttgacaatg

SEQ ID NO: 27155 - DNA, 3003 bp, Unknown; identical to SEQ ID NO: 27154
  misc_feature (1)..( 3003): 2750-1469P.txt file - cDNA_ID_2730409; gDNA_ID_2684211; Annot_ID_137351

SEQ ID NO: 27156 - DNA, 3003 bp, Unknown
  misc_feature (1)..( 3003): 2750-1469P.txt file - cDNA_ID_2730412; gDNA_ID_2684211; Annot_ID_137350
attattgctataatacacgcatgacaggaacttatgttcttaaaagcttttcatgacgatgttcaaatcagcttaggtacagaaagcatcacatcagtaaaagtgaacagtacacaagagaaactaaaggtgaagtgaagcataccttgatggtgtcgtagtggttccacccgacttcagaagaaaggcgacccaacagacagtatttgtgtccagcctgcagcctcaagaccctgatcaagaaggaagaatcaaagtttcagagactgtagctacttgtaagtataaatgaaggaaactgaaaaaaaatgaaaatgaaagggtaaaaggacaaacttgagagcatcaggaacgaccatcctcttgatcttgtcatatggagtaggaactccttcaaagaccttcaagcgggcaagtgcattagctccacgcttagtcttgtgtggaatcatactgccacacaaacaaaaacaacaattcaacatcggatttggcacattttctcaaacaaaaaacaaaaactacacattgtacaactacaaaaacatcaaagtggattctctactttagtatgattccaatcctagagcaattttcaatgaaataagagttcatatgcgctttctacattattcacagtactaaattcataaaatcggtgctcgaatcagtagctaaaaataacaaaaccagagagagatcgaagtaacgaacccgcgaacggtacgccagaagatcttggagggagcacggaagtgaataggtccgtgagaaggtttagtgttcatacgcttacggagaaacctcatgtacttcatcttctgacgaacaagtccgccggagagacaaatctcctcgcaccggacaaccacaatattctggccattgagcagatcctttgctacaaccgaagccaagcgacctagcatgtggtgacgagcatcaaccaccacgcgcttcgcgcaaattcctgatccagacaccatttttcactcagctctgatcagccgcaagcttactactccggggtgattaaaagtgagcagcttattcaaattagggttttgcggtgccttttagcaccattttattgggccgtgataattgtctgttgggttatgtacttagtttaggatagtcaggcccatcttttctcttatgttttatatgtaaattttaaatgccaaagggttgattagggaaataatataaaatattggggtttaattgtgaaagtagaaaagaaattagaagaagaagaagaaaaaggagaaaggtatgatacacttttacttacgtgaatgagtttgtgtgacaacaagacaagcgtggattctggtactcatacgatagaaacggttgatgttagagctaatctcaattttcaacaatcagataaacaaatacaaaaacattctctttccttggaaatttacacaccacaattttggaaaaatatataattaaaaatggtcggaaatggaaaggttttaaacttgtcggagctttctcaacacaggaatcgccatgttaagtgagttttatgttggagacatagatctctctaccaaggccagtgatattgctactactactaccccaaatcagacagagcataatcaagataacaagagctttgaattgaagagttctgagttgttgttgattaagctctttcagtttcttgttcctcttttcatcttaggtttggctcttggtgttcgattctacaccaaactccatcatttccatgaaaatcgatttgtggtttgggggcaatcaagaagatttctatggactatggttattggttaacattatttgcttttatatctctctgtattgtctgtgtataagacatcttatatattaatcatgtaagtgacattaccttagtttcttcaaaactatgcagaattggttctagtcttcacagtcatgcattatactcctactgattttccggatagttatagcatgatcatgtgagcataataaatcgataaaatcttggcataaaacatcaatgaattctttattaatttcttataaaattattgtttataactataactttcttatttataatatctttaaaataaattgatttagaaattccgaaaaacataatcaggaagagttttaaactgttagtattaaatttcattttactattttataaaataatagaaatgaaatctatgaaagtaatatttacagatttattctttatcaaaaaggaaaagaaaaggatattttattaaaaaaacagtgataggacgaaactgttaaatgggctggagagatataaaactgttagccactacctggcccataatatatcacatcgtctctttcgctgcacttggtggttctccaattccgtatcgaaaatcttcttcgggtcagacgatctgaagccgatcgctgtagaatcagtttcgtgctccgcagtttctcgagtttcctctcacttcaggtagtcttcgacaccctaatcatgttagattgatattaatgttgaattttagctgatattcaatggttattgatccagatcttcataagagaattcacttacggagagggactttttcgtagacgattctcactggatatctatcacccggtaagatcgtcttgctcgaaaagaattgaaaagtttttaagtaattgaataaggaactgtgaatcggagaggcttacttttttgaaaagatctaaaccatcgtagaagatcgtcctcaaatatctcacagaagttaccaattttgaaagatcactagagatagctacggattttgagaggcggatctgtccaggtcggcactgtgaaagagaactacactggttttttccagatgatatgaagcttccgtgaacgaatctgattctaaggtactcatcgaagagaatctgggattgtattgatctggtcccttagcttccagtttggctataactctgacaactgttgtaagtgataagttgtgatcaataatg

SEQ ID NO: 27157 - DNA, 3000 bp, Unknown; identical to SEQ ID NO: 14669
  misc_feature (1)..( 3000): 2750-1469P.txt file - cDNA_ID_2730416; gDNA_ID_2684211; Annot_ID_191530

SEQ ID NO: 27158 - DNA, 3000 bp, Unknown; identical to SEQ ID NO: 14669
  misc_feature (1)..( 3000): 2750-1469P.txt file - cDNA_ID_2730416; gDNA_ID_2684211; Annot_ID_137349

SEQ ID NO: 27159 - DNA, 3003 bp, Unknown
  misc_feature (1)..( 3003): 2750-1469P.txt file - cDNA_ID_2730424; gDNA_ID_2684211; Annot_ID_137347
cgtttaggcacttttagataattttatgagaatattacacgtagaggtactattttgaaactttagccacaaataggcactttgaaaggagaaggcactttaccaaatcaaaattcccaaattgccctctgaaccacaacgctttctcctcattttctctctcaactcttttctctatcgtctttatttctctctctttccaaaatcaaaaccaattttttacgggaatctcaatattccaaatcaaaactaaaaacccaatttcatatgatttatcatcatcttccctgtctctcaacaattatttgatttggttccatttatttctctccttgattaaggaatctctgtcatcgattacaatgaaaagtgaggatgttaaccatgatcagttaccttctaagcaatctgggcttgaaacggttcgtgatgttgagaacgcgagtagcagcaaaaaggccattgtcgatgtaacttcatctgaggcatagttgtccattgatgagtgtccaagcattcaagtccaaatggtcatctaataactcacatttgaagcatagttgtccattgataagtgtccaagcactctagtccaagtggtcatctagtaactcacatctgaagcatagttgtccattgatgagtgtccaagtactcaagtttaagtatataaagcgtgtaagaagatcaattgtagcagcaatgttctgttgttgattcttaatatattcttcgtttttaagttatgatagagaattttgagataatctcagaatttctatgatttgtaagaattatagagaaccaccatgattgatgattttgaaaaagaaaataaaaatgatgaaaaaaaaaacatggaagacagagaagataaaaaatgatgctagtttgtctccatgataacttgtccacgtaaacgtaaccatgtggaaataagtgattctcataagcaaaagaatatgcttttaaggttagacgttcaatgaaacatcaatttatcaagaaagaattaaattgtaccaaacaaggcgatcaaatggatatgaaatttaatactggaatttgccaacttgggttttccataaactctcaaatgtttgattttgataaactcttaaatgtttgattttgcaaggaaagaaaaaaaagtaataatgagaagagagagagagaagagagagagaagagagagagagagagagagagagagagagagagagagagaggaagaagaaggaaaaaaaaggaacgtggagagatgaaactttttttttaattataattttttaattttcaggggcaaatttgtcaaaagtttaatgaaaaagttggaaaagtgcctcatccctgacaagtgcctcaaaaggaataaaattctctaaaagtgcctaaacgagtccatttaaatatatccactcggaaacctttttactgatccatatctaatctatataccatgtccataataacaggagattcaattaaccgtggttcgtatagaaaccaaagttccatgtccataaggtcttgaatgtggaggtctctgcaaactgaaagaaaaatcaacaaataattttttggtatccataataacgagtccatttaaatatatccattcagaaacctttctactgatccgtatctattctatatatcatgtcaataataacagaagattcgattaatcgtgttttgtaaagaaaccaaagttccatgtccataaggtcttgaaggtggaggtctctgcaaactgaaagaaaaatcaacaaacaattttttggtatccataataacgaatccatttaaatatatccattcagaaacctttttactgatctatatctattctatatagcatgtccatgataacaggagattcgattaactgaaatctcgatgctacgtagatgaaacgagtttgacacatgagagaaagcaaaaatcaaatcaagccgctgttgttgaagaagaagaagtttcttttcattttttacaaagatgaagagagagagagagggagagagagggagagagagagagggagagagagagagagagaggagagagaaagaaaaaaaacgtggattaagagaatattttagttagaagttattttagtaaaaaaacataaagaaagtgtctagtcttttgaaagtgcctaaacatggaaatagtttttaaaaaatgtctaaaagtgtaatattctctcattaaaatcatctttttgactcttcctattcagtcaaaagaatttaactggatatgaaagaattcaaattcctatacatatctgtttgtatttttaaaaatttattgctattgaattgattgactgttattttatttatgatggttttgataataatatcactttttatgctcccgttagataagaatttatttattactttaatttctaattgtttttttgttcagttcaattattccaaattctattgcttgatatccactgggtaatcatttgaaaaaatcgttaaagatcgacaaatgagtgtatatcatgctctggtatatattaaactcctatccaatagaaaatagtattgtgaagagagaatataatctgctaaagtattcccactatccagaaaaatacaaagtagaaaatgcacaaaacattatggttagatttctatccactatcgaagattggaatactagtttataaaaccaaaaacgtcacggtgtaactcctcgactgcacgtaatgcatcgaataacgaaatagtgatatatacacagaaaactatatagtatcatataaaattctttagtaataattattaggtcttaagaaatacagtagttgcgagtttaattgactagagagagtcatgattagtttaacgataatgactatttaatcgggcacattcttttccaaagatacccctacgacaacattaaaaaatacaaaaagccgaaacccgcccactacaatgaaaagctccgccaccaccaccaccctctggaacgatg

SEQ ID NO: 27160 - DNA, 3000 bp, Unknown; identical to SEQ ID NO: 14673
  misc_feature (1)..( 3000): 2750-1469P.txt file - cDNA_ID_2730428; gDNA_ID_2684211; Annot_ID_137346

SEQ ID NO: 27161 - DNA, 3000 bp, Unknown; identical to SEQ ID NO: 14658
  misc_feature (1)..( 3000): 2750-1469P.txt file - cDNA_ID_2730446; gDNA_ID_2684211; Annot_ID_191512

SEQ ID NO: 27162 - DNA, 3000 bp, Unknown; identical to SEQ ID NO: 14658
  misc_feature (1)..( 3000): 2750-1469P.txt file - cDNA_ID_2730446; gDNA_ID_2684211; Annot_ID_137338

SEQ ID NO: 27163 - DNA, 3003 bp, Unknown
  misc_feature (1)..( 3003): 2750-1469P.txt file - cDNA_ID_2730462; gDNA_ID_2684211; Annot_ID_191504
attcctagagggtgtaaaccaaacgtccacacttacactgttttgattgatgggttgtgtagagacggaaagattgaagaggctaatggggtttgtcgaaagatggttaaagacaggatatttcctagtgtaataacttacaatgcgttgataaatggctactgcaaagatggacgggttgttcccgcttttgagcttcttactgtaatggagaagagggcttgcaaaccaaatgtaagaacttttaacgagcttatggaagggttgtgtagagtcgggaaaccgtacaaggctgtgcaccttttgaagagaatgctggacaatggcctgtcacctgacattgtgagctataatgttttgatcgatgggctttgtagagaaggccatatgaatacggcttacaagctacttagctcgatgaactgctttgacattgagcctgattgtcttacattcaccgctataataaatgctttctgcaaacaagggaaggctgacgttgctagcgcgtttttaggtttgatgcttagaaaaggaataagcctagatgaagtaacaggtacaactcttatcgatggtgtctgtaaagtcggtaaaacccgtgacgcattgtttatcctggagacattggttaaaatgagaattttgacaactcctcactccctgaatgtgattcttgatatgctcagtaaaggttgtaaagtgaaggaggaattagcaatgcttgggaaaatcaataagcttggtttagttccttctgtggtgacatacacaacattggttgatgggttgattcgatcaggtgatattactggttccttcaggatcctagaactgatgaagttaagtgggtgtttgccgaatgtctatccatacacaatcatcataaatggtctttgtcaatttggaagagtcgaggaagcagagaagcttctttctgctatgcaagattcaggagtttcaccaaaccatgtcacttataccgttatggtgaaaggatatgtcaacaatggaaaactagaccgtgctcttgaaacagtaagagcaatggttgaaagaggatatgaactaaatgaccgtatctattcttcattgttacagggatttgtcttatctcaaaagggtattgataattcagaagagagtacagtttccgatattgctcttagagaaaccgatcctgaatgtatcaacgaactcatatctgtggttgaacaacttggtgggtgtatcagcgggttatgtattttcttggtcacacggttatgcaaagagggaagaacggatgagtccaacgatctagtccaaaatgtactcgagagaggtgtttttcttgagaaggccatggacatcattatggaatcttattgcagcaagaagaaacacaccaagtgtatggagctgataacacttgttctcaaatccggatttgtcccgagtttcaaatccttctgcctagtgattcaaggtttgaagaaggaaggagatgcagagcgggcgcgggagcttgtaatggagcttcttacctcaaatggagttgtagagaaaagtggagtgttgacttatgttgagtgtctcatggaaggagatgaaactggtgattgcagtgaagtcatagatttggttgatcaattgcactgcagagaaagacccaccttctaaaattattattacacatgattttgtgtagcttttttgtttgtttgtagtagcaagaagagaatccttttgaagtacagcgtgtggagatcataccttgagtaataccaaggatcctagttgggctgggcctggaagatattaaaataaatctacgaatgggcttttagcccaaatgttaaattgtggcattaaaagccctttctctttcgtctctcaaatataaattccacttttgcgaaattgagaccaaagtttcagtttcattggctggggttttgagagagagagagagagagattcttcttcgtctcgtaaaagagtaatagttgtaataaaaaaaagaaaagaaaaagacacagaagaaacattacagttatatacagaaagagaaggtatatatatatatataaacacgcacccatatgccaacacatggagattgatagagagagagagaagagaagatatttctcagtttcttcgtttgtatatcttcttcttctctctctcttttgagatcttccaatctctctctctctctcttatatatgattttttcaaataaaataaaataacggaagctggtttaaagaacaccgttgaattctattttcccataagctgaaaaaaaaactaaatttttgtgttgcccaccaaaaggtttgaaattttgatccgacgatacttgagctgatttacgttattagtgctatttcgatttcctcaaagatttcgttttttttttcttctaaatttcttagttaacctcttgcgtgtgcaattggtgcacttagcaattcctcttctgggctggtgatttggtttgcgattgttttttttttttagggtttgattggatcgtggccctgatttagaacctaattgcggtcaaaagagtctgtgggaggattgaattggaataaagtgttatctttttttgattggcggaattcacattcaatcggaaagaggccaacttgttggcggcttccgatataaaggtgcttttgagctctgctcatatatcttatttaactccaacgaaattgagagacgaatggttccgattttgattttctctgctcatcatgggtttggcaggttagctacaaatcttgaggtccccaggtgcaaaattactaattttatagtgtatacttaaggataattgaagtgaaatttgggagatcataaagaaatgtttggagcttctaagtgatattattggatatggtggactggatcatagattctgatctggtcaggtgctgggacttaggagcgacaaagtaactagagagtggtttaaagtataccacttttaacggataagtggtcatg

SEQ ID NO: 27164 - DNA, 3003 bp, Unknown; identical to SEQ ID NO: 27163
  misc_feature (1)..( 3003): 2750-1469P.txt file - cDNA_ID_2730462; gDNA_ID_2684211; Annot_ID_137332

SEQ ID NO: 27165 - DNA, 3003 bp, Unknown
  misc_feature (1)..( 3003): 2750-1469P.txt file - cDNA_ID_2730470; gDNA_ID_2684211; Annot_ID_191502
ggtcatcttatatttgtttataaaattgccaataattgagataaggtatcatgattcatcaatctagctagactgtgtgtaccatacataaactataacccatgtgtataaaatatacaaatatctgtgaacatcaaccacctaactataatgaatatgaaaatcatacgactaaactaatttacgtaaactatactactttgaaacaattattcatcaaattctcttatactattaattgtggtttactaaacttccaagttttatgttttactaatcctgtaaaattagactttagccgagtccgtttgaatctaggatttttgaaatttccaggtggctcaaagctaaagaaaatgtgaatgagaaatgatttcaacgaaaataagatttacataatagccaatgacatatatgcacttgtcaagttggagttaaacaataaccacacaccgaattgaggagcccattggaaaaaacagaagcaaatatatttttatgtaaaaatagaaacggaataatatagtaacaaaaagatactctcttcaaccttatccattcttcgccacttctcccactaatccgctaaatcattcttcttcatctctctctcattcacaattcccgaaattctctcaaatcacagatccttttagggtttttccactgtttctaggttttttttattgctcaaatctgatcaatggatagttgtctctctaatcaaacggcgcttcagtttctcccgtcgcgttccaggagacagagcggcgatggaggcggtggttttgttattccggcgaagaggaagatccagtatagttcgatggttgtggttgcggcggcgggacagagtcggtgtgagcctggaagcagtctaaacgcgccgcttgagccacgatcggcgcaggggaggtttctgagaagcgtgttgctaaacaaacggcagctatttcattacgccgccgctgatgagctaaagcaactggctgatgatagggaagctgctttagctcgtatgtctctcagctctggttccgatgaggcttctctccacaggtccgtgaaacctttccttatctaatctctcacaattcaaagatccgtaaacagctgtagaattataaacatacaaagaaatatgtgtaaatcattacttacatactcttatttaatcgaccacaaatcagtattttattagtatttatcacataagcttgtaaagtttgattataagttgtttgatggtgtttatcagtttatgatgatttgagaatcacactaatgatatggttgaattgaaacaagagaattctgtagttatgatcttcaggtgctttctcatactctgccttgtgaagcaagttttgttttagtgtttgataagggctggttttgcttttttacatttcattgttgcttagttcgttaaatagtttccgtatattttagtttcttgcctgtgttaaactctctgacttgctcaggccattttatgctctgtttgtgaacattttctcaactatcttctgctcttttacgaacactaacactctgattccatggttggcagaaggatagctgaactcaaggaacgctactgtaaaactgcagtccaagacataatgtacatgttaatcttttacaaatactccgagataagagtccctcttgttccaaagctatccagatgcatctataatggaagactcgagatctggccttcaaaagactgggagttagagtcaatttacagctgcgatacccttgagatcatcaaagaacacgttagcgcagtcatcggattacgggtcaactcatgtgtgactgacaattgggcaacaacgcagatacagaaactgcatctcaggaaagtatatgctgcctcgatcttgtacggttacttcttgaaatcagcttccctaaggcaccagcttgagtgttccttatcagatattcatggaagcggatatctgaaaagtcccatctttggatgctcattcacaacgggcactgcacagatctccaacaagcagcagctgagacattacatctcagactttgatcccgagacattgcagagatgcgcaaaaccaaggacagaggaggcaaggaatctgatagagaagcaaagtttggctctttttggcacggaagagagtgatgagaccatagtgacatcgttttcgagtctgaagcggttggttctcgaggctgtggcgtttgggacattcctgtgggacacggaattgtatgtagatggtgcatataagctgaaggagaatgggaatgcagaagaacaagaaggaaagaaaagcatatgatgaacaagtctggttagaagaaaagcttcatgatcttctggtagtgtatatatagagaaatgtttctgccgaatctctcaggcagttgttcagttcaatgtatagatcttgcttagaaatattttgatttctgaataagaatgtggtgtggttataaggaataagagatactgtagttgggttcaattttatgttatgtgttaagtttccttgttcaatttgatctttctccttttgtcaaaagactcaaaacctcaaaaacaaaactaaaatttgggtcccaaagaagctatgcaaagggaaggagatactttgataatgcttgtatttttgggcttattttaggcccaaatagcaccttatttcggcccaaaagttagacctaccaaaaaaccttcaattgtcactagagcgaatgaatgtaaaaatctggtctcctattatcaattccgtttctctctcgccggaagatttttgctacttcatctccttatcgccccaccaccgtcacatattcactggtaagcatatccattttgcttcctcatcttccacattaggcttctcccattttcttcttcctcccgccgcgaatcgcgcgtgattagggtttatgaaatctaacgcctcaggtttcgcattttctcaagtttctcgttaatttcggttaaagaagatg

SEQ ID NO: 27166 - DNA, 3000 bp, Unknown; identical to SEQ ID NO: 9142
  misc_feature (1)..( 3000): 2750-1469P.txt file - cDNA_ID_2730470; gDNA_ID_1972013; Annot_ID_177825

SEQ ID NO: 27167 - DNA, 3003 bp, Unknown; identical to SEQ ID NO: 27165
  misc_feature (1)..( 3003): 2750-1469P.txt file - cDNA_ID_2730470; gDNA_ID_2684211; Annot_ID_137330

SEQ ID NO: 27168 - DNA, 859 bp, Unknown
  misc_feature (1)..( 859): 2750-1469P.txt file - cDNA_ID_2730474; gDNA_ID_2684211; Annot_ID_137328
aagcttttttagtttctttattacaagacgaccgttgagatttgttcagaattaagacaccaataaacagtcttgtactacttaacttacataaccttttcatcacataaatctcttcgtgccaactcgtttagagccccgacaatcacacttttaatactttttctaagaatcaacgtttatagtactacaatgaacagtcaacgagagtttcctgagaatctgtcaatattttgttccgttcattaacaacgagagttgaactaaaaaaatccatagagaacaattcttcatttatccacctacttcatttcccacgaagcataagggtccataaataatctcaacgacatgttaattattagaccatgaaaatttctttaattattaacctttgtagacaaaatgtgagaaatgtttttagcaatagtttatatcatttaagatttaaaattatatttaacaccaaaaacagaaagaatatttttcactaaaacataatttattttaaaacaacctttaagaattggctagaaacagagtttttcaattaatataaccattcagactaaccaaaaaaaaaaaaaagagaagacgtcgtagtaatcgtacacttaaaaaattgaatataactagtaaatacaaaagttagtaatacattgtatcttttgttgatttaatactcaaaaacaggcttttgtacaggaacacgtaacactagccattaaatatctccactcttctttcttcttaccaaattactcaatccatctccctctcttcttctccttctccaaacaacaaaccaaagcttctctcttttcttgcttcagagagacctagaagagttatcaacatg

SEQ ID NO: 27169 - DNA, 3003 bp, Unknown
  misc_feature (1)..( 3003): 2750-1469P.txt file - cDNA_ID_2730490; gDNA_ID_2684212; Annot_ID_137371
ttctatcgtagtttttttttcggatgtgtatcttagaaagttttgaccatcccaaggaagtagaattaagaatctgatcaaaatattcgtttacttagggatttgtaaacgccttggagatatgttccgtcggtgaattatgaaatatatttgttgtggtgttattttcgaatattttttgggagatattgtaaccgacacctgatttctcccgtgactcgaagaggatactaagaccatcttcattggtagtcttttaggagattttcattactaaaataataaaaataaaaaaaaaaagaagagagagagcgtagaaagtttttcaagtgagaaactatgagatactctctacaagctatctttacatttttctcctttcaattggtttaattttttattaaaataaaaatttaatcatataataaaaatttaataaaatactaatattttttttgtttgagaaactttttgagtttcttcttaatggagatgccctaactcaacaagtgaccaaataagttaatttatttatgtgtatggttaagcactccaacgtcaacttaacatgaaaatattccttagcctaactcaacatatatttcaatttagagactatttggctctctgtaacaaccataatccagataattaatagaatatcttgacatgagatgtgtatctatgcacatgagatatgtatctatgcatgtcgatggaaacaaaaacagtttgtcctcatgcataggttccaagagatgtgtcggccgacaaactaaatacgctcgttagtaaatacataaattatacgatacgaaattattaggggtataatttccaaccataaatgagagtcgttaattgatgtgaaaacaatcttgtaggagtagtaatttagggaacaaaacagaacctccacgttacgtaattagacactaaaataaaactctcccaagaatagcgtaaaagtttttaaaatatatacagaatcgaaagcaatcaaatcatatttttcttatcgttctaaaacaattaatcacgaagagcttcttttcggcattataaaaccgaacatgtacaatttcctcatatccattagttgtttgattggtggtttttttttttttttctcgccaattggtggctttatgatcgctgtataactattgtcaacagagcccattactaacgtaacgtgcatgttcttcggtcaacacttccaatatctcaaatcaaagccataaccgtgattaaataactattttatgagttttttataggtaaaattgagtgatatactatatagtaagaaatttcagaagctcactacattttagtatcttgtttttggtcgtactaattgagaaaaatcgttttattttcataatattttccaattcatcgtgaatgtaagcaaaaaggttgaaagaaacgaataacaattattttaaaagattagaaaaaagtgaaaagagagttttgtagtacaagaaatgaaggaagtacaaacagagaaacgaatgaatgggtgtcagtattctcccaatcaaattgacatctactttccgtaccatacagctgtttccccctcttctcaaacctttttccccacttctatgtacaagtacatacatactattagttagattcacacactaaatctcgtgtattgtacttccttagaaaaaaaagtgcacacagagtaagaagagagggtttaagttttttttatacacatccggaaaataaagaaaggagaaattgaatagctacataaatcaatccgtacaatgcgagagatttcatatagtagttttgtaaaataaaagggtacttatgtctttttgtatcgacaggttttttgtattttatgatgccgacttcctccaaacgtggacgcgctttatggttagtgtgtttaagtaggctaaaaatctctaaagtgaaactcaattgtcaacgattaaagaattaagaagatgtaaaaaaaaaactaattttccaaattaattaataagctcataatatagcgtgattcgcgttaccgaatgtaatttgacttgtggtatactaattgtgactttgtttttatttctttgacattacgtaaaatttgtttctaccaattttgataagtgcacggtcaaatcaaaagaggaaaatgaaaacttggggttgaattctcaacttgaacatatatgatagtcaacacgacaatacgttgtattccttatattgaaatgaagctaattaaggtctatatggaaacaaatatgttatttatttatcaatgacgtatcacattttgacgaataaagagattaatgttatcctttacaaaataatgaaataagaaagaaacagaagtttatgtttgtccaattatcctcaatgtttgttgatatacgaattttgagaattcaaactgaatacaagaaataaaaatgtagtgagataataatacaaatttgcattatttcttccaagattgttttctttaagtaaatgaaaagtatcttggattattacagaaatgaccctaaatctttttgaatttacagtttgtaccaccaccgaataaaataagaaaaagtttcgttaaatgttacgagtgctcgttgaagacgaagtttcgaagacgaccaacaaagagaaagatcaaaatttgagagggaaacaaaaaaagaggaagagagaagaagaagaagaaaacacccttgattaataaagtctcagactttttgattcgattcgaaaaaagtgagtttatgcttgaagctgggaattccaaaactcggaattcgtgtaaaactagttcgatttatcagagttatgctaaggtaacatagtcgattcatttcaaatttacgaactttatgttcatctgatctctctctctttctcttctatttttggtaacgaatctcgaaatttcttgtgttgaattttgtagttagtgaaggtgaatgaaaaagagttgatttttgagagaggagagaaatg

SEQ ID NO: 27170 - DNA, 3003 bp, Unknown
  misc_feature (1)..( 3003): 2750-1469P.txt file - cDNA_ID_2730494; gDNA_ID_2684212; Annot_ID_191567
tagaaaacaactagctctaaccaacaacaaaaccacagaacaagaaattccagagatctataaatatgcagatgcatgcacacctcttcactggatgttcagtaatgatctgagcatcagcaactttagcagttgccctgaggaaatgagccaaaggctggcctagagtatgtgggaaggcacgggcaatgatatgagcatcaccagcctttgccacagtggttccatcaccaagttcaacacggacagtagtcccctgtaatgtacattgaatcaataacgaattaaactacgaatcatccaaccaaaaaaaaaactacgattcaatcactgttccagaaaatcactccatcatggtagttcacgttgaaaggcaattctacctaccacactaaactgaaatgttaaatcagacgagtaagtataaaaggatcataaaccctagatcccgattataataacagtgtaaacagatctgcatgaacggaaacaacattgcaagttcctcgagtagacaatcaaaataaacagctcgaagggattcaaaatattcgcgacgtgacgaaattgtgagaaaacgaaacagcagaagagatgatatcaatgaaaaacatagagatccaaacattggagacagtgaacgagagaaggaagcaagagatctaaggaagatacgaatatacaaataaaaggaagaaggagaagtacctggagacaaggaggaagctcagggtggtactgagatcggagttgttgaagaggagagagttctctggggattccgaaatctgaatccatgggcgataactttttaggtttttgtgagaaattaggttggtgagagtgtcagagagactcagagaagattcagagaaagttttttcctttggcccgtcaaaagtatttatatagtatgcgggggacttgggcgatacgatcaaccaaacagccaaaatttggtcttcttcttttttttctttcagtccacgctttttctcgatcagcccttgttattctggttatttacgaaaatgccattggatataaatatatacccttacctttttcggtttggtaatgtttggttagtgaccaaattgtctaattcggtttggtgttcatattttatgggttttaaaaggttttagactgcaaatttatcgaactgtatgagtgtacgtttggttttaagtttagtttataaatgcggttaggttttggtttagtttgagttgacaaattccccacctaagtgcgaccaaactttcaaactaagaaaaaataaaagcaaaaaataggatatgatgatatgctaaaagggagagtgaatgagcaccaaaggataggtgaagggtaaatacggaaatagcgagagaaaaaaaaagaagatggaaatattggggaatatagcattcaatagggagatatgcttttacatggtaattacaaaggaataaaggcaaacatatagtaaaagatacgactctctcattccctcttccccaagtattattattgcctgataattgataaactacccatcgaaaataaatatttattatgcacatggatctttaaaaaaatggatttgtttattatttgacctgatttgggcttttaataaggcttcttatttactctgttgaccgtaggaaaggcctgtcattatttaaagatctaccaactgaatttcatcagtcagtatcgatgggattaggtatattaatggtaattgttattttcataatataggcctagtgtgataagacctcaaaaacaataagctttgatattacgatgagagtaggagtatataataaaagcataagattatgatgatacaaaggacatcaaagttggtgaacacctagaacaacaaaaggagtaggtaaaaggggtcagctttgcattgtgcttatctcaactaccttatgagaagaaaataatatttttttctaaagtcaaatgtttgatgagtgtagtttggataatgccgcattaaaaaaaaaaacgtgaaatgacaatcgaacattgatgattggagggcttatttgtaattacgataactatagtcaaacggcccaaaccattaataataaaaggtgaataaagaattttctgaaagacgaagaagagaaacgaaattcgtagaaatgatctcgggctcggcgacggcgagtcatgggagagtgttgcttccgtcacaaagggagcgacggcccgtctcaactggatcaaatattttacgtttcagagaaacagtaccgagacaattcagcctgatgatggtgacgaaggcgacggcaaagtatatggggacgaagatgagggaggagaaactatcggagatgatagaggagaaagtgaaggaagcgacagaggtttgcgaggcggaagagatgtcggaggagtgtagagttgcgtgggacgaagttgaagaagtgagtcaagccagagcagatctgaggatcaagctgaagttactgaatcaggatccgctcgagagtttctgccaggagaatccagagaccgacgagtgtcgaatctacgaagactaaaatttgagttttcgtgtttttaatgattgtagctaatctcaaaacagaggacttagaacagagactgattctgattaataaatctcaatcgtccattgaaaccgttgttcatcgtgttcacttacaccgattgatttggaatgaaactctgcattttggatcttttgctttggaacaaaacggttgttttgattgtttatggatctaacgatgtggcctgttacttaattgggcctataatctggatccgccgagtccgggctttttaaagaactggcgaatatcattacacgtggccagatccataactttgaaaatttggttatttttaatttttgtggaaaattagagaccgcttcttgctcttctaacttcacctctgctttcttcttctcgagtgaaacagacagccaaatcaagatttgacggtgagccaaattccatg

SEQ ID NO: 27171 - DNA, 3003 bp, Unknown; identical to SEQ ID NO: 27170
  misc_feature (1)..( 3003): 2750-1469P.txt file - cDNA_ID_2730494; gDNA_ID_2684212; Annot_ID_137370

SEQ ID NO: 27172 - DNA, 3000 bp, Unknown; identical to SEQ ID NO: 14701
  misc_feature (1)..( 3000): 2750-1469P.txt file - cDNA_ID_2730501; gDNA_ID_2684212; Annot_ID_137368

SEQ ID NO: 27173 - DNA, 3003 bp, Unknown
  misc_feature (1)..( 3003): 2750-1469P.txt file - cDNA_ID_2730505; gDNA_ID_2684212; Annot_ID_137366
cataacttcatcaaaaccagtcgttgagattctgttgataacatcagtcggattttatatggctctcgatggagtcaatcttcttggtcatgatgctcgtaaatatctgaacaacgtcagttaattatcacttaattttactcttttctttaataaatctaaatgattcaactttaatatgtctctgttttgttatcattttcttgatgtgtgtgtatatagattgtcttctatgtgtttagtccttcgcttattggaagccgtttagctgatagtgttacatacgaaagcttggtcaaaatgtaagtcaatctcagattttgcatcttgagtctgtaatctttgctctttggttaatgaaaatgaggatttgcaggtggttcatgccggtgaatgttctgcttacattcatcattggttcattacttggctggattgttattgtcatcactaagcctccttcacaccttcgtggtctcattcttggttgttgtgctgctggtaacaaaccttaacatgaatgtttctgatttcagaatctgtttaacttgtgttttgcttatgactgtggtaatgaatgaaacaaaacagggaatttggggaatatgccactgattataatcccagctgtttgtaaagaaaaaggaggtccctttggagatcctgagagttgccagaaatatggaatgggttatgttgctctctccatggctgtaagttcttcttcttcttcttctttgtcttcttcttcttcaaggttttgtaatcagtatgtctcatgacagtacttggtaacgtatcagatgggatctatttacatatggacttatgtatacaatcttatgcgtgtgctatcgaactctcccgttgaaacccctccctctgttgaatccaactacgacagctacaaagttccccttatttcttccaaggaagaagaaaacaaccaaaaggtttcatcacatatgcacatgatcagtaactattcatttatcaaagttggtagtgactgtgtgtatatgacaggctgggaggtgggaaaaagtcaagcggagattggtttcactgtcacaaaaagtcaaccttaagacaatttttgctccatcaactattgctgcggtttgtgtttcaatggctctgttttatacatttgagacgtcactcacactagtgtaatctttctaattaccctttttgttcttctgtttccagatgattgcacttgtgatcgggctcattactcctttaaggaagctaataatcggcacggaagctcctctccgggtgcttcaagactcagtaactctagtggggtaactgcagctaaaattagaccattatcttagcattagctcaacaatgaatcatctcttggaaaaacgtaactcactcattcgaaagcttcttatgtgtcttgtttcttttggctgaagagatggggcagttcctgcaatgaccatgattataggaggaaacctactcaaaggtttgaggagttcaggaatgaaaatgtccagtattatcggcgtcttggttgcgcgttacgttttactgcctatgagcggtgttttaatcgtaagaggagcatataagttggatttagttacatcagagcccttataccaattcgttcttcttcttcaatatgctgtcccaccagccatgaatctaggttcattgctctgaaaccaactctttaaaaaatacagttacttctttcagataagatcacttcattagtttcacttactcttgcaggtacaattactcagttatttggaactggggagagtgaatgctcagtgattatgctctggacttactctttggcttcgattgcactcactgtttggccaacattcttcatgtggcttgtagcttagaatagacccccatactcatcatgttacatgtattgttttgttccattgattcaagaattgttcttggacttccagatgattggatcaagtataatagagaacatatacttataagtcttttgatacgaactttggacttacagtctgtaacttacagatagaagatcaagtccagcctcatcaagaatctgctattttgatcctcattgtcttgggatccatcaagagattgtgaggcttaaaatctctgttatgatacccaaatcattctctcttgaaacagggtaaaaccagagaacaatctacttgactacttgtgactgtggccatggcagaaagctattcctttgtttagtttggtacacctgagaaaaatttcagattgttacatttggtttaatagactattacatatcagtcaagtgagtacaaatgatgagagaaaagagtggtgacaaaaagctctaattggtggattttgtgataaatttctttacatctgtgtccatgtatctcaaacctaatcgtactctaagatcaattaatgtctcatcacgtcatatttgagattttgatgtataaccttccacatcagggctaaagtgcatgctagactccaagatatactatatgtaatatataaatttgtagctagtgaaactgtggaaaaacaaaaattatagtactgaaacattttagtttatgaaacgattcttcagaaaatagatgacaacaacagaagtttttttaaaatcaacgttattgttctttaccatacggtaaacacaatgcgacatatccacatcttcagcaagaaccacaaagtaacatggcacgtttcctagtcgctgtgactaaaggcatgacgatggttcccttataatttgtattctttttttctcagataaagagttggtggttatgatacgttggttttttcatacggaacaaaaataatacttactctatatctctccttcactcttcctctaaaaaggtaactataccatttcatttgatttctccataagttatcgtcgtttggttcattgtttctttatctcaaatcatgtaatatatggattaagtttgcagattctaacttttggaagtagagatg

SEQ ID NO: 27174 - DNA, 3003 bp, Unknown
  misc_feature (1)..( 3003): 2750-1469P.txt file - cDNA_ID_2730509; gDNA_ID_2684212; Annot_ID_137365
gggacttaggtctttcaatagagtttaggtctttctctagttctgaaggctcctctacaacacctttggtaccagacggcacatcttgctcttgcatttcagtatccgccatcatgaagctaattctctgagacatagcatcacaacaacaacgcagaattcaaaatccagaaatcataaatagaaacgcactattgataattccagagagaatgcaagacgcatgtaatcgagaattggaacgcatcaaaactctgagtcctactctctcactgattcgctataattcaaacagtgatggcgactaaagcattagaaagcagagcttcacgaaatcatggagtacatacatagaaacaaaagatacggttaccggtttcgccggaagaagaagacgccggagacggtggagtcgtcgcgggttagggttcgatagcagccggcgaaatggaaggacgccggcggagaaaaagaagcgagaaacggaaagatatcaattaaacggagagatatgcagatcaaaagatttatacggatgatataatgaacacatgaattcattaagaaagaaattaatgcttgttacttgtattaactcttaacgaagatcttaatagcaaaacttattaatgatatttcagaaagttggacttttacgacccatttacataacaaagcccattattgtaaactatgggctcaatatgtaaggtatattatgaatataatcttaggcccaattaaacacggaagacaacgtaggtttctgcttgtctcgattgttgttgtgtttttatttgttactaaagatagagaaagaaatatcgaagcattgtgcgttcatgttcaatatagagtttttgttgtaccaaaaaaatatagtgtttgaatctttaattatagactagctagcatataattaacgtgattaactttacaattatggtgatgatgattttctcagtatgtaggtatagtacttgtcaaagtgacaaataattgcaatttaatgaattggtgtggatccaaaggataacaaatagtatgagcatattcattcgaagcaaaatggtacagaattaagcaaagctttttgtccaaaattctaatgaattaaggaccattatttttagggaataatagtctttgatgccccacatttccaatagtacaaatcaagattttcaatatatgtcaagtttgttattttcattcacggacattaaaacgagtggagcatttcaatttgacatatctttgtccttttctttttgttacagatatcttttgttcacgttctttgaatcatcatattcatagctatgagatcatagaaatatcaaatactgttaattaacctctttaaaaatacatattcacaagtctcttgtgtgagtagaaatcctatacaaacaagtttattcatgctctaataagatagataaataagaagatagctcatgacatggccttcattaggcttgttgcatatacaataagcttacatataaggaattaaggatggtctaatatctcttgcttcacatgagaagagttataggattcgagtcacataagagatttttattgtagtgtgtataatatatcccacttctacaattatccagtctattgtgtatttttcattaataaatcactaaaatttgcactttgacaatatatacttaaatatttgtatctcgtatatatatatatacatatttttagcactgtatgataattctaattattcgctaattgtttttttttggtaagaattagtcgactattttgatattggggttgttacatttatatcttgcattgaattttatggacggacactggtcgcagcctcacacactaatttgaattttccgttatcattaatattcgatcgtttcgttggtacgcttccatcacacaattaatttaagccaccacactattatcttattctcattcagttttgtttccatttcaaatttcttacgacgcatatgaaaatgtacatttttataacaattccccttaaaaatagatgacaaaaagaaaaatgttttttttaaaaaaatatataaaataaaataaataataaatcttcaacaatcgatgaacactttgcaatatctccacaccttgggcaagaaccagaaaaaaacatggggcacgtttcgtagtcgatgtgacgaaaggcatgacgacggttaccatataaattcgtcttctcagataaagccttattattctcaatagtgttatacgacaatatacgaaacaaacaaagaccccgcttgagttgagttttccaaaaattgtggaactgtttcctctttctttttgtacataaactaggttacaaaaaattggaaaatatacaaaatcaaaggacataaacttacgagatatatcataactcataagttgtgaaagttggaattcaaaaaggagctaactatgaatctatgatacgttattttgttgcttatacggaacaaaacaattccaaaaacaaagaagatgtaaaagtctgacccggatcatgcggacaccaagttgtacatacaaaatatgtaggatgaaaatatgaaattctcttcccatatgcatagaataataatttaccttagttaaaaagattagtttctaagtttgccccaaataaagagattagtttcttgaaaaaagcattttgtggatagacaagaatttaaatagaatgaagaggcgaccatgcaagtgttgtactaggccaaattttggagacgctctttctctttcatagagagagagtgagaaagttctgatacggcggcttctcactgtcatctagctgtaccactgacgataaatctctctcttcctctaaatcggttaaaaaattcattcccttcttggattgctctgttttcttcggcggttcttgcagctccattgattctctgtttcctctgctacagttaacttatacttgcagattctcgcgttgatagtaaaaagatg

SEQ ID NO: 27175 - DNA, 3000 bp, Unknown; identical to SEQ ID NO: 14690
  misc_feature (1)..( 3000): 2750-1469P.txt file - cDNA_ID_2730513; gDNA_ID_2684212; Annot_ID_137364

SEQ ID NO: 27176 - DNA, 3000 bp, Unknown; identical to SEQ ID NO: 14684
  misc_feature (1)..( 3000): 2750-1469P.txt file - cDNA_ID_2730520; gDNA_ID_2684212; Annot_ID_137359

SEQ ID NO: 27177 - DNA, 3003 bp, Unknown
  misc_feature (1)..( 3003): 2750-1469P.txt file - cDNA_ID_2730520; gDNA_ID_2684231; Annot_ID_137606
ttaaaatcagatgagacttgtgtataaatactttgagatctgtgttctctttcgttcactccaaagagcatcctattaagttgctaaagagagagacgccaatggctgtaaagcaaaaggtctgtgttactggtgcaggagggtttattgcttcatggctcgtcaagtttcttctctctcgtggctacactgtccatggaaccgttcgagatccttgtaagggataagatagaaaacaaatcctctcttttttgtgaacttttgaatattctctgtttcttgagtttgaaaaagttgcatgcattgatcccattgttctcaggtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagttcctctcacagaggcaagttcttacatagattcttcttttgtttgtttcttgaatcactaacaaagtctttaaaacattcaggaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgaggtaatattgtatctttgaagctaccatgttggtcagttgtctctgtgttatacatatacaccaagacagtaatagaattgagtgtttaatgtgatgcaaaaaatctgaggatctcagggttattggcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtgatgtaaacatataatgtgtgttctcttacctcctattgcatattttggttaagtgattgattcattcttgataatttgatgaattggtgtgtctcttcttaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaaggtaagaagagtaagaacaaacgcttgatttcaaactttgagatttcggtctgatctgatggaatgtttattggcagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataagcttacagagtcgtcacagtgactgtttcttcacttttatcactcctgaaataaagtggtttttgttagaatcatttcattctcaaatccattatctattactatcatattagtgttgttctttgtaacagtcagttatttgtcactttcaccaacatgaataatttgatggaacatgtcagattctcacggtttctttttcacaaaacaaaactggttttgaatccgaccactagactaaagtgtccatagtccgcggcaaaatgaaaaccaatttaaatgtcgttatacaagctttgtagtctagtagagatatacaaatttaattgtcgttgttagttttgtagtctagtagatatgattagtcattagttacggtttcttaataacattgacatttagaccacaatgtggacttgtggggttaaatgagtcacgagctcatgaacccctagccatttatttgggattttccgaggacgaggcttaatctacaccgtccgaattcgttaatgacggcaaattgcttccatgagtagatttttctttgtctcattagtcattatacaatttcaattctaaggataaaataatcaacaaagtttgatttcagttttttacattatttgtgtaacgttactacaacggatagatttgattcagacaaaacaaaaagatcgatgattacgacgttaattacagaattagaggtataaatatatgggtcccacgtcatttacaatggccagaaacaaaagtatctctttctctctctcttcatcttcaacaaatcacgcaccatcataatcatcatcatcttcatcgtcatcaccaacttcttcatcatcaccatcaatggaattccccaaaccaaaccacccttcaccctaaaaatcgtttcatcttttttccttcttctaattttttttaggtttttaattaacttttgcttcaagttttcttctatagatttcttactcagaaaagtttcgaattcgaccctgtagcttagttgttgtttataatttcttgtgatcattcacagtacaaaaaaactaattcacccaccgacttcttcttcttcttctcttctctgtggcccatccttaaacccacactgcttttgcttttcctttttttttccgggaaatttgatctctttacctttcgtcattattagtagggaatgatcttttagttttttttttgtttcccccaaatctcactttttctcacttcctctccatctcaaatttcacacaaccgagtaaaccctagaatctccgcttctcattcaattggtttcatcactggtcttaatcattgctagggtttactcggttacctttatcatcatcaattgatccttgttcataattcatcctcttttctttctgtctttggcataaagtttcaatttttcttcttcttctctttctcactcaatcatg

SEQ ID NO: 27178 - DNA, 3003 bp, Unknown
  misc_feature (1)..( 3003): 2750-1469P.txt file - cDNA_ID_2730524; gDNA_ID_2684212; Annot_ID_137358
cggtcacctaagtaaccaaagatgagctgacctaacgcggtgccaagaagagcgattgcgtaagaagttgagagaagagcggttccgattgagtctttgtggtaatatatttgacttatcattttcatgatcggagctatacagaaaagatcgtatgcgtcggtgaaaagtcccattccggcgactattatcgctttgaaatggtaccactgtatcctcgctgcgtctaacgccgataataaacttaactccggcatcgtttcgtcgattttttaagaattttttcaagatacggagaatgagaacaatagaagtctttgtatttttcatttgaatgtgtttttggagattttttcttattggagacaaatatggaatatgctttggtttgactgtgaggaacacaacacctccctggatcgagtccacttctttagttgactttgacaactttatttataaaatttggattataagttttaaatttccctctttggtacaaagagttttagttgtaagatgtgattgccaaaatcttggttaaaacagttccgtttcacatcaaggtgctttttttcagagtctaagaacatcttaaggaaccggatcattggacatggttctacacaaaagaaactagaacattcttgagtctctaacctctgctaaatccgaccaaagacttacaggtcggccactgcaactaaatgctgattaagcatggaggatatcgtggttgaatgaaaaccggaactatgaagttgggatgcgcactccgagcttgactacgacgacttcaaagatcccatcagatctaaaattaggagaaaacaagcgaggatccacttgtcccggaagattaaacgtgattgagaatggaccaggcggacagagctgttgcacttgcattctgtataagcatcccgtgtcacttggaatcgcaatctcaggtataactccttggatgcaaactctcccctccctctgaatttcacatttgatcttatctattaacagaacagaagatagcattttgggtcaaagttgctttcatacacggatagcgtaaaagaaagcagctttcttttcacgtcattggtcattatctaacccaaaacatgaggaatccattccggtattaacaggttgttattttcattatccaacaacaggacataaggagaaaagaaatgtgaaggcttaccttgatttttctcaatgccaggaagagagactcggaagatgtaagcaacttcgctgacgccaatatcaacaagaccaatgggtggcccaacagagcctagcttagcagtaccagtgcagaatacatgtgagatcactttcgagtgagtagtagtagtctgattattctcagcgttcatctttgtgtttctgtttttttcacaagagatagaatccaaacctacctgttaataatatcacaattaagaaagcaaaagaagaagacaacaatcaaatcacaagcacaagtcaagtttgaagatgtaaaagcaaagagacctataagatttttctatacaaacagagcaaaggttaaaactttatgagtaaaaggatctaatctctctgaaggaagattccaagaacatcaaattgaaagtacaagggaagaaacaaactaagctagatcatgaccaaattcttaattttgatgaacaaaagttctgaaactcgaatcgtttgagctagatttctcaaatgatttgagaaactaaatgtggaagatgagtttcatagtacgaatcagtcgaaatcatttgaaatctaagctcaatcaggtttatgaaattagttcttctttgcattcaaaaccctagaataagtggcgatgaagcgataattttcgtcttcctagggttaaagaaacagattcgtaggaaaatggagttaaaggagacagaggagacccaaaacagaaaaaaaaaaactaatttcgattccacaatgccgaaacccagaaaaattctcaaaacgaagtcactcaagaagataatcaacaaagcgaaaacggagaagggtttgggtttaaggtaccgtaacgaactccggtaagttccgatgatggtgttgacagcgaagcttcgtggaacagcgtgaccgtcgttactcactggatttgccggtgaatttgatgagtcaaaaatataactagcagctggtcaaagtaaccactctgaataagacacgtgtcagaaactttgttgaccattctgactaaagaaaccttgtaaccaaaaacatccacatttttacatgctctgtcatatttcaactgtatactaaagttgaaatatgactatggtaacttatgtttttttagttgaaaactaaggtaaactattctatgccagcaggtaaaagatgtggatgaccaactactgctggcataatttattctatgactaaggtaaaactaaaagttaatatcactcgaaatatttacaaaagtattagataaagtactaaaaattttaagttagaaatgatgaaattaaaagatatatgtggcttatttaggaaaatagatacttttaatatgatggttgggtagttttattattgtttgggattgaaaaaaactatgaaagtgtctccaagtacagtaatatttaacaactaactaggaaggtgtacattgttcagtattcatcattctaattaatacaaataattttaaaaatttggggtcgtcaattgctcaaagatattcattattttataattttctacattttatcaaaaacagaattgtgtaaatgttgtgtcattatgtgtcgacttggatgtatgcattacataattttattttatatatgtttttaattgttagagcatttattcgaaaattataaatattgaattttaatcctcagtcacttaataaaaacattattttaggactaaaaaataataaaagttgaaacagcaaagtagcgatagatttcgtgaaaacagagaagcggacatatcttgaaacacatg

SEQ ID NO: 27179 - DNA, 3000 bp, Unknown; identical to SEQ ID NO: 14861
  misc_feature (1)..( 3000): 2750-1469P.txt file - cDNA_ID_2730524; gDNA_ID_2684231; Annot_ID_137607

SEQ ID NO: 27180 - DNA, 3000 bp, Unknown; identical to SEQ ID NO: 14682
  misc_feature (1)..( 3000): 2750-1469P.txt file - cDNA_ID_2730528; gDNA_ID_2684212; Annot_ID_191553

SEQ ID NO: 27181 - DNA, 3003 bp, Unknown
  misc_feature (1)..( 3003): 2750-1469P.txt file - cDNA_ID_2730528; gDNA_ID_2684231; Annot_ID_192260
atcttagagctttgttcagcagattcttcatctgtaaactgtaatacccaaaagagagtcgttgtgttagacataagatactaataagataggttattgtggcaatagactagagttacctgtcctgtgacagtgtataaacggttgtaccatccgtttgttgccattccaattgcagagtacaaatgcttgcgagcttctccagggttttgtaaggtgtactcgatgtaatagaatcctgatcatagattgtgtcaacgaaacaatgccaagatactgcagagattctcattgagttgagatttttgtatttacccttagaagctctgctatcgattagctttgcagtcactcctactggtttttgccagcttctatccaatccactgacctatacataaatgtcatgttgacatttgtaaggaaatctttttgcagagagtttgtttgtttgtttcaattgcatgtagagagactaaccaatgtttcggcgaaagcttcgacctttccgaatgattccatcctggtgaagtctggacctagtccagtgatcgctatactcactgagacgatccatatacatcacctatcggttagctcatgacttctgtctgatccagagagtaaacaaaaagaaacaaattttgataaattttaccattggaagttgaagtttcttgtgggtaaaaagctgtgattgacttgaatccattaggttctgcttgcccgacttgccaatctttatgtgaatgcagatcaaattcattcatcactcataatgatttcgccactatcataagtatctgaaaacagagtttgattagattaccttgtgggattgatatctcgaatttgttcgtttcatctgtgtacacacggaaagcttctgatgcatctgagattcaaaagaagttgttattagaaattctcaaggaatcaatatcatcaaaaacacatagaatcaacaatacttgtctctgcaaatgcaggtgaaatggccaatggaaggaagaaaacagaggaagctatctgtaacatgacgtctcttctcttcatcccaacatgatctctagacctgtttactttaacagattcagaacaaacccagataaagaaaggtagtgaatttcactgggacattgatagactttacgaaattcgatgttgttcctcgttggagctgtcaagaacagagattgccgcagaaattgatgaacatcttctggaatctggaaagaattagctccaagaatatgaattttgtaaactacgatgaatcagtgaagactgtgagagtgagagagattgagaggacctgtaatggtaacgcggggattcgaaaagctctgaggagaagataaccatggagaaatcgctgccatgtgtttcaagatatgtccgcttctctgttttcacgaaatctatcgctactttgctgtttcaacttttattattttttagtcctaaaataatgtttttattaagtgactgaggattaaaattcaatatttataattttcgaataaatgctctaacaattaaaaacatatataaaataaaattatgtaatgcatacatccaagtcgacacataatgacacaacatttacacaattctgtttttgataaaatgtagaaaattataaaataatgaatatctttgagcaattgacgaccccaaatttttaaaattatttgtattaattagaatgatgaatactgaacaatgtacaccttcctagttagttgttaaatattactgtacttggagacactttcatagtttttttcaatcccaaacaataataaaactacccaaccatcatattaaaagtatctattttcctaaataagccacatatatcttttaatttcatcatttctaacttaaaatttttagtactttatctaatacttttgtaaatatttcgagtgatattaacttttagttttaccttagtcatagaataaattatgccagcagtagttggtcatccacatcttttacctgctggcatagaatagtttaccttagttttcaactaaaaaaacataagttaccatagtcatatttcaactttagtatacagttgaaatatgacagagcatgtaaaaatgtggatgtttttggttacaaggtttctttagtcagaatggtcaacaaagtttctgacacgtgtcttattcagagtggttactttgaccagctgctagttatatttttgactcatcaaattcaccggcaaatccagtgagtaacgacggtcacgctgttccacgaagcttcgctgtcaacaccatcatcggaacttaccggagttcgttacggtaccttaaacccaaacccttctccgttttcgctttgttgattatcttcttgagtgacttcgttttgagaatttttctgggtttcggcattgtggaatcgaaattagtttttttttttctgttttgggtctcctctgtctcctttaactccattttcctacgaatctgtttctttaaccctaggaagacgaaaattatcgcttcatcgccacttattctagggttttgaatgcaaagaagaactaatttcataaacctgattgagcttagatttcaaatgatttcgactgattcgtactatgaaactcatcttccacatttagtttctcaaatcatttgagaaatctagctcaaacgattcgagtttcagaacttttgttcatcaaaattaagaatttggtcatgatctagcttagtttgtttcttcccttgtactttcaatttgatgttcttggaatcttccttcagagagattagatccttttactcataaagttttaacctttgctctgtttgtatagaaaaatcttataggtctctttgcttttacatcttcaaacttgacttgtgcttgtgatttgattgttgtcttcttcttttgctttcttaattgtgatattattaacaggtaggtttggattctatctcttgtgaaaaaaacagaaacacaaagatg

SEQ ID NO: 27182 - DNA, 3000 bp, Unknown; identical to SEQ ID NO: 14682
  misc_feature (1)..( 3000): 2750-1469P.txt file - cDNA_ID_2730528; gDNA_ID_2684212; Annot_ID_137357

SEQ ID NO: 27183 - DNA, 3003 bp, Unknown; identical to SEQ ID NO: 27181
  misc_feature (1)..( 3003): 2750-1469P.txt file - cDNA_ID_2730528; gDNA_ID_2684231; Annot_ID_137608

SEQ ID NO: 27184 - DNA, 3003 bp, Unknown
  misc_feature (1)..( 3003): 2750-1469P.txt file - cDNA_ID_2730540; gDNA_ID_2684215; Annot_ID_191665
attttgtgtacttctattaaatcaggagaatatctgactgacaccatacataatcatataactgcagataaaatatcggtttttttttgttaaagtgtcgttaagttacttttggttctatagtttgatcaagtgagtatttaaacactactaagtaagttactattggtactagataaaattttggaaatatgtatgtgctgccaattaaattatctgtctcagtggagtgttgcaaatctacaaagtactattgggtattaattagtacacaatagtactttgtagatttacacgtattcatttatttttaacaccagtaattttttttggttacatacttagatgcaacacactaattgaaaaagaaacatgcaaaatacacatgtaatagcaccatgacgaaagtagcatatatgcatcaatagctataatacatgtataaattgataaggaaacaaaagaaatgattggcctagcaaatttaacgagtatcaactttggtcatattttgaaaaacgagtatcacgtgaaatcacggttgtgaatattttaggtaacttatactaaaagcattgtattgtaggtggccaaatatgtgtatataattttctctttattcttggtaactttttttgtccaaccctatttttcattataattttgtccacattctcatcatactaaattactaacgcacatacgcaataagaaaaaaatgtctgccagattattaaatattccactttccaactaaaattgtgtcgctatcttttgtaattatgtaaaaataaaataaaaaaaaacaacgatacaaattgtatacctacacatatgacatgtccattacaataccaataaactgaaggcaaattgaatacgattccatgactttcatttattatacatataaaattagggaagttgtaaataatttaggatttttctcaaaaacaaataatatttcgggttatgtgcttaattagatcatgtgtaattagaacacgtataatatcactatcggaataacgttataaattagtagctatcaacttattatacacataaaattaaggaggttgtaaataatttaggatgtttcataagaataaaataatatttcggatcatgtgcgtaattagatcatgtgtaattctataacaacacgtataatatccctatcataataacgctacatgagtagttttctttattaatatgcagccgtcttaaataatttattcctctttgaccccaaaacttacacattaaccaaaaaacaccccatagaagttttatagaatcacgcaaaaacccccttttacaaaaacgtgccaatttgaggacttaaagcatccacgatttgattgatatttcctcaatgattgggtccgagagtaaatgcgattgataaatgatcacattactcgcgataagagtctgcgatctactataagcaaactagtcgtcttttgattctcctcttcttcacctttttaccaatttcctcgcttacaagattcaaagggtttgtgattgagagaagctttaaaaaacccatctttggtgtttgattctctgtttatttaattcataaaggaaggctcttttttttttgtttatttcaggctcattacgttgatggtcatctaaatctcaagaagacaaagttgcgatttttgcaactgggtttctctcttcaggtactgagtttttgttgttgattgtgagaataaaaaggaaagtagacaaaagaagagaatctaggtttttgattgaactccattttagaaaaagttgaaaactttttggcgtttttcatttgtttttcaagttgtggaattttctgaattggcaaaaaaacaattttgtgactactaaagcaacttgtcttggctgcttctttttatcaatcatatatcattgactccactaagatctagtatttatataatattttgtgtaggccttattaccttcatgctaagctcgtgtcttctgatctatttgtaattattttaatctattttttttcagagatttaatctgtataagaagatctcaagatcagcttttgtgtattgaagaagaactaggaagaacgaggatagatacaggtattatttttatatatcaagatctctgcttttggcttatttgtttatcatctttttcacttgaaatgcacgagttttaaagtataaataagctttgtgttcttgttcttgaggctttgtgttgtgtgaagtagaaataagctgaatttggatttgatttgatttggtattaaattgtcctcactggttttgcgtgattatatcatctatgcacatggcttgtagcgctgacttgcttataagtatttttataaaacgtgttgcgttcttgttttggcttctataattgtagttttagaattgtgcttgagcactaatcagattcacagcaattcaaaaatccatttagaggtataattccttttagatgctctttgatcttttcgtgcttgagtcagtttgtacttttgtccttgactctttctaaaacaggttttgtgttaatcccttgaatctgctttatcgcttatgtctcttgaaatctatctatgttgctctctttgtgactgtctgatcattagttgcaaaatgtgaaattgtctgtgtaatgatcaggtcgagttttatgaaatgttgttagcttccattgagtaaggcttattgtggattggtggattgaaatcttcatgtaactataagtattgaggagctttgaatgtggatttaaaactgttctggagtgtcattgactttggatactattattatgtatttgtattaaattcatattatgtatgccacagacccattctctatttccttcaacaagttgacagagagcaaaatctttatatacgtgatatcaaagtgttctaatttccacattcttctcacttctcaggctttaatctaaactttgctctctgctttctgcgattaaaagatg

SEQ ID NO: 27185 - DNA, 3003 bp, Unknown; identical to SEQ ID NO: 27184
  misc_feature (1)..( 3003): 2750-1469P.txt file - cDNA_ID_2730540; gDNA_ID_2684215; Annot_ID_137394

SEQ ID NO: 27186 - DNA, 3000 bp, Unknown
  misc_feature (1)..( 3000): 2750-1469P.txt file - cDNA_ID_2730572; gDNA_ID_2684215; Annot_ID_137384
cctcttgttgttgccaaaggtggaagctttatgttctgtttaagcgaacaaccactggtcttcgtcttgcgctcgatcggtttgttgttgttgttgttgctgttgtcaagagagatgcttcttccaagtggtctgctagaaggagtttccttgcgagagaagctactactgcatggtaagtccaatctctgtgtgttcatgggaaaatgcgctgatactgttgctgatgttgctgctactgcttcactcctcaatcttcgagtaggcgacaacaatgatgaactcgaacaacctgccaacatcctctacaaaatctacctaacccaattcaagagatggtctacaagtgtgtgtgtgtttgctcaaacaattaaaaaaatggaatccgatgaatcttttttttttggttttagtgaaatcaaagtgaatcctatatgaaaaaattgaagaatgaaatgaatttgaatcccctgccccaaaagaaccaacgaatctatataatcaaataaagaatgaaagaattatcgaactaaactaaatcaaatcaatctaccataaaacaatcatcggattccttaaactttataaaaaacaacaaaatctcatttagatgataatgacgaccaacgaattcacatcatcacgaacagagactactgaagaacgacctcgaagttgctggataaacagacttgagagttgctgtaaacccggttcaccattccggtttgccattctggttttgccaaatcaagaaaaatctctcagaacatccagaaacccaaaatcaacaagaacccagatcagacaatcactaggagattactgaaacacaagatcaagatccaaaaactctcaaagattgttactttcttcactctctctctcactctcactctcacttctatctgtttctctcactcacttttggtttctctctctctctctctctctctaactctctacaggggttaagagatactatacagcttctacaaataccatagtggaggcaactttttagagtttgttttcttgttgggtcttcgagaattgaagttggcgacttttctttttacagtaattgttttttagagttgggcagagtgagtggtacacgagggatctgaatctatctgagccgttggatctttaaaatcaaacggtagaaaattggtgaccgtttgtgaattgtcggagaaatatgaccgttgggagagaggaagaaagaagagagtgttgggtgtgtacggacatcaatgacttctgattgggaaagccaacaacgactttttttaatacacccaccaaaaaatgacattgtttttttttagactatgacacattcgcagtaaaaaaacaaatgatcattgtacaaagtccaaataactatttagggtactaaatttatctgtcattaataaatattgccagttttgtgaaatatatttactaattccttctctatattagtaagaatgattgtttatgattttcttacgcatccccttaaatctttttataattgttttattataccaataatttacatgtaccatttttctacgcaaaatacttccccaatactaattcaatttattcaattgtcgtatgtcaatgttttttgaagttttacattttataacgtctaaaaaaaacccaatattcatggaacataccagaaatcgaaactaagcatcaatttttttttattgaaacttgtgtaaaattgcattcacaagaaattagagtttctggccttcctagagtttcttgaattgcgttaacaaaaaattagaggttccggcattgcttccacactaggttaaggttcaacaaaattcgcaaccaaagaatagctatgaaacaaataagcaagatttcacaaacataaagagcttacaaaatttcaaaactaatgggctttactagcaaatataatgggctttttaataaacctttttttaataagcctattaataaagatgggcaaaatgtgtttctttttgtatcaaaatgttgtctaattttactgataaataagaataagaaatagggtaaatatttggaaactatttagaaatacattttaatctaatggtaatgattaattcaagatgtatataatttctagtatcttttccctaataattgatatttttcattcattaacactaggaccttttaggtttaacatcttaaaactctatcttaagatgtttagataagtatttgggttgtaatgattttctaggaaacactaaaatagtatgaacataatctagttaatcactagactaaaaatcaaatctgaatctatgtacaaaatctaaactatacacataaaagtagatattaacatatatattaatgaataatatataattatatatagatacacttagcacaaatatacacatatatttattttggattgttatcatgtgctctgtaagaaatcatgctacaatatacagatgatataacaggataagagctatattaatagagaactttgcataaaagtcgttatccaaaaaaagaaaataaactttgcatgaaagctaaaccaaatgcaaataagaaaataattgtatcttaaaaggattgttcttaaacgatataaaggtacataattccctcccacgttaaccattcattgtgcattgtggaattccatttgtataattagttttgaattagatcattcatttcctttgagtttgatgaataaaaagtaagaaaaaaacactaagcttgggagggtggcttaattaagcgtgtacacataaactatactttgttaaaaaaaaattgggaggttgattatgacttatgagcgaataaagcacttttgcgatagttattgaacttgctaatcaagttgttaaacgtgtgtatatatataggatgtgcatcatcacaattctctctagctagctcttattcgtattatataaaaaactcaataactcttttttgtttttggttcttaagatg

SEQ ID NO: 27187 - DNA, 3003 bp, Unknown
  misc_feature (1)..( 3003): 2750-1469P.txt file - cDNA_ID_2730576; gDNA_ID_2684215; Annot_ID_191650
aaagccaaatcaatatcacctctcttacataatccatttactacaataccataagtaaccagatctggttgacaacctttcacaaccatccggtcaactaaagccactgcttctgaagctctgttgtggcgaaaaagtccatgaattagagtgttgaatgtgaatgaatcgggctgatatcccatttccaccatctgaccaacaagagatacggcatctgaaatcctattcccgtgacagaaaccattgagcagagagttaagcgtgacaatatcgggctcatagccgagtttcatcatcttggcaagaacagctaaagcaagagagagctgagagcgtcggcagaaacagttgatgagaatactgtatgtgtaaagattatgtgaaattcccaaattttgcatctgctcgccgagagagatgacaagatcgaacttgttcatcttagcaatggcactcaacagtttactgaactcaacaatcgaagggaaaggacgagacttgaccatgtcaccgaacagattaaccgcatcatctagcttcaaatcatttagcctatttatcgatatttttctgtaatcatatctaacaccagagaaatctcgtacccagaaactgcaatggctaaaggaaggaggagcagttccacatttaccttttccgagaagactccgatgaacaaatctgtttcccgtcgatgaaatcgcaaacaatctcctcatcttcagctgattggggtttcttccaaaatcactgattcagaatcgtaaactctctgtaaacttgtataaaccctaaatgatgaaccttttgcagacagagagagtaaaggtttgaacttttggttctaccaaaccaaacagagagagagactcacataggctgagagagtgagagtgatattcatccagtttcgcaccaccgttggatcatttgaccggtcaagatttcatcttatcatttttatcaccggtttggtttataatcacataatgtatttttttttggtttagttctaaattgaaaggccagcattagcaaataaatatgaaaaaaacaaagaagattatcaagttttgctattttggttccatatttgtctaactatatttccttcatttttttttttattgctgagatgtccctttctaattaaggtgaaaccgcgtggaccttaccaatttatatcttggattgtaaagatctatatctgtttggttccacttgtatatgatacaatgatacaatacaagtttggtcattatcattttttctaatcatatgtcaacaaaaccaaagtatgcattcattttgcaaaatatacacatctatttgtatcacctcccaaacatttctcccattatacggacttggacaagtattcatacctctgcaaaagtcttattgataaatgaatgtgaaagtacatacaattggtttagaacattaaacacgagtttggtttggacacatggctttcatatactccttagtgataaattatggttaattataaccatctttgaagtttattctaatattttatttattaatttcattgatatggtttcaaacgtcaaggaatattaaaccttttacgaaaaaatttcgggtggatcatataatatcttcccttcaatcctcaaagttctcgaactctaccaatacctacaaggctacaaaaatttatacaccattgaaatatgctgcaacgaagtccatttaaggcctgatgataaattccttggagatcgacaataatatccaagcgattgttagtgagattatagagttagtctttgttggattcaatagtttgttccacaatgtaaaagtcgactattctaaagaagcccttggcaacttattaaatcttataaatagttaaatatcgagaccgtagaaccttttgctatatatagtttttcgtcagaaaaaaaaagtcttcatgctagagaaaaaaaagtttaacttataaataccatgctataattaaaacaaaataacacgtactacaaatagtactagcttatattttctctcttttttaataattaattttctaaaaaaatacatatcttaagaaaatattattaaaattaattatgaatatattattttttgtgttttatatttttttataattaaaaatcaataatatttaattatttatcttgaaatttgatattcatcaataatatctaattaatattgcaaaaaaatctagaaatccatcttttaaaaacacttttttgtataaaaaaaaataaaaaaataaaaccctttttgtaaaaaattcaattaagaaaaaataaaaggagtatatgttttatcttctctttttactttaacaaaataccttgtttttttgttgttttcaagttatatattttgtaatcttgtcgcaggtctgagttgttttttgcactcagaaaagaaacttgtactaaaacctaggagaggaggagctggcaccaccgcctaactcgccattgacacaacaccaaaaactcttctttactttttgttattctacacacatcgataaagattaagaacataattaatagaattccataaataattagatgcactaacttttcaacatcaattcaacggtttaaattcgtgaaaaagcgtttttattttattttaatggttacaactttgtagtttttaccctaaatctctctctgattactgatactctgtctcaatctcttctttcttctaatcctttatttcttgtaagctacttctcctgaatttcgtatttgatccgtttaatccaagtttcgattttatataacaaccacatagacagagagagagagagagagaaacagagtaatggcgaacagagatgtggagagagtagggaagaaaaacagaggagctaataacaattatttctacgaggagtcttctggtgaaactcattggacttcatggctgattccggcgattgtagtggcaaatctcgctgtctttatcgctgttatg

SEQ ID NO: 27188 - DNA, 3003 bp, Unknown
  misc_feature (1)..( 3003): 2750-1469P.txt file - cDNA_ID_2730576; gDNA_ID_2684215; Annot_ID_137383
acatttggtctaattcctttgttatccatttcagtgaacagattgagtgcatcattcacgtttttgtagttgcaaagagcatcaatgatagtgttgtagatcacaacaccaggctctattttcccttgttccatcttctttaacaaactcaaagccaaatcaatatcacctctcttacataatccatttactacaataccataagtaaccagatctggttgacaacctttcacaaccatccggtcaactaaagccactgcttctgaagctctgttgtggcgaaaaagtccatgaattagagtgttgaatgtgaatgaatcgggctgatatcccatttccaccatctgaccaacaagagatacggcatctgaaatcctattcccgtgacagaaaccattgagcagagagttaagcgtgacaatatcgggctcatagccgagtttcatcatcttggcaagaacagctaaagcaagagagagctgagagcgtcggcagaaacagttgatgagaatactgtatgtgtaaagattatgtgaaattcccaaattttgcatctgctcgccgagagagatgacaagatcgaacttgttcatcttagcaatggcactcaacagtttactgaactcaacaatcgaagggaaaggacgagacttgaccatgtcaccgaacagattaaccgcatcatctagcttcaaatcatttagcctatttatcgatatttttctgtaatcatatctaacaccagagaaatctcgtacccagaaactgcaatggctaaaggaaggaggagcagttccacatttaccttttccgagaagactccgatgaacaaatctgtttcccgtcgatgaaatcgcaaacaatctcctcatcttcagctgattggggtttcttccaaaatcactgattcagaatcgtaaactctctgtaaacttgtataaaccctaaatgatgaaccttttgcagacagagagagtaaaggtttgaacttttggttctaccaaaccaaacagagagagagactcacataggctgagagagtgagagtgatattcatccagtttcgcaccaccgttggatcatttgaccggtcaagatttcatcttatcatttttatcaccggtttggtttataatcacataatgtatttttttttggtttagttctaaattgaaaggccagcattagcaaataaatatgaaaaaaacaaagaagattatcaagttttgctattttggttccatatttgtctaactatatttccttcatttttttttttattgctgagatgtccctttctaattaaggtgaaaccgcgtggaccttaccaatttatatcttggattgtaaagatctatatctgtttggttccacttgtatatgatacaatgatacaatacaagtttggtcattatcattttttctaatcatatgtcaacaaaaccaaagtatgcattcattttgcaaaatatacacatctatttgtatcacctcccaaacatttctcccattatacggacttggacaagtattcatacctctgcaaaagtcttattgataaatgaatgtgaaagtacatacaattggtttagaacattaaacacgagtttggtttggacacatggctttcatatactccttagtgataaattatggttaattataaccatctttgaagtttattctaatattttatttattaatttcattgatatggtttcaaacgtcaaggaatattaaaccttttacgaaaaaatttcgggtggatcatataatatcttcccttcaatcctcaaagttctcgaactctaccaatacctacaaggctacaaaaatttatacaccattgaaatatgctgcaacgaagtccatttaaggcctgatgataaattccttggagatcgacaataatatccaagcgattgttagtgagattatagagttagtctttgttggattcaatagtttgttccacaatgtaaaagtcgactattctaaagaagcccttggcaacttattaaatcttataaatagttaaatatcgagaccgtagaaccttttgctatatatagtttttcgtcagaaaaaaaaagtcttcatgctagagaaaaaaaagtttaacttataaataccatgctataattaaaacaaaataacacgtactacaaatagtactagcttatattttctctcttttttaataattaattttctaaaaaaatacatatcttaagaaaatattattaaaattaattatgaatatattattttttgtgttttatatttttttataattaaaaatcaataatatttaattatttatcttgaaatttgatattcatcaataatatctaattaatattgcaaaaaaatctagaaatccatcttttaaaaacacttttttgtataaaaaaaaataaaaaaataaaaccctttttgtaaaaaattcaattaagaaaaaataaaaggagtatatgttttatcttctctttttactttaacaaaataccttgtttttttgttgttttcaagttatatattttgtaatcttgtcgcaggtctgagttgttttttgcactcagaaaagaaacttgtactaaaacctaggagaggaggagctggcaccaccgcctaactcgccattgacacaacaccaaaaactcttctttactttttgttattctacacacatcgataaagattaagaacataattaatagaattccataaataattagatgcactaacttttcaacatcaattcaacggtttaaattcgtgaaaaagcgtttttattttattttaatggttacaactttgtagtttttaccctaaatctctctctgattactgatactctgtctcaatctcttctttcttctaatcctttatttcttgtaagctacttctcctgaatttcgtatttgatccgtttaatccaagtttcgattttatataacaaccacatagacagagagagagagagagagaaacagagtaatg

SEQ ID NO: 27189 - DNA, 3003 bp, Unknown
  misc_feature (1)..( 3003): 2750-1469P.txt file - cDNA_ID_2730600; gDNA_ID_2684215; Annot_ID_191644
atcaatttatgtaaatgtgatgaaagcacaaggcatatacaaaggttagttctcactgattcttgattgtagtcatcaagggccttcctagagagcctctcgagtaaatctcttgtggtttctggctcatcaacgaattcatgtgaatcgagataagcaagatggtaattgaatacacaacggaagtgtgtgaagtcgatatcaaaaccctgttgtttcacaaactctcaatttcacaaatttatttatagagctcattataaaccgaaaaaaaatcacaaggataaatacatcgcttgcaaggatttgtttgtcgagtaaggcaagttctttctctggtgagtacttaggctcatcttcctctttggtccaatccctatacgctggtctctcatagccaggatcctcaggtttccacagcaaaaacactggttcgagccatttgatccagcctgagacatatcattggaattgatcgggagagagtatatataataaaccctaacttttagggaaacgaatttcgaatcttaccttcaaattcactcatcgccttgtgcgtacgttgatgtcttgatgaacagaagatgagccctaacttcgggaactctataatgtcccttttattttactcaagtcccttttatttattgatctgtcttcctttgccctcgtattgtttgttttgtaagactaccccctcaaaaaaaaccggtactaaataagagctagtttttttttatgatgatgagtcaatccaacaattttcttaagtttttctatttgttattaatattattttactattctttttgccacacaattttaattccatatactactctttcttaaaaactaaacttatccaaattaaatatctcaaaattttaaataagaaagcttttataagaatattttagttatattaaatgtattatgtttttctattagaaaaaaaaatgaaacaataaaaatatgtagtatatgtatttcaacactaacaaatgacttcatataatattaagttttacattgaaaccacaaatcaataagcctaaacttagaatgacgtaaatgcaactttattttataatataaattaataagatatttaaaatttaatttaaaagtttatttatagacaaaaaaatggattttgggttttttatttatcttaaaattaattttaaaaacaatattaattagaaatcttcataattttgattggctacaaaacatattttttgtaaacactaaaactgctttaagaactacaaccattcaatgccaaaataaccaactgacgtggaagattctcatagcaactccattgcacaaataagttgagtgtcttcctacacttaaaatcttttatatttaattattaatattttataaatttaatattttaatattgttaaagacatcttctttctattgtgcaatgaagttgctctcaggaccttaagttaacgtctccgattccaccatctcaaaatggatattgtggtaatactctagtagaagcctctatttcgtcctatacggctatatctgtagctataagatagcaacattggacgaattcgggtccttaattaacttcaacattcattttgagacggcgatggtggaatcttctcataagctatatcatttcagacatttctaagcttggtttaattattaccttttcacaatgcttactttcactctttttcttagccaacaaataaactatcttgtcttttcctgtaaaatatgttttcacttttttttacttgccagttttcaataacgatgatatttgtttgtctatattattgaagttaattttttaatttttttttaagagatgtagtactttttgaaaactcgcatttgtttacatatacaagttattgtaatggtatagtgagtattataatgggtctttcgatcttggtcattctgtttatgaagcttttcacaatcttaaaaagggaaattcggattgagctagacgaattgacgtggaggagaagtcgaaagcttctgaaatgataaaaagggtttgaataatggtgattaataaattataagtagagaaagagaagaaaaaaaaactaagcctttttacacgcctgtgacttgggttataagcaatcaacatttcgtttatctcaagccaatgggaatatcattattgctacatccgtccaatttgtggtttggtctttgttgcttgacctcctactcgatcgtctttaaataaatgagcaataaaagcttttatctcctaaaaaagtttgtcattttatttccacatatcaagttatgtttcctgtacatctggacacatttacaaaaacaccaaaaaaactataatattaaaaaaaattaaaaatgtatatataatattttctaaatgatcaaattttaaaaaataccaaaaaaatccattaaatccttgttgactattattgtaactttacaaatgacaactcaacacctcataatatttggttttagactctttaaatccttgttgtcaaaaaaaactatctaaatccttaattatctattaaaaaattaggaaactaaatcgaattacacactaagaaaaaacaataaacaaactttaaatatcccacttttccctctaatccttgtggatttggtcataactcgttatccataaacccaaaaatagcaaatgagtcatctctcttttgttccaacaagatcttttttatttggtcaaaaaggtgtataaagtttgttataacaagttagttatataaaccctcacgaattcaagaaaccaatcaaaagcaaaaaagctttctctttctctacctttttccttaatttcacttttgcggcgtcgttcttatctactcacaagaaagcaaccgatcaaataactcccagaataaagaaagactcaaactttattctctctctctttcttaaatagtgaagaaagcttcgattttgggaagtgggtttgttcgaaaaatg

SEQ ID NO: 27190 - DNA, 3003 bp, Unknown; identical to SEQ ID NO: 27189
  misc_feature (1)..( 3003): 2750-1469P.txt file - cDNA_ID_2730600; gDNA_ID_2684215; Annot_ID_137377

SEQ ID NO: 27191 - DNA, 3003 bp, Unknown
  misc_feature (1)..( 3003): 2750-1469P.txt file - cDNA_ID_2730608; gDNA_ID_2684216; Annot_ID_191691
gatattttcattcattaatttaaattgaaataatttaaaaaactatattaaagttataaaataggatgcagatgaaattaatcttattactattatgcttctatagaaacattaaagtagaagaagatctgcacaagttggtggagaagtccatatatacttggacgatagtatgggccttttaaaagcccaacagttagaacccaaaaaataagagattgatataaccgtaaataaacaatacgacgatatttaagtctccctcttggctaaaatatgttgacttggtggtaaatgatccacatacgcgtaatatattctggttatgaaaatctttagtgaaccggattaaacccggaattaagttgtgtgtttaaaacgtttaattatctataaaatagaaaagggacaccaatactcacccagcaaagtggtagtgactcagcatgatgctggagtcgcaccagggttcgagtaacgaaattggtaccccgagtgagaaggaaaaattgtttcctctcgacttccatcgagtgatgatggttggcttccactgagtgtcaatggaagatgaatgacaaaggagtttattgtgactccgtcatgaccagactgcagtctggtgtccgggtcttccctgaagtgaagattcggggtcgggaatgtttatcacagagaatcatgcctctggtgatagccgaaatgaggtaatccaaattacctctttttttataaaagacagagaatcaacttctgttactacaaacgaggaacagagcatcaccttaattatctgcaaattaaaagacattgacttgttctttgaatagtgtgtttggctgattcattcaaacttcccatcatactactactaaaccgactctgaccagtgcaaaaaataccagctttccaccaaaattcactatttcgtttcatattattctgatttctgaatatatgcaactataatatattatgaggttttttcattcatttatctttatgtagaattatcttcttcttcttttttttgactctatgtagaattatcttaatgtagcttttatctataagtgttgaaattttattctgttcaaaataatcgttgaggcaaatcgtccgtactatatttagattggacccattctcttataatatttgtttagtttattgctcaaatctaataagattttattgtggagataacataacaaaatgttagtagattttctttagtatgtttaatgtaacttgtaacgacataaaaaaaaaaaaaaaattgtaacgacacgtatatataaaatgaaggacaaaatggttttaacttcatatcgcttacgtccaccttttgcatattttcttataaccgtttggatttgttttgaaattaattattcttagagattgtgtgattaacgataagattttgtgccaagtttcatgatttttttgtaagaaaatgaaaaggaatctagaaacaaaaaggaatgtcattttcccagaaaaaagcactaacaatttataaattaaatatattttctatctgatgtttgattcttttgtcctcgtacaagaatggagtatatattttaattggaacctgattttctttatcattttcaataatttaaaaatcgaacactatttaaaaacacagtatgattgtattaatgtttactgcataaccatacaatataatcttcaaaagtaattatattcttgcaataatgttgtcaggtatgagttgttttattttattctaaatgatttgagttgtatgttttggagcatgttacacgacataagggaccattacatggatatagagtgctaccaatgaaatatagccacgtcatcactaacagctgcgattatgatggtgggaccatagatatctgactttgacggctaagattgagtggagaaattagagtccatgtgagattgggtggactacaaagcaggagagagtttgatggacgtcgttacttgcagctaccggacgcaacaaaccggacttgatgcttaccatctcttgtttctcttactctcttcaattgttttgtcttttctttacaactatttcgagaagaaaaaagttctcacatttcattattgctacataatttattattttctacaaattatgaggataagtataaatttcatttatcaaaaacaaaaaagtatgaatttaaaaaatctaacagtataagaatttatcagttatagtttggattttcgtacctaagagttttacacctaaaatccatcagaatttatttcaaatccttcaaacttcagcacattaatatatatcactactttaaattttgttataaaatatcactagaaaaatatataatctgatgtcaatatatataatacaaaaatatggtatatttaactgctttttaatgtatttaattaattttgttgccaccaactaatcatgtttcttcaatgcattgcgattattattcaaaaaacattataatagggaagaaatatataaataagaaactccgtgtattggacgcggatacatagatagaaatacattaaaattttaggaatgaataatatattattataattatggttgaaaattgaaagtgaagaataaaagaaataaatacgtacacacatctttttctctgtctttaagagttaacgaaaacaccattagatttaagtcacatgtggctcttttgcatgttctgtcataaacacgtccatttcattcatcctcttcttcttcttctccttctatcctctgttttttgccctctctctttgtttagtggctgtggtcgtttgtatttggtgaaacataatttaaaaacaagtgcggctatctttaactctggccgacacatcggcggattcgactgtggtcggatcaagaagtgcttcctttttttccggcgtcgtttcttcttttatattcatcgatttggtgctctcgcaacttccaatagattacggctaatttctaaaatg

SEQ ID NO: 27192 - DNA, 3003 bp, Unknown; identical to SEQ ID NO: 27191
  misc_feature (1)..( 3003): 2750-1469P.txt file - cDNA_ID_2730608; gDNA_ID_2684216; Annot_ID_137410

SEQ ID NO: 27193 - DNA, 3003 bp, Unknown
  misc_feature (1)..( 3003): 2750-1469P.txt file - cDNA_ID_2730626; gDNA_ID_2684216; Annot_ID_191685
ttatctaatttatcaaaccatttttttgttatcataatggtatctaattcaattactccatatgaaccggtagagacaataactcccctggagattttccttcatgtatatatatagtgatgatcatcacgttactctttaagtctatctgctcatttcctcacacgatcaaaaagatagttcaaatttttctttaaagcttaagaaaccactcagtggaaaccaagactaattaaggctaatggtttctcgacaagaaggaaccctctactctagaaagagggatttcacagtctgtggagaagagtttcacaattcattcaagaagagcaaacaagaagatcaatcacagagcactctgttcaatgaacgaccaaaatcggagagtatgagatcaattacctttgattttgaacttcatctccacactcctctaccatcagattggcaaactaaggtatctatattcatatatgaattgaagtatcttatatttgtatcaatatgaagataaatatgcgttatgatatgtgcataaacatgcatctaaaacaacgatacttatattttcagggatattcaagaacatctgatgagcatagggcatatcccaaagatccagtgatttttggacaacctaagatgagcctagaccttgagctgaacctttcaccttcaggttcaccttcacgaaccacaacgaagaaatatgaatcctcctcaattcacaatgaaacagtatcatcatcaaagattaaagttttgacgaacacaagtaagaagagcataattgggacaggactaagtcgatcaccatcctggctagcgtttgaaggtggtgatgataacgatgttgatcacaaggggcaagagatggtaacaacagtttgcatgaaatgccacatgctggttatgttgtgtacatcaactcctgtttgtcccaactgcaagttcatgcacccacacgatcacagctctacaaaactgtttaaaccatcaaatttgcttaggcttctatgctaggctctttcaaggttactgaatctataaaatttgtacggcagataataagccaagagactagatatggacaaagttatgtatatactaaaagtaccagaaagtttgtattaattctctgcttctatgaacgatcatgctttagatctctaaacatatcagtattttgcattgaattgtacttggggaataacacgtacacacggaataatatcaactagtattgcactaaaacatatatggatactgactaaatagctttattcaaggtaagatataccagagtttgagttccgagtgtagtcactatcaataatagaaccagaggtaaaatggtttaacttgaatctaccaatggttcagtagcaagcgacgatgcttgtgttatttgtactattgacattaaataaattaactaaccccaaaacactttggagggaaaatctcgaaaatagaagtgggacattttcattttccgggtagagtcaactaatcatatattgacacctgtcacattgaacccttcattgagaatctggcgtagaagttttgaaactcaaaaaatcaaaaacagaaagaagcagagagacgatggcgagcaaagacgaattttcccgagatctcactgcgattcgctgcgccagagctacgatgcttctctattcacttgcatcatctcgcacaatcgattccgccggcgaggttagttcgatcccttcttcttccgattggaatcgattttgctacaatcgactcttaaattacgaaattgccatgcgaaatctcatctctggtgttttgtttagaagcaggagaaaggagaaacgcgaagagagatagaggatctgaggagaaagcttaccatggtgaagataaagatgaatcggattaagctttgcggattgatggaactgcttcttctcgtctttttggtactgttgctttccactttcttccttgtcttcttccttggatctacttgatccttcccttggaatcatcagcttatgcaacattatggttattagagtaaggaaactattttagaagtcgagatttgtgcagtagaagaatcggataactgtagaagtcagtcattagttttaaaacttaacgtttgcatcttctaatgaatgaatcttgttataaacacttaactatttgaactctggagatttagtagttcttcttgcaatcatcttcttatatgcttttaactgaatacattatgctctttcctgaatgtgaaacttgttttagtacatcatcttgcttggctttgacctctagatatataattcttgctccagtcatcttcttgaatgctttcaattgaaaacatgagtgctcgttcctgaatgttgttagcagagacttactggttgagctctgaagatcttgttcttcttgcaatcatcatctcgaatgctttcaactgaacatcatgctcgtttctgagtgttattttttcaaagtcagagcagcctgaatctgagcttttctcagttcctcatcatgcttggctttgacctctggagatctaattcttattgcaacaatcttcttgtaacatcatgctcattcctgactgttgttatcagaggcctcatattcctaggcttcatattctgagcttggcttcagtttctcattgtgattggctttgtgctacaaagaaaacgccaaagaaaagggactttgattcagatatctcatatctgcatcttctgctgctaaacctataattaagaggggttaaaatcttagaaaactccatctaacatatagttcctcagcattatatccttttcagaatcaataatttcatgctttccttacctttacttttggagccacagaatttaaagtataaaaagcccaaaaacggttccaccggtccaaccactcaattttggccgattcccacaaattagcttttctctacaaattcaaatcaattttgctcctttcattatccaaatg

SEQ ID NO: 27194 - DNA, 3003 bp, Unknown; identical to SEQ ID NO: 27193
  misc_feature (1)..( 3003): 2750-1469P.txt file - cDNA_ID_2730626; gDNA_ID_2684216; Annot_ID_137405

SEQ ID NO: 27195 - DNA, 3000 bp, Unknown
  misc_feature (1)..( 3000): 2750-1469P.txt file - cDNA_ID_2730642; gDNA_ID_2684216; Annot_ID_137401
tttagacctaaatcatcttcctttttcatagtggcaaatgcatcaaactcttctctaaatttcccaacaaactccttttttcttctcttctctcaacgatatagcttacgtagtcgcaaaatcaattgaagtttacttctcatctaagtgtgagcgtttgctatagtgtacatcaatacatgcttactgcacattgcaatatcaatactaagacatactcataacttttgtggtacaaactgctgaaacaagtttggttttccggtttcagaagacccggaaaagaaaaacaataacttctgaaacaagcaacatcctctgtcccgtagtaatgcttataatctcccaacagtttaagctcgaacttacattagaaagccctaacggcttaaaaaccaactcaataaaaataacaaccacgaaaccgcaaaatacaaatcacactttgagctgaagtgtatgggaaaccacaagaacacacaccgaacaaccgcggtttataaaagagttaagttgttaccgaaaaagatgattttaaacaagtgcgatgcttgtctctccacctggtggtttacggacaccgcctaaatagtctcttgcttctactttcccatctgcaaatatgttgtttcctcctatctcctttagcttcgcttgactcagatgcttttcaacattagatgacgccgcatctcccttgaatatgtcgtttcctgaaagttctgcgaatttcttgtcataaatcttctttgctgtcttcacagatgagtcttcttcagcagtctgcagaatagcgtttctctgattagactatatataacaatgattgctaagagatatcaagaaacacattggaaaagtcttacttgagattcagctccgaggttgaaattgtccttaagagccaatgcacgattagttccagatcgaggtttgatctcaggcggtggtgcaaagatgttctgtccactgatctctttgtatttagcatcagagagctgcttctgtagcttattagctgattcattctccatagtcccactgagctctcgctgtttcgccacttcaggtacagtagccggctttttaggagatagattttcctcttcaccaaatgatatctggcttataccattaactgcttgctgaaagataatcaagagtttcagtaatatgactaataacataacggaacaagtctcactctctacacaaactggtacctgataaactggtaatggctctgacgcatcatctttttcgttacgagaaaagatcccactgccagttatctccttcattttatgttctgagcaaggcttcctaatgacatcataaacattttcacaagttttgacattagtataaataaccaatctcatgaagctgtcaaatgcatcatcaagaatccttaaatacaagtcacacttgaagattactctctatgatctaacttttgatggcataaacagagtatgaattcaattcacaaaaagttttcaactttcagatatatggacaaaattggaaactaattttcaaagaaatcgaattggaaatgaaatagtgataaggaagtaagtttaacctgcggttcaagctctcaacttcttcatcggtgacttgaccaccaaacaccactttgctaatcccatccgatggctacaaacacattaaaccaaaattgaaacaaatactattaccagattgatcaaaatcaaagtgaaatttcatgaatttcgaaacggtgcaagtacctggtgggaacgaacggcggagcgagaagcggaggaaggagaatccggcggtggaacttccgaccaagtaagtagatctgcggtcgatgtgtgtggctttctcaccggagtacttctctccatactctctcactcactagtcactagcaagcaaacaaatcgaagagaatgagaaaaatacagagaggaagaagaagaagaagattagtctctctcttttcagcttcttcttcccacttggtttaagattaatcgattgtgttaattgactctattaccctttactttgttcgtaaatctcattttgatctggaagcttcttctctacgctgccacgtgtgatttaacaagtggtcatgatcattaaattcaaaatcagattttctaatcagaaaattgttgtgattagtagtataatttgttggcgtttaacgggaatattcgaatacttttcttcttgtaaggaattgggattaatattttagaatgtaaaaaaagttgttattagggaaaaaataataattgaagcgcattagatagaattatggtcaatcatattcttctctttttttttctgacacaagaccatgtgaagccatcaaaactaataaagacttttaccaacgttttatttaagcagtgtgatcacgtgatgccaaccttttattagccatttagcatacaacatgtaatttgattaaaagtgtaattatttcaaaagccgtgattttatcctctcaattaggccttcataactaaacttaattattttccgcaatctttaatcctgattcttcgtaacgaaaactaaattagtaaattcaaattgtcacggagatatgcagttttttacacggatccttaaaagaacatgcgtccaaataaattgtggttagacaggaatatacacagtaatttgattaattagttaatctagattaaaaaacatgtaatctactaagcccaaaacgtttaattcgaagctttatgttgttgttgacaagaaaatgaagaaaccactaggcccaaaacctagacccaaaccaattatattgaacaatgtttgggcctttatttgaggatccatcaaagaccataataaaggcttctctttcacaaattccaaaattgttaagttttaccattttaaaacttgtttccacgcattttgtgtgatttctttctttgcctttaataaagcttcgtgctcaataggctgccacggaggcgagcctgaaaaatg

SEQ ID NO: 27196 - DNA, 3003 bp, Unknown
  misc_feature (1)..( 3003): 2750-1469P.txt file - cDNA_ID_2730660; gDNA_ID_2684216; Annot_ID_191673
taggcattttaccaaattccttttttttttttcgtttggaccacagagaatcagtctagtagtccattatttacaaacaatcgtgggagctagggactcatctgaggtgaaaacgtttcactactaatctaatgaaactattgtcctttttcgaattgttgtcctccgtatgtaatatattttcttttatctttatggaatgttgctataatagttattattaagtgcttaacggaaaacatagagtgaaaaaaaaaatagtaagttaagagatatagatagcagtaaaagaagaatgtgtatgtataaaacagagcaatactgaatacaaaaatagaattagggagttctagaagagaaaggcccaccgtgcatggatggaccatggccatgccaacaaattttattaaaaaacaaaattcttccttaataagaaagttattcaaggtctctttgtggaatggggacccttaatcaaaatgttaaatctcctaaataaataaattaacttacatttcatagtaattatgttttaaaacaaatggcttagcagtcttcttacatgcatcgtttctgaaaggtattattttcttaccaccattttttattaaaaatattttatgaaatataagcttgggatctaaattctgatgcatctaaataatcatctatatgaaaattgcatcgtgccggagaataaaatttggtatatggaactatttataatgaacttttgggttatggtgattagttcatgaacccaacaatgcctaatttaattagcttttctctaaccgccgccaaatataaagatacttctaaataattaagcaaacaataaattaaccacaaccacacattgtcttaattaacagcacgaaaatgattagaaacttccactcatgtgtttatgactgtgtttatatttgtacaaattagtaaaatacaatgaatatgagctaatgcagcttaatttaagaaatttaaaataataaataccaaagtggttgtccccgtcggaacaagaaatctaaagggtttctaatttcgtgccctttgtggactctcaagtaacgaaagtcaagaatgttgacccatctggtctgtgtttagttatgaaatcatattcaaataccaattagacttaatttatttagacaagttaagaaaaaaagcaggacaactaaccgtcgtgaatagtagtattaattaattcgaaattaaactacagatataaataaagagtgaagccgtacgtataatacgcccaagtgcatgcaatgaaaagaaacaacgaaaaagaaaagtgatacacgtaggatttgcgtacgaattttatcattacaaaactaaagagagtttatagctactagtttcgactgaaataccacaaactgttagatagatttaggtgcaatcgtttttgctcctgtgggcgtttcgctctgtttctttgtattttcctattaaagtgcccaaaacaagaattgatacgtcctctaatttggtaaaccaatggatctctgtgctatggctatagctaatgcatgtgatcgttagaccgacaaacgatatttataactcaattcttcataggcccatagtcatatccttagccacagtattcgaactacagaaatttctctaccccatctctattgaaataacacatatatacagataacacgtttataactgcataagtgtatttcaaatgcagatactcttttaagaggacaaatatataaagaatatatattggagtgggcaccgagcggttaaaatctaaaatataagtttctgaatatgcctgctatgtatttcggtgaaattttaccttttcttgattcctaatcttacgaataggaaccgaatatatatcattttccgagatcatgtagagatatgatttttgatcaaattccttaatatattaatacgttgatgtgtatcctaagaatgtcgaataatcctcaaatctcaaggttaagtgattagaaaatattaaaaacattccacgccgtaacacttggtaaattcaataaatatacaaatcatattaagacgaccaatccaacagttttttttttttttttttttttttttttgttgttgttgtaaaactaccattccaacaaattcattttaacataagcctgcctaacctttgagctttgatctactcccttttttttggtgtctaacctttgatacagccgtaacattaattagctgactatttaagctaaatcaatacactgtctatttttagtttaaaacgacacttaaataacactaatttaaaagcaaataaccattcttaacatagcttggatgattaaaaaaacaatctgattcttaaataaaaaggatcttatttcgtgtgattaccaaaaaacaaagtcttctttcttgtgccatcaaaagctacgctcgtatctcatgctacttaattaaaaatatagaccaattatgaaaagattaaacgcattattataaaatcagatagtgcggttcataatctttcaacatggatgaaattaattttactttttccgctaaggttcgagtttaacacatgtctgtctactccaacgaactttttttttttttttttttttctgtatatatggttttaaccgattgactccttataacatttttttttccgatgttctaaatttccattattgtactctatacatttcatttacattgagacatcagacacgtagaaaaaacatgcttaaaaacctaaataactaattttccaaggatccaatggagagtgaaaataaaaagagagaaagagaggcataatgtggccaaaaaggtacagagggagccaccaatgatagatgaagttttttcctatttcttttgtcttctcttccttcttcttataaattcctctactcctccttcaccatttcctcctcctcaccttctctctctcaacatctctctctttctctgtcttctctctgtctcaacgagaatatg

SEQ ID NO: 27197 - DNA, 3003 bp, Unknown; identical to SEQ ID NO: 27196
  misc_feature (1)..( 3003): 2750-1469P.txt file - cDNA_ID_2730660; gDNA_ID_2684216; Annot_ID_137395

SEQ ID NO: 27198 - DNA, 3003 bp, Unknown
  misc_feature (1)..( 3003): 2750-1469P.txt file - cDNA_ID_2730664; gDNA_ID_2684220; Annot_ID_191830
tgctctagaaacttacttatgtcttactgtcttcttttgttaacacaatcacaaaagcaggaaacaatccacgggtccatggctattattcgtgtgtgagaatggctatggaaagcgtgttcctctgagtagcttccggcgttcgcgtctgaacagagttggtttatctggatacaaggtaggatctggattttcaccatttttggttgtgtttgtgttgatttttcccttacatctaaatctcaatttgtcagtttgctgaggatgatcgtttggctgctgttttcgttgttggttactccttggctggtaagtatacactgccacaaatacggatttaaatgttctttgattgctgtttatatataatctcaccattgggttttcttgcagaggatggggagagtgatgagcaagtagttctggtgagccaaagcggaactgtgaaccggatcaaagtcagggatatctcaatccaatctcgcagagcacggtactcccttcatgtgacagtcttttcaaatgtatattttatatggtttctcatttgattgttaatttctcaggggagtgattcttatgcggctagatcatgccggcaaaatccaatctgcatctctgatctctgcagcagatgaagaagaaacagaaggaactctaagtaatgaagccgtagaagccgttagcctgtaaattttacaatcccaattccaccagtttttgagacaattgtcaagttcagtacatagagtctatgtgctaactctcttcattttgtttttttgtgatgttactacgagaagagaaaaccatgatcgaagttagttattaacattaatctgcttcacattttgttgggtttaactatatacatatgttaagaaagttgaaaccaattattctggttataaccaaaacagtagtgctcttctcacttttgttttgttgttaaccacaaatcaggagaaatattttactagtggtacaaagacgtaagcaccaaaccccataatcacaagagcagctacaccaacattcaccaaaggtatgtcatatgtccgactctcttcttcacccattcctcttcctcctactgcaagaggaggatccatgtcgctcttcttctgtccttctttgactagtaatggaccggtttctggttccacgacttcagcattatcctttagatcgcctctatctttggctaaaccagcttcgtctatcttcttctgctccactctgtcttgaatctctccttcactaaccatgtctccaaccatctcattattctcatcctgcttgtttctcacgccatcatcaacatccagtttgattctttcatctccctctttcgtttttagcttaggctctgcttggtttctctgagcaacattcttctctattcttcttgcctcatcaccaacaactggttttgtaaatttatcttctttctttggtcccaagttaatccttcctccctccagcttctgacctatttcaccatcttcctttttctcaacaactttggcatgttccttggattccactctagcatctatggtcggcgttctgctaatctctttttccttcaccttctgtccagtcttaagctgacttatatcatcatctttctttctctcaattactttctcttcttttgcctgtaccttaggttttaagctaccaccaagggttggtgtacttttagcctcttcctccttcaatttatctcctatcttttgctgaactatgtgagcagcctcctttctctcaaccaccttctcttctttcgcacgttctcttccccctaagctagggattgcctctcgcgctttaactttcgcttcagacttctcttgactgcccgttggcactgctcttttaccctcaaccactgatttatacgttttgggtgcttcttcattcaacgttggagtggttttctcttgacttgttcccacttgtttctcctcctccaaagctttctttcgtcccaaggtactcccattaggaccaggccctccacttttctcctgattagacctctgtccaatcttctcctgatcttggactgctttctcctgtttgttagcttccacgattgctggaaactcgatggtcaagagtccatgtgagaaggaggtgctcaatttggtcatgtcacaggtatcagggacacggtaagcttcactgaaacgagccttagtctgagcagagagcggtcgctggccttgaatctggacagtccttgtcctctcatccttttttatttctatttgatccctataaaaccctgccggttccacacaataaacgagaaattcataaagtttgttatcaattaaagtttgatctcaagaaacaaaaagaaagaaagagagaagaaaaaagaccaggaagattaacgtagaggaaaatggaagatccggagttagtccattgagctctcggcttgaaactactcactgtcggagccagcggtggcggatgacggccacctcccggccttggtctcttgaaaatcgccgccatatatgtttatatatagatcacactatatcaggacaaaaagttcaaagcctttacgaaataaatgaatcaaactgtatatgaaaacataaaaaatgtttgaatgatgtatataagatagaaagagaggtaagaagagattttgagattacggtatgggtttaggattgctttagggtatggactttgtctgtttcttcatcccaaggtctcatatgtgtaaatagtttcttgtacttcaaggaaagaagcttttaaggttttgaagaatatgcgtatcaacacaaagtgatgtcgttttatttgttatttccattttttttttgtttccattttaattaagctagtagccgatatatatattacgtggcattcaacatgtgaaattaaaagaatccctggacctaactaaccacatcacttcaccggataaaacctccaccgtcttcttccgccgcaatttctgtctccatg

SEQ ID NO: 27199 - DNA, 3003 bp, Unknown; identical to SEQ ID NO: 27198
  misc_feature (1)..( 3003): 2750-1469P.txt file - cDNA_ID_2730664; gDNA_ID_2684220; Annot_ID_137443

SEQ ID NO: 27200 - DNA, 3003 bp, Unknown
  misc_feature (1)..( 3003): 2750-1469P.txt file - cDNA_ID_2730671; gDNA_ID_2684220; Annot_ID_137440
tacgtccttgagccgtgattgtgttttgttgtcctttcattggtcggcgagggagaatccggcagctttggagaactgaagctgagttaccaaagatgaaatctactgttccgataatggtgcattcacggtagaattggcgttgtgcatgaacgtaaagcgtgtcttggtatgcgttcatcgtgcaacggtaaaatgctgtgagatctgcgcttaccattagagcaacagcttgatgtttggatggaccagctgtgttgatgaagcccatgtctcttgccataaacccttttccaaacacagctgcagaaaacagagcatgtcaaaaaccgatttcttgggttataagtaatgatattatgttcggttttctagttgatattatttcagaataacgttaccaatcataattctaaacattatatctttgatttatgagattatttagtctactttgatattattaggccataattaaattaatgaaacaaccaagtcgtgctatttcgaaatcctctgtttccaaaagtaaacaagaagaaaaacaaaaacagagagaggtttaccgaatgtggcggtcttaaaagtgggagttccatcgatgacattaagtctaccagagacaatactcttgctctcgccatctccaaccacaataacattccacatcttcttctccaccttcacattctcaaaataaactcctttcttcacatatataatcgtcctcttctcactcttctctggcacatcttgtaaagccctctttatcgttctatacttccctgaaccatccttcgccaccacaatatccgccactttcctcaaatccgtgctctgcaacaatctccgacccgcgtggaagtccacctccacgtctgcagttgttaacaaacgcctccggagtttgaaagagtcagcgatcttcccgagccatgtgatgatcgctagtgcgttactcgtcaactccgttgagttcttgagatgactttcgccgaacggcctcatatctggagccaacgtttccacgcacgtccgttgatacgtcccggctgaactcagccatgtacggagatcatcgactagctcaggaaccgtgacatcaccgtttgatgatgaggttaacgtgttgttgaggttatctatcgttaggtcaagaagctcagcgcaagcgttcatggtgatgttgttcttttcatcgcctaaggatgaagagaaagcgttgatagcttttgaaacttcggcgattgtgattttgactgcgtatctgaagagctcttctggattgagactgcttgcgtttggagctgatccgagggtttcgaagcatttttctttatgcaacgtaacgtcgcaaacggctttaacggaaacggagattgagtctccgttgttattagtctccactgtctctggtgacttcttgtgagccatggttccaaacacagctccgatcacgattccggcaagaatgactagtgatacagcgatgattgcgatgttctttctcgtcttacgacgagcttcgagccttacatgttcacgctcgtcgactttgccgtaaggagaggacatatttgtatcctccgtccctcttttctaatttttctttgtattcttttgaagtttctcgttagttatgtttggtttgtagatgttggagttggagggtccatataaagacgaaggaaaaatataatcatttgaatagacctctaacaacttacgtgcgaggcacaaagggggattataaatcttcacattaaaataccaaggatgtatttaactacaagtgctcctcatgttttagtcttttatgttaatataagcttgtcggtgaaacatatttgtttaagattgggcactatgttttctgttggatttcagcttcggcatgtttcttggtttaacgaatttattttttcaaggagttctatctctagtttacaaagtttggaagtatatattcaacttgatgttatgtttatgatttgtggttcaattcattctcggtttcttcttttaatatgattatattttgaaaaaaagaagaagaagatctttctatttatatgtttatttaatagaatctcttgaaatcctaatcagacattacaatattcatagggattataatgtcaactttggatagttagttaagtttgatataataaagctgtcaaagaatatttttactaaaaaaatttgagagcaattcatttgtttttcatctgacattgtcggcggatgtattctcctgcttccgtgagagagttttcaaaccttgttttgaccaattacatatactgatgatatacattgtacaacttcttgacccttttatttgaataatcttgacgctaagtcagaacatataaaattaaatcaagaaaaactcaaactgtaagtagaaggtcatctgatcaagaaagctcgcaaagaggtaatctggcgttggagaagagcttgcgttgtaagatcttatatatctgatgggttatatcttatatgagatcaagtcttgggtaaaaatgtaccaaggatcattgtacgtataaattgacattgatagcgagtatgagtatgagagatacctatatcacttaaagtgaacgaaattcatatggataacaaatgagatgagatcaatgttatctcgtctctttctatttgaaaatagttcaattagtataagcagacatattttttttgatttgaatcaatatatactactgtttttactaaactcaaccagtcatggaatagaaaagatggtgaaaataatcaaggcttttaactgaagggaaattaaaggtttaccaaacactaaccaaaaggatagaattagacgtgttaccaagcagcaccttatttggtcatcttcctcattcgaaggttactcgcacttcctctgcacacttcttcctctccatctaacctcagtactcctacaatcctctaagaatccatagatcaactgctgggaaaagcttcgcgacaatg

SEQ ID NO: 27201 - DNA, 3003 bp, Unknown
  misc_feature (1)..( 3003): 2750-1469P.txt file - cDNA_ID_2730683; gDNA_ID_2684220; Annot_ID_191821
ccacagagggaaacgatggccttttcaaggcatggcatattctggatggagaaattgcctcctaaagagtcaatgatgctaaggtaatttaatcccggggaatctataaccaatgacctaccagaaccatttttttcaagtgattgcgaatcaatgaaccttgtcacattgtcactcttatttcggatcaccaacaaatatctgagaacagggcaactcaataaaagcctaacatgagaatcttggtctttatacaccacattgacaaggagcagcgattgaagggacgggaggcaagccgcggaaggaacatcaacaagaatcttgcccataagattcaatttcacaagcgttttgctggtgtaaagcctcttactggcaggatctgagagaaaactaagacttagggttagctctctaacgtaccggtcaactgcattcgagacccactttccgacatctacatcaacaggacattgtggaccaagcatgatacgcaagctttctactgaaggtgccttgtgtagttgcaatgacttttctagcaagtcccaaatactctttccgccttcgttgctttctgtgtactcgagtttaggcaacatcgtccagagaaaacgccatcgtttcgacaaaatcatggtggtcaccgcatcttttgttgggattagacacagtatatgcaacagaaatcgtcaggcaaggcactgatcctgtcagacagctcgtttaaattttttccgatagatctccgcttctgatgacatcctttaagatcttgttcgtcagaataagaaagccctagtttgattacgtagatagaggcgagttaacattcttccgtagcaagataagttagtattgggctaggccttttaaaacaagttgaaactcgaatatgtttagaaaaaggaattgtgtcattgtacattgggctttttaaacaagttgggcttaagtccatgtttggtcaacactctatttcgggtattgtctctgtcttcctttagcggcggctttactttagattcttctagggtttctagattgtataccctagataagcatcctataaagtaaacacaagtacttgcagagactttagattagagggctagcgactgcagaagaagagtaacacgtcatctctgtgcttctttgtctacaattttggaaaaagtgatgacgccattgctctttcccaaatgtagacaaagcaataccgtgatgatgtcgtggagattttgttgagatgctacgagcgtgtaaatgtttcatgtttgttgtttgattttactgactgctgatttctttttttcttggatctcgctcaaaactagatcctcactacagagcataactgttgatttttcttattccagatcttgctctgaacaagggcatctaaagtcacagatgcgtgtgattattgttctagacttgcagacttccttcttttttttttttttgcaaatccagatttgttttctgaatggtgaattcgtggtccagtaaggttttgatacctttcaaagagataaacttaacagaacaaaattttgttaaatatcgtatcaattcgaaagaacaaaaatatggtattgaagaacgaacataaatagctaatttctcgtggttaacttcgaaggaaattggacgtgattatttctcataggacaacatgttcttgacactgtttaatgtgcaaacacaacaataggttagaagccctggtgtcgaactaactagtgtttctacatctccatggattttattattttaagctgagattatgtagaaaacctttgagatagaagtttagatgtagatgtaccaaacacaatcattatagcatgtttattagtatctctcaaatgagagaatgagacattatggttatcctaacccacttaggcatttaaccacacatgtatataaaaaaattcctaaccaaattaagatccggagattagtgtggattcaatccgagatcttctgcttaaaaaaacaaaccaaacaaaaaacagttcctccgattccgttgaagacatgcaaccaaatgatttggtatggtaggtgtatgaaaaaattattatccttatccaaatttcagcaaagaattaataatagcattatccaaagtggagaaacatctttatccaaaaaagaaaaagagaaaataagcgatagatgaacaggtggaacgaggttcgttcagtagtcgtcgcttctaatcaacttccacttcttccacggaaacaagcaattcgatcaaacgtgaaagcaatatttaagatttttgtctcatactctaagcaagcaatatccaaataaacattcttatacctccactcctcctctgtctgattccttcacccaattcttgtctcgtttccatcaatccattgtctttgattccagaggtttgtttctatttcttgttgattccaattcgggtttcttcattgtgcattctcttgtttatgtcatgattcttattctttgcttatcaaagctctatactttatgaccatgatttgagagattctctgaaaagatcacacctttgcctctgaatttgagaaattttagtttctctgtatctgtctggtttagttcttgaagccatttgtgatttaatgtctgaaggttttgactttatgagttgagattgaagccactcttgatttgcaacaagatttgtcattttctatcatagccttattttatagctttggcatcatatcttaaattgagaaagactctgccttgttgcagttccaatgaggacaagaaaaacagtaatgggtcctatatattctcatgtgtttgtcttccttttggtctagacaaactgataagtttctttttgtagctggtactttcttttgaggcttttttaaaaattatccaacggcttgaactgaattggattcaatgtttctacaaatgtctcttatatgtaggttcttggtttatttggatgtggtgattatggatatg

SEQ ID NO: 27202 - DNA, 3003 bp, Unknown
  misc_feature (1)..( 3003): 2750-1469P.txt file - cDNA_ID_2730683; gDNA_ID_2684220; Annot_ID_137436
taaaaaccacagagggaaacgatggccttttcaaggcatggcatattctggatggagaaattgcctcctaaagagtcaatgatgctaaggtaatttaatcccggggaatctataaccaatgacctaccagaaccatttttttcaagtgattgcgaatcaatgaaccttgtcacattgtcactcttatttcggatcaccaacaaatatctgagaacagggcaactcaataaaagcctaacatgagaatcttggtctttatacaccacattgacaaggagcagcgattgaagggacgggaggcaagccgcggaaggaacatcaacaagaatcttgcccataagattcaatttcacaagcgttttgctggtgtaaagcctcttactggcaggatctgagagaaaactaagacttagggttagctctctaacgtaccggtcaactgcattcgagacccactttccgacatctacatcaacaggacattgtggaccaagcatgatacgcaagctttctactgaaggtgccttgtgtagttgcaatgacttttctagcaagtcccaaatactctttccgccttcgttgctttctgtgtactcgagtttaggcaacatcgtccagagaaaacgccatcgtttcgacaaaatcatggtggtcaccgcatcttttgttgggattagacacagtatatgcaacagaaatcgtcaggcaaggcactgatcctgtcagacagctcgtttaaattttttccgatagatctccgcttctgatgacatcctttaagatcttgttcgtcagaataagaaagccctagtttgattacgtagatagaggcgagttaacattcttccgtagcaagataagttagtattgggctaggccttttaaaacaagttgaaactcgaatatgtttagaaaaaggaattgtgtcattgtacattgggctttttaaacaagttgggcttaagtccatgtttggtcaacactctatttcgggtattgtctctgtcttcctttagcggcggctttactttagattcttctagggtttctagattgtataccctagataagcatcctataaagtaaacacaagtacttgcagagactttagattagagggctagcgactgcagaagaagagtaacacgtcatctctgtgcttctttgtctacaattttggaaaaagtgatgacgccattgctctttcccaaatgtagacaaagcaataccgtgatgatgtcgtggagattttgttgagatgctacgagcgtgtaaatgtttcatgtttgttgtttgattttactgactgctgatttctttttttcttggatctcgctcaaaactagatcctcactacagagcataactgttgatttttcttattccagatcttgctctgaacaagggcatctaaagtcacagatgcgtgtgattattgttctagacttgcagacttccttcttttttttttttttgcaaatccagatttgttttctgaatggtgaattcgtggtccagtaaggttttgatacctttcaaagagataaacttaacagaacaaaattttgttaaatatcgtatcaattcgaaagaacaaaaatatggtattgaagaacgaacataaatagctaatttctcgtggttaacttcgaaggaaattggacgtgattatttctcataggacaacatgttcttgacactgtttaatgtgcaaacacaacaataggttagaagccctggtgtcgaactaactagtgtttctacatctccatggattttattattttaagctgagattatgtagaaaacctttgagatagaagtttagatgtagatgtaccaaacacaatcattatagcatgtttattagtatctctcaaatgagagaatgagacattatggttatcctaacccacttaggcatttaaccacacatgtatataaaaaaattcctaaccaaattaagatccggagattagtgtggattcaatccgagatcttctgcttaaaaaaacaaaccaaacaaaaaacagttcctccgattccgttgaagacatgcaaccaaatgatttggtatggtaggtgtatgaaaaaattattatccttatccaaatttcagcaaagaattaataatagcattatccaaagtggagaaacatctttatccaaaaaagaaaaagagaaaataagcgatagatgaacaggtggaacgaggttcgttcagtagtcgtcgcttctaatcaacttccacttcttccacggaaacaagcaattcgatcaaacgtgaaagcaatatttaagatttttgtctcatactctaagcaagcaatatccaaataaacattcttatacctccactcctcctctgtctgattccttcacccaattcttgtctcgtttccatcaatccattgtctttgattccagaggtttgtttctatttcttgttgattccaattcgggtttcttcattgtgcattctcttgtttatgtcatgattcttattctttgcttatcaaagctctatactttatgaccatgatttgagagattctctgaaaagatcacacctttgcctctgaatttgagaaattttagtttctctgtatctgtctggtttagttcttgaagccatttgtgatttaatgtctgaaggttttgactttatgagttgagattgaagccactcttgatttgcaacaagatttgtcattttctatcatagccttattttatagctttggcatcatatcttaaattgagaaagactctgccttgttgcagttccaatgaggacaagaaaaacagtaatgggtcctatatattctcatgtgtttgtcttccttttggtctagacaaactgataagtttctttttgtagctggtactttcttttgaggcttttttaaaaattatccaacggcttgaactgaattggattcaatgtttctacaaatgtctcttatatgtaggttcttggtttatttggatgtggtgattatg

SEQ ID NO: 27203 - DNA, 3003 bp, Unknown
  misc_feature (1)..( 3003): 2750-1469P.txt file - cDNA_ID_2730695; gDNA_ID_2684220; Annot_ID_191817
aaaagtaaaaaataaaatctcaaaattttagattcaataccttttaaatcgtatacacagaggcgtgggcagttctacaccgctaaactttattagaaatgttaatcttcgatcaagggacttccacgatacaaactttttgtgtgagataatacatcccgaaactcatacaaaacccataactagcatctcaacctctcggcaaccaaactaaacatacgcgttacgtccccgccacggagaattggcgttattggtcatattatcaaaagctaatgagagtacaaataagaaaattacagtagttatgttaacagttttgaatttatgaatcccacttctaagctgtcgttggacattgatgtcccaaaacgacctaataacgtcaatcatgatcatttgccgttgacattcattagcaaaatactttgtaaatggtgtaccaattaagtctcaattgtaaaagatttaacgttgatatatagataaattagactgccatgcatgtatatacttatgctattcttggtccatatgattctatgaagtttcttgtgatcagtagataaaaatactatatgatgcacaaaagcatgtgtttttttattgatttggtaaagttagtcccaaaagagccacaagactgcaatttttttctaaaatatataataatataatgttgtagaatgaagttaaataagcttctttttgaggaagtatcgtttgagatacaaaacttgactaatcgaaacgacaatagctactcctaaagacattaagccgagctgattgaccctcgtgtttgtcttctcgtttatttccctcatatatgcttccctgcaccatttttttataagagaatcttaattaaatccttttttgcgtattccacatatatacgtaagattgatatgaaagttattaataacctgattctcaaatagagtatgttggccctaatagcacttgcgtattctgtagatcttcgaatctcaagctccacaccctggaaccatatattcaattacatgtgtttttttagattattataatcatatattagaattggaaatgaaggacttgcctcgatcttttcttttttagcaacagaatcccagtctttggctctgatacccatcttccaatcaagactgacgataacagagctattgactgagtgatgtgactggtcgtgatgcattgctaaacaagctaagaatgttccactctcgctcgttgtaaacgcagcctgaccgtgtgtcacgtttgctatcttgtacagttccttcccatatggagatgttacctatacattttaaccaaggcatatatcaacacacacaagtttatactatattttcactccaactatagacaacttataaaccaaattaacccttattttctcaatctattaatccgaaatctcttggtagaaaagttcatgtgaattttgtggttaactaattgatttttcctatacaaatctatcagcagtttaatgttgattttcgatctctaatttgagtgatcttaactcgtagtcaaattatttctatctcaaatatataacgtttgaccacacagtaacgaaattttcccggatgcatgaaatttacgaagaaaaaatggagtatatatggttgatgtacaaacccgaacatctaatgttggaccaagttgagtgaaagcatcgtcgatgcaaatgtaatcaaggacaacgaccacgttggcttggatctcttcgtagacgcatctctctcctgattctggaaccgttaaccatattgcctccacccccggaaaaagagagccaccgccggcgaggtaaatcaaaccaatgaatagtaccggtgagatcgccattttcgagagagagaggtaagtttaaggttattgaaaaccaaaaaaagagagaagaggaacaagttcaaaggctattcacgttattatgcaagagaaggttttaagacattggcgcgtggagttaaagccatcgttgtatccaatcagtaagggccatgtaggatgtggtgaagattgtctacggagccgtttttggagtatttttacttttatggaaactacgtttaattttgaccaacaatatcatcttaataaggaagtaaatccaaacaaaatatcttcacattaaatgtccttcaaataaattttattttatttctcttttctgtcaactctagataacaacaactagatttttaggcattccaatggattgattatagacgtgtttcatttggaaatttactaatgtaaaaatattagagagaattgaccacgcaacccacaaaacatagtaaaccacgcttgaaaaagtgaatagccatgaattagtagctttaagtttagaccatatcatgcatttaagatccattaagtagattacgtaacgttcgagattaactgctcctaattcagtgataagattacactgcaacatttcctacgctaattatacttggggagaagatactttgtttttcggtgcattgatatttgtttgacaaaattgttcagaacgatgcaccatggaaaaatgaaatgtgacaccaaccaaacattatacttttatgattccaccaaaatcaactttacaaaacccacttctcgattaaaaaatgtcacactgtattaacataaaatattcaaaaagtccgacaaattaactcaagaaaaaaacacagagaaaaatgaatgaataaaaaaaaacaggaaaggaagcaactttcgtattattctcttccccacttgattgcgatttgagagagataaaggtcgagaaagtcttttcatctccttcaccctcatcgtttcgcgtctcttctcttctctctcagaaaatgctcatcagaaattgtctcctttttgtttccttgatgtgttttctcttctaatctccggtgaaacaaagaacaaaggattcataagacacaaagcagagaaggagagagagatacgaggcttttcttcatctttatg

SEQ ID NO: 27204 - DNA, 3003 bp, Unknown; identical to SEQ ID NO: 27203
  misc_feature (1)..( 3003): 2750-1469P.txt file - cDNA_ID_2730695; gDNA_ID_2684220; Annot_ID_137433

SEQ ID NO: 27205 - DNA, 3003 bp, Unknown
  misc_feature (1)..( 3003): 2750-1469P.txt file - cDNA_ID_2730722; gDNA_ID_2684220; Annot_ID_191808
tcatggtgctggtacaagatcaaatgtctcatggaagtctctggcttcaccgtcacttgcatcgacctcaaatcctccggcatcgattcttcatccgtggattcactcactaccttcgaccaatacaaccaaccactcatcgacttcctctcctctttccccgaacaagaacaggtgaaacctaattcagaactcaaatgaattgattcttgaatctgaagcaaactcactctgtttttctctgttctgtttttttcatcaggtgatacttgtgggtcacagtgcaggagggcttagcctaacgagtgcgatacagagattccctaagaagatctgtctcgctgtttttattggagcttcgatgctcaaaaacgggcttcagacagatgaagatatgaaagatgtaatgatacacatttctttaaagtcaagttaacttgtgtgtgacgttatgtttctttgtcacagggagtgcctgatctatcagaacatggtgatgtctacgagcttggttttggtctaggaccggagaatcctcccaccagtgctattatcaaacctgaataccgacgaaaactactttaccacatgagtcctcaacaggtttctctactgtttcatttcatatataatctcaaaagatttaatgtgtttaagtgtaggaaaattcgaccaactccttataaaaataaatcaccatttaatacaaaatttgcaatgttcataactaacctttatttttatttttatatatgtgtgtttttttcttataactttaactaaacaattatacaggtatatatatatccaaaaatcttccattattaaagttaaatattcgtgaatttgtctgctatgtacgtagaattatggtagtgtggatgttacatatcgaattggagtggaaacatgcatatcaaatcaaatattacaaactatttcatcaaatccaaattccttgttcttatacttttttttgttgttgttgttgtgttggtgtaaaggaatgttccttggctgcattaatgatgagaccagcaccaattttggcgttaacgacagcaaaactggaagaagaggaaaaagaaaaaggacaagaggagcaagtgccgcgcgtgtacatcaagacgttactcgaccgggtcatgaaaccggagcagcaagacgcgatgataagacggtggccacctagccaagtttacgaattggagagcgaccattctcctttcttctctaacccttttgttctctttggtttactcatcaaagctgccgtttccgtcggttctatctaaaactatttaaagaactaaaggattgccttttgttggttttaaaaccggttaagtgatcagtattgtcgagggagtgtttatttatttttgatttttgtgacattttggtattttatattaatcgttttgaaataaattatgttttgcttaattttatcttgcgtcacaaaagtgaaataaatttcggcaaatcgtgtagttttatataaatcactaatttgcagtcttccaaggtctacttaaagtcctagccggtatcgacaccaacttcacagttacctcaaaagccttagacgaagagaatgactccgctgaactgtacttgatgaaatggacaacatttctagtccaaccaacgactctgttcatcacaaaccttgtaggagtggttgcagacttgcagtgtttgattttgcctaatagttgtttgtagttgatgtcttaagggaacataggcagcgtttgattttgcctaatagttgttttgagggatcaatatattactcgattcaatccaattttcataccatatatcaagaaagatgaacaacaagagtcattgtcatgaaacccaaacatttatttagcaaaagagtttcagaaaaactgactcagaagattcccacaagagtttttgtgaaatttataggcttgaaacaaaagaaattacttcaaactgtcaggttcttgtagaaaaggagtgacttcatgcttcagaatctgtgctcaagcttctcctgttccttgaaatactgagcatacctgcattcattgtgtgtatttgaaagaataagcacaaaagatgactagaaactagaccataatatgcagcacccgtaatgtttagatcgatcaggtaactaatagcttcacaagcaagaactcaacagttttaatagaaccacactaatcagctaatgattacgactaagccatttaaatcctcaacatcttgaaatgcaattccacagagtggttcatcaacaatactaatttgatacctggaagactttttctagctgagagtctctatatactacactccacttaatactcatctcaaactaacttaaatcctatcatttctcatttgttcctatgacacaaacgaagaaccctatatccatatgcgccgcacaagaccgatgacacagatcgaagaacaatcaaccagatcggaactcgatccaaaggttcctttaccaatcgattgatgagagagatagaaagagagatagagtaccagtaggttccaacgacaggggtaacgagaagagtggcgctgatccaattctcagagaccttgtggtggatcttctccggcagatccttccagagaccggtcatgatcttctgctgaaacggagaaagtgcgtaaaccaccgccttcaatttcaccggctgcttccccattttctttttctcttcccagataatcccaacaacaacaatccacagtacgagaacgaatctcccccaaaacctaaaataaacaattctcaacgaagcttatgttttttatccgattccggttcagttacaattacaattgaaccggatgaccggctgcaaaatttatcctgatttgtttcggttcgatccggtttgagtaaaccgaaatagataaatcactagtccagacataaatgatgatgatgatacagctagtgttccggaggagaaggacgatcgatctaaggagacgatg

SEQ ID NO: 27206 - DNA, 3003 bp, Unknown; identical to SEQ ID NO: 27205
  misc_feature (1)..( 3003): 2750-1469P.txt file - cDNA_ID_2730722; gDNA_ID_2684220; Annot_ID_137425

SEQ ID NO: 27207 - DNA, 3000 bp, Unknown
  misc_feature (1)..( 3000): 2750-1469P.txt file - cDNA_ID_2730724; gDNA_ID_2684220; Annot_ID_191807
atacaaaggatgtaagtagcacctttagtttactctttcgttcttggagcaagtttttcatgactgatgttttatcctcttcatgtttacaggttgtatttcttccaagactttgaagttgttcgtgttcgacttattgttgaccaatcgggtaagcatatgggctgtggctattttgagtttgcttctgctaatgaagcagagaaggtgagtagtttttatagcaatgatgaaaactagtgtatacttacttatatgatgaaattgttttgatgaaatatttttatactgtaggcgctggaacagaggaatggtaaaagtttgcgctatcacaaaatctttcttgagctggctgagatagctccataccctctccaacacatgtacattgattttccatgttattgctctagttttgatgtcataacagaagattaacgttatcattttttgttaattaggtacaagcttgcagagaagctttggtaagggattttttaactactattttgcctttaagagattttttgttatcaaaggcaaattcggtgaagtttttcgtataaatggggagagatcacaagggtttttgatacaatgcaggtacgaagacaaccttctacgagaatcgaatctgaagcaacagaaggcaaaatccaacggattctgcggtaagaagattaccttctcttacggggacgactgctagaagatgaagaagctctctttttacggggattagtgtagacactgaaattattatccatagtaaactgaaaattcaaaaagggagtacggcttacaggtcggtctgatttcggtttaccaaaccggttcacagtttcacacagaatatcaacattactggttcatacaccttttacaggatcattcaacacaagtacacaaaacataggcaagaagctctccatttatcatcatcccctccactgatccttcttgttccgaacttccctcattgtatcaattggcgacttgcaaccgagtttctcctggaaaataacaaagttaatctcgatatacgacaagaaagtaaagatcgatatcaacagtgatagctgataaaaccgaatcatgaattgttcaagaagatgaaccaaatggagtaataacctgtatctctggcttatcaacacgcataaatggatttgtttcgagctcttcctccagtgttgaagggattgtgggaagatctgcttggcgctgttgacgggcccatgctaacttctgttgtatcttcccgttgtttggttccacagttagagcaaattccaagttcttaacggtgtactgagaaccataagaaatgaatagcggattattcagtttataggcatccatttttatgagttaagaactcaaaagacataatgaagctgttgatttttttacctcatggccgcagtaaacctgtgtcggtttaggtaatgcagccagagtcacacacaacgactgatacatctgctcagctgtcccttcaaaaaacttcccacatccagcaacaaactgtataaaatcaaagtaaacacagcttaatgtttaactcataactatctccatttagacatttacagagataaaagatctacggagaacatatagggtccatggtagggaagaacaagaggattcagcttaatgttaccacttacaagtgtatctccggtgaacacggctgggttttctccttcttttccgttcacataataactaatgtgacccttggtgtgactgtaacaagtagatatatcagaggaatcagcgatgacaagagaaaatgactgagttaaacatcaagtagattagatgcatctaaattcattggaaaaaaaaaaaaaaaaaaaaacaaaccaaggagtgtggagagccaatatgttaatatcctgacccaaagtcagcttgtcaccattatcaaccgcatcagtgcaacccttcaccttatccagagaacctccatatactttgatatcaggaaccaactgcttaatcttctcgtttccaccggcatgatccctttgatcatatcaagccaccaatcaaacaatgagtgttaaaataaaaacgtcgcctcaaatccaaatttcatcgaagacaaaggcaaccatcatatggtacatatataataaatcttgcatcttcaagaggtgaaacattaatgcagaaagtatcagactttaacaaagaatcagactcacgaagatgaatctctaagtcagttgaaactgatagtaggaaaaagctaaacacttgatcagaaaactgagagatttaacaatagacttgtactaatgttaatgtctaggaccggaatctagcatatgtcgatatcactgagtaataagaaccaacagagaatctcggagatgaatcaaataagataagttaccagtgacatagagagaagtgaggtttacttaccagtgatgatgcgtagtgagtacgaacttgatcttagcttggtgcttctcagccgatgcgatcaccttctccggatcaactggatccacaaccgccgcgtctccggtgctctcatcgattatcctgttttttttttacgaagaaagaatcctaaactgatgatgaaccgagtcagattaagaagcaacgaaattgaagtaggatatcaaaatggctcacagataagagtagttgtcttgcagacaaggaacgtggaagatcttcatcgtctccttagatcgatcgtccttctcctccggaacactagctgtatcatcatcatcatttatgtctggactagtgatttatctatttcggtttactcaaaccggatcgaaccgaaacaaatcaggataaattttgcagccggtcatccggttcaattgtaattgtaactgaaccggaatcggataaaaaacataagcttcgttgagaattgtttattttaggttttgggggagattcgttctcgtactgtggattgttgttgttgggattatctgggaagagaaaaagaaaatg

SEQ ID NO: 27208 - DNA, 3000 bp, Unknown; identical to SEQ ID NO: 27207
  misc_feature (1)..( 3000): 2750-1469P.txt file - cDNA_ID_2730724; gDNA_ID_2684220; Annot_ID_137424

SEQ ID NO: 27209 - DNA, 3003 bp, Unknown
  misc_feature (1)..( 3003): 2750-1469P.txt file - cDNA_ID_2730728; gDNA_ID_2684220; Annot_ID_137423
catgttcaataaaaaaaatgaagatttaggaccaaaacatattaataaacaggattttatcaaaaataaaaagaatgagacaggatcaggttacacatatacggtagccttcacattctttttctttgatttgaatgataatagatctcttaaactttatattcttatataaataaaaaaaattagaaagtgcacgtattagcgttttatgctacatatataaaacaactattgaatgctaatagagaatccacaatgattgaacggttataaacgaatatatatatatatatatatataagcttaactcacgaagaacttttcagactgaatgaaatggttttaatttctccactagcccaatatgcatgtcatatttagtgcacacgctattggagttggtgtattcaaaatttaatttatgcctactgattcagtaaaatcatttctgcatgcatggtcgagtgttcaagatgggtttcgactgatcttacgactacgagaccagtttgataaaaataaataatgtatatgttaacatgtaccatatacgttttttatagttatcatgtacgttggggtgtctaaacctaaagaaactgaaagatcaatccaaattaattaacattagtcgtcgtttttaagttttattccttaccaaacttaaatacttgttctactgttgacacaatttgttaaaaaattgatcattcctaacagaacgaagtagtaactttttttttcttttttcgtcaaacgaagtagtaacttggaacagttttggttaataattatgagacgaaagtaaattatatagtggcaaaaacgttacacgtaataaaaaatgaatctgattccatttgtccacaaagacactgacaattggcaaaggctttcctttaggcacatgtctctcgtctgaccatatcatatgtcatctctcacttattgcaatttttttccttttcacaaaatgttaacaaaagctatgtattgtggaatgatgatcttttttacaaactgttttcaattttttttattttttttttgtgattggattttctttaaaactttaatcgtggctagaggtaaaaaaatgaatgtgtagaaaaccctcaaaatatggactaatccaaagtcatgtagcaatgtagcatatgtcattttcattcacacgttggtttgtctagactagagcatagagaagaaaataaatcgagttacaaaaaccgaaaattagggatacgggaaaaaaataatagaaaagacgctttcgttacccactgaaaaggaggaggagatatcttcttcatctttgtttgtgacacttctccttttttgccttttcaatcagtgtttaattatttgcaccttattcatgttttttttcctatcattctttaatttttcttttaacaatgagatagaaacaaaaaaagacagaaaaacagttacacaaaagtcaaatctctttccatttataatttaatggttccgagcaaggtttatgatataattggtgcatattttcaatttcaaatggattattgaacgtgaaaattgcatatgaccaactaattaattgagtcaatagtttttgagttttgacgtgtacggtaaacctataacctttgaattacaaccatttgcatttgttttgaactttttcccttgcgcaaattcatatggttcataactttagctaaaaccaacttgttcattgaaagatttgtagtctttctttctttagagttacgagcatgaaataggtcaatgaaattgattatctctgcgttagaaaactgacgggaaaatactttagctatagtataagtataactttaatcaaattacaaaacaaatcattagcacgggtcttgataacacacgtgacatacctgaatctaagtaacattttataaattgaacccagcgcgctatcaaatggattttctttattagtttagattgaaagtcgtttataatttgtcctccttaccgtcttgtaatcgtatgatcttgaaataactatgaacttttaaactggatcattccgatcaaaaattattttaatggtatgacatagagaatagaaacttaattagtgcggataaaacgtaaatagtaaataataagcatatagtcagacacacaattattacccattgactaccccaactatgaatatgcaataaatcagtgaccatatgcaaaagtcggatccacaaccaaaacgataaattgatttttatatatatatatatatatatatatatatatatatatatatatatatttctctctaaaattccttcacctttatttccttttaaattatcgtaacaacgctagtttaacaaatacaattatcgtaacggctgcatcaaaatcagaatttgcaaaaaggaagtgtttatgtcggaaaaaaaaaatagcattgtgcaaagaaccaatgtctatttcatggtaataaagtttattcttttttggaatatcttttttaacaaattaatttttaactgcttattctattatatattttactaaataaattttgaacttatgggtggttcggattaatattggacaaaaatatttttataccaattaaaaaaaggattgtttttttggtagaattaaaaaaggatttatttagtaaattatataatagaataagcaaatgagaattaaatttatatagtttccttttgctcatttttagcttaacaaatccttttttttggaaataaatcctacacattatacgcaagtagacattctatatattccttgttaaatttctatcctaagtatactggtcatgtcttaatagtagaaattaattactaattattttttaatattataaaaaatcacataactgagaaagaaacaaaagatatttttcactatatatgcgtttgacaaatgtgacaaggcacacagagcattccgtggaaaaaccccaataaaatctcaggcaaatctccggcgtaatcgatg

SEQ ID NO: 27210 - DNA, 3003 bp, Unknown
  misc_feature (1)..( 3003): 2750-1469P.txt file - cDNA_ID_2730762; gDNA_ID_2684223; Annot_ID_137504
ttaaaagattctagaaattttctagaatcatcttccacctccttaaacataaaaatctagatactctaatagaataatctagataatttgaataatgtaatctaaatcttatgtaagaactctctagacttaggattaaaatattttagatattttgtagtttggaggctataaatacctcctccccctctcaaatgttgcaatgttgtgaagttatcttcaagtttaaagcaaagtaataaaagttatatttcctaaaaaactctctcaaaacacttaaacactttctccattacctctaaaagaattttactctaacagggaagattccggcgaacacaaactcatccgacgacgaagaaccgaagataagcggagaagcagagcgaaatcgctaggcagatagaacccaacgtaagtttcatgtccgtctcttctcgtagtctacgcatcaccaccggcgcaaacgtgagtccaagcatcgataaaccgattctgataatcaccaccataaagcacatatcggccatcttgttcagctctgatgcacagtataacgccacgtgtccgttcttcgtcgtctccgttagatatgaaccgtcgaaaccagaagctcgtttgcagattccggtgaaaatggcgagcgaaactgcaagaaagaaacgatcgtttacacgacgagtttcttctcttctctcacgacctccatcttcgtcatccattgcgatctcgtagtcttgcaggagaaaatggagattttgaaacgatgattgatgaaaaaatcagaatccgggaaaaagtgagaaaatttgtctctgagaggttttggagtttgttaaagagggaaagaagaagggtttataacctaaccatggttaaaattttaaccatggaccatagtttattttttaaccttgctttttctctaaccatggtttataatccgtacgtgttgaaaaagtttcaaggagagaggtgatgactgatgatattgagtggacgaaggacttacctcttttggtcactgttaaaaattggtttcttgaattactggttacaaaatttcgttcgttgctgaaccggaaattgacaattttggttacacagaattgggaccaaaaatatctgcatggtttagtatttgatcatataactacctataaaaagactagaaatattttatattgttagataattgtgaaattttgaacaaaaaaaaatgttaagggttaaatatggtcttttttactaagttttattcatcggtttttctaaaatgttactactttgggtaaacaaaagttaaagcagttgcctgattacgacacgttgaacaatggattgatcttatgtaaatttaattgataaaaaaacagttcatgactgcattttgcagctaattccttaaacattttgagctaaaatttgaaactatcatcaagaacatgaagtaattagtcttaatccgatatcataaacggttcacacacacatcgatttctttgtaaaactaattattgtattcagggatgcgatccgaaactttaacgcatttttatctatgcaaatacagtatgaagtgataaatattgcaagttgtaactacaatatcaattaatattcagaaaatcttgtttaaaccttttattcaagaaaccaaaatgttcacaacacaaatccaaagaaataaacgaaaagcagatacagagcatccgcgatggtctcactgaacgatcacaggtccaaatattcaaacctctaatcaaagaaaccataatgttcaaaacaacaaacccatcaaagaaagaaaaaaacgaaaactagattgtagatagaaagagagatgataaatgtaagcatcgtcgatggtctcactaaaagacacaggtccatagtaacggtggaagaaactcaagacacaccactcacccggtgacggagcagcgaaggtacgctaagaaagcaatcgtgaggacgacaaaaatcaaacccacgagcagctgcacgtcacactcttctcgtacttttctcatctgttccagttccaccaccatcggagcaacaatgatcttgagaatcacaagcataaaagcaagatgcgcccacaagttgaactccatcgcccaagaatacgccacgtgtccggtcatcgtcgggtttggatctgagccagcagctgctcttttgcagactcttgtggacagttcaagcaacactgcgacgacaaaacgaccgttcaatctacgaagctcttcacgtccctgtcacgattctcttcacgtggctcaacaactccttccatggcgagagattcttgcaggagaaaagaaaaacaagattttgagacgaagattgtgaaaatgaaaacagattcgggagagaaaatctatataataagggtttttggagtttataagcataaaatgtttcttttatttaaattaaccacggttaaagtttgaccgtggaccatggttaattggttatagtaatcgtacgttttctaacgggacgtgagtcttgatgactgtgttgaaagttaaacttgattttgaatcaagtttaattattggatcaattatccaataattaattatggccaaattcaagttttagaattttctctagaaatatcatcatttccacctccttaaaagattctagaaattttgtagaatcatcttccacctccttaaacataaaaatctagatactctaatagaataatctagataatttgaataatgtaatctagatcttatataagaactctctagacttacgattaaaatattttagatattttgtagtttggaggctataaatacctcctcctcctctcaaatgttgcaatgttgtgaagttgtcttcaagtttaaagcaaagtaattaaagttctatttccaaaaaaactctctcaaaacacttaaacactttctccattacctctaaaataattttactctaacaaagtggtagcagaacttgaagatcctaaagatg

SEQ ID NO: 27211 - DNA, 3000 bp, Unknown; identical to SEQ ID NO: 14741
  misc_feature (1)..( 3000): 2750-1469P.txt file - cDNA_ID_2730780; gDNA_ID_2684223; Annot_ID_137499

SEQ ID NO: 27212 - DNA, 3003 bp, Unknown
  misc_feature (1)..( 3003): 2750-1469P.txt file - cDNA_ID_2730786; gDNA_ID_2684223; Annot_ID_137497
ctctcaacaacgagcgatacatcgtccctcgaggtaatggtggtcctataaaaaggttctgcagagcatttagctggatttgtaccgcttaattgatccacattacaaaaaatttgtctcctttctctatgcataagttatatatttatgattttttgtatcaatgtatcgatcaatatttcaagtatttatgtatccttcttccataattttttatctttaacaatatttacttgtatacggaaaatttgttaaaaatctaattatttatatttatatatgtaacaactgaaaattggtaacttgtataagcataatttatgctgcataaacatatttgcatttaactacacggaaacttactaaagagaaaaagagaattctcgcatataaaacagaaccgttactctgtttctcttggcgctttaattagggtttcttatttagcttttgcattgccacattcctaaaggtttcatcttttggatccttctctgactcacttcttaaaacccatcaatggaggaaggaagtctgtggcgtcaatggactatgttcagatctctgttatcgattcttcaatggtggggttttaacgttactgttatcatcatgaacaaatggatctttcaggtttaaaaagtctcttacttttatcattaaagacttagcctttcgtttgttttatctgatctgcgtttgaaatttggtacctttccttgtttgcagaaactggatttcaagtttccattatcagtttcatgtgttcatttcatatgttcgtcgattggagcatacattgtgattaaagtcttaaagcttaaacctttgattgtggttgatccagaagataggtggaggaggatttttccaatgtcatttgtgttctgtatcaacattgtgttggggaatattagtcttagatacattcctgtctcttttatgcagactatcaaatctttaactcctgcaacaacaggtttagggtttttttaagattgagaatttttcaaaataaagtgatttttttttattgttctgattggtttttgtgtaatggttttttgagtgcagttgtgttacagtggttggtatggaggaaatattttgattggcgtatttgggcgtcattggtgcctattgttggagggattcttcttacttctattacagaacttagctttaatgtgtttggattctgtgctgctttgtttggatgtttagctacctctacaaagaccattcttgcagaatctcttcttcatggatacaaatttgacaggtcaatgttctgtttcctgaggttttgatcttcagtttcacatgataggtgttgaatgtgtgaaacttacatttggtttcaatgacatgccatgctctcatagtccaatacttgatttgctttttcatatttcatggaactgagtgtttgtgtcctcctcattttcatgtctctctatgtagcataaacacggtatactatatggcgcctttcgcgaccatgattctcgggttacctgcatttttactagaaaggaatggaattttggattggtttgaagcacatccatctccatggtcggctctcataattcttttcaactcaggtgttctagctttctgtcttaacttctccatcttctatgtcattcaatccacaacagcagtcacattcaatgtagctggaaaccttaaggtaaatgaacaaatcccaaaccacataacattaatctttatattctagtttcaataactcagatgtttgatggatggtatgtgatttgcaggttgcagtagctgtgtttgtttcatggatgatatttcgaaacccgatatcaccgatgaatgctgttggctgcggaatcacacttgtgggctgcaccttttacggatatgtaagacacatgctttctcagcaacaacccggaactcctaggactcctcgtaccccaaggaacaagatggaactgatccctcttgttaatgataaactcgagagtaaaatttgaatatcatcggtaagtcactagactattgaacgcacacaaagaagttagatttgatcttgaacatccacaagagagttatagtttaactatatgtttatttttactcaaactagagaagttagagaagtgccattttatttgtttccattgtattaaattatctatcctcatcaaaccaactcagagatgaccacaaagatacttaaagcaggcccatttttgtattcaattatggtagtgctttcacttacctcagctttttaatttttccttccaattttgtttgtgccatagtgccatgttctaacatcagagacttaatacatgacaaaatggtgcaagtttgggaatctttgaaagaagatgaaaatagaaagttaatttgacaatatataagaaatgattattcattttcccgccttgatacatgaaagagcttaagacggtgtttaagggaaacgaatattttagctctcaaaacagctcatcaaattcgttgctttagcttctcaaaagtaaaaaatgggctttttcaagtgggcctcaacttatgttgctgaatttaccgccatatccttcccttacaaaaaatcaattttcaaaaaatcttcatgctacagtagtctgaaaccaggtcaaaggagttaaagagaaaagggcaaaacagtcaaacagcataaaaagatgtctgtgtcttggagatcgcaaagctaccgttttctgttcactctgtacaacacacttgtctccttcttcctctcttctcttctctctctccatttcaaaaagggtgaaacttttcttctctttctagaagaagaaaaccagagatacagagagattctctctctaccaaacccctggaaaaatctccagattcatcttccatagaccaaactaaactctgttcactgtactctctgtcattgtcctgtaagagaaattgaaaaccctaggagattttgaatttcgtaaaaccctaaacacaaaaatg

SEQ ID NO: 27213 - DNA, 3000 bp, Unknown; identical to SEQ ID NO: 14768
  misc_feature (1)..( 3000): 2750-1469P.txt file - cDNA_ID_2730827; gDNA_ID_2684224; Annot_ID_137536

SEQ ID NO: 27214 - DNA, 3000 bp, Unknown; identical to SEQ ID NO: 14763
  misc_feature (1)..( 3000): 2750-1469P.txt file - cDNA_ID_2730831; gDNA_ID_2684224; Annot_ID_137525

SEQ ID NO: 27215 - DNA, 3003 bp, Unknown
  misc_feature (1)..( 3003): 2750-1469P.txt file - cDNA_ID_2730835; gDNA_ID_2684224; Annot_ID_191888
gcaagagtaaggatcatcaggatccagttgatctccgggatatagatctgtccatatatatgtttcgaagtatggactactttgatgcgtgggaagcaccctagggcatggcattgtttgattattgagaacgtagtggttatcacagcctgactgccaacaatggctgcaagtgtggcaatgacaaagacaggccagaaaacaggatctgcataaaggaccaagatcatataagattgtcattatcacaaggaaaaaagtgaatattaaaccctggtgtcaaagtaaatgaacctgggactgaatcgtaaaaactgttaggaatagacccgaggttctttgacaggaaagctgcctggcccatgtattgtaccaccagacaggggtacacgacaacggcgaaagcaacctgcacaaaaaaaaaaaaaaaagtagagtgtaagaaacaaagctgcgcaaccagcatggacttatgttgaaggataactaccaaggctgtagagaagtcacagataaaataactgatgtacaccactactagacaggaaacctctgcttactctgattgagaccgaggtgaaatggccaagatttgcaaacatggcttcagtacctgatgagacagcgataatcactttagcaacataagaccattcactaaaggattcaaaacaagcagaaaataaataatattatggttatgccttgatccagaaccagaactacctgttacagaaagaagaacccctccaagagatatccatccatcttgaccagtcactctgaagaatttgatgatatacagtggggaaactgcatgtattatctttggattccaacggatgatgttgtataaaccgatgaagaatattgaaataagccagatgatcacaattggtgcaaacatgaaagccaccctgtgagtaccacaatgttgcaaagcaaacagtccgaccaatatgacacaggcaagcaccagtagttcgcctgcagtggattaagagacaaaacatcaaaacaaaagaaagtcacaagatgtaatcaaacaacaaacaaaacttgatacaggcacatagtggaagcaacacgtattagataccatcagtcacattcttctctgtagcttgcaagcctgacaaggacgacagaactgaaaggaagcaggagttagtcagtcagatattgaccacaaacaaacaaaaaagatgctgatgaatagaaagtaaggatggtcacgaagaaggtgggtggttacaactacaagtaagagacgatgaaattaactccaactctgaatataatatgtaggaggcaggcatgctttacctgataaagctggggtcagaaccccgtctccaatgaccatagcagctccaaaaagtacaacaagcagcaaagcggtcctcagccttttgtgcttttcaagaaatgttctgaagggggatgaagttacagtatccgtggaaggaccaaacttgtaagctgagagctcctcatcagcagcttgctggttaggaagtaagctaagcttagcatgcctacaaagcagggaatagagagcaaatgttccgcctagagaggcaaaaacagaaaaagattcaatcatccggggagatataagttgaagagaggaggatctcgtttgctactgcaccttctccattgtcatcggcactcagtaatacaagaaggtatttgagaaggggaatgagcgtgagggtccagaaaatcaaagagaaagcaccaaatacggcatcctcgttgtgatgcttgtgcaactttccaataaatgtgctagggaagacataaagaggagaagtactgagatcaccgtagactacaccaaagctctggtaggccaaaatcaagttactagagagattcatccacgagagctgaaggaaacggatatcaacaattcagtaagtctgaaaacagagcaatagaagaatcccagcacaagaaagcaagggtctttatttagatagaaatgaaagcaaaagccaaacatgctatgaacagttcaagtgggcataaaggagctaacttgagaaggattccgacggggagagactccagattccgccggcgccatcgcaggttgtcgatacaaaagagatcaattgagcgaatcaagttggagctcttcagacgaaacccatcttatctctcactctcctctcctagcatcaaatatccaccttaattaattagcaaatactctctcaacgcgggaacctttatatctgtctctctcctccactcacttgtttctccgattagcaattttcctcgagaagtgaagtgaaactgacagtcttctaataataatactcaccagtcacgttttcccgtcctcgggttggccccacctatgttggctcgtcgtcaggcccattatgggctctcctaaaagcccatcatagatcttgtcactaatatacagacactatatcttatcttaaaaagtacaaggcccatttaatcaaagggcgtgataatatgtagtaggagctgtaaagcttatcaaggtagagaagatgtgtctgtcgaataggaggagtttagtaagattgtatatgctttggaatattcggaaatttaatggaagcatttataatagataaccaatccacaagtaacaaagattagaacgaaggtgtgaatcaatcaacattgatggctaactctattcgatttccatctagagagagctaaggcccaccaggagcccaagagagagggagacaaccaggaaaaagagaggggagggaatatccaaaagggataatttcgattttgactgttattaggaatgatgacgtggcgatccaaagaatattccaagatcccatcatcttctccttctttattcttcttcttcttcttcttttttaagcaaagcccccaaacccatatccctctcctcacaacatcaatctcacaggaaggaaagaaagaaagaaagacgagcccttttttctttctaaaaatagaaatatg

SEQ ID NO: 27216 - DNA, 3003 bp, Unknown; identical to SEQ ID NO: 27215
  misc_feature (1)..( 3003): 2750-1469P.txt file - cDNA_ID_2730835; gDNA_ID_2684224; Annot_ID_137524

SEQ ID NO: 27217 - DNA, 3000 bp, Unknown; identical to SEQ ID NO: 14761
  misc_feature (1)..( 3000): 2750-1469P.txt file - cDNA_ID_2730839; gDNA_ID_2684224; Annot_ID_137523

SEQ ID NO: 27218 - DNA, 3000 bp, Unknown; identical to SEQ ID NO: 14760
  misc_feature (1)..( 3000): 2750-1469P.txt file - cDNA_ID_2730847; gDNA_ID_2684224; Annot_ID_191885

SEQ ID NO: 27219 - DNA, 3000 bp, Unknown; identical to SEQ ID NO: 14760
  misc_feature (1)..( 3000): 2750-1469P.txt file - cDNA_ID_2730847; gDNA_ID_2684224; Annot_ID_137521

SEQ ID NO: 27220 - DNA, 3000 bp, Unknown; identical to SEQ ID NO: 14757
  misc_feature (1)..( 3000): 2750-1469P.txt file - cDNA_ID_2730855; gDNA_ID_2684224; Annot_ID_137516

SEQ ID NO: 27221 - DNA, 3000 bp, Unknown; identical to SEQ ID NO: 9126
  misc_feature (1)..( 3000): 2750-1469P.txt file - cDNA_ID_2730863; gDNA_ID_2684224; Annot_ID_191872

SEQ ID NO: 27222 - DNA, 3000 bp, Unknown; identical to SEQ ID NO: 9126
  misc_feature (1)..( 3000): 2750-1469P.txt file - cDNA_ID_2730863; gDNA_ID_2684224; Annot_ID_137509

SEQ ID NO: 27223 - DNA, 3003 bp, Unknown
  misc_feature (1)..( 3003): 2750-1469P.txt file - cDNA_ID_2730871; gDNA_ID_2684225; Annot_ID_137569
ttatatttttatctctttgggattttttctaagacaagtttttgttattcggcacaaatcgaagatggtgagtgtggtatagtccacgttatggcatatgcttgcacgacgagcaagccagtgaacaaaatatgtcatgtcaatgtattttctattgctgaaactatacaaaaatggacactaaccagaccggccagtgtcacatggctatgttactggggaaagagtatgcggaaaataaattaaagtatataagagaagatgatagaaatatttaacgaagtattgattgattctttattggggaaaaaaaagaaaagagtataggttgttgatctatcaaaccgacttttagtgttaggctgcaaatgattgatacctctcagaaacatgtatacatgcatgttttctttttgtcgacgaaaaatgtgtacatgttaattataaatatatatgtgtacacaacataatttacgatataaaaaaaacgaatccttaataatcacttcaatcgttttatggatgttttatgtataccattattagaatatgaatttctaactcaaaactaattagtaataagtgaaaaagtttatatttatatatgtcatttaaagttttactcaatttctactgtgagatattattaaccctaatattatattaatttaaagtaaaaactagatcatacttagtcaattattatccaatcgcaagaaatccctccaattaaaatgcgtgtagccaatgttggcgaggttatctacaattgaccaaggattgtagacatgcaatatgttgtagttcctttctttcaggttttgaagtctccaagtaaaaccacgatcgccactgataagcatcacattcgccaatgtgcgactggtgcaagtccaaaacacaatcctcctttgaatttctttgtcactggcttgtttttctttattctcaagataatggtactcgaccccattgtcttcctatgttcgttgaatttcaggggaagaacacgtttataatttgccgcaactggaacaatctttataggtcttatgtatccttatccctcaacacagctttaaccgtaggaccaaaagtggtgggatcactatcatgtggaaccccacaaaattctatgtacaacattgtcaaggtccaagctctcgcatagattggagtgtgcatgcagtactcgtcgacaacatcggcactatttatctgtaaaaaaaacaaattttgtgacatttactaagttcagagcaaagattaacaaagtaagttgttcagttctaatttcaatgcctcaaattaaaaatctccgatagaaaagtggtcttagtgttttagtctagtcttaaaggactcattcaagtgattacatgttcaaaaacatatgtctaagactgatatatgaacatcaagcaagaagtcatggggacaaatctagtacacaagatcataaggattgaatcgaagatacaatgagtaaggatctcaactcgaaattgatgaagctaagacttgaaggacataagcaagaatggagaaaacaacgttccagtgatgtcatcaagactagatgaattgcattgcagttctaatgtgaataagattattcacgtattagtaataaacacatcagaagttgactaataagattattcacgtattagtaataaacatatgctatgctaactttaagctttatgttcttaggaaatttgagaaaaatgacccaaaaaaaaacaataatgaactcaatgaccatataacttatacggcaggatcctgcatataattaacccaaataataatcccttaaattggtaaaatgtggatttcaccccatcctcccacctccctcctctttctaatgttaaattgttggggcaaaattgatatgtaagttcgtctatgggagggaattaagtttccgctgagtaataaacaaacaagtgcaaacctaggaattcaacaccaatgtaattttttataattttgtaggactctttaatagtcaagtcagtatttaaaccacaagagtcggtcagaaaccagaaaaactagaaacaagttatgtcagttctaagaagagagatgtgcaatgtattcggcaatcgggtatatcatctaacattttagccagtgaaaaaagagaaagatatgaggatttttccattgttcagtaagctaagagaagacagtttcattaaagagtcgaatagaatggatattctcatgaaactgagaaggttaagtttttttggggaatactttgcatgcctttatataggtgaagagtcatgttgcatagctccgaggcatttcagcttataagtatccatgtctcgactcatatgatgaatggacttgatgaagggactaggcaatcgatcgtcagtgcgggtgaattttgacgtcttgagtccatccgaccattcaaaagaaagtattcttcttaccacgtagcatgtgactttacctagagttcgtggagcacaagtagaacaaataggattatgcctaaacacctttagaactagaccaaaggtcaaaaactatcaaaacaagttttttacgctacatggtttacataaaaaaattaagtgatacactcaatgatgaataacaatattaacccaaacaaatttgatatcaaaacacagtataaccaaaatcaaaaccgtagtggaactaaactagattatataatatgcctccataaatactcggattttccacgtgaattggactaatcattaattaggaagaacggaatcagaataaatatgtctactcaactttcggtatggtggtggtagaaaagagaataagattcaaagcatattacgaattattgccatatgggatcatatctaacacaaatttaaaagaacactctactactacagtacaaaattgtatatatataaacacctgaaagattttaattacttatccctatcaaagaaactaacacaagtataaatttacagaaaaatg

SEQ ID NO: 27224 - DNA, 3000 bp, Unknown; identical to SEQ ID NO: 14797
  misc_feature (1)..( 3000): 2750-1469P.txt file - cDNA_ID_2730879; gDNA_ID_2684225; Annot_ID_137567

SEQ ID NO: 27225 - DNA, 3003 bp, Unknown
  misc_feature (1)..( 3003): 2750-1469P.txt file - cDNA_ID_2730887; gDNA_ID_2684225; Annot_ID_137563
tttttagatctaatcagaaaggagttacatgctacgattttgtggataaaaccactgttctcttgttctgtgatgaagtctgagatctctctttactgtgtcggtgttattaaaaaaaaaacagaactttttttgtttctcgagttttttttttttgaatccagattctgttccacagatgctaatttcaatcatagtatcaatctcaattgaaagtttctggctttggatgaattaattcaaaataaatttgagtattgatgatctctccacaggctgctttcattgattcggatcaaactcagcacaacattcttatggattcccaatcaactgtctccggtgtaagcaaccaacatttctcaaactttcatcttcgctgtgttatgggattatctttgtattgttgttgtaaagctgtctgttcaaaggctttgtattgattcattgttgtgcaggtgaaaactgtcaagattagcaatgtttcactaattgtttctaagaaagatgtcaaagagttcttttctttctctggtgacattcaatacgtcgagatgcgaaggtatgaaaaataacttgttgtaaattatcatcttcttgttaaagatgatctttaccaatatctctaatgtttactctaatgatctcagtgagacacaagagagtcaggtcgcatatgttacttttaaggattcacaaggagctgaaactgcaatgctcttaacggtattttgctttccgcgtatgcatcattccgtatatttcatgaattagtgcttacagcgaaaaacatttccttccagggagctgtcattgcagatcttcgtgttagtataactcctgctgttaactatcagctaccaccagaagcccttgcacttgactcggtaaagaccggaaactctttgatttattcgttactctctcggtgttcatgttgtttcctctgtgtagcaggaacattcgtttaatggtttttctgtcaagaaagctgaagatgtggtgaacatcatggtgggaagaggttatgctcttggaaaagacgccatggagaaagccaaagcatttgatgacagacacaacttgatctcaaacgcttctgcaaccattgcatcgcttgacgataagatgggtctgagcgaaaagctaagcataggaacaactgtggttaatgagaagttgagagatatcgatgagcgatatcaggtgagggagataacgaaatctgctttagcagctgctgaagagacagcaatcagtgcaagaacggctttaatggcaaacccttatgtatcaagtggagcttcgtggttttcaaacgcgtttggcgcagtgacaaaggcggttaaagagaaagttgagaatggaggagaaggaagaaaggagatcatcacacttgatccctcttcacccaaagttcctgctgtagttcctgttaagctcggttgatgcagatctcatcaaaccaatcggatctcgactaaattctttgataggtttgttgttcatatatatgctttcgtatgctaaagagaagataaaaagacataaaccatgaaaggtgttgttacattcaaccagcatttgttcctctcttgaaagagattattaagattcaagcaaaatagcaaataacttgcaggaaccatcaatgagaaaatggtctcaagaactgagttgaagaaacctctgtgccattggatgcgtagcgtgcgaaagctcacttggtttaagaacttcaacaatctctccgtcgacaacaaggcaaacgatatcagcaactttctgaatctgcttgatactgtgagaaacaatcacagtagtaatccctctctgcttcttcagtttcactataacatcctcaatgttctctgtcgatatcggatcaagagcacttgttggttcatcgagcagcaacacctcaggctcgttggctagagtccttgcaagtgctactcgttgagcttgacccacagataactctgcaccagtcttcttagcaaaggaagcatcaaggtctgcaagacttagcagcttataaacctcttcgtcacttagtttctcccctctcaaattcggaccatatctcacattatccgcaacagtccctgtaaccaaccacacattatcaagacctatgaaactagaggctaagcaaatcccaaaatttgattattaccttgaaaaagaacaggaagctgaaaaagcattccaactctacgacgaagagcaataacatcaacgttggttatatcttcaccgtccaagaacacagttgactccggtggttcccaaagacgattcagagatctcaaaaacgttgactttccacttccactaggtccaatcacaccaacgatcataccttttggtatatctatcgtaactcctttcaagatccgagatccatcatcggcgactcgggtcagatcatgtacccgaatctttggttctgaaccagacacaacaacatccacaagatgctctcgtaatgatccatcggattcgttagaccaaagtgatggcatggctttaaagttttcaactttttttgatcaaaacactcacttaacgaaaagatttgtgtccgtatatgaacaataagaatcagtcaattgatattgacaatttattattcttacaccacttagtggccaacttttaggaccaatctctgacatttacataatttatgacatcacgagatttagaggaggaattgttttttttttttttcacatccagatacaaattccctacatgactacatctatcacttgactatgccagaaatgataattccggttcgtagataaccaacaaaattcagacacagaaattaaagtagaccggttcactatcgtataacttcgctttgagttttttttttttttttttggtgtttcagagattaactttgaaaaatgagtatcgctttgatctcctgctaaaatcgccattgcaaaattcaaaacctgtagagattgaaactgtaaaaaaatg

SEQ ID NO: 27226 - DNA, 3003 bp, Unknown
  misc_feature (1)..( 3003): 2750-1469P.txt file - cDNA_ID_2730891; gDNA_ID_2684225; Annot_ID_137560
catgaagaaatcacttaaaaaattccaagatatgtatttaaagtttagtgaatcatcaaagcgcaaaaattcacaactaagtaagaaggttgtcgataaaaagcaaaaacaaaagttacagaatgtcttgaggagaggattcctcaaacctcctaagaaaagatcttttgggtttttgtaatctgtcattgtaagttaagcaaagtttgttgaataagtgttccagagatatgataagttgaccttttggattgtctaatctggaatcttttagtttatggtgaactctcaccccaagctcaatgtgatgtccatgtaactaatcttaggcaacatgatgtggcataggagattgggcatcctcatcatcaagatccctaaatgacgaaatgattttaaaataataattcctaagatttcacatccttaaacccttattaagtcctaacattcgaaaatacacaacattcatttgatttaatttaaatttttatattaacttctctattttcattaaaaattgtaaaatatttttttattgtcgtaaaatgttttacttttctatttccattaaagttgtaaatatgttttattaacgtcgtaaaatgttatttttttaaataaaaatatctgttgggccaaagacttaaaaatatctaaaaccgtgacttcttcttcctctcttccttgaaatttcctttgatgtgaacgacgatcccttgcccaacgcacaagtttcatctccttcccacataaaccccaatcccaaattctcttcatttttccttattcttgcgactaatcgattcaatcccaaatttcagaattcaaaatttcatctaaagtttagagatttctcgattatggtgaaatcgacggacggtggtggtgggtcttcttcttcttcttcagtggcgccgttcttgagaaaatgttacgatatggttgatgattctactactgactctataatctcatggagtccaagtgcagataatagcttcgttatcttggacaccaccgtcttctctgttcaactcttgcctaaatactttaaacacagcaatttctctagcttcattcgtcagctcaatatctacgttagtcctctcttctcctctctcttttcaattttgtacaattggatcttctttgttatgtctcttactcttacatggtgtgattgtatttagcaaagtttcattttttctctgcttttacaacgtgtggataggttttagagaagattgattatgaatttggtttatgaagcatgaagaaagatgttttgttcaacttctattatctggaacagtgtttagaactagtactagtcacaatcttgaagactctatgatagtataagttggttgatctagggtaaatctggctcattggatctttgagtagacttgtgcctgattcgtggatgtgtttgtttacagggttttagaaaagttgatgcagatcgatgggagtttgcgaatgacgggtttgtgagaggtcaaaaggatttgctgaagaatgttatcaggaggaagaatgttcaaagtagtgagcagagcaaacatgagagtacaagtacaacatatgctcaggaaaagagtggattgtggaaggaagttgatattttgaaaggtgataagcaggtattggcgcaggagttgatcaaagttaggcagtatcaggaggtgacggatactaagatgttacatttagaagacagagttcaaggaatggaagagagtcagcaggagatgctttcgtttttggttatggttatgaagaatccaagtcttttagttcagttacttcagccaaaggagaaaaacacttggcgaaaagcgggggaaggagcgaagattgtggaagaagtgactgatgaaggagaatcaaactcatatggtcttcctttagtaacataccagccaccatcggacaacaatggaactgcaaagtcaaactcgaacgacgtaaatgatttcttgagaaacgccgatatgttgaagttctgcttagatgaaaaccatgtgccattgatcatacctgatctatacgatgatggagcatgggaaaagcttttgttgttgagcccttcaaggaagaagacgaagaagcaggagaacattgtgaagaaaggaaaggatgatttgacattggaggaggaggaggaggatggaacaatggaattagacaagagctatatgcttaagctgatatcagaagagatggagaaaccagatgactttgaatttggacagcttactcctgagaggtctaggaaccttgagattttgacagagcagatggaattgctggcttcaaatgaatagttgattttttgaacatatcagcctcaaaacttttgttatgtaactctataacaaacaacgaagtatgcaccggatatattactttcaccggtgcaattctcaatgatgtgttatagcagcttactacaaaaacatggttgaaactttttgacaataaccatgagagcaaaccagtatagtaaacctcttaggattcctatatcggttcgattttgtgggttttaaatcgaatcaaaccataaccgaatgcattataaaacccgtttccgagtcaaaaccaaactaatcacttgatttttctgtcattgtttattggcctatcggattggttttactgcggttcggttatccctaaaccgaaccgaaccgactaattattttctcagtcactctaaactaatcgcttaaatttaagaggctttttaagaacacgtggcagcatataattgggttgctttgtcagacttttttatagcgttacacgacgacgcatgtcacgcatctaaacgccgtttccaaaacagcgttttgcgtctcgacaaacaacaatcaaaatctccttactctgtctccgtctctctggttttcgatttcgtgaatccaatttttgtgtgtatgtattcgcttcgtctctccatttttcttcgtcttacgtttacgtaatccaatg

SEQ ID NO: 27227 - DNA, 3000 bp, Unknown; identical to SEQ ID NO: 14792
  misc_feature (1)..( 3000): 2750-1469P.txt file - cDNA_ID_2730895; gDNA_ID_2684225; Annot_ID_191945

SEQ ID NO: 27228 - DNA, 3000 bp, Unknown; identical to SEQ ID NO: 14792
  misc_feature (1)..( 3000): 2750-1469P.txt file - cDNA_ID_2730895; gDNA_ID_2684225; Annot_ID_137558

SEQ ID NO: 27229 - DNA, 3000 bp, Unknown; identical to SEQ ID NO: 14791
  misc_feature (1)..( 3000): 2750-1469P.txt file - cDNA_ID_2730899; gDNA_ID_2684225; Annot_ID_137557

SEQ ID NO: 27230 - DNA, 3000 bp, Unknown
  misc_feature (1)..( 3000): 2750-1469P.txt file - cDNA_ID_2730903; gDNA_ID_2684225; Annot_ID_191943
attgttggggttacaaaattatttgtttgttttaactaagaaacatagttatcaaaatggatgctctttggatgtagattaccgcgatagacattgataaagaagcttacgaagttggactagagtttattaagaaggctggtgttgatcacaagattaattttatccattccgatggtcttaaggccttagaccaattggtgaacgacgtacgtgaaaatatgtgttcttatattattattaactttaagcttaattaactatatttttttagctaatggtcatacattaaaaaacattgcagaaatgtgagtttgattttgcatttgcggatgctgacaaatcaagctacgtcaacttccatgagaggcttctaaaattggtgaaggttgggggaatcattgcgttcgacaacaccttgtggtttggttttgtggcggaggatgaagatggagttccggagcatatgagagaatatagagcagctcttatagaattcaataagaaattggctttggatccccgagtcgaggtctctcagatttccattggagatggtatcacgctctgtagacgtcttgtttgatcaaaagactacttgaagagtacgtagcagaaccaaagtcggagagtttggaataaaagtgttagatggttcaataacgacttcgtcttttgtcacaactttgcttgtaatggtgtgtttgattgatgctcactctttatcttctttctatgttgtggtttcgtcgatgttgttctgtctggcaacaaaactattagtacactaaattacttttaataataattgttgtaacattataatttttttttttctggtcgacacattattattactgttttttttctttttaagtgtttgtaaactattaaaaagagttgtgtaaagattaaataaacacctttcagctttttggggacatctaatatgtgtgtttcaattttacatgcatatgcacactagtgttttccaattccattttttctgccaaaattacatatccacccaaatgatatgaccaaagttttattttatttctcagttaggtattactatttaaagccaacatagacacacatttgctaacactcaaaagagattctcacgatcgagcaagagagagatggatggtcgattacctgacaaaggcattctcaagagcgaggctctaaaacaggttttaatttactagtcccttaatcatttaagaacgatcaataaatttacaaatatatgtgtttgcttacacgactgcataatgtgttgttacatatgacagtacatcatggaaacaacagcgtatccaagagaacacgaattgcttaaagaacttcgagaagctacaatccagagatatggaaatttgtaagtcttaatccatatttgattttgtaaccagataattataattaagaaatatgatttatgtaaaaatttataaacgcagaagcgagatgggagttccggttgatgaaagtctatttttatcgatgcttgtaaagatcatcaacgcgaaaaacactatcgagatcggtgtgttcaccggttactcacttttcaccgtagctcttgctttgcctgaagatggccgtgtaatgattcttcttcttgctatcataccaaataaatagggataacttttgttagtatagttattatttgtttttgtgtatgcagattactgcgatagacattgatcaagcaggttacaatttgggactagagtttatgaagaaagcaggtgttgatcacaagatcaatttcattcaatctgatgctgttagaggcttagaccaattattgaacggggtacgtaagtagtagtacgactcacacaattaattactaaagcaaatggtccctttttaaggaatagttatattttaggaccaccaaatttgtatatattttttatatataactaatgaaagattgattgaaacgtctttaatacagtttttaaaacaaaatcgttttcagatttttacagtattttttgatgtaaatatgaaaatacaagttttttttatttggtccataattttcattaaactgactactaacctaatcaataaattttggataatggtcaaggagaaacaagagtatgattttgcatttgtggatgctgacaagacgaactacgtttacttccttgagaagctccttaagttagtgaaggttggaggaatcattgccttcgacaacactttatggtttggtactctaattcagaaggaaaacgaagttccaggccatatgagagcttatagagaggcacttttagagttcaataagatattggctcgggatcctcgagtcgaaatcgctcaaatatccatcggagatggtctcacgctatgtagacgtcttatatgataaacctatagtaaataatgttatatgcttcaataataactttggcctttgtttgtaatgttatatgctactataatgactcttcatcttcctaataaaactcctctttcaatttcaatttgcaaagagggttcaaatttggatgcgaatataacagtttattactttgcggcaaaatgtttataatttttaaactttgagggttaattgataaattaaagataaacatcgacatttctaaatcagaaatctcgattttattttgaatgttcaaaagctgccagattgagaatatttcgtccgtcgttgaaacttgagaatagaggcgaatctggttcgagttagggttccaattgaaaagtttgaagctccttttgactctctctctcttctagatctcgacaactctaacctcttcgatttggtaaattttcgctctttctactgaaatcggatgaatttgtgattttccggggatgggttcgtgtctctatgcattttccgatgatgggttatgagaaaaagtttttttttttttttaatctttgctttgtgtaggtggatcttgagaaattgattttagttcaaagcttctgatg

SEQ ID NO: 27231 - DNA, 3000 bp, Unknown; identical to SEQ ID NO: 27230
  misc_feature (1)..( 3000): 2750-1469P.txt file - cDNA_ID_2730903; gDNA_ID_2684225; Annot_ID_137556

SEQ ID NO: 27232 - DNA, 3000 bp, Unknown; identical to SEQ ID NO: 14790
  misc_feature (1)..( 3000): 2750-1469P.txt file - cDNA_ID_2730907; gDNA_ID_2684225; Annot_ID_191942

SEQ ID NO: 27233 - DNA, 3000 bp, Unknown; identical to SEQ ID NO: 14790
  misc_feature (1)..( 3000): 2750-1469P.txt file - cDNA_ID_2730907; gDNA_ID_2684225; Annot_ID_137555

SEQ ID NO: 27234 - DNA, 3000 bp, Unknown; identical to SEQ ID NO: 14789
  misc_feature (1)..( 3000): 2750-1469P.txt file - cDNA_ID_2730911; gDNA_ID_2684225; Annot_ID_137554

SEQ ID NO: 27235 - DNA, 3003 bp, Unknown
  misc_feature (1)..( 3003): 2750-1469P.txt file - cDNA_ID_2730927; gDNA_ID_2684225; Annot_ID_137549
ttctaacaattttacaatgtgctgaaaactcttgtttctatttcgcaaaggtaacgtaacctaacctttcttagacaacaatgtagggtttcgagtttacaaaacgaaaactgaaagcgcaggcattgaggaaatcaatgaaaggattaggaacagatgacacggcgttgataagaatcgtggtgacgagagcagaggtggatatgcagttcatcatcacagaataccgtaagagatacaagaagactttgtacaatgctgttcattctgatacaactagtcattacaggacttttctcctctctcttttaggccccaacgtttgagatctctttctgtatccaatcccaaaattaactttgattctctgtatcttacaaaattacttgcaacaatcttgaaggatattataacatgattatgtgtaagatcaaacaaagagataattgagaagctgttctttgaagccaagagaatcactttcaagttgttaactactcaattcaacagtaactcagaattcatttctaatcagattccactttgtgtatagtttgataagttttccattgaggcaaggatgataatagctccttgagtaacttacagctatactcttcccaagaggtaaccgcgagagctatacccgtcaagtcgagtgaatcctttcgatcctcaccagagcacgaatatccaaaagttgtggctacgaggttctcatctagcaggaaaactgatttcagggcattgatagtttccaactgagagtgggacatagctttcacctcttctaatgtgtcattttcgacattagaagttacgagttcagaagctttccaatggtagaactgaacaacctattatccagcaaaagagaagaaataagcatttgattatatatgatgaaaggaagcccgtttaacaagacatttactatatcaactaatcactaacgacctcgaagaaactcatgtgaatgtcaaagagaaaagtacctgaagagcatgaagaatgttggcaaattttcgggtgagtaactttcctcctttagctaattgtagtggtcccataagttgttcagaggcatccgtagaatgatcttcgccttgtaagctatgtacatcaaaaccaagaagatgcaacctcgcaacgcaaacatcaaaacctatgttttgattagaaccatcttgatgaggacagaaccagtacatgttagtggatgcaggcaaagggaggcacacttcatgtgatgtacattgtgaaagacgagaaagaagcttggaatcttcgtcatgtgatgagtcccggctaaaccagagtgcaagagtcaatctttctccatctgttacctcatcaactgagtgaatattccggtcatcagctgtgtacatgataacatcctgctcaagaacacaaactcattattcaatctaagtaaccactaagccaactgaaaaagaacaatacttacaccagccgatggagcaacggttactggttcaccactctgaaaacgaaaaagaccgcctatgaaatctttctcgtaactattcaagtaacaaactgccttcaaaccaactaaaaaccaaagtcatacacacataaaccacaatatcaacaaggacgtctatagattacaaaaatgagagtgaatacgaaccgcaaaatctctttgttttagatatgatctgttatcatcactatgccaaccaatgctagctcctttgcaccaactgattcaaaacaaagaatcaatatttactcttttttcctgacttgttttgttaaagagacaggggagagagactaacctaatcaaacctgtgaattcaataaaaagctcatactcacacccaaatgtttcctctatcttctctttcaacctctctgttaactcaacacaacaaagatcatccctttgaatctcacaaaagtaagatataaagacaaaagcgaaatctttgagttttaaaagattgacctctaatggagacaaaagggatgatgaggtgaggagaattagtggcaatgaggtgagagagagtagtggagaagacatttggtctgtacccaattgtactgctactcttgtgtataagctcaagttcctgtttttacctcaaaattaaccaaacccacatgattagacacaaaattaagcaaaaaagggacaaccttgcattctgccggcgacaggaaattgtgtagaattagccgagggtgctctttctccgacatgtctctccggtttgtgtaatgaatccaatgaacccagatcgattgtggttgtttagggtttcagttaatcctgttcttacttgtcttgtctatttcggtgtaccaccgcttttggaattaaactgaaattagtttgttaatcttttttttcttttgttcattagaataattaattatatgatgttaaaaaaaaattattatgtaagaaatgttaagtcggtaagttccaattaacttaaaccggaattttagaagacaaatgttacaaaaacttttgaaaataactaatcaaagtatcaaactgaggtaaaatgagattatactaagtgcttaccactacaatcgaatttaagttcttactaaacttctaatgttgttcaacttttgctatcatgaaatcctctaccaaccatcgatttttgttcattatttacatatttctagttcaacattatcaccaccacatttgctcttaaacataaccgagaagacaagtgttaaaaatctcaatttcctaaccaccagtctaattgttgactactaaaacgtctgtaatcctctaatctctaactcttaacacatattgtttaaagagcaaattaagaattaagacaattatgaatcaccgatacacttattaaagtactttctcttgtctctattttgacttttgagtggtactgataggtacaagaaacacaacaaaccctagatttatcttcatctctctcaattctgtatcaagcaaagacggattcaacgatg

SEQ ID NO: 27236 - DNA, 3000 bp, Unknown; identical to SEQ ID NO: 14786
  misc_feature (1)..( 3000): 2750-1469P.txt file - cDNA_ID_2730931; gDNA_ID_2684225; Annot_ID_137548

SEQ ID NO: 27237 - DNA, 1739 bp, Unknown
  misc_feature (1)..( 1739): 2750-1469P.txt file - cDNA_ID_2730950; gDNA_ID_1591533; Annot_ID_151125
tacaaaagaataggataacamaactatatatatatatatatataacgtagtgtcaaataaattaattagtgtgttattttcaaatatacccataaaatccttttattttctaaagaaaacacaaaataaataatcgaatttaagtatgatttttatccattatttttgccaaatagagggttctttactgcatatattccttaaataaaggaaagaggtgactattatcctaatttcttaagtaagaatgcgattgtgaaggttttgatatatccmactttacaaaaaaagaaaaaaaaagcattgcatgtgatgagaatccatctcccccatcctcccacccattctttccaactcaaccatctcctttctcttcctattaataaagtatcatcttctttttgtttctctttttattttttaatgaaaaataaaacttttaaaaaaatttgtatttacttcaattttcttacagttccacttggatagacaaatgccctttaatgagatggtggtggactttaagtatatgttatacgcacaacacacacacacacacttttatagacatgttttttaataaagaaaattctttcgaacatattccagatctctaatttttcttttgtttgagatgttatatagaattggtctcagctgacactcaaaaaccagatctgactctagggttttgtgtttgttttttgtttttcttgtaagaaaaactatatattggaaattttctgattcgtctcacttgtgggcacagtattcttatttgattaaaacctatttcttatataaaaaggcatgagatgatggcaccacattgtatatttgtatatatacggaaacataaattgggtatatgcatgtgtcttatattcaaaacaaatattctcaagtcccttccctttttaatttacaccagccctatagctaaaggctacacatatatacatttgtcaccattaaaaaacatgtactgttaaacatcaaatttccaagattccgtttatatttttcacctatccttttttttatttatctttgaaaaacaaaacttactcactctgatcgaatattttatgatatgaaataataatgacttgtaattgttgtgtagtgaaaggggatgtttttttgtttcttgtcctgatgctaatgtgggctccaagctccttgtcccactctctttatatgtataaacatctctctccatagatatgttttgtgtttgtaaacaaacagtgtacagatagagaagagagaggttcataactactctgaagaagattgaagcaccaaagaccatacaatgcatttctccatctaaggtgagaggtcaatgaaacaattaacaaaaagttgaaagtttcatttatttttttcttttccaagaaaattataaaaagttggatagtaaaagggaatagaaaagctattatccctttatgtgagaaaaaaaataaagatgatttcagaaaaacaaagccctttgtttctctctcttaactcatcttatactttcttcttctattagtaaagatgagtactctctctaccaaataaataaggaaacataaaaaacaatctctccttctttctctacatgaaaaacaaaagattcctcaattttgttcttatttttcatttagtcacagtacctctctcactataaaccacactgtcttgagataaaatacaaaaagagaagagattaaaaacctcatccgatg

SEQ ID NO: 27238 - DNA, 3000 bp, Unknown; identical to SEQ ID NO: 14784
  misc_feature (1)..( 3000): 2750-1469P.txt file - cDNA_ID_2730950; gDNA_ID_2684225; Annot_ID_191929

SEQ ID NO: 27239 - DNA, 3000 bp, Unknown; identical to SEQ ID NO: 14784
  misc_feature (1)..( 3000): 2750-1469P.txt file - cDNA_ID_2730950; gDNA_ID_2684225; Annot_ID_137543

SEQ ID NO: 27240 - DNA, 3000 bp, Unknown; identical to SEQ ID NO: 14505
  misc_feature (1)..( 3000): 2750-1469P.txt file - cDNA_ID_2730961; gDNA_ID_2684226; Annot_ID_137588

SEQ ID NO: 27241 - DNA, 3003 bp, Unknown; identical to SEQ ID NO: 27105
  misc_feature (1)..( 3003): 2750-1469P.txt file - cDNA_ID_2730977; gDNA_ID_2684226; Annot_ID_137583

SEQ ID NO: 27242 - DNA, 3003 bp, Unknown
  misc_feature (1)..( 3003): 2750-1469P.txt file - cDNA_ID_2730986; gDNA_ID_2684226; Annot_ID_137581
gctatgggtctgaactatagcagtaagttccaccatgggagatacattgctgcgttcaatgtgatagcattcaggtgcatgaactttccatatggaaacgctcccggactttgaaccaattgccaaaagagagaatcttaacatattcccacaagaactttctgatgagaatcttagaagagatgaccaggcaacggaatgggaggataataatgcctcacgagacacatacgtttgcggacttatctcttgactgcatttttttagagctttaggcaaggaacgacgatcttggccattgcttgcctgtttatatacttcaatctcaagtacctgggaatataaggaatcgagttagatatgagtacaatgcgacgatttgattcttactagatgacacttgagagtgggagtgtcaaacttctaagaaccatatggtgtgaacgatgcattaaaggattcaggtggaattcaaaagcatgacaagattcgaaatgcatcaaatcaatgacaagacaatataaaaaccacacacatgttctttctataagaacactggagggaggtacaaaatgtcaaaatctactcaagatactaatttacttgatgaaatgacctagtttcttattaattactaatcctaacaaaaagagtttccacaaaaacaacggataagatacaatctgcaggaacagagttagaatctgaaacttgttacagaatacactacaaagtgaggaacagaaataagttggaggaatcatgatagtattttttcaaagcaatgcactacaacagaaagaagttaagagatatgaggacttacattatgctctgctttactgtcttgcttggaacatgatgctcgatctgtataattcttttcatgcaagttgctaaaacaaagaaagtaagttagtcaagtgatcaaaacagaaaaaagaatatggaaaacaatttctcaaaccactggtatgcatctgacgaaattgaagagtgaaagaaatgctctttacatgttatttgcacttgtttttcttcgcttgcgtgccttcagacttgaaatcctttcatcctcctcatggtcatgttctaccacttgatcctgttataaaagagcacaaatcatttcaataatatagtttggataaaaatattatgcagacaaacatcaacaattccatcaaaacgcaataccttccacaacaacatttgtccattaataaaggataactaaagatataaacgatttgtttagatgcgtctttatctaaatgtgaagagtacgaagtataaactatctacatatcccttataggaaacacatacatatagtttgcgggagtagtaagtcatccttcatggttatcaaacttccactgaaaacactttagagatacaagttaccttagataatgaagtagaaggatttttggactctccaaagttcatgcttgatagattctcataaagcattttagatatatcaacaatctgcgaaagagaggagaaagcaactttaaatgcataggttagttataaaaggcgaaagagaatttacgacctacctcaatccactcagcacagaaatcagaatatggaggtcggtatagcttaacccttccttccgctgtgcaaacagccagtaagcacctgagcagagttatttgaatcacgaatttaggaaatagagaaacaaaacaaaactgaacatgttacaagaaatacagtacccgtggtttggagacattcctatctcagaccatgagagagatcgaacacatggacttctttcccgcttcaaactcgaaggcaagagtccaccagttagcaaatctacaatcacatcatcactcacattgttatccgaaacttctgaatgatcgaaaacacagaaaccaacagaaatttggtctacaaacacacaacttcatgaagaactaaacagttgcaaaagattgaatttttatcttcaaatctgaattggcaaacatacaggcaggattttgaaatttgatctgaattttcataaaacaggtacaccaaaattctgtatttatcaataaaaaaaacagaccttgagagcgaacacgaccaatctgataaagctcggcgtcagagattgtgatcaatccacgagggccagtaggcaaagccggattctgacaattacaaaagtcatcaatacaatttaaaaagactcaaactttaacctcaaaaaacgaagcagaagaaaacttacaatgatgatgactagatgaccagcagcgacggcgatgagattttccgatgaccaagcgacggcgttaggatacgacggtgaagtaaccagtgaagcttcctgaaaccgcgacgccatcaaaaagtgaagatcaacttagaattttggagggaaaataaaacttgctctgctttgcttttgacaacgaaacgaactgatgaagttgattcagtacggaaaccctagttcgaatcgcagtgacgcagatcagatcctcaattatttatttcttcccgagtttaacaaaaagtcaacgtgctcgttttttaaaacggtgtcggttagatgatgggctaagcccaaatccttttgagtccaaatacggagaccagagttcgaagcgcaagtgacggctttataatctctttatttaataaaacgatgtcgtttttgcttaagcaataggcccaaataagtaaaaagttcaaattaagggttttgaaaatattcgccgtcgccgatgtcgggaaaccgaagaatttgaggcaaaaaaaattcgtatttccggtgagtctgaagttcctgaattataaatttccgatctttgttaaattcaccattcgttttcctaactctccgtcggcaaaaggcgacacaatgaagcacatataaaactgaaaatctataggaatatatatacacattataattctctaattgcattggcattggatttatctctttgttttacagaagagagtaatctctggaaagaatcaatg

SEQ ID NO: 27243 - DNA, 3000 bp, Unknown; identical to SEQ ID NO: 10548
  misc_feature (1)..( 3000): 2750-1469P.txt file - cDNA_ID_2730994; gDNA_ID_2213660; Annot_ID_132542

SEQ ID NO: 27244 - DNA, 3000 bp, Unknown; identical to SEQ ID NO: 10548
  misc_feature (1)..( 3000): 2750-1469P.txt file - cDNA_ID_2730994; gDNA_ID_2684226; Annot_ID_191991

SEQ ID NO: 27245 - DNA, 3000 bp, Unknown; identical to SEQ ID NO: 10548
  misc_feature (1)..( 3000): 2750-1469P.txt file - cDNA_ID_2730994; gDNA_ID_2213660; Annot_ID_181864

SEQ ID NO: 27246 - DNA, 3000 bp, Unknown; identical to SEQ ID NO: 10548
  misc_feature (1)..( 3000): 2750-1469P.txt file - cDNA_ID_2730994; gDNA_ID_2684226; Annot_ID_137579

SEQ ID NO: 27247 - DNA, 3000 bp, Unknown; identical to SEQ ID NO: 10549
  misc_feature (1)..( 3000): 2750-1469P.txt file - cDNA_ID_2730998; gDNA_ID_2213660; Annot_ID_132539

SEQ ID NO: 27248 - DNA, 3000 bp, Unknown; identical to SEQ ID NO: 10549
  misc_feature (1)..( 3000): 2750-1469P.txt file - cDNA_ID_2730998; gDNA_ID_2684226; Annot_ID_191987

SEQ ID NO: 27249 - DNA, 3000 bp, Unknown; identical to SEQ ID NO: 10549
  misc_feature (1)..( 3000): 2750-1469P.txt file - cDNA_ID_2730998; gDNA_ID_2213660; Annot_ID_181860

SEQ ID NO: 27250 - DNA, 3000 bp, Unknown; identical to SEQ ID NO: 10549
  misc_feature (1)..( 3000): 2750-1469P.txt file - cDNA_ID_2730998; gDNA_ID_2684226; Annot_ID_137576

SEQ ID NO: 27251 - DNA, 3000 bp, Unknown; identical to SEQ ID NO: 10553
  misc_feature (1)..( 3000): 2750-1469P.txt file - cDNA_ID_2731007; gDNA_ID_2684226; Annot_ID_191980

SEQ ID NO: 27252 - DNA, 3000 bp, Unknown; identical to SEQ ID NO: 10553
  misc_feature (1)..( 3000): 2750-1469P.txt file - cDNA_ID_2731007; gDNA_ID_2684226; Annot_ID_137571

SEQ ID NO: 27253 - DNA, 3003 bp, Unknown
  misc_feature (1)..( 3003): 2750-1469P.txt file - cDNA_ID_2731025; gDNA_ID_2684227; Annot_ID_192023
atgttattttgtctaattatagtgtataaataaatggtatgtcatttgaagaaaaacctgattttttcacatcctactaataacttttgtgatcagtgatcactaaatatatttatgtattttcgtccaactcaatggaagttgtttagaaacaaaaaacttggttattcacttaactagagaaaaattcactaaattgatgcgaaattaaaactttcagtctccacaaagataaaaagaaacctcgttcttgtcaatcgcacaagtaaaaaacaatccattaacggtaactaacttctaaacgtggatcatcaccaaacgctaaaaggaacaatcactcaaacaatgcaaatgcacacaatcatgtgaaccaagtcaaaacaaatcttcgttaccgtacacgtgtcttatctaaaagcaagagttgtttgacgatctcgcgtgtggttgaagcaaggcattttcgcgtttaaggcggtccagcactctctgatatttttattatcaaactataaaaccacagaaaaaattataactggaatttaggaacattaaaatgttattacaatattacggaaaaatctcttataccgatgagatttctcacgggagcaaaggggaccgcttgaacgtgggtagatgataacaaaattaaaataactatatgaaataaaataaattattttagtatttgtgagacagagaaaaataaaataataataaggattttttaagatctaaaagataaaaatctattataagatacctcccacactccttcacaatctaataataaaacattttctgaattgttttatgctatactttagtggtgggacattaggattgaatgaaaatgtaaagatagtgggagctattgtttagtgattttaaaacttatttcattcttacacaagatctatttgttttatatattaaagtgtattcacatgccaattatattttatgattgtttgcaaagaatgcggtagtttatgaattattatgactagtagtatgtttttagattgagttatcgaatgacacgtagcttattaccattaacacatctgaaactttttttcagatctaagagatttttatacttataattactgagactgtttattatatattttttattaactctaaacgtagttcaactttttctttataatttttattaactctaaaacatttaatttaaaaaggattattttggcaaaaagaattaattaaaatgtcgttttaaaacttaagaccttaaaaaaaaaacttttaacgtgttttataataaataatcttatagatttttaatgcatatgttttataaaagtttcagttttctttttactgttttaatagttagactaaccaaaaaaatgaaacttttgtgtaaattttcttaaaccaacttttaatactatagataggaaagagtagtatgtaaaacacatacacgatatggattccaaattgttttcctctcttaaagatagacaagtatgtgtagttaatgaattgtctcactaccatccatgcatatctatcctaatttaaaattcatgatgttgattaaaacaaattaatactactagttgttgattaacagttgtttccacgaaaatgagtttttgagatgtaacagttggttactatgctcagttcccaaaaacatgaccaaacataattttgtctttcacgtgactaattactgctcaagccaatgaaatgaatgtcacatcagcataaactctgatcaattagagtcaaacaatggcgtgtaatgtaactatgggaacaaaaattacaagattttttttataatttttttttctttgaatgttggtatgggtattcgaacaaaatatcaaaaagtcactatttttgttacaaatggaatgaccacaaaatctagtacccatgatacaaaaaataatcatataagcacaatataattctttcaaatatacaaatataaggtttttaatgattgtaacaaatgacactaaataaaatactataactacgaaatagatcgttttatttaagacaaatatatatacagtagttgtaactttcttatactaaccgttacaaaattgtgtattagcagaattttttttttctatctttaaaatcagaattagcataacattcttatctataaatataagaactgttacatatgtccattacaactagatatatttaatccgaataaaccgatttgaaccgaaatactcaatccgatttacaactagcccaaactttttaaaaaaaaatcttaaaccaaacctcactaatctagtcagtcacacatactacaatccctacaaataattcataatatatatcctttctatatttaaccaaaaccaaatcaagtttaaaaagagaaataaaaatctcattttccgtttgatatttatttcaatacaattaaaaaataaaaaatttgaattaaaaaaaaaatgcctgtctggatattattattatcataaggttatataacatggccctataaattgaacaagggacctctccaatggccccttctctcgtccttcttcttctgtctaacaatacactaccacacactttcacgctctcttctctcacacctttcttcttcctcacccaaaattcttctctctatgttcttcttcatcttctagctctctcatctcttcttctcgccatagcttcaccttccttctcaagctgtacagttaaagcttaaggtattataacctcaccttctctctctctctctcaatctctcttcacttccgtcgatttcttttatcaattttcttagatcgatgaatctagatctttcagatctgttattgacggatctgtttctggaaattttgattcactgttatcatcatcatcgttgttcttacgatttagatttgatttttttgctcagatctaatttcaaattttcatgtcaacagattaattttcgttaattttaaattcgaagaaaagatg

SEQ ID NO: 27254 - DNA, 3003 bp, Unknown; identical to SEQ ID NO: 27253
  misc_feature (1)..( 3003): 2750-1469P.txt file - cDNA_ID_2731025; gDNA_ID_2684227; Annot_ID_137596

SEQ ID NO: 27255 - DNA, 3000 bp, Unknown; identical to SEQ ID NO: 14826
  misc_feature (1)..( 3000): 2750-1469P.txt file - cDNA_ID_2731031; gDNA_ID_2684227; Annot_ID_137594

SEQ ID NO: 27256 - DNA, 3003 bp, Unknown; identical to SEQ ID NO: 21921
  misc_feature (1)..( 3003): 2750-1469P.txt file - cDNA_ID_2731041; gDNA_ID_2684231; Annot_ID_137624

SEQ ID NO: 27257 - DNA, 3003 bp, Unknown
  misc_feature (1)..( 3003): 2750-1469P.txt file - cDNA_ID_2731064; gDNA_ID_2684231; Annot_ID_192269
gttttctttatttgtttaagcttgtttgatgttaaagtatgttgttttgccttttatcttatctgtgaatgttttgtttacagcttcctgattattatgagattatcaagaatccgatggatttcaccacattgcggaagaaattagaatccggggcatacaccaccttagaacaatttgaggcaagtcttgtaattgaatccctctatacatttctgcgctttgctttagctaaaatggagtgttcacctttcatagttttggttcttcatattgttaagtcttgttcaagagtttctctggtagtaacaacatcgtgtttgcctacaagcgtgtaaggttttcttagttttcctagccacaatgtgttaattctaccatgagaaggtgcagatatactgttaaaagtgaaagccttgtggggtctgaattgtttcgttttgttgcagcaagacgtatttttaatatgtacgaatgcgatggagtacaattcagcagatacagtatactaccgacaggtttgtcttggcttatataaacttgctattttacttccttttgttataatccattctctgatagtatatctatggcatgacaggcaagagctatgcttgagttggcgaaaaaggactttggaaatttgagacaagaaagtgatggagaagaaccagtgtcactgtcacaacagccgaaagtagtcaaaagaggccgtcctccaggctcaggccttaagaaacagcttgagcaatctttgattgatcgcacgacttctgatatttctgctgatgcagcagcattcacttatgctggagatagctctagattatccggttcttacaatctaagaaaaaatcctccttcatatggattccgtcatgcagaaacttcggttagaatcaaccataatagcgagaaccaaagtggcttgttgatagattgggagaaggagtttccacgtaaagatctacttttctaatactaccttcttcagaccattataccaaatacgtttttgttgacataaaccattttgtgtagcttctgttgtgaaggctgtcaataaatacgggatgaaaaatgtcgacgagaacaggcgagatacctacaaccagaactctgcttccttgcaagattcttcgatttttacactgcttgatgataatttaaaacaattaactccagtacgtgcttagcaacttaaaagttaaaatatttctccttttgttctaagcaacaaagaatctgaccattgtttcgttattttaccaggttggactgaaagctgaatatgggtatgctaggagtctagcacggtatgcagcaaatattggtcctgttgcttggacatttgccaatgtaaggattgaaaaactgttaccaactggaaccgaatttggtcccgggtgggttggagagaaccctgagaatcctcctcaacagcaaaacttaatgtcgggaaagcaaaagtgttcgaatgactatgcatctgatgatcatcatcagtcaagtagaatcatgtctccatcaacctctgtctcaagctccatcataggaaacatacattcttcccatgaaagcaaagagtctgttcaggtattgaatcaagaaaccgagataaatggtctagtccgtggttccagcggatttaaccataaaccaaaccagatgctggaaacagctggctcgcagcaaggcaacataaaacaggaatttcagcggttgccaccagatctcaatgctaggctttcctcaccaaactcaccaggctctaaccaccaggcaggttcatcgcagcatccggatttggcgttacaactctaagtaattcctactaatattgaaagccttaccgatatatgagggagaagaagaggcaaaggcatgtgattcttgctacaaggttgaatatatagggaaagtcttatgtacagattgttgcaattttctgatttttttagggtaaaaagaaaaagaaaactgatcgataagagtactctcacaagatgtatgactgtaaaaaaatttgtacaatttcctagtccatcaaactagagtgtaatgaatgtactcgggattgtatatcatgtacgtttttgtttggtcttgtgaatctgtgcataatatataatactaatatttataaatatcgaaacttaacaggataagtagaaaaaatgattacaaagaaaagtagaaaaatattttgaaaactccgtttgaaaagattatgatagctccctgtgattaatcaaaagtcaaaacacagttattaggatatgtttgggggattatgagaaaccgtgtctcttaaatagtcagtcttacattttgataatgttatatacgttacagtatataataagtagacagcttaaattagttccaacggaaaaaaaaagaaacaaacgttgaagaaacagaaggaaggaaggaagaaagaaagaaaacgacgcgcagttccaaaattaggatcatattggctcctttaatttctcttccgttgccatttcaaatattttcacagttgcttcctttcaccactctttttaatatttctctcaacatttttccattagcatataagagagtaaaaaagcctgtttcttcttcctcttttagtatatatataaacaaaccattcttcaccattcaaaatgccatttgtataattttagtttttctccacttttcagattcttccttaaggaatcattttcccatttttctggaattttaagagagaaagagaaaagctctctttcccatttataatcccaaagacacaaatcctaggttttttcttctttcttttattacaagaaaccttggttttttgtttttgtttgttctgtttcgtgtgtagggttccgggagctgcgtttgatgataatgttggacatcatctcaaaccagctccgtctctgaatccattttcttcaaccattgttgttgtctttacgttaaataatatcatctttcacgagtttattaaggaaaatg

SEQ ID NO: 27258 - DNA, 3003 bp, Unknown; identical to SEQ ID NO: 27257
  misc_feature (1)..( 3003): 2750-1469P.txt file - cDNA_ID_2731064; gDNA_ID_2684231; Annot_ID_137615

SEQ ID NO: 27259 - DNA, 3003 bp, Unknown
  misc_feature (1)..( 3003): 2750-1469P.txt file - cDNA_ID_2731068; gDNA_ID_2684231; Annot_ID_137614
tatgaagaagcttgatagaagctaaccgcaaatcatcgttctcatgtatctcaacaaactgaaccaagcttatgatggcagctgagtttctgatggcagaaacaacattaataaccgagtttggacagctagtgagtccaacaagaaccgccaacagctttccttggatttctggaccagtgttgcttgttagttggagaaggttctccactatttcctctgaaacaagagtttggtgatgaggtccaacaggaactttgtcgaagtcgtacccaatgttcactatattggcaagaatagttgcagagacttctttaagtcggattggaagctggtttggcccaacatagaacaagtctttgataagcggtgggagaattccggtgttgattaagagtttagcactcccttcaaaggatgagatgttgttaagagctcccaaagcagcttcccgttggctcatgtcgcgagttctcataagatcgataagagaagaacccacagtctgagccacaataactttcacatcgttatttaaagcaagaaccccaagatagaaagccatggaaacttttgtttccggtgaacctgtagatgcagatcatgttacatagttatagtttcattcaaaccaatcagtgaaaatcagtttattggtaatgaaaggttagtggtttggtgaaataatcaccttcaagaagtttagcaagaagaggctgcagtctaccattgatagccatctgtcgaacattttcctctgacctctccaaatttgtcaaagttttatcagctttctcaacagttgaaacattctctgatttgctgcttgtcagaccaaccaataagatgattgctccatggattgatccaatcttctcgcataatgcttcagatttagagagctcaaacaacacggaaacagctgcttccctcccctttgatggctcttgagacaagaacttaactatagtacgcacagtgtctccttcagctactattgcctgaaacacactaaaaatcacttacaaaggaatcaaagacaaacagagagacaaacaaaaacacaaacagagagataaccttgctctcttcatctccttcaacgactacttgaagagtttgtagagccttacaccgcacttcatgactactactctttagcatatcggtaatcaaccgaacaagctgaggattgcacacacgttgcctaattttacgtatattcctacaaatctctctgacattcttcaaagccagcaaaatattagtctcagcatttcccaaataaagtgactgacgagcaatatcaagcttcaaagcatcattccttgctctccactcttcaatagtgttacgtaaagctatacttggacttagatcagtgatactcaactccttagaagttataggacaagatagaggttgaccgttttcacgacattcttgaaaccatttctcaatagcttcacgctcaaatgtctgaccattctctaaagtgacaggattatgcataacttgctttgtcaatggacagataaaagcttcgtatatgttatcaatccctggctcgaattgtgagctgttatccgattggcttccatcccaacttccacttccagccatctgatgaattgattcttctacaccataataagactataatgtaatcaaagatcttatataccaaattaagctaagttcttctaccttttatgaggaacaacattcagtagctaaaatcaaaactataccctaataataaaggcaactaatttgcttctaacaatcatcattcgtttaaccctaatataggaaatattaccaaatatagaattttgtttattctcaggatagtaattactaattagtactagtatataacaaacacacgaaaaaggaagattaacacacgtaccagttcaaaacaaaagaagccctgaagaagctgtcttaaccaagaacaaaggtctttagcttcttcttctgctagcttgagaaattgagaacgatctctggttaaattcaaaacctttgaaaagaaaacgggtgaaatcgagtcaaatccatgtaacacaacatcggtgtagtcaagtatgaatccgccagagatatttttgtgcctgaatcgagaccggaggaagaaagatggaaactagaagagagtttcagtcatctaagcaaaagatgggaaagaaaaaacacacaccgacaaaaaatagaaaatagacatataccaaaaagctttgacaattattgagaagtcgtcatgggaaaacacatgtgaacaccgagactacccaaaataaaacgttttttgtgtcattttaaatgatgttaatagtcaaaaaaaaaaatcttctttatcgtattttcaatgtactaaacattcgctgttggtttcattgtttctatattaaaagcttaattcttcgatctttcttggttaaaaagtcaattatctaattattggtctcatgactctcatcaataaagttaaatagttaatgtagatgttttgcaattttataaacaccactggccaaaaaaaaagaaagtagactagttactgtagttgtatgcaacaagatgttataaaaaaaggaatgatatagtgattagtgagtaacaacatcaaaacaaaccattaaactacatggtcttattacatctaatctataatcttcaaaatcatgatctaatcaccctagagattttatgtagtggcccaaaaaataaacatttgcagacaatccagacatctatatggaattaaggcccaattggcccaactcaaaaacgttatcccaaaatgatccatagaatgtaaaccacgtgtattgcagtcacgcacgagtaacccgtgtccaattttggtctgcacgtacgaactcactcacacatgtgtaagcaaaaaatgaataaacacgaaacgactgtttattagaaagaagagaaaggcggagaacaatagagagagagagagacaagagaagagagagaatg

SEQ ID NO: 27260 - DNA, 3003 bp, Unknown
  misc_feature (1)..( 3003): 2750-1469P.txt file - cDNA_ID_2731072; gDNA_ID_2684231; Annot_ID_192266
tagacttttacgtataattaattgaaattaagtttagatgctaaaacgagttctattacctgacatcatttacatacaaagatgatgtctttctttctttctttttgtgaaaacacaaagatgatgtctaaaagactaaaaagtagaatgagatgcatgaatgaatagaagataattgcaattactttcaaaaatatctttacaagttggggaattaaatttaaaagtatgtaacaaagatttgggataaaacttgtcacatctagtgcagtttaattaacaaaatttcttttgggataataaaaccaaaagcgacctcatcacttaagagctttcacatatcgccgcctctaataaaaacattattgtagatattataattaatcatacatagagatcacgtggaattttgtaaaagtcactaacaaatctaacgataaaattggtgacttgtctcagtctctttttcagtttttcttttaccatttgaaaacgatctttgatcttttcattttccctctttttgagtgatgatgatcagtaagcaaatcttgagcataccccatcttcggattctgaagatcaacactctttttaactcagattttggtactgatgttgatgttccgagcagcaccatctcaatttcaactaaaccaaaccgctctgagttagtttgtttttcgatggtccgggtttggaattggttagtgaaatcatgacgaatttcggcttgatggtttagcatgtttttaccggttaagttatgtacggttcatgatcaatggatctctgagggatctaggagtgtttaagtctacttataaagtcaaactacatattgctacgaaccctattatccgacataggaacaacgacatttcctttaagagatgatgatttggaagatctctgaatttgattaattggtagaattaaaatgtgttcatcagcagtggtatcaatacatttctcagatgatgattgaaaaaaatgcagttacaggtcataccgcaagttccattttcccttcatgttcgcgttgagagtccaattgttttctctaatctgcatataagggacctgaaaggaagaggcaaacattgttctgaagaattaaaaaaaaatggaaagcatttttcgagttttacaaatgatataaagcctgaaaacgatgacaatcgatttcaagagtgttggcttaggcaatcatataagagtcctctaagcaaatagatggattatcaatgatactatgaaatgaaaagaactttggtttcaacaaacactctgctttgtgaacttagagattaaaagagcaaattttggaagagtcaacacacttccaggtacgagagagataccttatcaaacatttcgtagccaactttgatccgtacatcctgatcttccttgaaatccattatgttccaggcaaattctgctgctcctttggggttcttctgttagcacaaaatgatgacagttccgttagggataatacacaaggaagaaacataacttcaaagaaagttcccgagaccaagaaaaaaacatcgaacctgatttaagtcctgatcaatatcacaccgccctttaatattaaaggttacacgcttatcagctcttacaggaaactctttttttccgcgtacaagacaccgaagcttttggcgcttatcataatgcaatcctaccccaaggcctgttgaagcctaagggaaatttgtaacactatattagtattagtctacagcagaaaatgtttcacggtgacaaaatagaagaaacagcagaaaatgaaatcaaacctcaggaaaaaagtgtctaatcatcgcacagaagtaactcggagccccagttccagtatctaactctccatgaagctagcaccaaacaaaaaaccatcaaggaaattaagaaatcagaaacatgtttgcaagaaacgaaacataatccggctatactgtagccaaagccaaacaactataccacaacaaccaagctgggaacatacactgacaaataataaatcaagattcccggaagcatatggatgtttctttgctaataaccattataaagaagttcaagacacaatttttttcttatgcctaacacaagaagtctagaacctagataacattctcaaaacccaaaaccctaacagcaaaaatgatgatacagaatcctacgagaattccaagcagagagcaagtgtgtaagacacaaactactcctcaatttggctcctgcaacagctcaatgctagaaatttgaacaaaacctaggtcacaatttctctcagattaggtttcataactccaagagctcctttaaagtaatcttatcttcttaatcaaaagttcaagacaacacagttcacttatgtaaaatgcacacaacattctccgaaacacccaaaataaaaccctacatatcctcaaaagcttaaactttgcaaatcccaagagacttttgggcattaaactccagagtaaagaaacttcccaagaaattgaatagagttaaagtcctccatagcaacaagaatacgaagcagacaacaaaaaacaaaattttcacctgtaaatgggtttttgagttcaccggaaccttctctttggcatgaatcttcatagacttggaattgctggtatacctcatagaagtctccattttcctcaaacgattttctcgagaaaatcgcctagaaaatcctcactgagtcaacaaaaccaaaacctcacctagtttttgcacacttcgactactgtatcatcctctgcaccaaggttcaccataatccaaccaataactcaccgccagctgtcctattagtaaaagagccaatctagtcccttaagcccatgtttagggcccaatatatatgggcttcgactagatccgacccggggaaatagccaatattttgttaaggtctctggttctctgagtgagtaagctagttcgaagactggtccgaaaaatctgacaaggatg

SEQ ID NO: 27261 - DNA, 3003 bp, Unknown; identical to SEQ ID NO: 27260
  misc_feature (1)..( 3003): 2750-1469P.txt file - cDNA_ID_2731072; gDNA_ID_2684231; Annot_ID_137612

SEQ ID NO: 27262 - DNA, 3003 bp, Unknown
  misc_feature (1)..( 3003): 2750-1469P.txt file - cDNA_ID_2731082; gDNA_ID_2684212; Annot_ID_191560
ataaagctttcacatcaaacctaacaacaaaacaagaatcacacaataacttagtctcagcttgtggggagacaaaaaaaatcacaattgaagattgagaaagtttcaagaacactaacatgttatcgtggcagagacaaggcaaaccatttaccaagactacaagacataatagtaagtagcagagtgtcctgtttaatggaaaatacgattcttttctgattccaatcttgtaatcagcaaccctgaaatcgtagattccaacaagtacaatcgattttaggctccacagtaccttacaccaatgagaaccaaagcaaactaagatacagattctttaattacgtcgtacgagaaaacatcctagtggacagacaggaccacattattgcttagaccttggccctaatgaaacctgttattcagtagctgtttcaaaattagatccaacatatcatcaagcttatcgacatagcccggtttagcctaatttggttacttgaaacttttttttttttttttttaacttgaaacttttatcttctaaacatttttcatttttttttaataaataaaatgaaggatttgtgcgtttgtgtgaaggaatctgaaaacataaaaccaaaagaatataattggaggagcaattcaatcaatcaatgggttttttaatagttaatttacttaaggggaggtaggttttatttgtctgcttacttcgagtaaggtcgagatccaccagaacgtgacaatgtgacttccactgcttcaggacaaatcaaatatgaacctacgtcacaaaattactattataacaatttatccttatttattctttcttacgactatcttgtcttttgctatcatttacatttgtaaaaaacatcgtgatattattatttactagtatataatatcaaacttttcacgtttaataaaaattattaatttgaaattattcatttttgaatttgattgatatagttgacgaaaaagagttgttagtgtaggaagtttgtccggatatgcaattttttttttgtaacgtgtatcatctcgttaagaactcatatgtattatatgaacaaaatcaatcatgtatattaaaaatggtttgccctaaagatattctatgtttttttcgtgaataggtgttaaggatattaaacaaaaatacccttatttattcttacgactatcttgtgtctatagcactctagcttctacgttggtatcatttatattttaaaaagattttgtgatattattatttactggtataaattttaaaatttctcacgtttaataaaactaaacatattaataatttaaaattattttacttttgatttttattgatatggttgacgaaaaagagtgattagtaatggaagtttgtctggatatgcatttttttttcttcgtaacgtgtatctcgttataagaactcatatgtattatatgagccaaatcaaatcgtgtgtattaaaattggttgccctaagaaaattcaatgtttctttcgtgaaagaaagtctattttttttatagatttgattctcttcttgggatttccacattaaaattattatcttagaggctcagtttgatacatacactatattttttatatattgttcaacgtatagtgactgaatggtagttgtttaaaaggattgtgtaaacgagttggatagccaaaactatgttaacttgatccttgtaaagtaaacaaagccatgcatcctctaattcaacaatttggtcccattaccccaagaaaatgttataaagaggttatctttatcaattacttgtaaacaggacattatctttataaagaaaatgatatacatgctgcatttttttggtttggtagttttacatgctgcattttgtacttgcaaccacttctatactaattgttttagataagatagtaccttcttgtttgatcacatcgtaaaaggatcggatatgttaaccgtctttttccaaacgttatatactcttcaacactcatcataatgtatggagatgtatcaagtatctcttacgaccattggtctttgcggcctaatttgcaacagaaagtcagaaatatccatactataactatgctatttgaaaattattcattttgactcatatataaagtagagttaattaggtgtatagccaaattatggatgaaaattagacaaatgatcatgacattcttttttcttaatttcccaaaagaattgtaatatcagaagggaaaaatacattccacacatagttagaacttagaagaggtccaatcaataggcggtaaaaattaatttgtaacggtaaacaaaaacgataaaggataatagtacaaactaattggcaattaatactgtttttggtcaaatatatatgtcacgacagtagatgaaaataccgtttttggttgaatcgttttattttttactttgtcttgaatcttgtctactcttcaataccgtttttcgttgaatcattcaaaaaaaaacagatctcctagtgatatgaatcaaagtttatcaataaaaatcttagtatacatttgcaaaccataacttcataattttgaataaacgataatgtaagacaggttggctcattagaaagcatatcaaattaattgtaaggacacaaatatctataattaatgcaggcttttatgaatcaatcatcatcattcacatcctcgtataattgtctaatttcgtacctcaaaaaaaaaacaacaacgtgaaaacctaaaattagatgagttacgaaaattaggcaaaaataaataaactaaatcatagtattacaaaacaaaatgaaaacgaaaaaatgaagaaaaagcaagctggtccccaacagacatgcgagttcgtctcctataaaactttgttaatctctccttcacacttatcacgccacctcaccacctctctcctctctcctctctctcccccctggagagattattcattccctccaatg

SEQ ID NO: 27263 - DNA, 3000 bp, Unknown; identical to SEQ ID NO: 14859
  misc_feature (1)..( 3000): 2750-1469P.txt file - cDNA_ID_2731082; gDNA_ID_2684231; Annot_ID_192253

SEQ ID NO: 27264 - DNA, 3003 bp, Unknown; identical to SEQ ID NO: 27262
  misc_feature (1)..( 3003): 2750-1469P.txt file - cDNA_ID_2731082; gDNA_ID_2684212; Annot_ID_137362

SEQ ID NO: 27265 - DNA, 3000 bp, Unknown; identical to SEQ ID NO: 14859
  misc_feature (1)..( 3000): 2750-1469P.txt file - cDNA_ID_2731082; gDNA_ID_2684231; Annot_ID_137603

SEQ ID NO: 27266 - DNA, 3000 bp, Unknown; identical to SEQ ID NO: 14895
  misc_feature (1)..( 3000): 2750-1469P.txt file - cDNA_ID_2731086; gDNA_ID_2684232; Annot_ID_137646

SEQ ID NO: 27267 - DNA, 3003 bp, Unknown
  misc_feature (1)..( 3003): 2750-1469P.txt file - cDNA_ID_2731112; gDNA_ID_2684232; Annot_ID_192299
aatttattcttcccttcttttaatgagaaggcacaaaattaaataaagagtaaaagtctattcaaaattcttggatcttgttacaattttgtttcttctctttattttcttctatatttctatgctataagtgatctgtttatcaaagaaacaaactataggttcataggatgttaagttcgatcgtgccactaatttagtcaccttgagtatatgatttactcacgtattacacacaaccttggcttaggattgtttttaattgctatcacaaatttagtcgattaatttcaaaactgacgttatattattaggatcactttagtaccgacgttaaagtatttcaaaactgacgtcaaaaatgtttttttttttttttttttttgtagtggatagattttatcaaccacaactttcccaacttttatacaagtttacatatcaaaaatactatatttatctacatttattcctaaataaaatcaaaatattttattcttttgccacacacttacaagatatcatggatgcaaacattatttttctgcatttatcgtatatagatgatagttaataacacagtcacaaactgaaactgaaacctctaacattgaaatattaaatatggatttatagatagtattttgacaaccaatgagttttctcttatcaatggtgttcgaatgcatgatcttgaaaatttactatttttaggtgatcatgtgaagggtttcggtttgatgagctattcaaaaaaacgaaaatatattcaaactgattacaataaaatagggaacataaaaatttcatcaacacataaaaatcttatagagagggatacataatgaatatgtttaccactatacgtgtgcatgcatttgaagtatcaataatacgaatatataagtgggtaaaaaatgatagctagctgcaaattttgaattggcttctcaatgtgtcggacgcaacaagcaacaatttaacaagtttcatattcatcatcatacgaattataaaaatacaacataatcattagtttcattcagtctcacgttgtattgcttttagtttacattaaattaattacactaaacctcaaattaaacatttgaatgaatcttttgcgcctgtaacgtaggctaagattgttttaaattgtcaaaaccgtgcaagtagcagttatttgttgtgtttaatctcacgtgagagaagttaacgtcgtttgaccaataaccattaacgaattgaattactgacgtgtcgtagtggaacttgaaaaaaaaaaaaaaatagtgatataatgacgtttttacccttgaagtgaacatagagaaggcacagctttatttgtcgaggaagcatcgaaagagagtccccaccacaaatccaaatggcaatagcgttaattaaggaaggaacaaacctacttctttactatttacactatttatttctccattatttaatttattagtaagtattaattatttatctagctggaccaccagactcttttatgggtcccacctttacccaccacgaacatcttacgtcgacctccgattattattacatcacattttctctatacttctctcttgaaacctaaaaccaatagtagagaacaaaatagtttgaatttctgtgacatgttccaagttttattgcttctgttctgtgtatatacaagttaatacgaatatcaaagttatagtcttcagagatcgcaattgataaatttgttgttatctattgttaatagtggggtaatcatgtatattattatatggaccataatgttataaggcaatattaataccgtcggacctgagagtgtccataccatttaagtttgcttttttaaacgatatcagcagaataacttgaaacttataatttagggtcccgatcatttattggttttaattagtgtcatcgtttacatttccatataaatttttttgcattggttatagatttgtaattgataagaaaccggtatcaaactatcaactaaataaaatttgaactcgttagaaactgctgaaaataacaacttctattatgttgcgatgttttatgtcctagaacaatgtaaaatacagaattaaaaattgaaaaccctacttcgcttgaataaaaatcacaaaaaaaaattataaagaaaagtaaatagtctaacaaatggaaaaaaaaaacaaaacgctagattccaattaaaatccataatatgaaattatgattggttaacttaatattagtggccttaccaaacaaaaaaaaagatgacctgaaatgaaatctaatgcacattcaagagttggcaggattataaatgcatctgtatatgtataataatacaataccctgtcaatgtctattaaattgttccaattaatttctcctcccaaaaataacttatccaaataaacaactataatcaatgaagttagttagcctttattttcatgatgattgtgataataccaaaattcttatcttcataccaaagtacacaaaataattcacactctatagtctatagtataaatttggcaaaatttcaccgaattctcctattttctagcttcggctttgtctttttatatacacgtattaactatagtcaccaataaaaaattaattaagttaaactgattaggaaaaaacactagttaattgtgtaattagtagttttgttcaatgttgttaattaaaaagcgaacgtatcgtcgtttctctttttaactcattctctttggatccaaatctttcgctttggaattcgccattgacaaagtactcaattccaaaacaaagaataagcaaacaacaacaattttcacttccttcaaaaattataaaaatccagtttttatctttgcaagattcaaaagtttgaatttttacttgttttgatttctgggttttgtttgttttttgatttcggtaatgatacaattgagattttgatttcgtgtgatgttgagagattcttaaatg

SEQ ID NO: 27268 - DNA, 3003 bp, Unknown; identical to SEQ ID NO: 27267
  misc_feature (1)..( 3003): 2750-1469P.txt file - cDNA_ID_2731112; gDNA_ID_2684232; Annot_ID_137637

SEQ ID NO: 27269 - DNA, 3003 bp, Unknown
  misc_feature (1)..( 3003): 2750-1469P.txt file - cDNA_ID_2731116; gDNA_ID_2684232; Annot_ID_137636
tctcctcatcgtgctgcatctgcgtctcttgcatttgagcgctttgtgtggatgcaaaacgttgagcctcgttatacaactgttgacccgttaaacaaccaccgttattaggtgtgtgttccggtatcatcataggattgttatgcatttccagattcgtcatcgaaggtggtggcacaaatgtggggacgatacagtaagaggcaagttcgttcttgacgatcgcgagttgttcttccaagtctttaatctgactaaggaggttgtaaatgatacccagacagccattgaccggatcattggcttgaacttgtgcctcccaagcgagcgtgtccatggcaaattctctttggcatgggtgaagactgttgataagtgtagccacatggcttgctccaaataccttgtgaaccgcttcgtagttgtccagtttagtcgaggggaagtaaggcgcaaacacacaatcttctgtgcattttctcctcaggtgcttgcatgccgcgcatggtgtcgatattttgtccatttgatgaaacatcataatctgtgaaagaaagaaagaaaatgtaattgtacatttttgatcatttctagaatatatacaaaatacatttaaatataggatatatcgaaatacatgatgtaattttttccttttaaactgaatcaaacaaacatatttacagaatctttttcttaaacacgaaaatccgaaacatgaaaaaaacaaaaacaaaagggaaaatcgtatgcctaggtctatacacgaactgaaaaaaaaaaatcacaacctacgaatttttatgtgaattctaaacagtaaagagattaaggtttctaaataatatagtaatcagaatagccaatcaaaatcgtggattgcgttgtactgcactcaaatatgttagagaaggtgtgaagatgaaaacacaaacctcaatgcataataagaagatgaatctaatcaagcgaatatcacctgatttctaaaccctatatattaatagagataaagaatggatataaaatgaaatcaaatcggtatttatatgaaaataaaaaaggaagatgaatagagagattcagtttttaacctaaacacaatgcttcttcaaattctattccctacttgtaaaatgcgttttgagaaagaacctaaaattgatcaacacagatttaggtcaaaatttcctaccacgcaattttacttatatagtaccaaaaaatattcaggttagttaatatttttgaaaaacaaaatctagataaaactgaattcatgattatccaaaaacaaaaaatatatatattagcttccaaaaaagtaaccaatcaaaatcaacatataagatttgatatctaaattttaattaatttaatttaattagaaaaacgaaatacattattattttccaaaaaagtaaccaattaaaataaacaaattagatttgatatctaaattatcatattaatttttttattaattattatagtttacctctcatctttatatgattctaattttgcaaaaaataatatcatcgttataaaaaataattagagtttttttcgcatatgccataatttgaatttttaaaaacaaatataaactgttcaatacataaaaaaatattataacagtcaaaaatagatttaagaaaactttatactgagtaacgggtcatcatttgaatatttatattcaatttcatacatattattttgaaagttataatcttatatacaataataattaataacatattagatttttttatgtgtatgatgtgattcaatttttaatacaagcaggaaaattctagaattgacgggtttagatcgatattaatacaagatggtatactacaggtgaaactctaaaattaacaattaaaatacaagtgtataatcttaaacactaaacaatataaataatatcaacaaaacatatacaactcgcagtttactatacatttaaaatcaaataaaataatattatctatttataattcatctttacaataaaattttttagtttaactaaaatataagcctacctgcggtataccgcaagttaatatatagttagctcaatatcattgtaataattaaatattatttgcttcgttccaaatattttataagaaatttagcagagttttacgtatttgctttggcctctcttcagctacagttagagatccagatatggcggatgcagtagcaagatttttttatgttactattttatttctctatacatgtttccatgaaattaaccaactacagtaaaacctctataaattaataatattgggaccaaaaaaatttattaatttagagaagtattaagttatcgataaattaattaaaattgtacaaattttgtaaattcttacaaaaatttgatataaaatgaagtttttttttcttataatcaataatatttatgaaacaaattacaagtacaaatcaattattaagtttaaaaacaatacaattttttttgatgttgtaaaatattagaattgaacatacaaaaaaattaataaaaattgaagaaaaacaatgtcatattttatatatgatatttataatatatattggtaaatttatattattattaatttatattattgatgggaccatatatttatataagatttttaaaaaaaaattagaatcttattaatttatcgagttatatcaatttttatattgatcttaattcgagactggaataattaattaatttatagaaattattaatttaacgggtattaatttatagaagttgtactgtagtatgtaataaagtttgttattgattttaacgtgagagaggaaaaaaaacgtaaacatatttgcttcgttcgaacaaagggcaaggcccataaacaaaatctaagtaaagcccagttagtgttaatgtcatatcaatggaattggtttctcgtcgttggatgaatctaaagcaattgtcagatttcagcatctcccatg

SEQ ID NO: 27270 - DNA, 3000 bp, Unknown
  misc_feature (1)..( 3000): 2750-1469P.txt file - cDNA_ID_2731123; gDNA_ID_2684232; Annot_ID_192296
atcgatctaaacccgtcaattctagaattttcctgcttgtattaaaaattgaatcacatcatacacataaaaaaatctaatatgttattaattattattgtatataagattataactttcaaaataatatgtatgaaattgaatataaatattcaaatgatgacccgttactcagtataaagttttcttaaatctatttttgactgttataatatttttttatgtattgaacagtttatatttgtttttaaaaattcaaattatggcatatgcgaaaaaaactctaattattttttataacgatgatattattttttgcaaaattagaatcatataaagatgagaggtaaactataataattaataaaaaaattaatatgataatttagatatcaaatctaatttgtttattttaattggttacttttttggaaaataataatgtatttcgtttttctaattaaattaaattaattaaaatttagatatcaaatcttatatgttgattttgattggttacttttttggaagctaatatatatattttttgtttttggataatcatgaattcagttttatctagattttgtttttcaaaaatattaactaacctgaatattttttggtactatataagtaaaattgcgtggtaggaaattttgacctaaatctgtgttgatcaattttaggttctttctcaaaacgcattttacaagtagggaatagaatttgaagaagcattgtgtttaggttaaaaactgaatctctctattcatcttccttttttattttcatataaataccgatttgatttcattttatatccattctttatctctattaatatatagggtttagaaatcaggtgatattcgcttgattagattcatcttcttattatgcattgaggtttgtgttttcatcttcacaccttctctaacatatttgagtgcagtacaacgcaatccacgattttgattggctattctgattactatattatttagaaaccttaatctctttactgtttagaattcacataaaaattcgtaggttgtgatttttttttttcagttcgtgtatagacctaggcatacgattttcccttttgtttttgtttttttcatgtttcggattttcgtgtttaagaaaaagattctgtaaatatgtttgtttgattcagtttaaaaggaaaaaattacatcatgtatttcgatatatcctatatttaaatgtattttgtatatattctagaaatgatcaaaaatgtacaattacattttctttctttctttcacagattatgatgtttcatcaaatggacaaaatatcgacaccatgcgcggcatgcaagcacctgaggagaaaatgcacagaagattgtgtgtttgcgccttacttcccctcgactaaactggacaactacgaagcggttcacaaggtatttggagcaagccatgtggctacacttatcaacagtcttcacccatgccaaagagaatttgccatggacacgctcgcttgggaggcacaagttcaagccaatgatccggtcaatggctgtctgggtatcatttacaacctccttagtcagattaaagacttggaagaacaactcgcgatcgtcaagaacgaacttgcctcttactgtatcgtccccacatttgtgccaccaccttcgatgacgaatctggaaatgcataacaatcctatgatgataccggaacacacacctaataacggtggttgtttaacgggtcaacagttgtataacgaggctcaacgttttgcatccacacaaagcgctcaaatgcaagagacgcagatgcagcacgatgaggagagttaccgtgacaaaagttcttatcaaaaatttggaccatgctttaacctacattaatcattatcatattgaatcttgataacaatggtaagcttttaaaatctttttaagtcttgtctagtcgtttgtataactacattaagatataaatacaattattgtttttagttaacaaaacatccgttatcgtccagcggttaggatatctggctttcacccaggagacccgggttcgattcccggtaacggagctttttttggtttttaagattcgaaaaagtactttttgcctcatcactatctttacgttaataaactcagcggcagttcaagccgtaaaccttaacatttctaatcaggatccttagtcaatttgattatttcttttacaaatactccaacattcaacaaggaccttgtgtagaactacactctgccataacaaaataataaaggtgcacttgtagttatgtacaaacgactagacaagagttataaaattagaaaaaggttaatgtaacattgctgtgtacgtgaaaacgtcttatatgatctataagaagcttttttttgttcgtgacaaaaacaatttctgacttggctcaaaatacgaccacaatcacccacataaagttgggatattttggaagtaaacaagtacaagtgaaggtaaaacaatacatatatacatgagacattcacataattaatttaagaaagacataacaatttactcacctcacaattcgtactcattcaattacaaattttaggagcaaccaaattgtgttgataatatagaacagtaaaattaatattgatacctaaaaaaaccaaaaaaaaaaatatttgaaaaaaaaaaaaaaaaaatcaccaaaacgcggcggcctttgtcgtatcaaatcagataactaaaacaaagaaaacggtgtcgttgcaaacatctctctcctcttatctaacttagagagcgaccaataattgcctttgtctttctcattcgtcgttgatccatctttttcccccaaattcatatccttccttagatatttttctccttcttcttcttctagattccagctactccagaagattcttcgacttaatctgatgtgattaggaagagcaatagaggaagagaagaatcagaaaaaatg

SEQ ID NO: 27271 - DNA, 3000 bp, Unknown; identical to SEQ ID NO: 27270
  misc_feature (1)..( 3000): 2750-1469P.txt file - cDNA_ID_2731123; gDNA_ID_2684232; Annot_ID_137634

SEQ ID NO: 27272 - DNA, 3003 bp, Unknown
  misc_feature (1)..( 3003): 2750-1469P.txt file - cDNA_ID_2731127; gDNA_ID_2684232; Annot_ID_137633
aaattctaacgatgaaataatctagtatatcaagtagtataaaatcttattaaaagactctagaagagcatatacattgttttctatgggaatacaaaattaaaatcatcgatgcggtatgagaaagttaatatgatgagatataaatacattatgattctagagtggaattcaatacgagatggatgaacttgaagtttcatcatttcgaggaggagaagtaatgaatctcacatggataataagtgacatatccagaagattatgttcaatctttgactactaaagatctaaaagttgtataaagcaattcttatacgaatgtgttattagataaaataagttataattagttattactgaaacttcaagacttgaagtctctttgtgaatataactcacattgttaagagaatatctatgatgcagagatggtaaaacagacgcttaaacttttacgtaagtattgttgtcctgtagacacaatatttggaatgaaattttgagaactattataaacttaaatcgagtgtttttcaaaggctaagaaaacatatgaattatcgatgataagtaatactcatattctgaagtgaatataagatcttacatagttagtcaaatttaatatcgtttatactagaatataaaattttaattattatcttgttattgttttattaacatatgattgattattaaaatacatggaagtaattttgattataagatctcattaagggagtaactgataagcaatgaaaagtaaattagaagttttgaaagaactagaagtttcaaaagaattaaaagtttcaagagtatatttggcttaaccggattggttatcctggtttaatgatgatgtgaaagtattgagaattatgtggacattaggtgaaaaaccagaagattctccctaataatttatcaaatgttacttgctcagaaagcaatatgataatgtgatttttaccagggtaagtaatttggactttatctattcgtaagtatatacaaggagataattatgggttgatcacccactatatgacatttagatacctaatggttgtaaaagatgcatcgattcaatggacgcattgactcgattgttgcatcgacaagaaggtcatatttatccttgttataaacccgcaacatagagtttgcgagattactttcttgattaaagtacaagagtatttcagtgtttatttataataaccattattggatatccgttgggataagtgtttaacattttgaaattcatgttcatacacaaaatggtttagtaacatcgatacgcatcaagccaatgaataattaatagttttccccattattattggttttgggtcagaaaccaaatagttttcatctaaaagctttgaatgtgaaaagtgctccaccacagcacgcagaaatgaaccctcaaaggaggataagaatacatgttggatatgaatgataactaagccatcctagaaggatttatataccgctcgttttgaagactatcatattatatagtcagctattccaacataagggggagaatgtatacagctggtgaaaaagataaatagaaatgaattatcaatgatcctcggagtaaagaatgtatattaagagtccaaaagataattcaattacagaatttagcgttgtaattgccagacgcatttgctgacccaaataaagtgatgaagtcacttataccagttgtaaattaaatgctccagaatataatgaatgtcctgtaaagaccaatttcaaactgctattgagtcttaatatcgcatgaagcgtaatagaccttggttccaaatataaatatcctcgtaaaagtgaaagagcacaaaattaaaaatgaccaaattgaggaaataaatattttgatgatctcttgaagagagtgaatgatctctaaaagagacataaacatgacaaataaaacattcacgtacttgacaatgaagagatctagctagctatgtcatgtcaaaatataatggaatcaaaagcaaatcgacgtcgtaatatatttgcatgctatgagcagttgatattacggacaaaaaggaggatcatgaaagaaactctattgaaaagtgtacacaaagtaatgattagccaaaaatggaaaagaagaaatagacatataattataacctctagtagagatatttggactagtagtctatgcacatgatgtgtaaaaccagtggaaaataaattagtctttatgtgaaagaatagtgaaattaatgagattttcacaaagataagaaatgtattatgaagagatatattctcttgtggtggatgtaatatttttttttaagtatctaaagtctggcaataagagacggaacactggatatgacatttatatgaaattcttgaaagatataatctcttaaggattaattatatgagaattatgttctctaaaactctactcgatcgaataaaaaaaaaatatgtaacatggcatataatcatataaatgtatatttatgttgagtttgtcaaaatatattgatcaaactaatatttgttttgaaaatcattaaaactcctacagagttatcataagtaatacgatgacaataatgtatgataaaatatcactagataatgatatttataaatttatatgaaaaccatataattttgatcattaagattatggttattaattccaacgagatattgtatttgattgaaaatcatctcatgaagaagatgtttccaagggggagattgaatgatatgcgtggatgtaccctttttccttatcatagtttttatcccacatgatttttctatgacaaggtttttaacgagacattaaagaacacgcaaataatacacttgatgaatattaaaaaattctatcaatcatccaaatgaatattatacactaatgatatttagagaaataaataagatggtcaagatgaatcatctaaaagattcatgagcagaagaatg

SEQ ID NO: 27273 - DNA, 3003 bp, Unknown
  misc_feature (1)..( 3003): 2750-1469P.txt file - cDNA_ID_2731133; gDNA_ID_2684232; Annot_ID_192292
aaccttcttctttgtcttctttgcctagacagaaaaaacaaatggagatacacaatcacggataatgagtaggtactttcggatttgattattctagcaagaataattatgcatctcaatggactttaacaacaccagagaaaactttgcatgtatttaccaaatatttatttagctagtatatcccataattgttgtgaaattgagaatttgaattttcaaagaatatactatatacaaatataagttagtgtagagcttagatgtttactgaacttgtaagaaacacatccaaactctagaaagatatatcgatgtacaactaaaatatgcaaaaaaaaatgaaaaacggatattgtatttggagctgagcatttgagacacttgagttgccaattgcttcttctcaagccatgcttgttatatagttgcattcttaagccatttttagttatatattaagtcataaattgtactttaatgtggtgatcaaaatattgtaacttatgagatataaagggtcataaatttttggatcaaagtactcctaaatagtgtttaataccttattacggttaagcagctaagaaaatgttaagagtatgcattaatggtaatctataatagtaaatataataattttttattatcaaaaacatataaatagtgataactttgtactctaaaacataatatcatgtcaaaattttaaagatttgattttgtaattagttaagggagttgcaattatggtagaaaaaaattcattttaaaattgtagtttaatatgtagtaatttcatagtttaatgactatttttctaaatataagatatatctattaataaattattttagtcaaattataattaatgataagtacacgtatcatcaaagtagagtgtcaaatatcgcattggtaggcaaagttagaaaaaactttctcttattatagaagatttttatctaaccagacttcttgtaaatccttcttatgggtcacaaacgcacaatcaaatgcggaaacataaaatattcacttgctttaacaactactagctgtaaaccaaacttaacaaagaggtaagcgaaacatttcactataattagtaggatcaatatgaaagaaaaactttttctatatttaatctaaatttagctaaaagagtttccatatgatagtcatcataatatttcacgataatgtcaatatagaatatacaatatttctaccaatataaattagaaaaacgagaatggacagaaacgttaggagatttcagtacacgtcagtgattaatccaacgtatgtacaaattcgatcatttagaatatgattatcttccctttttttctttagtttcatatataacttgaaacaaacaaattaattttcattgagaatgcttcactgctcgctcttctcttctttaatttcatagtcacaacaagttgatcaaaatattaatatttaacagaaaaaattaatccacattgagactatttctctactcctttttctttaattccataatcacaacaagttggaaaaaatcaatccaaataagtgtttttgtcaaaagaccaattcaatattgattcattcatatactaacctcgtgcgatcgagagctaaagctaattgcaataaatctctttgtaatttaagtaatccttaaaaaaaaactatacaaaatgcctcttaccgagattatcgcaggggctgctcttggacttgctctccaaatccttcacgaggccatccaaagagcaaaagatagatccttaaccacaagttgtatcttggaccgtctcgattctacaatcttgaggatcactccactgatggctaaggtcgaaaagctcaacaaagaatccgatgaatctctgaggaaagtcttcgaagatcttaaacatcttctcgagaaagccgtggttcttgtcgaagcttatgcggagctcaaacgcagaaacttacttggaaaatataggtttgtgaatcttttggtctcgtatatatatacatgaaataatgattttttttttaatcttagatacatgaatacttctacatattacttgatctcccaacattatatagacaccaattaaacaaaaacctatcatttttttttgtttcatgtatgtatttaattacatactaaagtgtactgttgttttaggtacaagagaagaatcaaagagttagaaggttcattgaaatggatggtagatgttgacgttaaagtcaatcaatgggcagatatcaaagatcttatggccaagatgtctgaaatgaacactaaacttgaaaaaatcatgggtcaaccaatagattgtattatatctgaagataatactaatatggacatagtcgaaagagttgatccatcattggaagcaaaagctggatgctcaaatagcgattctaagccgaagatcgatatccaccttcgatggagcaagcaaagcaaagatcacggaattcgcttcgttttgaattagttttttttttgatgtggtatgtgtcatagaccagcaaaattgagaaagaaaataatcaaatgtaaaaaaaaaaaaaaaattatacttacgaatattgtgttatcaacttatcatacatataacgcctgcttgtataaacaaaaaagaagattggttccaactaatatgtaaattaagatttttggatttttttaatgcaaatgtacaagtcaacatttaatcctactgttaaagtcaatcattgagattgattctcccttcttcgtaatttaaaaatcacaacaacttgcatatagatccaattatctcctttcacctagaaagaaagagagtcgactaattctaagtctttaagtcaacgtctcttgtcttcatatagttcatcaaaaacaaaacgttttgttaaacaaaagattcttcaatggtttcatgtatatagattgctccatacaatcacgttgagagctaaagagctaatctcttgacccaaagaaaaatg

SEQ ID NO: 27274 - DNA, 3003 bp, Unknown; identical to SEQ ID NO: 27273
  misc_feature (1)..( 3003): 2750-1469P.txt file - cDNA_ID_2731133; gDNA_ID_2684232; Annot_ID_137631

SEQ ID NO: 27275 - DNA, 3003 bp, Unknown
  misc_feature (1)..( 3003): 2750-1469P.txt file - cDNA_ID_2731156; gDNA_ID_2684233; Annot_ID_137667
aaattccggtaacctttggtagctcgtacggcttcttcacaaaattgccggcctatgaagatcatttccttcatttaaccctccaagctccagattatccattgctgtactcacaaagctccaaagtcttgttcttttcttctttgtttctttaattactgctcatgactatctctctgatggaaaaagtcgaagcctttttctgtgtttctctaacgggtattgattgctaagtacttcgatttccgcgtagtatggtacatagttgaagtttgagaatttgggttttgttctctgatattttaactttggtgggtagcttttatatgcttattatagcttctttcttcgaaattgaaagcttgagcctttgattctaaagcttggagtgagttcgtttggattgatgcagatgttgtcaatgagggttagtgtttatgtagttggattggagaggatccaattactcttttgattgttgaggacgaagagagaagaaatggatctatggttaatcgcagctactgctgctacaggatatataaccaagcatttgcgaaatgtatccaaaggtaaatcttcttctgaagatttgactaatgtgaagctagagtcaccgagatgcttggctagtaatgtagtaagagttaaaaaaccaaaagaagaaaactttgaggattgcttaaatggggaaactcttgatctatatgaatgtggcaatgcatatggagtggaagtagcttcgaataatgaggaggatttgggatatgatgatgagattcgttcaggttcttttgggaacagagcgtttcttaggagaaatcagtgtcctatcaagcctttttctttggagaaaagcattatgtctcggttacatagagagaaaatatccatggaggaatatatgcgtagtccgtttccatcaccttgtggttcagtttcgaggcccttgcttgttactgatggtacaaatgtaattagcaagaatactggagattctgttagccagcaagtttcggaatgcgggattcctcagcttaggaagttgaaatcttcacttctttacgctaaaaggggagttggagatgcgaagagcgtgagtagaagatctgataatgggactggtaaaattcttgctctctttttaaaatgttacatttgtttatattgacaaaggagaagacttaacatgttatctttcttttcaggatcaaatgatccagtgttagtgctatgcgttgggatttcaattgggataatgtcatcatttgtagctaaccaaaccgaactaaacaaagtcagagcagagtcaaagcagacagagaatttgggaaaagagttagaagatgacatacacgatggtgaaaaacagtgtgatgaaaagacagcagagaattcagaatctataagtaaaattgaagcagaacttgaagctgaacttgaaaggctggagatcaacatgatttcctccaacattgagacaaaactctcagatgtctttgaggtgagctttatactctagcttttgctttttcctttcctttcactgaatcattgtctcattttggtcgatcatgtctgttcattctggaagttatcccgcagcactaatgatcctgttttctccatatatgaaaattgagcaaaacagatatttgatcataagactagccattgtttaatcatctatagaagttcagcttgtaaattgtttctcaattctgcagctggagccagatttcgaagtagaatttgcgcagggtgagctgagagatgatcaggttgaaagacagcgttttgatgaaaccgtgtccaaccaggaacggagtagcaattccacacctgaatcaggaaactacatagtctcacctcgtgagttaagcttgcgtctgcttggagttatcaattcatgctatgaaaaacggataaaagaacttgagaatgccttacaagagagtcagaggaaagtggagcagctggtcatagaatcagaggaaaagaagaaaccattgtcaaggatttgggaaacccatgaagagatgaaatataagaggggctcaaatcctccagtttctgtagctcatatagagaagaaacataatcctgcagagatccaacctctggttatgactttagaaggggaagcacttgacgcattcaatgaatcttacgaggaactgatggatattaacgactattcagaagaagacgatttacaatgtgtgatgcaggagaatgagcggcaagaagaattgtctttgacgagcaaaagctcaccttggagccataaagattacataaaggattcttcaagaacttcagaggatgtgaatttgtccatgctgcaagatctacttggtctgagcgacgaagaagaagaagaagaagatgagatggagaagcatctgataaagcagattgttgagaaaacaaagcaagggtcttctgctgtgttaaatgcccagaaaatgctattcctcatggaagaaatacaaccaaatctataaaaagcatttactcaaattctcatcattttttgatgaaagtattacacgtctctagttagtgtgtgtgtagatatgcaaagattggtgtaacttatcttgtcatatgcaaagaaactgaagagagaagaagatgtgttgtcaaattcaatgtatatatcttaagaccagtgtcaaagcttaagatgtgataatctttaagaccatctccaaaactccgatggagatgctctaagtttttctggcagaaagaagagtcttttgaaacctgctggttgggtcagagagtttgagagaaggcgccaaataaaccaaaagctagacaagaagaagcggtgaagttttgaaaacgagaataaaattcggcgggaataattaacgaaaaatctaatagctcccgcgcaaatctttcttttacaaaacaaaaccattttgcttcccatttcctgtgaattctaaagagaaagaagagatagagctagagattaagatagagatg

SEQ ID NO: 27276 - DNA, 3000 bp, Unknown; identical to SEQ ID NO: 772
  misc_feature (1)..( 3000): 2750-1469P.txt file - cDNA_ID_2731167; gDNA_ID_1620319; Annot_ID_153277

SEQ ID NO: 27277 - DNA, 3000 bp, Unknown; identical to SEQ ID NO: 14904
  misc_feature (1)..( 3000): 2750-1469P.txt file - cDNA_ID_2731167; gDNA_ID_2684233; Annot_ID_192336

SEQ ID NO: 27278 - DNA, 3000 bp, Unknown; identical to SEQ ID NO: 14904
  misc_feature (1)..( 3000): 2750-1469P.txt file - cDNA_ID_2731167; gDNA_ID_2684233; Annot_ID_137663

SEQ ID NO: 27279 - DNA, 3000 bp, Unknown; identical to SEQ ID NO: 14905
  misc_feature (1)..( 3000): 2750-1469P.txt file - cDNA_ID_2731171; gDNA_ID_2684233; Annot_ID_192335

SEQ ID NO: 27280 - DNA, 3000 bp, Unknown; identical to SEQ ID NO: 14905
  misc_feature (1)..( 3000): 2750-1469P.txt file - cDNA_ID_2731171; gDNA_ID_2684233; Annot_ID_137662

SEQ ID NO: 27281 - DNA, 3000 bp, Unknown; identical to SEQ ID NO: 771
  misc_feature (1)..( 3000): 2750-1469P.txt file - cDNA_ID_2731175; gDNA_ID_2684233; Annot_ID_137660

SEQ ID NO: 27282 - DNA, 3003 bp, Unknown; identical to SEQ ID NO: 22943
  misc_feature (1)..( 3003): 2750-1469P.txt file - cDNA_ID_2731179; gDNA_ID_2684233; Annot_ID_137659

SEQ ID NO: 27283 - DNA, 3000 bp, Unknown; identical to SEQ ID NO: 774
  misc_feature (1)..( 3000): 2750-1469P.txt file - cDNA_ID_2731187; gDNA_ID_2684233; Annot_ID_137654

SEQ ID NO: 27284 - DNA, 3000 bp, Unknown; identical to SEQ ID NO: 14896
  misc_feature (1)..( 3000): 2750-1469P.txt file - cDNA_ID_2731191; gDNA_ID_2684233; Annot_ID_137649

SEQ ID NO: 27285 - DNA, 3003 bp, Unknown
  misc_feature (1)..( 3003): 2750-1469P.txt file - cDNA_ID_2731195; gDNA_ID_2684233; Annot_ID_137648
taatacagagccatatgattttgcaatttattctaagtgaccatattaattagtcaaaacatgtttaagatctagtatttcttttgatacaacataaaaggaaaataattgaattatttcatttcatttattaaaattaaactgaagattgaaaatttatgatggtaacaaacaaaattcaaacttaaaaaactcaatagtagtccatataataatactgtgtatattaatatattaagcttttaggttttgacggatcgggagatatggaaacaaaaagtctttttgtatttttctaaagaatgatgccttccgcgatggaccgactttggattcttttgattatatattgcaaaaagataagatctacatgctgacttccaaaaagaacagagatgctctaaataatttctaataattcgtgccatttctatattattcaagtaaataatactttgtaaaatttaatacttttcgtggttgtaaagcttattatacctaaattatattttttttaaaaaatttgtatcaaatgtgctgcaatttagcaacatagaaaaattgtgatacatcaaaagaaccttgttatcaaatgtggttactggttatgcccatttgaaaccaacactatcgcccatttcaatctgaaataacataatctgaaataacattttctgaaagcccaattccgagaaaggccgagcttataacacctgaggcccaaagtttcaatttctgtttgctgattctagaaaatttacaaaaatgtatacattgtgatcatcctacatataaagtagcttaccaacaattcacaaaagactaagctatattgcgtgtaaagcagaaataagtaaaaagaatattacagttttctgaaaaaaacatataggatataacattgaaagctaactattgcctacaaaatacttgttgtacaaagtatcaaataatatatgtaaatgtactttgaaaccggcaaatgatatatatatatatattttttaaatgatatttacatctcttaattttgattgaaaatatatagatagggatatagtaaagagaaataaagggataatatgacatctgtattattattttctttttgatataaaggacagatctgtttcaattgattgcttctgatttaagcatgacacgaggcaatactgactgaaatgtcatcgagtgacagatgcaccgattcgaaccaccttccttccacagttgttaccattcgcaattgttctttctgacaccacaatcttaatttattagttactacctcttttgctcctattatttgtttctttaattgtgtttattttattaatctggatttgcctttttagcataagcaaatacaaaaaaaagttattcctttaagatctaatcctgtttagtaatgttctctagatattattggttatgcaacttgtgcttggaaaatttttaaagtataatagttgaaagtgactttcttttgtagattttgaacttatttgaatagtcatgagatgagaacaaaacaacatacttccaaactgactatgttttgtagatttttaatatagtatcattgtcatattggttttgaaaattgactaacgttggaaatatttctacaaaataatttgtcttttctggtcttaaaagtgagttgattgtgtttaaccaagtaattcatttacaagtaagtgatcattgtgtaactaatgtaacttgagagaaatatactcaaacaaacttcagtagtaagaaagaaaaaaaagagtaaagctaaaagccaaaagtgaatgaattaattattaatatttgtcacaccaatttcgaccgatcttacttgttttcaaagagatgcttcaactgttttgtttgtttctgttaaaccaaaatcaattaacgagaataaaaaggaattaacgaataaaaagtggtagaaagctcatgtttcaagagaaggttttgattcatcaaccaagttgcaccaactccatatatattaccaaaaccaaaataaatttacatatttggaaagacataaattggacagaacatatcaagcatgtaatatacagaagccgacaaattgcaaaatttacctaaaccccatcttacaccaccgtcagattctgatgtaagtattatcaaagctcaagaacaatcacatcatcagaatctaacttatatatcaaaggtccagaattttctccattgaagctggattctaaggtcagttcttacttctttatctcaatctgatgattccatatcgaaagtcttactttttcacttcaatttcaatctgatgattctaagatctttgattcgaggtcgatctctgatagttactacatgtttctgggtttatttatttttaatccatatagtaattaaaaactcttatgaggtttaattatggttacttgagaatttgcaatcgtcatctttctttgactcctatccattttttggtttttcctttgtttaatttctgtttcataattgtaattgtaaattaaccaaaacaaattgatcagaaacctttttcctatggaatatttatcacacgcaagcctgtgagttgtgactctgtaatcacttccttgttctggtaatttcagtggttaaggctctccttttttctgatgttgtcagcaaaagttagtttttcttcttctttaatgggttaattacacctaaatctctggttattaaacaatccagaaagaaaaaaagtttattccttcctctatgtatatagtttcacatgcaagcatcacttgtttgttctgacaaattgcagagttttgagttctgtttttttttttttctaatgttttgtctttaagaaagttctgtttttttttctgcaggaaagttatcaaaagttttgagagctttggatagtgaagctcaaagaactaaacaatgggcttcagagtttgtgttattgtcgtcttcttgggttgtcttcttctagtccctgagaaaacaatg

SEQ ID NO: 27286 - DNA, 2479 bp, Unknown; identical to SEQ ID NO: 14945
  misc_feature (1)..( 2479): 2750-1469P.txt file - cDNA_ID_2731203; gDNA_ID_2684234; Annot_ID_137694

SEQ ID NO: 27287 - DNA, 3003 bp, Unknown
  misc_feature (1)..( 3003): 2750-1469P.txt file - cDNA_ID_2731223; gDNA_ID_2684234; Annot_ID_137686
tgccacaaaagttgctcaatctcagcaggattaacaaaaaaataccaaagaataacaactgggcagagttttccaaacttaccctttcattttctctctgtaagaatttttctcttctttctacttcacgacgctgctcacgctgtaacctttcctcttcttttattctttcacgcatcaacctctcttcttccttacgcctctcacgctcgttcctttccatctcttttctcatgcgttcttcattctgaggacacaagcatcaactcatcaatatatctgttacagtgatactaacaaaagacaataagacacctttccaaataatcagtaaggaggataataaatgtagagcaaatacctttttcctctgaatttctagcttctcaagatcttttggtccatgattctctcgggtttcactccctcttccaagtctaccatcgttaatctgtgagagtaaacatagaaaaatgacattacaacaaagacacatcttgtcaacaaaaacggatgaaataaaagttggtacaatgaagctacctttccctttctatgcacatcactactcttacgcactccatcaggtaacaaatatggatcttctgtaccaaggactgatgagtccttctccagcaggaatctatcaccatgatgcgctgattcaatggggcttggcatgtcttgttgagatgtcgaacagttacgagacgcatgtccaggggtaacataggaccttggtacaggtccattcgcgtgcataaatgatgaaattctagaacgtgcaacttcatagtccataccacgtgcatgattttcagagtatcgttcatacatattaggtgtaaaagaagacggatcatccagagattgttgctcatggaaagaacgggcagcagcatgagactataatcaacaaaagcaaatatgttaagcaaagtagtaaaaagaaaatattataaaactgtgaatacatgaatggacaagaaagagaatagaaacagcagagcggaattcatctttctaacaatgatcagagactaaaaactgccataagactaatgtcagccttcatgtaatgagaactctaaaaattactcctaccatataattcatagaccatcagtttatggtaacctcttcaactagtcaatttgagatatctaggtgcattataaagaaactaaatagagcatatctgtttagtcagaaaactaactcttcgaggtcggggatcatgtcgctcatacagatcgctctcatagggatgaagtaggtgtttctgcatcgctgaaatgccaatgaaaacaaagttagagagttacttatcacaagaagtgtaatactaacactgacattggttacacaagtcataaaacagggcaaacatagaaagtaatgtatacctataggtgttccaaacgcaccaggaggcaaaggatcaaactccatgccaagaataggtccatcatctctcaatggctcacctaactgagcctcaatacagacaatagctctatgcaccattgtcgacaaccgcgactcataactcggctttcccattgtctcatattcatccaattcagctcgagaactactactaccactagcaaaattcctcctagagttggaataaggactgcaaccagactcagaacccgaatcagatctggaatcttgctcaggtaccgatccagcagcagccggtaactcgttaaccgaagccgattgaaccgcagcaaccgatgatttcaccggtttattagactgaccatccttcttgtcctttaaccgtctatgacaaaaccacatctgtaattgtcgatctgacaaatccaatttctcagataactcagccctcgtcgcctccgacggatacttctcctctgaatcaaaaattcaacatcaatacttaaaaaaacaaagagaacgaagattgaatcaaattaattgagatgaataagaacctgaataaactttctccaaggtttcaagctgaaacggagttttcatctgacgtttaggcttgacacgaccatccttagaggaggaattattatcaatcttcttcttcttattattaagattagcatcaccaacgacgctcctgatcttctgatcttcaccgtcagaacccatctccatggaaagagaagaagaagaagaaacccagaaacggccgcaagaagaatcaaagaacacaaaaacaaaaactagggctttctattgaacaaacaaaccctgatccaaaaacgtaaaaaaataaaaataaaaagaagtagaatatataagagtaagaataagaagaagaggaagaacaaacaataataatagtaaaatcgataaaaaccaaaaaggaagaaaaacaacaacagggcttctagtagtagtagtagtagtaccactcatctcaatttcaacctccttcatattcctttctttttttttgcctttcttcttaattaaaatcttgtttttttttgttgtaaatgaaaagaaaaaaaaaatcgaaacttgaggattctacagcgaatcgcgtgcttatgtgtgtttctgccgttgatgtgtttatcaaagctttttttctttttattatataaatcaagttaatttaaaactaaattaatacaacaactcttgaagggctttaacgtgcttttggtctcgtgttcgtgttgttgtctttcagatccgcaggctggttgcatgattatcatatcccccagattttttttttgaggaaccacttgtgttgagagtaaacatcttgccctttattgttttcaagtgtacagtccttgtcgtttttaaaaccggttcaatacttcaattcagattttttaatcccggtttactcgccgtccctatgaatcacagaggaatcgaaagaacctttacgaggaagctttgactcgaaatctctctgaagaagaagaggagagacgaaactgttggcttagtttccgacgccgggaacgtcggaactccggtgaacagagaatg

SEQ ID NO: 27288 - DNA, 3000 bp, Unknown; identical to SEQ ID NO: 14929
  misc_feature (1)..( 3000): 2750-1469P.txt file - cDNA_ID_2731227; gDNA_ID_2684234; Annot_ID_137685

SEQ ID NO: 27289 - DNA, 3003 bp, Unknown
  misc_feature (1)..( 3003): 2750-1469P.txt file - cDNA_ID_2731231; gDNA_ID_2684234; Annot_ID_192372
acctacaaggtcgttgagcgcaaggtctaaatcaacgagtttactgagttgacccagcgagtcagggatctgtccgactaaatgacactcagtgagccacataacctcgagattcgtcaagttcccgaactccggcgggatccgactcggactaaaggggttatacgaaagattcagcatcttcaacgtgctgatgttgccgagaaacggaggaatcgtaccgtctaagagattgtaaacaagagaaagaacctctaggttttcgaatttgccgaaactcgccggaatgtcaccggaaaagttgttaccggtcaaatctaagtgaaccaaagtcggaatatcggcaagagtttgtggaagctcaccggtgagtagattctgagagagatcgagagtttgaagactcttacaagcagcgatgttgagaggaagagtagagttgatggagttattgtacaaagagagatgagccagattagagagacgacaaatgactgaaggaaaaggtccggcgagattagcgctggagaggtctacggaagtgacggaggagaaatcaccggcgcaggaaacgccggaccaccgacaaggagaagcatcgttggagttccaggaagagagatatgagtctgggtcgtctaacgagagcttgacttgttgaagaatgaaaccgtcttggttaagagagaagacggtggggaaaagtaagaagagaaagagaagatacatgtttcttcgtcttccccggtatctatgacggtggttgaagaaagagagagagataagagagtatgaagaagagagtgtttgtgagagagtgctttgaaggaagagaagaagagagtctataaaaagcgttgaccggagacaggtgaattatcgtgactctgactgtgaatgctataaaaatcatttgtttttctactatcatttattttgtttttgttttctataacgattctctctaattatttgtttgcaattattagtatctatgtcgagtttccaacattgtataattatcctgtgtttatctgattataaaagagaatgttactaataatgatgatctagctaaatagccatatggaaggaaacattctttttttgtactttgttgtttaagagaatgcaactgtttttaaattagttatgtaggagacgataagattgtaaattttcaattaaataattttagctttataatatatatggaatttgcatacaaatttgatttcattatatatgtttttaatgtaaatgaaaagttagttagtagagtaaatgtgcattttaaaaaaattgcaaggtgaaaagaaggtacggtaaacattaattttgaaatgtagatatctgatttttttttttttttttttttggagatggaatgagatatattccgacagttttatttattatcggcgtttgtaaagtagtaaagtacaaatattgttagaacatatcaaaaaaaaaaaaaacagaatgtgttggaagtttacttggaacgtagtctaaagtcgatgtgaattaaattaattatcattcaattttaaaaagtttatgcacgtcttaaagagtattaggaatattgtatcaactattaagagaataaactagcatgcatgtagaaacatgaaaatattttattttgttgaaatgtgaaattcatttttgaagataataatatgtagttatttacaaaaaatgcaaagaaaatatggaagataggataagatatcaaaatattgagatatttatgaaattaaacattctctaatgaaatttgttatactaattagtattgcaaagggaaagagggggacaaacttgtatggttaaacgttaggaaacatattgcctaatggtgtagtcaatatgagaatgcacttctcaagcgagagtcatgagtattgcttatcttagagatgtcatagtcttaaaaaagtattcgagtcgaataagagttctttatggtttttaaattttaggttgatatgcaacaaaattggaagacgtaaaataatgtattgtgaaaaacaaactgtgtgtacactttgttcttattctcacaacttggttttcataagttgttacggctaaacgaaatcgtaaattattttgtaggatgtgaaaaagagttgcactaactgtacttgtgttcaagaattttgtttttgaggacgtgaatacattgttgaatccagttaaaaaaaattgttatctatttttgtttttattttcttacgatttggatttcatgcccgttacattatgagaattgttacgtttactatcataatctcaatcttagtttatcagttggaatttgattttattttagttaatcttaatttaacaaaataataaactcataaaagaacaacacaaattttgcctacatatatgttagttagaaaacgtatgttctaacatatgtatcggttgagaaaagcatcactttaatcaacataccatttgaatgatatttaaagagatagatgagtgaaattttggagatagattgattccaagcagtcttctcttcttcgtgtttctaatagtttctgtgaaacacacaatacaagttgtcaaaaaaaaattagggtacactaaacggagttcgacacttgtatcctataagatagacatttaagaaattacgtacactacaatagctacaaatctctgtcttatgagattgttataagcaaagtctctttcatcctacaaattgttgctagctagttgattgaaagaaaccgtcaaattagttttgtttatatttttaatttcattacttagttaatcaagtttccattacgtgtgattgatgtcctcttatagtttcataacattgtcactttggaattatttaatagaactattaatttgttacgagtattgtgtacaagcaagcaacctttgatctatattttgagagttcaagttcttatataaatggtttgaaggcattacgctcctcaatgcttattagcaacaatg

SEQ ID NO: 27290 - DNA, 3003 bp, Unknown; identical to SEQ ID NO: 27289
  misc_feature (1)..( 3003): 2750-1469P.txt file - cDNA_ID_2731231; gDNA_ID_2684234; Annot_ID_137684

SEQ ID NO: 27291 - DNA, 3000 bp, Unknown
  misc_feature (1)..( 3000): 2750-1469P.txt file - cDNA_ID_2731241; gDNA_ID_2684234; Annot_ID_137680
tttgattttaggtgtccgaccaggtcgcacttatttgagtgatggatatagtttgattagaataaaatctagtaactattttgttaagtcagggtattgggttgcgcaagaactttctcgccctacttgtgactacccttttcagggaccaggaatcactccctttttggcacaagtatggaagttaaaaaccacaagaaagcttaagcattttgtggtaatgtttatcagggtacttggcaacaaaccatacactattctaccgacacatcggtaaggaaaagcattgtcctagatgtggtgctcaggaggagacagttaatcacctcttttttgaatgcccaccagtgcttcaaacttgggctctttcaccaattccatcactgccttcctccttttctgattagtccttattctccaatttggattttctttctcgaaagtgaaaggaatgatgaatggtaaagaaattggacaccttttcccatggatactatggtatgtatagaaggctcaaaatagctttatacagtagaaactctataaattagtaatgttgggatcatgaaattttattaatttataatgatattaatttatcctataaattaatatttattaacttatacgataagttaataaatattaatttatagaaatatttacataaaatacaatattatattctttttaaaatgtttcttaatttaagtttttatatgttttgttgtttgcatatataattatgttagttttagttttttttttacttctttaatttatttttcagcaagatattgtgtctatatatctacgccattaacgtcaatgtaaacgtaaacatgaagcttaatccaatttctctttactcaaatcttagcaatgctttctcaaaaagattttacaaaatcaactatgacggatcaaatacgcaaatagttaattatatgagtataacaaagatcataccagttgtattttaaaaagagttgtaattgtagcttgaataaaaatttcatataaaaattagtcttaaaatatatacttaagatctatgattattaatttataatattattggattttgaaattttgaattttttttcattttttatttatttattttacattaggtttcttccctcttgtaacaatatttgtgctgattgtctagctaaaaaggtaagagcatgagggtctcttttctcccatgtaaacacatctgcttaggattgtctttctttagaagaaaaattccgtccgataacttagtaaaatggtgttcgactaaaaagaaaaaaaaaacatttaaaacaagaaagtcaaataattatttgatataaaattttaatgacatatttataattaaaatataatttaacagaaatatagttatatactagataaaaaaacatatttctttgaaaattaaaacagatgaaatatatgaaattaatcatttctaaaaagctttctaagtaagctgtttcgttcctttacatctgtctttttcatttactttttgggttgagattattagtttcttgttcatgaagcttcgcatctccatcgaggatcatgtgtacggacccgagtgcttacccaaataaaccgaattaccatagcatttacaaaaaaaacatttggagagttggttgtaccattctaattatatatagttcgtcttttaatattgtggttagctaagaaaattcaatattaggtctactttaagacacagattgagaaaaaatatatataagttaataacttttggtgaagaatctgttgtcaacgagccaaaatatgagaatttttgggtataggttacttgcttaacacgagagtttgttctgtgcgtgaagatatggtcttattgcttcaccaagttggtccaacatatatatatgatctaacatttatctatgagatctctttatctattgtatatttcgtaaatgaatcctactatacatacatgaaatattgatagtcgggcataacttaacgttttccattgcataattcatcacacgatctttttcttggattttttttatatatataaaatataatctgttaaaggatcaatcaagatcatgttatggcatatgatatattgaatagaaaataaataaaactggcaaaactttaaatagtttggaaaagaaaatgagtttgaataacgacactccatctctcgtcacctttcttgattttgaagagattagttttctctattttttttcgttttttcttttataaactccatatcctgatttagtttaatgatctcttgaaggggttttcctaagtgtggttggataccattagttaaacattttcacacaactctagctataacacattcaatatttcaactgtgaatactagaaaaaggttaaaatggttcaaattaaaatagtcataatcaaaatgttgaaaaatgcatttaaaagttatttgttgcaaacgtatgtacatacaccattcataaacttgacgtccacgcaacctcccaaaaatattattttattacaccattttaatttaatatactataattaaattttagttccaaaacttaacattcacttgcccctctttctatatcacctcctcatctttagctccctctctctcgttttatcttttgatagttctgattgtaattagattttggtaggtcacttgtatagagagatcagtaaaataagaaggatgagttggtgtgatggttcagatgataactacgatcttaatcttgaaagagtatcgaacactgatcatccatcggttcaactcaaagaccaatctcaatcatgtgtaacgagccgtccagattccaagattagcgctgaaactcccatcacgacttgtccttcttgcggacacaagctccatcatcaccaagacgaccaggttacatatgttaaccattaattcacctaaatgttctttagttatcaatatgattactttagattttgacataaaatg

SEQ ID NO: 27292 - DNA, 3000 bp, Unknown; identical to SEQ ID NO: 14932
  misc_feature (1)..( 3000): 2750-1469P.txt file - cDNA_ID_2731244; gDNA_ID_2684234; Annot_ID_137678

SEQ ID NO: 27293 - DNA, 3003 bp, Unknown
  misc_feature (1)..( 3003): 2750-1469P.txt file - cDNA_ID_2731250; gDNA_ID_2684234; Annot_ID_137674
cactgattaaaaaccgtggaacagggagattgcaagcacacgattgtgattcgagacatgaggatgagtcatccagaggacgttcagaacagagcagcttacccgatcatgttctggccgaaacgtaggattcagaaatgcggtgtttgtaagataaagagagcttcaaaggttgcagtggatgacaagtgggcaagcgagaacagtagctatttctgtgatgtttgttttgagcttctacactcagaggaaggcccacttaactgtgacttcccagtgtttgattatgtgcatgagtaaagatgatcttctttgttgcataatatatagataggaagaatacgaagaaatagttggcattgcaagaagaagacatgatgagtcttgtcttggtaaatttgttgcataattggatatatataaaagattttcttgaaatgatgacatgacaactatttctgaatttagccattgtcaaaagctctcttcgttttgaagcggtagaaaattagaaatgtttatgtttagccaaattcaaaagtagaggagattccttgaatttctgttttctctcgctgtcttctcaatattcaaaactcaaattggtgtcttctccaatttagaaaacgttaaaaacaagagaaaataaaactaaactttttagaaccaaaaaaaataaaaataaaacgcatttgggatttctcattgtcatcccaagttcttggaacagccaaatactttttcattattagtttataatcgtctcataaaggcaaaaaggtttatttcggaaataagatgggagcatatagagcagaagacgattatgattacctcttcaaggtggtcttaaccggagattccggcgtcgggaaatctaatttgttatctcgtttcaccagaaatgatttcagccacgactcacgtgcaaccatcggtgtcgaattcgccacacgaagcatccaatgcgatgataagatcgtcaaggctcaaatatgggataccgccggccaagaaaggtacttacactctaaaattactctcaaaagttatttaacgtttgcatgatgaccaaataaaattttaaaaaattaggtaccgagccatcacgagcgcttattaccgaggagctgttggtgcattgcttgtttatgacgtgacgcgccacgtgacattcgagaatgttgagagatggctaaaggagcttagggaccacacggacgcaaacattgtgatcatgctcgttggcaacaaagctgatcttcgtcaccttcgagccatctcaaccgaagaagctaaagcttttgcagagagggagaatacctttttcatggagacttctgcacttgaagctgtgaatgttgataatgctttcactgaagttctcactcagatttacagagttgttagcaagaaggctcttgaagctggagatgatccaaccactgctttgcctaaaggacagatgattaatgttggaggccgagatgatatctcagccgttaaaaaacctggttgctgctctgcatagacacacttctcacttttttcttgtacttttattactaaacactaacatttttcaatattttcctgcaaatttgtatacattcttggaattatcagacaaacaaagttcacactcaaaagtttttttagtttcggttccactctttacaatcgcttgcttcgtgctctctctgcttctaccgatcgatgtacttctgaatgttcatgaagatgttccattgttgacgcgctcctttttccccatctgcaaatagaggttaaaacagcctaatcagtttatatcatatgagcgtgaaatcttaaaaattgtacttcaaaatgtttctttcaactgtgagttttgtctagtaatgaaaaagctaaagccaacatggaagcagaagaagaagaattgcagattttgagtgcaacacaaacttaggaattatccaaacatacttggtacttgagaaatggaccttccatattctgatatttcatgctaatgtactgaaaccaattgcgaaaacagaggactatggaactcatttataatatcactttgtatggattctatatatgtgagtagcaaaatgaacctaaccatgaaccgtcttcgcttttttttctgcataaagttggataatattcagctcaaagaaaactagattctgatcttaatcatctataagtaaacaaaacagagtccatacagatttcgatatcttaggatcaagcaaagagtagttcaataagaaccaaggatctacataaagttataacaatcctaaaatgtcaatggcatactagagcaaattcaacaattttcttaatatcagttacactagaacaaagacgaacttcgttccaattccctaatcctaaactctcataatcaagaacaaatatcaaaccataacaattgagttactcagtttgaaaaaaacgaatctcaccagagaaaaaacgcagatacggaatcatttttcttcatcgcgaggcttagaactcgattgaagagaaggaagaggattagagcccttgatgatccaaccgagtccgaagaaaaaacctccagctagaatcgcagttccccaagcgtgtgagtaccatttactgtattgccgaatcgcgaatttccattgctcccttaacgtcgcctgatccggattcaccgactcaggcgggttataataccttttacccgaacccgatccgatctccggcgtcggttttttcgccgacgaagaagtattgttgttgttatcagggatttggctcttctccgccattgtcgtcgtctagattcttttcttcagatgttgaaaatcattttcagaaaatgtgtatttaactctaaagccactgacacgtgcaagataatgccacgtggcagtttctcgtactaaaacgattccgtttcattgtttcgtctacctctaaccccaccttagggttttagtactctctgtgatttttatctgttcgtcaatg

SEQ ID NO: 27294 - DNA, 1118 bp, Unknown; identical to SEQ ID NO: 14924
  misc_feature (1)..( 1118): 2750-1469P.txt file - cDNA_ID_2731254; gDNA_ID_2684234; Annot_ID_137672

SEQ ID NO: 27295 - DNA, 3003 bp, Unknown; identical to SEQ ID NO: 21808
  misc_feature (1)..( 3003): 2750-1469P.txt file - cDNA_ID_2731258; gDNA_ID_2684236; Annot_ID_137721

SEQ ID NO: 27296 - DNA, 3000 bp, Unknown; identical to SEQ ID NO: 14955
  misc_feature (1)..( 3000): 2750-1469P.txt file - cDNA_ID_2731276; gDNA_ID_2684236; Annot_ID_137712

SEQ ID NO: 27297 - DNA, 3003 bp, Unknown; identical to SEQ ID NO: 15725
  misc_feature (1)..( 3003): 2750-1469P.txt file - cDNA_ID_2731279; gDNA_ID_2684236; Annot_ID_137711

SEQ ID NO: 27298 - DNA, 3000 bp, Unknown; identical to SEQ ID NO: 14952
  misc_feature (1)..( 3000): 2750-1469P.txt file - cDNA_ID_2731283; gDNA_ID_2684236; Annot_ID_192417

SEQ ID NO: 27299 - DNA, 3000 bp, Unknown; identical to SEQ ID NO: 14952
  misc_feature (1)..( 3000): 2750-1469P.txt file - cDNA_ID_2731283; gDNA_ID_2684236; Annot_ID_137708

SEQ ID NO: 27300 - DNA, 3003 bp, Unknown
  misc_feature (1)..( 3003): 2750-1469P.txt file - cDNA_ID_2731287; gDNA_ID_2684236; Annot_ID_137707
actgcccatggtgtccttaaagatggttggagctccctcagacgctattacctgaataactttgctgatggaactaagcaggtcagtgaattttcattctcagtaactctagttgtatcatctaataatgttcagttgcaactgtgtgcgactacttttggtgtcacttacccctgtaactggaatgtgtcctgacgcaagttaatatggctatgtgcaataggatgcaattgatctcttgcaagggcactacatagttgctgtgagccgagacatggctcctgtacctcaaaagggaggccttgaggctgtagccgtaagcatttatcaattaagattagaactaatttccactatattagcatacaaagaattctagtcttataacaatgtaaatttcatgtctcagaacttcccagtggcattgttcgtggttctgatgagtttctggtttgcaacaatgtctctaaaacaaagtaagtatggtatttcttttgctggatagttaagattttctttcaaacttaatctgaaactgtgtaaaatttgctgagcagctgggagtgattataagcataagcacttgttcttctcattgttgtggacgggaatttgcgtgggcatggctgcactggtgagggccaatggcaggatcttctgtaaccgacctcgtctgcacaagcccagaggctgattcatttcgtgagatcaattaattaaagacatggaactcaagtcggagacaaaagttttctcccttcgattgttttattttattgtatcaaaattggaccttgtgacaccatctagaggcaattgtctcaggtttggatccctcatgatttaatactcccacagccatcaaatgactcgatacagttacacatctttcttcatgttcattctatgattactcggtccgacaaatggctttctaaatccctacttcttgttgagtgattccattgtagaattcatcatgaggcatgatagaccaatggcagacaaaggaagtgcatgttctaggttgtttagccataacctatgcgcatctttgttattcaggctcagtccctagatggtcaatcgttatattagtgttaggatccattattttgtggcagatgcacatctaccctctgttaaatcttttctacggttgtttctgagagattgtgctccattgttgcttgatcattttttggatatttggtaaggattcaaacaaaccaaaaagaggcctcacaagttcaagaagcagttcaatgaggcatttttaaattatgaaaccaaatattaatcatttaaatatggttaagatctacagtacaaaaaatggaatcaatcaaaacttggaaaaaccagagaaaaaagcacacaaccttgaatatctctctgactttcctatcaaaagaggaaacaaaaaaagaataaagtaactcttcttacctttttccaacttgctctcagttccttcacaactcgttcaaaacacctttgaggagatccaatccctctgcagagatgctcctcctcttatgcgacttgggaatctcaatccgaggaggcgcttcgggcgagaaacagacaaccactacagtaagattgtcacagctgtttcgttgaagagcctccttaaccaaagcttgagagcatctctcaggatcattatgctgcatcagctccctcctcaccatcgtcactgcacactggctactcatcacatcccagagtccatcacagcccattataagatactcatcctcttccgtcagcacaatctcttccagctcaggctcgcagctgagcgggcagagtgaacctttagttcccttaatgtgccaatctcctaaggctcgagccacagatagctgcccgttaaggtaaccatcgtagatcacacctccaagcttctcaatacgtagccgctcggaagtacagttaggtttgtggtcctttgataactcaatggctctgcctcgtttcccaagcaccgctctggagtcaccagcgtttgcaatcaacatagtcttgtccaaaatgagagcagtgagtgcagtagtgccagaggatctatcaagagaagaagcatcagccaaagcatgatcagtcttcacaaaagcactccttgttgccttctttgtgctggttgggaaatgtttgtcttccattacaagcttcataatgttcttttttgtgaatgatgcagcatcaacacctccgtgtccatcaaacaccttcataaacaaacaatcattttaaaaaagagaacttttttgaaatattcgatgaagcaaatcttatataccccatagaaagctccagtggatgatccaatatactcagtgagatcatcaacacaaatgaattcatcttccattgattgttttggtcctttatcagaccaacttccagatctaaacacaggctggaatgttgaatttactccttccggagattttgcaccaaatctctcatctccttcctgcaaacaaatcattttcacattgtaagtttcaaactttggattgtttttgagtcacgagatccgatctaagctacattatcttatctgttcgtgaccgtgcaattacaatcacaagcatttgaatttaaaaaaaaaaaaaagcaaagaagagatgaaccaacgtaatcggtcaaccaggcagtgctgttgcaatggcgcattgcagagatgtttcttggaggtttcccagaggaactgagattcgtcattttgtcatctgcgacttccaatgtgttgatcatcggagaaacttcagtcaccggtgccatttccagattccgatcaaaagctttctttttttgtcagagtcatctcttttaaattataaaaatagcttctttcttcttcttcctccttattttactcaccaatcagctctctggatgccacgtgtgcttccaatctccatattttttttttagtttgaatataaaagagaattaaatcttttattagtttcccattagcgaaagatg

SEQ ID NO: 27301 - DNA, 3003 bp, Unknown
  misc_feature (1)..( 3003): 2750-1469P.txt file - cDNA_ID_2731295; gDNA_ID_2684236; Annot_ID_137705
tacatcaatggagggcgcgtggagttatttattcaaggcttaccaggctatccagataacatccggtatgatggagatggacattactggattgcaatgccttcggtaactataaaaattgaaacccttcttagagtttattgagttggtttaggtctcggtcatattcagtatgtgtgtcatcttttatatcatcttttattgatcactattgtatcatcttttattgatcactatagttgaaaacagggagtaacaacgttgtggaagctttcaatgaaatacccattcttgaggaaaatcacagctatggcggctaagtacggctatgaacctatgtttatggagaatgcaggagttttgcaggtggatttggatgggaaccccatcgcatactaccatgatcaggcgctctctcacataaccaccggtgtcaagattgggaactatctctattgtggaagtctctggcattcacacattctccgacttgatctcctaaaataccctgcacaaaacaagaagctttgaaacttcatgtttataaaaaaaaaagacttttacattttaggagtattcactgtcacaaaatgtaaactcattgtcctgagaatgaatcatgatgtttctctatctctaaggatattagtaacctgaaacaatgaataccaaacgaaaaaaatacaatgaagacaaaccaaatcatacttaagatgcacaattcctaaacaaagcagatatttttctttgtttagaactcaaggcaacccattgtccatacaatattggccctactggtaacatagtaaaaccccacgagatttcgactaatagttggttacaacttacaagggactagagtcaaagattattatgagtcaacgatgatttgcgatttcatcattaaatacacgtgtttaatttagttgtttttctcttcaatcacaagttcacaactacaaaattggcatgttcaccatttttccacaaactcaaatttgctccaatgcctgtacttttctcctctcgttctctcatactctccattattgtccccttacttatatctatcgctctctacaaactcgacacattcgaccccgctattgttccttccgatgcattcacatcctctgctacttcactcccgccgcttataaacgacgaatttctcaccggagctgagtttatcggtgtcggtcttctcaatatacccgaagatatcgcctaccataaggaatctaatctcatctacactggttgtgttgatggatgggtgaaacgagtcaaggtcgccgactcggttaatgactcagtcgttgaggattgggtcaatactggtggtagaccgctcggaatcgcgttcggaatccacggcgaagtcattgtcgcagacgtacacaaggttggggttttgaaatcgaattttgaaaaatcacaatcttaggtttgactttgttgttatgtatagggactgttgaatataagcggtgacggaaagaagacggaattgttgacggacgaagcggacggtgtgaagtttaagctgacggatgcagttaccgttgcagataacggcgttttgtatttcacagatgcttcttacaagtacactctcaatcaattgagtttagacatgttagaagggaaaccttttggacgactcttgagctttgatcccaccacacgtgttacaaaagtacttctcaaagacctctacttcgctaatggcatcaccatctctcctgatcaaactcatctcatcttctgtgaaactccaatgtatgtgcattggatcagttaaattttttataaatttccgactcagtttgatttggcaataagttaatttatctatatctgttatatactactttaggaaaaggtgcagcaagtattacatcagtgaggagcgtgtggaggtattcactcaaagcttaccaggttatccagataacattcgttacgatggagatggacattactggattgcattgccttcggtaacgttacaaattgaatttcttttcttttctttgaggtcatgttattaactcattacatgctaataaaggatcatctttgtgttgtggttgtgcaaacagggagtcacgacattgtggaatatctcgttgaaataccctttcttgaggaaactcacagcaatggtggctaagtacggcgtggatcttatgtttatggagaatgcaggcgttttacaggtggatttggatggaaatcccatcgcgtactaccatgatccaaaactctctcacatagccacatgtgacaagattgggaaatatctctattgtggaagtctctcgcaatcacatatcctccgacttgatctcctgaaatatcctgcacagaacaagaaactttgaaatattatgttttcacaaataaggaaagtttccattttaggaaggagcattcactgtcacaaaaaatgtaaactcatttcctgagaatgaatgatgattgtatctcttttttttttttttttttgtctctctcgtagatttgtatcattgattccaaaagcatatactatctagcatgatgtgagtgttattgttcctttaattagactcgatacattcctttaattagacttggtcataattaaaggaataataacactctgtgatatatgaaaagcatataaatggtattaagtaagaatcgaacctgtgacctttaagaagttaagctggcttggaaaggtgtatgaggtggtcgtccactaattagattcagagagtcaggacttgatccaacgattaacgcaaaatcatttgcacgttctacgcaactccataatttcaattcctctcgacgtttcacggcgaagcttcagatctacttttccccagctcaggtgatcttttccatcttccatcatcttcgttcgctgttagagattatcttcttcttcgtcttcgtcttttcctttacgatttctgaatcttcttttgtctcttgtttgattttagtatg

SEQ ID NO: 27302 - DNA, 3003 bp, Unknown
  misc_feature (1)..( 3003): 2750-1469P.txt file - cDNA_ID_2731299; gDNA_ID_2684236; Annot_ID_192413
tcttaaggagtacatagtagcctgaaacaatgaatacaaaaccaatcaaccatacaagccattccaatgtgtcataaaacttaacaaagtttagtgcgcatgttctttatatattaatgattagaagacgtcccctgactacggttacggttattacgtttacggtttattaaccaccggttacggttataaatttttgttaatcttaaccttaaccgttacatgtacggttaaaacggttacggttaaatacggttacggttaaatacggttatggttaaatacgattacggttatttgataattatgatatagttaatatacgaagtaaaatattatattttttaaccttcataataaaaaaataaataaatagtaatatatcaaataatatttattttacgcgattatgtgcttcaaatatctatagtgaatcatctatctattttcttaagtaaatcaacgaataaacaaattaatggtcataattataataatttaattacattttcgaaacaaaaataattctaaagagaagatgttgtgaacattaaaaaacaattttaagagtataaataataataatatgaactacttataatttaatttatggtcaaaagagtagtggagtaacttcgattgtagtagtgacatattaaacgatttaaggtgatgttttagtaaaataattattcatttaaaattatacacaattacaactatattttaaaagttttaactatacggttaaccgacggttttgatacggttacggttaattaacggttacagttagtatatttttttaaccgtaactaatctattttcacggttaacggttacggtcaggttacggtcagttaattaacggtccggttacgatccgaaatacggttacgattagattttggtcatgcgccttgagctcctctagaaaaatattgggcctactgggaatatggttaaagcccataagattccgtaacataacgtactacggaaaagaagaagtcaacgatttgatctgtgattgtttttctctcaatcaacttcaaaatttgttgattcaccatttttttccacagaaccaatccttctacaatgcctgtattcctctcttctcgttttctcttcttctgcatcatcgtccccttactcatctctatcactctctaccaactcgacacgtttgacccagctcatcatcccgctgactcactcatctcctctactgcttcaatcccgcctctaataaacgaaagatttctcaccggagctgagtttatcggagtcggtcttctcaatagccccgaagacatcgcctaccatgaagactctggtttcatctacactggttgcgttgatggatgggtcaaacgagtcaaggtcgccgagtcggttaatgactcactcgttgaagatttggtcaacaccggtggtagaccgctcggaatcgctttcggaatccacggcgaagtcatcgtcgctgacgcttacaaggtttgggttcgtgacttttttgaaatcgaagtttgaaaattttcaattaataggttggtttctgtctgggtagggactgttgaatataagcggtgacgggaagaagacggaattgttaacggaagaagcggacggcgttagatttaagctaccggatgcagttactgttgcagataacggcgttttgtatttcactgatggttcttataagtacaatctccatcagtttagttttgatatcttggaaggcaaaccacacggtcgtctcatgagctttgatcccaccacaaaagtgacacgtgtacttctcagagatctctactttgctaatggtgtctctctgtctcctgatcaaacccatctcgtcttctgcgaaacccccatgtctctctcacatttcatctctgtttcttttattttccatctgtgttcattgaatcctcatgatctcaagttgttattttgttgttctcagaagaagatgtagtaagtattacatcaatggagggcgcgtggagttatttattcaaggcttaccaggctatccagataacatccggtatgatggagatggacattactggattgcaatgccttcggtaactataaaaattgaaacccttcttagagtttattgagttggtttaggtctcggtcatattcagtatgtgtgtcatcttttatatcatcttttattgatcactattgtatcatcttttattgatcactatagttgaaaacagggagtaacaacgttgtggaagctttcaatgaaatacccattcttgaggaaaatcacagctatggcggctaagtacggctatgaacctatgtttatggagaatgcaggagttttgcaggtggatttggatgggaaccccatcgcatactaccatgatcaggcgctctctcacataaccaccggtgtcaagattgggaactatctctattgtggaagtctctggcattcacacattctccgacttgatctcctaaaataccctgcacaaaacaagaagctttgaaacttcatgtttataaaaaaaaaagacttttacattttaggagtattcactgtcacaaaatgtaaactcattgtcctgagaatgaatcatgatgtttctctatctctaaggatattagtaacctgaaacaatgaataccaaacgaaaaaaatacaatgaagacaaaccaaatcatacttaagatgcacaattcctaaacaaagcagatatttttctttgtttagaactcaaggcaacccattgtccatacaatattggccctactggtaacatagtaaaaccccacgagatttcgactaatagttggttacaacttacaagggactagagtcaaagattattatgagtcaacgatgatttgcgatttcatcattaaatacacgtgtttaatttagttgtttttctcttcaatcacaagttcacaactacaaaattggcatgttcaccatttttccacaaactcaaatttgctccaatg

SEQ ID NO: 27303 - DNA, 3003 bp, Unknown; identical to SEQ ID NO: 27302
  misc_feature (1)..( 3003): 2750-1469P.txt file - cDNA_ID_2731299; gDNA_ID_2684236; Annot_ID_137704

SEQ ID NO: 27304 - DNA, 3003 bp, Unknown
  misc_feature (1)..( 3003): 2750-1469P.txt file - cDNA_ID_2731301; gDNA_ID_2684236; Annot_ID_137703
ggtgtttctcctcctaacttggtcttgatcactcagccgcgatcttttgtacttagagttatagtgttgttctttaattttctgtagattgcttctctctccttctattcttctttgtcaaaaataaaaatggtataaaacttcatcttttacccaaaaaaaataaatgtaaagtcgtgtacagtgaatattactctgttttcaactccagaaaacataattgggcctattgggaatataattaaagcccacgagattcgactagcgagagttgttgttggttacgtaatttagcgcactacggaacaaagaagaccaaatttatacgagtcaacactcaacagcgatttgatctgcgatttgatcatcaacaacaatcactccaaattttgtctgctcaccatttttccacaaagccaattctcttgtatccaatgcctatgttctactcctctcgttttctcttcttcttcaccatcgtccccttactcgtctctatcgctctctaccaactcgacacatttgacccagctccggttccttccgaggcatacgcctcctctactacttcaatcccgccgcttatcagcgacaaatatctcaccggagctgagtttattggcgtcggtcttctcgataaacccgaagatatcgcctatcatcaagactctaatctcatatatactggctgcatagatggatgggtgaaacgagtcagtgtccacgactcagctaatgactcagtcgttgaggattgggtcaataccggtggtagaccgctcggaatcgctttcggagtccacggcgaagtcattgtggcagacgcatacaaggtttggattcgtgaactttttagaaatcgaattttgaaaatctcgatcttaggttgattagtgtgtgtgtcggtagggactgttgaacataagtggtgacgggaagaagacggaattattgacggatcaagcggaaggcgttaaatttaagctgactgatgtagtcgccgttgcagataacggcgttttgtatttcactgatgcttcttacaagtacactctgcatcaagtcaagtttgacattttggaaggtaaaccacatggccgtctcatgagctttgatcccaccacacgtgttacacgtgtacttctcaaagacctttacttcgctaatggcgtctccatgtctcctgatcaaacgcatctcatcttctgtgaaactcccatgtaagtccactgactctgttggattttactaatatccgactcataccagttagcaatgtgttaattcatcgatatactatatctaggagacgatgcagcaagtattacattaatgaagagcgtgtagaggtgtttattcaaggcttaccaggttatccagataacattcggtacgacggagatggccattactggattgctatggtttcggtatgtaaaccagttgaaatattttctttaaggtttatgatgatgagcttttgtatagttttgctcatagtgttgtgaaaacagggagcatcaacgttgtggaggctctcgatgaaataccctttcttgaggaaaatcacagccatagcggctaagtatggcgtggaacttatgttcatgaagaatgcaggtgttctgcaggtggatttggatgggaatcccatcgcttactaccatgatcagagactctctcacattaccaccggtatcaagattgggaactatctctattgtggaaatatcttgcattcgtacattatccgactcgatctcctgaagtatcctgcacagaagaagaagctttgaaacatcaaagtttatacaagcactaaaaatttccactttaggagtatgcactttcacaaaaatgtaaacgtatcgtcccttagaataaatgtatgataatgtctcttaaggagtacatagtagcctgaaacaatgaatacaaaaccaatcaaccatacaagccattccaatgtgtcataaaacttaacaaagtttagtgcgcatgttctttatatattaatgattagaagacgtcccctgactacggttacggttattacgtttacggtttattaaccaccggttacggttataaatttttgttaatcttaaccttaaccgttacatgtacggttaaaacggttacggttaaatacggttacggttaaatacggttatggttaaatacgattacggttatttgataattatgatatagttaatatacgaagtaaaatattatattttttaaccttcataataaaaaaataaataaatagtaatatatcaaataatatttattttacgcgattatgtgcttcaaatatctatagtgaatcatctatctattttcttaagtaaatcaacgaataaacaaattaatggtcataattataataatttaattacattttcgaaacaaaaataattctaaagagaagatgttgtgaacattaaaaaacaattttaagagtataaataataataatatgaactacttataatttaatttatggtcaaaagagtagtggagtaacttcgattgtagtagtgacatattaaacgatttaaggtgatgttttagtaaaataattattcatttaaaattatacacaattacaactatattttaaaagttttaactatacggttaaccgacggttttgatacggttacggttaattaacggttacagttagtatatttttttaaccgtaactaatctattttcacggttaacggttacggtcaggttacggtcagttaattaacggtccggttacgatccgaaatacggttacgattagattttggtcatgcgccttgagctcctctagaaaaatattgggcctactgggaatatggttaaagcccataagattccgtaacataacgtactacggaaaagaagaagtcaacgatttgatctgtgattgtttttctctcaatcaacttcaaaatttgttgattcaccatttttttccacagaaccaatccttctacaatg

SEQ ID NO: 27305 - DNA, 3003 bp, Unknown
  misc_feature (1)..( 3003): 2750-1469P.txt file - cDNA_ID_2731303; gDNA_ID_2684236; Annot_ID_137702
tttaatttgattgagtgattcaagactgccattggattcatattgatcattatcaattggacgcattgttgaattagagagacaagattatgaatcaagatcatggcttgtccccgtttaaaaatggtttaaactatatgataagtttatttagaaagaaaaaaagatcatgtacggggaatcttagagaagtggtacgttacagacaaaagatcttcacaaaatttgatacattgaacctcatctcaacgtcaatctacaactacgccttcaatagtaacagaaacaaaacacaaaaagtccataagttaaacactgggcctgacaatttaggcccatatactgaaggaaaacgagtctataaataattgggcctaatgaaatataaaagcccacgatactagattatcgaatggtggtccctattagttacgtaacgtacgaagatttatctacaagtttgaatcactccaaaaatttaaaattcagtgttcaccattttttatttttctccacaaacccaatctttctacaatggttctcttcttctccactcgttttctcttcttctccatcttcttcccttgcctcatctctatcactctctaccaactcgactcattcgagccagcttcacttcccgcggactcactcatcacctctcccacttcaatcccgccacttctcaacgacagatttctcaccggagctgagtttatcggcgtcggtcttctcaataaccccgaggatatcgcctaccataaggactctaatctcatctatactggttgtgttgatggatgggtgaaacgagtcagtgttcacgactcagctaatgactcaatcgtagaggattgggtcaataccggtggtagacctctcggtatcgcttttggacttcacggcgaagtcattgtcgccgacgcaaacaaggtttagacgattctttattttttgaaatcgaattttgaaaatcttatcttaggtttgatattgttggtgtgtgtagggattgttgagtataagcgatggcgggaagaagacggaattgttgacggatgaagcagacggtgttagatttaagctgacggatgcagttaccgttgctgataacggcgttttgtatttcacagatgcttcttcgaaatacgatttctatcaatttatctttgatttcttggaaggcaaaccacacggtcgtgtcatgagctttgatcctaccacacgtgccacacgtgttcttctcaaagacctctacttcgctaatggcatatcaatgtcccctgatcaaacacatttcgtcttctgcgaaaccatcatgtatgtgcattacatttgttatgtttctaactcaaaaccaattggtaattagtttttatttatagattttgtatattactttaggagaagatgcagtaagtattatattagtgaggagcgtgttgaggtatttattcagggcttaccaggttatccagataacattcggtacgacggagatggacattactggattgcattgatttcggtatttatactataattgaaatcttttcattaaagtttatgatgagattattatatcatctttaatcttttatttgatcattgtgttgtgaaaacaggaagtaacaacgtcatggaaactctcgatgaaataccttttcttgaggaaactcatatacatggcggctaagtatggcgtggaactactgtctataaagaatgcagccgttttgcaagtggatttggatgggaatcctatcgcaatgtaccatgatcatccattctctcacataacaagcggagtcaagattgggaaccatctctattttgggagcctcttgcattcctacattactagactcgatcttttaaagtatcccgcacaaaagaagctttaaacatcaagtttaggagtattcactgtcacaaaatgtaaagtcttcgtccctggcacatcatcatgtccttttgtcttcgtccctggcacatcatgtacggttgttgtaaggtcgagttttggtgttaaggtgttgttagtttataatctttgtgaatatggttagcttcttggtgcattgcaaggttaggtgaggtgaatagaggtggcgaataggttttagtggtttcacttttcgttgagctagtgtattagtccatgtttgctcgttcgttttgcgttagttttcggagaagctataagcttctatctggaggttttgtggacggtgttgttctcggaaaactaaagtatagcagaagattgcaaaatacttcgatggtttattgatatgaattgcatgcctttaaatagccatgactacaaagactacgtcgttcacaactaaacaatgagaaacttgcggaagtaagctaaagactaggaccactataacaactactactcgactcttaaagaccatgagtttattcaaacatgagaacaacttaacgacttattcaaaacccaacagacggagagtaatgcttgtgacaactcagatgaggattccagtgcttcggtattgcggcaacagcgtacttttccgagcttcgcggattcggtgtttctcctcctaacttggtcttgatcactcagccgcgatcttttgtacttagagttatagtgttgttctttaattttctgtagattgcttctctctccttctattcttctttgtcaaaaataaaaatggtataaaacttcatcttttacccaaaaaaaataaatgtaaagtcgtgtacagtgaatattactctgttttcaactccagaaaacataattgggcctattgggaatataattaaagcccacgagattcgactagcgagagttgttgttggttacgtaatttagcgcactacggaacaaagaagaccaaatttatacgagtcaacactcaacagcgatttgatctgcgatttgatcatcaacaacaatcactccaaattttgtctgctcaccatttttccacaaagccaattctcttgtatccaatg

SEQ ID NO: 27306 - DNA, 3003 bp, Unknown
  misc_feature (1)..( 3003): 2750-1469P.txt file - cDNA_ID_2731312; gDNA_ID_2684236; Annot_ID_137698
accagtcctaaccagacaaaaaagaaaggtgttggttttaaacaagctctggtgttacaatgtgacattaaaacacgaatcttttctcttgagaatcatcaatagagagagagagtgagtggtcatattagggttcataacttgcttgaggttttgtaaaaagcagagaaagagagagagaggggcctagaaagaaagaaagaaaagcagtaagagactattaaatgttgcaggcaggtccagccagtgtcccctctcttctgcgagattccctcaaaatttattacaaagcatcttcatcgatgttcttttaattcttcctcaaaatcttttctctttttttggttatatatatttgaattttgatttatgaacctcctcaagaaggaaagacagaggaggagacaaagaagtataggttcacattgcatagccagtttagttttgaaggatggatatatgaaaaaaatatgaagagagagaagagagaagaagaggaggattaaagagggtgaggccagcttttgtgctttggtagtagatgaggtttaaatgctccataccttccatttccttctctcttaccctaatttaattcttcctctcctttataactccccacagacattctcacttctcctcctcacacttcacatcaacacttctttcttgttttttcattttacaatgtttcctttgatatccgcactttaagcatgagagagtccctttgatattggcctggttcactcagatcttacctgaccacacacgtagatatacattattctctctagattatctgattgagccgcgccaatatctcagtactctctcgtctctattttggactttgtggtcttgtagatcgatttgtatgtgtgtgttgaaatggagacaagtacttgtaacttctttgttgttatattgtttacctataggctgatgtcataaactcttttgatcttgtttctaacttccagattcttgaaaaatcaagtcgtgtgtgtgtctccatggaagccttttccatttcttcttttccaaggtatccccttaatcagcttccttgccaagtataaatctgttgtagggttttgcttcaaataatctatatggatccttttagaatgcatattgtgttgataccaattttgagacagaatgtgtcagcgaaactgatcttgtttattagtacaaatgcaggatgttagagagttagctaataacatatacaacaaaatcacaaaaccggtgaagcaatgtaaaatgtcacaatcacaagatgtttttttcaaaaacaggggaaaaagcagagttaatgagagagaagctgacgagcacgaaccctaacctgcaagcgagcaagagcatgcatacaatgtaaagcaattcgtgcttgtctcctcacaagcactcctctagccaccgcctgtaacttcaccagactcttcaatgctttaaacgctcttcttgcctgcaaaacactttaatggttttaccaattttgttttttcaggttttcaaaatctacagagatagaaaatgtaaattaccaggtgccctctgaaaaaggcttggattttaacggcggcaatctcttctcgagttgtttctggagctgaagagcgaatgattgtgattctgctttgagatcgtcggagaagtttccttcttacaacaccaaacaaacgtttggagttggccatgtttatgggtggatcttgtcttcttttggttttggttttggttttaaaagaggacgtctaaggaaacgtaaaatgtgaataaaaagtgaagacggtggctttaagggatatatggaacatgatgtgctctcctcatttctaactaacgaacgtgctcgcatgctcctctctttacacttggtttcgttttgtttattagtagttttcaagacacacgagtctttggtcttttttacatttagttattgaattatagttatgttatgcctaactcaataaaaagaagcttattgagattttgaaaaggttattataaagggtgattgttgcatttcaatgctcaaaattaccatgttatgatatatcttataatcacatgtgaaatctacactatttttaaaatttatgatttagacaattttttcgaaaatgtcactctatttttcaacaagaaaataaaattaggtcattggtattgtggtttgtaatatactaatgacccccactacaatcctaccgacaaagcgtccactctttgtaatgaagttctttgatcatttctctattcaatcttgacactatgaatgtaatcgcgcagcggaagaatggttcatcatactcttacactgttacacaggtccagccctgaactaaagtgtttgtgtttttgtatcggatatgattagcaattgtgcatcaagttagttacggtctcttctcaaatccagtaaaccaaaaaatatataaaaaaatcatactctataataaacttacatcaaatgtcctttttttaacgtttatgttgggagtacgtagtgagatttttcagatatgataaatgtttatgtttgaagttctattttgagtatcatcattttacacgtctcctatcttttcttcaatcaataaagcctttgagcccacaacttcgtaataccgttaaacccaattgttattgggcatgaaaacaaggcccaactcaagtctatctcccccacttgttcatcttctattgtcttgttgcgagtttgcgacttaaacagtaattaaattactaattacgcaataatggcggattaatcgaacctactctctctctctctctctctctctctctctctctctctctctctctctctctctctctctctcgtgcatctccataaactatcttcaaagattaaattttgaagatcttctttttggcttattacccgattctgtcactgtctcttcttcttctccaatcccaatgtttgcttgagagaaagagagagagtcaaaccaaaacatg

SEQ ID NO: 27307 - DNA, 188 bp, Unknown; identical to SEQ ID NO: 14981
  misc_feature (1)..( 188): 2750-1469P.txt file - cDNA_ID_2731322; gDNA_ID_2684237; Annot_ID_137742

SEQ ID NO: 27308 - DNA, 3003 bp, Unknown; identical to SEQ ID NO: 23980
  misc_feature (1)..( 3003): 2750-1469P.txt file - cDNA_ID_2731330; gDNA_ID_2684237; Annot_ID_137735

SEQ ID NO: 27309 - DNA, 3000 bp, Unknown
  misc_feature (1)..( 3000): 2750-1469P.txt file - cDNA_ID_2731352; gDNA_ID_2684237; Annot_ID_137726
aagaggcagaggaggaagaagagttagctgcggtggaggtggaggcggtgaaggtggaagagggttcaacgtcgtggataagaggcttggataggcggcggtgggcggcggaggagtcgtcatataggaggttaaagttgttgatgagaagaatggatggacggttgggatcgtcggaggtggcaccggacggagatgaagagggcttggtgagatttgatgggaagcaaagatggaagtttttccacatgactcttggcattgtttttgtttttgtgagaaagagagtgagagaatatgtattgagcatgtggatttagctaggttgtcttaatttgttttgatactattattgtatcatgcttgtatttatatgtacaaatatttatattatatacgtaccaccatgtatttgtataatgtattatatttacacaatgcatcgtgctttgctgtgaatcttaagaccaaaataattttaattcttatttttacttattttgtttgtataatatacagatctacaaaagtatcttattattaacggtcatcttagttttttgtctgttcgtttgaaggttttaagttataccaactttcagtaattcatacacttttttttttatagatttgttttcttgaaaatggttatatatcacttaaaactaaatttttaacatatttgatataaaattcatatttattgttgacaatgaaaatttctattttattattaatatacaatcttgataaaataaattaaaatattaatatcttaaatgtgaattagaaatttcaattaattaaatacaataagagggtaatttacgagtttttgtcgtatatagtataaggtaaaatgactcaaaaagcaaatcttgatggtaatcgaaactttaaacatgaaaaagcgcctacgcgtaaagtatttgttttttttcttagatttgatagaagggaaataaggttatatacggacatgcaaatatttatatgttttctccattatcaacatatacaaattatatgagtaaacttcaacaatataatccaaaattgtactgtttatctttatattttcacgctttttttttcttaatgtcataggcaaaaattctgcggggagagcaaaacctttattgtttagtaaataattttcttcaattcatttacgaactctagacataataaataaattaacgccaaataagaggaattattgtccttgcaaatatatacagcaagaactcacgaggaggcaatgtttggactaacctaaactggccatctcatgactcaaagacgaaagatcgatgtttgtgcaaagtacactgactcacttcacttctcattgatcaatcttaactaatatttgttctcttccctttttcagtttatcttagaccattgtttctcctagcaacaaattcaccgaatgatcatgtcgcgattagttttgggataaaatcataaaattgcttctcatcaagaattgctccgcaaaatcaatgttcaagcagattactagaccaaaatttatgatcgagtagtccgaatataatcttttgcatttaaagcctctaaaatttacaaatatctaaccaatgttacaacatggcatgtacctagtacaagctactaggttacaacttcagagcgaagaattaaaaaatgagaatcctatattaatgaatattctcgcttgagaaatctatgcatgacaactttctatcatcaacaataataattagatttgatcaatctctgtcgacgagaacccgccaaaagtggtgactgagagacatgtcacacaacatcgccctatttatacgtagaaatatcgatctatatatatatatatactagatcgacaataatatggtaagtttttttattttaaatatggtaagtaataaatgcttgtaatacgaaaggcctttatgctctactcattgtttggtgtataaaaaaaaaatggaatcaaggtgtcagatatgatggtacagcaatttttagccccacacgttgtcatttttctttggaaggtacattgagatcaatttctatttttgtattattttgaaatcatcatatagtttcattggatttatcacaagaggaatcttataaaaatgcgaatgggtatatctatctctctttcaatatctatgtcacacaagtgttgttgctatattgtagggacatgtcaaaacttgtcgacaaaagctccatgaatgggaaacattgacatcaagatacaaaatcacatgattcttcaacttgtgaaagttttcgagtgtgaacatcagactcacataaaactccattgtagatatctcttgtcataagacactgtcacattcaatatcgttttcaaactctccaaaatactgcctgattgcaatgttacaattttgtcatggacccaccaatccctgtgaaccaagccggttactgtttattactccgacccgacccgggctttttaaagataggcccaagaaggcccaatgattgaaatgtgaaatgtttgatacattgatgtttttgatcttcgctcaaaccctacaataaaactttggttcctccgaatttcgagttcttgttcttcccaaggcccctacttcggccctagcatcaaccattgtcgttttaaagctccaggttttcatggccaagaaagaagtaactatcgttgagatcttctgaaattaatcagtcttgaagtctctggagattgtacgtttctcttcttcctttcctcgtcggttttaatggattccgtttgcctgatttgcagtttctgcttcaccgtgaaatcgaaactcgttttgctcttaaacaaatattatgcatgcgtttcaatttgggtctttttcttgacaatattggttctgtttggattaagaaattgaaaattagttttgtagctgagccttttctcttgtgtgtataggaactgagctatatcagtagtgtatctagcatatttgattaatg

SEQ ID NO: 27310 - DNA, 3003 bp, Unknown
  misc_feature (1)..( 3003): 2750-1469P.txt file - cDNA_ID_2731364; gDNA_ID_2684237; Annot_ID_192449
gcatgtaccacgtacgattcttcagaaaattaataattagaatataccgtatcactaacaacggtccaagttataagttttaaagtttagtgatgtatatatttgataagatataaaggagttcattaaataggaagtagaaacgacatatcaacagactcagtctaagacagcctaacagtaacaaatcaaatattcgtatcaaatgaaactgtaccttcaagtagtagaatgtattggcgttttgtgtgtgtgtgtttttcttcaatatacatgaacttcggtaattctttcttcacgattatttttttctatatcagtcacgcgaatttacataacgtacaatatctttcattgatttcattttctctaaaaaagcgtgtgattatatgaaaattctgtatatcattgtacatatctcaataaaatgaaaacttgtttttcgctgcaaattcaaaattttaaagcgttactttgtgtgtataatggaggagtaaacataacagtgtgaaatctttattcttctgaatatccagtaaaatttgagataatccaatacaacaaactcgtgtcacgctcaagtagtcaaatgtcgatttggtcacatccgcacccgtttattgaaacttatcaaatatatatcattttgaaaaagcaataagaaaacaaaggcatgcagagataaaaagctggaggaaatgaagaaaaagcccgtgaacaaatagttgaatggaataattagtatgcacagtacatatgaggctgtctttttaattaaaaagaagctcttacttcattctatttttttttttttttttttttttgtcaatccttacttcattctattataagtgattctgataccctatatttgtggaagataaaaaaaaattaaagctaatgagacgactttgagttaagttcaaacttttcattattaatcgcatgaaaagtcactatgattatgtttctttgttcatttataacacactcatcattgtatttaaataaaatttaagattgatgatgtctttaaatgacgattggtaagctagcaacctttaattcaaataaatttgcatgcatatctgacaaaccctttcatcgtcaactctatagatttagataactagatcccggtttcatcagcacacgaacattatatatcagattattccgttttactatatgatcattatttagatgttgccatgttgggttatgtattctattatttagttaaatgacgtgaccttacttctcttaaagattatataatcctcacacaaacaaactattttgaaaattttgttttgaattccaatccatccaataattcaaatgtggattaacgttaatattttgaatgttaatgcaataataatacgatgaacctaacaccacgttgacctctaacacctaacatgttgatctctagtgtgccaaaggaaaaaaaaaaaacacgacaaccaaaagctaaaacaagttatccaaaaaccagtaaacagaattcagaatttaaagttgctaattatatatcggcttagaaataatatttgtcttggtaacgaagtccgacaaatattcctgaattctgattttctgataagaaattgacaatagatagcataaggtataagaaacagtggtgacattattattacagtaataattgacttagcgacttttggaaatactatagttttgttgctctgacgcaccatgtcaacaacaactcactcacgtgacccctcctcaagttctcacttattcttaaaatctttctaagcttttctatcacattttaccaaacctcctgaaaaaatcgatttcatcctttccctttttcttgttctcatatctaatttcaaattttgaaatatggccaatgacgttagtggcgtttgattacgaattttccatcatttcacatttttatatctcgttgattgtaaacaaatttgcttgcttccatcaaagactctagtatacatacatactattgtgattatgtccttgagatttcgagccaaagtcaaaatactaatctctgaaattaacgaagcgccaagactgcttgttattttattgaaacatcagcattggttaactatgattgaaatcacatttgaaaaactccaaatctcccaacaccttgatgagtcattcgactattttaaatttagttggtctcttaaaatattcataataacatttacaatatctaacattactttttttttttgttcttaaagctgttttggagaggtaaacctctaataattttacagacagaattttggtagaatatagcaaaaaagagggtttgatggtacttttgcactgaaatactgaaatcatagttaggtataagccaaggttgacccaaaaaaaagaattaactataagcccatatcttattcatgggctttgatgttggcccatcaaattattaattctctgtgattatttgccacttttaaccattgcccaattaggcgaaaatattaatgagatcgatttctcacaatagagagggggctaattgatcaaatcaaaaactaaaggggtgaaattttaataaggatggattactataaataaatccgggatggaaaaataaaaaaaagttccgttttggtttcctcatctttttgtaccgctccgttgcgcctctctcttcttcccttcctctctctagcggcggagttacattgtcggccgccggggaaaccggcgacagtggattctctaaactcttaaactcgctacgtcgattcttaaaggattcatcgccgataacttttatacctccttcttttccgataggatcgggactcattttgtttccaacaccccggatccggtgatttagggcgctttttgatgcttatcgagtaaaggatttatcgatttaggtatttcgttattgatttgatctcggattttgacgggattaagattaaaggtccttactttgattttgtgtagtgatcgtttatg

SEQ ID NO: 27311 - DNA, 3003 bp, Unknown; identical to SEQ ID NO: 27310
  misc_feature (1)..( 3003): 2750-1469P.txt file - cDNA_ID_2731364; gDNA_ID_2684237; Annot_ID_137723

SEQ ID NO: 27312 - DNA, 3003 bp, Unknown
  misc_feature (1)..( 3003): 2750-1469P.txt file - cDNA_ID_2731368; gDNA_ID_2214471; Annot_ID_133071
gtcctcttcgctctctcacaggcggttctcaacctccttagagctctcgggtttccactaatgtccttcttgttcttcctcttgaactcttgaacaaagtgattcaccattctgttgtcgaaatcctcaccaccaagatgagtgtctcctgcagtcgccttcacttcaaatataccttcctcaatggtcaaaagagagacatcgaatgtaccaccaccaaggtcaaagatcaaaacgttcttctcaccaacacttgtagccttcttgtcaagaccgtaagcaatagcagctgcagtaggctcgttgatgatacgcataacattcaaaccagcaataacaccagcatccttagtagcctgacgctgagagtcattgaagtaagctggaacagtaacaacagcgttcttgatcgttgtaccaaggtaagcttcagcaatctcacgcatcttgatgagaatcatagaagagatttcttcagcagaaaactctttatcttctcccttgtagttaacgacgatcattggtttttcagcaggtccagatttgagcgtgaagggccacaatttgatgtcactttgaacagagctatcagtaaatcttcgaccaatcaacctcttcgcatctgtcacacaacaaaattgaacacaattagaccacagatactatacgaattaaaacgatgctatatgtatattttgcctaaaggctaaaattagtaacattagatcgaaaattgaatctcactagctccagcaatgttaaaacattcttatgaaaccctaaatcatcgctatggatctaccgattacagatctacttataatccaagttcgaaagacaaatttagcaagaggaaacgagtgaaacgtaccgaaaacagtgttaatcgggttcatggcgacctgattctttgcggcgtcaccaatcaaccgttcgctatcagtgaaggcgacgtaagacggtgtggttctgttaccttgatcattagcaatgatctcaacacggtcgtgttgccaaactccaacgcaagagtaagtggtaccgagatcgataccaatcgctggaccttctcctttaccagccattgttaacgctactcaggattaagctaaaaaatcgaaagaaagattgtgaaagaggaattgtgaattgcggctaggtttgttttcttttttccaaaatatcaggtcgaaggagaagtctatatagagtcttgtactcgagtttcgagaaggttcgatggctcgctatgtaaccgcacgatcttttggagttggatctgacggtccaggaatgattcttttctcctacttttccttttcctttaacaaataaggaaagccgtttaaaaaggttcgagaatgttcggttcgatggcttagtccataatcaaaagtcggtcattggctcaacattttcttgcgttctcattggctttgagtcggtccaccgttcaccgtcagtgactcattgatagcttttttccttttcgtttttctgttttttttcccaaaactagctgtaggcccaatgggcttatcttggagaaaatttgaaaaacaagaaaaagttaatgtgtttatttattgtatgctgcataggtttttgccttttacacaaatgataattcagggcagttgttgacatggtccatgagtttgaatagtttgagttgctcgagctatattcacaataagcccaaagaattgtacacacaattgaaagagattgacgagagagtaaagagttttgggtttcctcttttgatagctaaaataagccccaaacaatacgtggaagaagcatgcaaagtggacggtatacgtaacgtaactatgtaataactttaacattctcaaagaaaataatttataaatgcaatgaaataaccaatatagaaactcaaccaaaaaaaaagggaactcattttcagattaaaatttctattgaaaaaaaaacgaatttttgtggcacagaaatttgtagccacaaattggaaataaaataggtgtacaagtaccaagtatatgatagagtaggaccaaattgattatgccatggaaattacctggtgaagaggaaacaatactaaccatgaagcgtgcagcttgtgattaatgctctcgatctctacttgaactcgaactgttgatgagactaatgtctttcatatcacttcttcttcttctcttttgtcttattcctatatttaatcttacccttttttcggtctaccacattttaaatcgagaaatgaaaggtcgattacgtggagaaattataacattttaaactctcgagaaacttgtagaaaatactgttttatcaattagtatttgaaaccattatgttttagttttagagtatgaaaccagctggttttgactcgtttccaacctatacgtgcctcaattttagagatgtcccatttggtttaatctgaccaagctgtatccaaaaagtgattcaagttttatttcggtttatcaccagttacattttcttcgatatatacgaaaagtatcggaaaataagaagacacaatcaaacttgaaattggtaccaaaactagaacagtgtaagtcaaaccgaaaccggatatatgggcatggcctaaaccaaactaaaccgtaatccattcggttaaaattagtttcccttccaactatttgtatatggcatggcctaatttaacccaaactatttgaaatatcagtgtctcttccctcctttgatgtatgaggcactgcctaaaccgaaactaaccagatgcagtacagagactggtttggtttggtaactacacaatatagaaaatgaaagtacttggagttaaaagacagctgctcaaaagtcttaactctttgacgttgccactttaaatcccatcacaccttatatatacgtagtcttcttgctcaccataaccttcatctcatcatctttatctaacaagtattcctacatacaaatccactaaaacaacaatccgttaaaagaatg

SEQ ID NO: 27313 - DNA, 3003 bp, Unknown
  misc_feature (1)..( 3003): 2750-1469P.txt file - cDNA_ID_2731368; gDNA_ID_2684240; Annot_ID_192573
tttccactaatgtccttcttgttcttcctcttgaactcttgaacaaagtgattcaccattctgttgtcgaaatcctcaccaccaagatgagtgtctcctgcagtcgccttcacttcaaatataccttcctcaatggtcaaaagagagacatcgaatgtaccaccaccaaggtcaaagatcaaaacgttcttctcaccaacacttgtagccttcttgtcaagaccgtaagcaatagcagctgcagtaggctcgttgatgatacgcataacattcaaaccagcaataacaccagcatccttagtagcctgacgctgagagtcattgaagtaagctggaacagtaacaacagcgttcttgatcgttgtaccaaggtaagcttcagcaatctcacgcatcttgatgagaatcatagaagagatttcttcagcagaaaactctttatcttctcccttgtagttaacgacgatcattggtttttcagcaggtccagatttgagcgtgaagggccacaatttgatgtcactttgaacagagctatcagtaaatcttcgaccaatcaacctcttcgcatctgtcacacaacaaaattgaacacaattagaccacagatactatacgaattaaaacgatgctatatgtatattttgcctaaaggctaaaattagtaacattagatcgaaaattgaatctcactagctccagcaatgttaaaacattcttatgaaaccctaaatcatcgctatggatctaccgattacagatctacttataatccaagttcgaaagacaaatttagcaagaggaaacgagtgaaacgtaccgaaaacagtgttaatcgggttcatggcgacctgattctttgcggcgtcaccaatcaaccgttcgctatcagtgaaggcgacgtaagacggtgtggttctgttaccttgatcattagcaatgatctcaacacggtcgtgttgccaaactccaacgcaagagtaagtggtaccgagatcgataccaatcgctggaccttctcctttaccagccattgttaacgctactcaggattaagctaaaaaatcgaaagaaagattgtgaaagaggaattgtgaattgcggctaggtttgttttcttttttccaaaatatcaggtcgaaggagaagtctatatagagtcttgtactcgagtttcgagaaggttcgatggctcgctatgtaaccgcacgatcttttggagttggatctgacggtccaggaatgattcttttctcctacttttccttttcctttaacaaataaggaaagccgtttaaaaaggttcgagaatgttcggttcgatggcttagtccataatcaaaagtcggtcattggctcaacattttcttgcgttctcattggctttgagtcggtccaccgttcaccgtcagtgactcattgatagcttttttccttttcgtttttctgttttttttcccaaaactagctgtaggcccaatgggcttatcttggagaaaatttgaaaaacaagaaaaagttaatgtgtttatttattgtatgctgcataggtttttgccttttacacaaatgataattcagggcagttgttgacatggtccatgagtttgaatagtttgagttgctcgagctatattcacaataagcccaaagaattgtacacacaattgaaagagattgacgagagagtaaagagttttgggtttcctcttttgatagctaaaataagccccaaacaatacgtggaagaagcatgcaaagtggacggtatacgtaacgtaactatgtaataactttaacattctcaaagaaaataatttataaatgcaatgaaataaccaatatagaaactcaaccaaaaaaaaagggaactcattttcagattaaaatttctattgaaaaaaaaacgaatttttgtggcacagaaatttgtagccacaaattggaaataaaataggtgtacaagtaccaagtatatgatagagtaggaccaaattgattatgccatggaaattacctggtgaagaggaaacaatactaaccatgaagcgtgcagcttgtgattaatgctctcgatctctacttgaactcgaactgttgatgagactaatgtctttcatatcacttcttcttcttctcttttgtcttattcctatatttaatcttacccttttttcggtctaccacattttaaatcgagaaatgaaaggtcgattacgtggagaaattataacattttaaactctcgagaaacttgtagaaaatactgttttatcaattagtatttgaaaccattatgttttagttttagagtatgaaaccagctggttttgactcgtttccaacctatacgtgcctcaattttagagatgtcccatttggtttaatctgaccaagctgtatccaaaaagtgattcaagttttatttcggtttatcaccagttacattttcttcgatatatacgaaaagtatcggaaaataagaagacacaatcaaacttgaaattggtaccaaaactagaacagtgtaagtcaaaccgaaaccggatatatgggcatggcctaaaccaaactaaaccgtaatccattcggttaaaattagtttcccttccaactatttgtatatggcatggcctaatttaacccaaactatttgaaatatcagtgtctcttccctcctttgatgtatgaggcactgcctaaaccgaaactaaccagatgcagtacagagactggtttggtttggtaactacacaatatagaaaatgaaagtacttggagttaaaagacagctgctcaaaagtcttaactctttgacgttgccactttaaatcccatcacaccttatatatacgtagtcttcttgctcaccataaccttcatctcatcatctttatctaacaagtattcctacatacaaatccactaaaacaacaatccgttaaaagaatgcgcgacacaacatggctcgagcgacttggcctggctctgcgaaccgccatg

SEQ ID NO: 27314 - DNA, 3003 bp, Unknown; identical to SEQ ID NO: 27313
  misc_feature (1)..( 3003): 2750-1469P.txt file - cDNA_ID_2731368; gDNA_ID_2214471; Annot_ID_183011

SEQ ID NO: 27315 - DNA, 3003 bp, Unknown; identical to SEQ ID NO: 27312
  misc_feature (1)..( 3003): 2750-1469P.txt file - cDNA_ID_2731368; gDNA_ID_2684240; Annot_ID_137772

SEQ ID NO: 27316 - DNA, 3000 bp, Unknown; identical to SEQ ID NO: 15001
  misc_feature (1)..( 3000): 2750-1469P.txt file - cDNA_ID_2731376; gDNA_ID_2684240; Annot_ID_192570

SEQ ID NO: 27317 - DNA, 3000 bp, Unknown; identical to SEQ ID NO: 15001
  misc_feature (1)..( 3000): 2750-1469P.txt file - cDNA_ID_2731376; gDNA_ID_2684240; Annot_ID_137769

SEQ ID NO: 27318 - DNA, 3003 bp, Unknown
  misc_feature (1)..( 3003): 2750-1469P.txt file - cDNA_ID_2731389; gDNA_ID_2684240; Annot_ID_192562
cacttctgcttgtatgatattataataaaatctttcttgtgccgaacttttaacagtcagactattgcagtatgagcaaaaggggaaaacaatgttctggtgagtgcaattgttttctatcagattaaagttcttcactatcgtttgagcacttgagaatctatttgggctgtgtcgcagagaaaggtgaaaaagataaagatggggctgaagaacatgctgatacttcggatgaatcagacaacttttctgacatcagtgatgatgaggtcggtaattgtttagtagtaaatgctatgtcaaatttccaacctcgaatatggaacatgaaataaagaagaattctcaacagtttcaaagtcttgttttctcactacagtttcccttgttatatttgatcgtcagtcatagtattttactgttgctcaggtaaatggctatatcaacaacgaggaggaaacgcactataagacgatcacatggacagaaatgaacaaagattatcttgaggtgatttcagaggctatataatatgtatcttctcttggattccttttgatttatcacctaggagatcaaatcacatacaaaattatgttgttttgtaggagcaagctgctaaggaagcagctctgaaggcggctagtgaagctttaaaagctagcaactctaattgcccagaagatgcaagaaaggctttcgaagctgccaaagctgatgcggcaaaatctagaaaggtgactcagtttgaactttgaaattatgttcctgatcaagcatctgacttttggagaataacatgatacccattgatgacatatggtttctcaatcaatttctgattcttttttctctctcttcatataggaaaagcaacaaaaaaaagctgaggaagcaaagaacgcggctcctccagccacagcagtggaggcggtacgccgaacgcttgataaaaaggttagaatgtcagcttctttgataccttgatacttgaaaacgaatatgcaaaaaaagataaaccgagtatgccatgtatcatctgttaaaaacctggcctggaagtacatagtcaacaacatggctgtcgaaattattagcattgaagaaactttagagtctgtgtttcttcctttttcctgattttgagtgttgactcttacagagacttagttcggtgatcaactacgatgttttggagtcgctatttgatacatccgtaagtttttgattacctcttcttgtatcctcaattctcatcactttttgaggtctttacaattttgcttctcttttcttctttcaggcacctgagaaatcacccaagaggtcgaaaacagagacagacattgagaagaagaaggaagagaacaaggaaatgaagagtaatgaacatgagaatggtgaaaatgaagatgaagatgaagaggatgaagaagaaggcaatgtagaatcatacgacatgaagacagattttcaaaacggcgagaaattctatgaagaggacgaggaagaagaagaggatggtaatgattttggattgtattgatgatatgtattgtgaaacacaagagttttaatttcttttgttttgccggattagttgattttatttgcattaatataggagaaccccaactaaatttattctttattatcagtaacaaatatttaagatttaaaagaaaaaaaagttcacacaaatgatctatttatttttacaattcaagtggtactgactaagaaatgaaaaaccactaacttaattaatttaataaaatctatatgtatttaattttgataattttattttccttgtttatgataattctaatttctatcagataacaactaacaatcactgaacttatctcacctatttgatgagctaaatgtattttaaatttatttttctataaagatataactgaaacaaaagtgatgactttttatgaaaattcccaaaatcaaataccagaaaattcaattttaaacaaaatgtgtcggtccggatgatcttacatctagcttggttttacaggatagtatttaagaagaatcataaagttcatctcaaaccaaatccgacggtccagagtcacctgcaaagcttggcatcgtatacgtgttcagtggtcaacggatcagctacgagtgccgtttgaggttcaaacttctgtttctgaggttaactctctaccgttaacgtccgttagtgtaccttctaaccttgacgacttttccactttccaaaagataacgacggcgttaaattggtctattttactgaaccagctttaaccagaattagattgcattacattcaactcgtgcttatggataaatatcagttcggtttggagaaaataggttacttaaggtaaaaagaacggcaagtaacggtgtgacgtcagcagaagaagtattcgttataatagtgagagagagagagataaaacttagggaacccttttttatgttttattttctcgctttgtttcgatcaagtcttctctttctctctctatccctctctctctggttcaacgggcaaagtatttttcgaataaagttttggttttttttttaacgttcctttcgccttctttcttcttcttctgctggtgaattcgtgtatctatctatctcgatgagctccacttttaatccagccgcttcttctccagatgaggttagtttttgtgtatcgaatctgaatttttaagggttttgttcttgtgatcagattctagtgaaattgagttctttgttgtttggctctgattcgaaacgaatttaactttattgaaactataaatttttgtgattacaattgttataaaccctaattttgctgtggttggtgttaatgttgagctgtttactgaattcgtgatttgtgagatctgggttctgtctgctttgtgttttacgatgattgcttttttagggtttctctgtttcttatcaaagtctggatcttttttttctttcattgagatgatg

SEQ ID NO: 27319 - DNA, 3003 bp, Unknown
  misc_feature (1)..( 3003): 2750-1469P.txt file - cDNA_ID_2731389; gDNA_ID_2684240; Annot_ID_137764
gttcacttctgcttgtatgatattataataaaatctttcttgtgccgaacttttaacagtcagactattgcagtatgagcaaaaggggaaaacaatgttctggtgagtgcaattgttttctatcagattaaagttcttcactatcgtttgagcacttgagaatctatttgggctgtgtcgcagagaaaggtgaaaaagataaagatggggctgaagaacatgctgatacttcggatgaatcagacaacttttctgacatcagtgatgatgaggtcggtaattgtttagtagtaaatgctatgtcaaatttccaacctcgaatatggaacatgaaataaagaagaattctcaacagtttcaaagtcttgttttctcactacagtttcccttgttatatttgatcgtcagtcatagtattttactgttgctcaggtaaatggctatatcaacaacgaggaggaaacgcactataagacgatcacatggacagaaatgaacaaagattatcttgaggtgatttcagaggctatataatatgtatcttctcttggattccttttgatttatcacctaggagatcaaatcacatacaaaattatgttgttttgtaggagcaagctgctaaggaagcagctctgaaggcggctagtgaagctttaaaagctagcaactctaattgcccagaagatgcaagaaaggctttcgaagctgccaaagctgatgcggcaaaatctagaaaggtgactcagtttgaactttgaaattatgttcctgatcaagcatctgacttttggagaataacatgatacccattgatgacatatggtttctcaatcaatttctgattcttttttctctctcttcatataggaaaagcaacaaaaaaaagctgaggaagcaaagaacgcggctcctccagccacagcagtggaggcggtacgccgaacgcttgataaaaaggttagaatgtcagcttctttgataccttgatacttgaaaacgaatatgcaaaaaaagataaaccgagtatgccatgtatcatctgttaaaaacctggcctggaagtacatagtcaacaacatggctgtcgaaattattagcattgaagaaactttagagtctgtgtttcttcctttttcctgattttgagtgttgactcttacagagacttagttcggtgatcaactacgatgttttggagtcgctatttgatacatccgtaagtttttgattacctcttcttgtatcctcaattctcatcactttttgaggtctttacaattttgcttctcttttcttctttcaggcacctgagaaatcacccaagaggtcgaaaacagagacagacattgagaagaagaaggaagagaacaaggaaatgaagagtaatgaacatgagaatggtgaaaatgaagatgaagatgaagaggatgaagaagaaggcaatgtagaatcatacgacatgaagacagattttcaaaacggcgagaaattctatgaagaggacgaggaagaagaagaggatggtaatgattttggattgtattgatgatatgtattgtgaaacacaagagttttaatttcttttgttttgccggattagttgattttatttgcattaatataggagaaccccaactaaatttattctttattatcagtaacaaatatttaagatttaaaagaaaaaaaagttcacacaaatgatctatttatttttacaattcaagtggtactgactaagaaatgaaaaaccactaacttaattaatttaataaaatctatatgtatttaattttgataattttattttccttgtttatgataattctaatttctatcagataacaactaacaatcactgaacttatctcacctatttgatgagctaaatgtattttaaatttatttttctataaagatataactgaaacaaaagtgatgactttttatgaaaattcccaaaatcaaataccagaaaattcaattttaaacaaaatgtgtcggtccggatgatcttacatctagcttggttttacaggatagtatttaagaagaatcataaagttcatctcaaaccaaatccgacggtccagagtcacctgcaaagcttggcatcgtatacgtgttcagtggtcaacggatcagctacgagtgccgtttgaggttcaaacttctgtttctgaggttaactctctaccgttaacgtccgttagtgtaccttctaaccttgacgacttttccactttccaaaagataacgacggcgttaaattggtctattttactgaaccagctttaaccagaattagattgcattacattcaactcgtgcttatggataaatatcagttcggtttggagaaaataggttacttaaggtaaaaagaacggcaagtaacggtgtgacgtcagcagaagaagtattcgttataatagtgagagagagagagataaaacttagggaacccttttttatgttttattttctcgctttgtttcgatcaagtcttctctttctctctctatccctctctctctggttcaacgggcaaagtatttttcgaataaagttttggttttttttttaacgttcctttcgccttctttcttcttcttctgctggtgaattcgtgtatctatctatctcgatgagctccacttttaatccagccgcttcttctccagatgaggttagtttttgtgtatcgaatctgaatttttaagggttttgttcttgtgatcagattctagtgaaattgagttctttgttgtttggctctgattcgaaacgaatttaactttattgaaactataaatttttgtgattacaattgttataaaccctaattttgctgtggttggtgttaatgttgagctgtttactgaattcgtgatttgtgagatctgggttctgtctgctttgtgttttacgatgattgcttttttagggtttctctgtttcttatcaaagtctggatcttttttttctttcattgagatg

SEQ ID NO: 27320 - DNA, 3003 bp, Unknown
  misc_feature (1)..( 3003): 2750-1469P.txt file - cDNA_ID_2731393; gDNA_ID_2684240; Annot_ID_137763
ctggtcgttaaatttagagtggaaggtaacgttcacatgtttaaaaggtccaaagtcaaaaggtacatgcgtggcatagatttgccaataaattaaagaaaaaaaggtaaattcaagaaaggcttatcgagctaatttaagcccaataatactgaactatttgggcttgagtcttaaaggcccaatttgtggaggaggcgtcatcgtcttcgcttttccttttcccttgagaggtcgtcgacgaggtttaagatttttaagaatgttgtagtagcttcgcgaataatctcaggtcttctataaaaccaaactagcgattagccgactcttcctctttattattacaaagacgaaaaggcttcgagttttgtaatttcttcttctgttacaagttcttttcactgtgaaagtaattcttcaatggcgaaagacggacctaattgggatggtttgcttaagtggagtctctctcacgccgacggtactcgacccactcgccagttgaggtacggacattcatcttgtagttggttttttaggttctgtcttttgatttgtctgaaactgatgggatgcttggtgggtagtttaggtatctgtgtggctatgattgagctttcacttgaggagatgaatcttatgagtgaattcgaatctgggtttgtttaaagtagttttcttttttgaagatatctgttcagttcatcggtttggttaagattcaattatcgaattctgctgttatgtaggtgaaaggttatctattttctcgtttttacatgaaactctgttaattttttttaagggaattcacgatttgttcatgtcaaatcattctgtatgtgttttattgtggattgttttgttgatttgagttgttttaatgagacagtgaggaggatcgaaaatggtttatggaggctatgcaatcgcagactgtagatgtagtcaaacgcatgaaggagattacactagttatgcaaacacctgaacaagttttggtggaacatggagtaacacctgaagatatccaaggtgcgtaatttgtggctataatacatagcttagatctttatcttttgccattgtgtgtagggtactaattgagtttattattctggtagatttgctggatgagctgcaagagcacgttgaatcgatcgatatggctaacggtacattatctctaacttggactttgctttttttttttttttttttttctttcctgttctggttagctcaatttgaacattgcttgtaacaacttgtttacttactattgtgtagatcttcattcaattggaggcttggttcctcttcttagtttccttaaaaactctcatgctaatattcgggcaaaagctgcggatgtcgttagcacaatagttcagaacaatcctagaagtcaggaacttgttatggaaaccaatgctctggagtcattgctctcgaatttcacttcagacactgatattcacgctcgaacccaggctcttggcgcaatatcatgtaagcctgcttctgatagttcatttttagtaaagattgagatgatcaaaagcttttgtgatttctattttacttggtttgtgatactaaaagagacttatcttttcaatatgggatgtagctttgattcgccataacaaaccaggagtaacggctttcaagcttgccaatggttatgctggcctaagagacgccttggcatctgatagtgtgagatttcaaaggtaacccacacaaatattcttatcatctgcggatataaaatcgtggaagattcttgaattgttgctcattttctttattcaaattctccaggaaagccttaaacttgttgcaatatctactgcaagaggatgattcagaccgcagtattgccactggacttggattcccccgagtgatgatgcatcttgcctctagtgacgatgctgagatcagagaagccgctcttcgtggattacttgagctttcaagagagaaaaacgatggaagtagcagcatagataaaagcgatgagaaactgaggcagctactagaagaacggatcaaaggaatcaccttgatgtcacaagaggatcttgaaacggttaaagaagagagacagctcgtggatttactgtggagcatttgctacaatgaaccttcttctctgagagaaaaaggacttgtcgttcttcccggtgaagacgcattgcctcctgatgtcgctagcaagctctttgagcctcctcttagagcttctgcagcaaaccgtaatgctactgagaagaaagatgaacctatgaaactacttggaccatagacgagaaatcaaagctaaaactttttattacttttccttgttttttatgttttgtaacttttcaaattgtcagaaaagtttcatagatatatgtattatgtcaatgatcaagggctatgttatgttaatttttgttttcatcattcgagatctttagtcttgttattgttgagattaagaatattcagcttcaatgctttttcaattcaacaagtgttctatacgatttcggtttagcaacagctaatacggacccgatctaattgatcggttaaaattggtaactttgaattgcggtgaaccgaagaacaaaaccaaagcgaacgtcacaattactttgcaatccctaaagggacagagttcgaatcaaggcagtctcacatatcggagaaatctctcgtcacgtctctcagcttcgccttcaacaccgtcgtcgccgtcacggccaactccggtattgttatatagatacaattacagtgaactagataatctcatcaaaccctgattctttccacttcctcgcacgattgtgtgaaaacagttactttcgctataaatagtctgatcttctttctattgagcagtaagattggaagctgttgtttcgaatcgattcaagcctcgaatctgagtttcggatcgatattagaagctaaggtaggagctttttgagtgaaggagttatg

SEQ ID NO: 27321 - DNA, 3003 bp, Unknown
  misc_feature (1)..( 3003): 2750-1469P.txt file - cDNA_ID_2731397; gDNA_ID_2684240; Annot_ID_137762
actctaaacaataaccattttactttatgacagaaaaaaagaatatatatatatatatcttacttgagtcttactcaatctacccttcaagatactgagataacaaagacaaggaaagataaaatcctgcacggtaaacaaaatatgaatcctttttaacatacgtgatatgcctatataatcgatgatagctgtaattatgttaaacggtgacttacgacaagcgttgcgaggaatgatcccatcaaagcccccatgatcgctgcaaagttataattagaacaaacgacgataaattaagatgctttttgttgttgttgtatagtttcatgcaaaaagaaggtaagagtattttaccgaagaatgggaatgtaagtgcgacaaccaaagtagagagaactaaaatcgttttaataaagatagatactccatacgatctcatcttctctgatggcggcataagttcttctaaacctagcacaatcggtgtgagagctaacgcgtatttggtcattggtactaccaccttaagtaagagaaaaagaaccaatcacattttagtaattatatatatgtcgagacaaacatgtttaccgagttttaaagttatatctcaccgctgtccaaactgcgattttagatgctgtgtactgttgtggcatgtttagtgtaaactgcgattgaatggcctcaccaaacatactgtagccgcaaatcgccacggcaatgtaaaagaatacgcagaaaccaaaactgcaaaaagaaacagagaaatgaaaattttgacctaatattatctgaagtccattataagtaaccttaatcaaagagatttttcacctaatgagaagcaccaaaggaaacttggatggttctttcatggaagagtaaatgctgggtaaaactgcgtgaccactgaacccaaacccgaatatcccaatagcgacgggtaagttagcgagatcaagagcttttccacccgtgtgaaacccgactccatcaaccgacccaacccagaagagacaaagagcaagcaagatcgaaacaaagactcctccggctaaaagaatggaacacacatattaaagaatatatgaacgaatctcgaagctatattggaaggatcttatgatagaaaatggaacctgagagataggagagtaagctaaggtctttgagccaaactgtaggaagaacaataagagtagctgatatagcaaagatctgaggagaatctagagatactccaacgatgtttaatgtaatgttggggaaaactctcgataaattatcgctcatcatgattatatactccacacaacatacgtataactccatgtacagaagtatctgcaactctcaaaagagatcaagaaccctatatattagtttggagatatgtgaagtatatatgtaaatcatttccatataactcacggagatgatgaggcggcctgtaaatccaaaggcagcttgaccaatgtccgggtaggtacggagatcagaagagctctcaagacatcgtttgaggaggataccggtgtagcaagtgatgatagcaaaggataagagtatacaaagcccgagccatcctccttctttcaccgcgtaaggcattgtgagtagacttattccacaaaggacattgattccttcaccaaaaataggttcaacttaaagagagattgaaacttttctttttgttatgacgataaaatctattcaaccgaaccgaatgcctaaaccctaaagacttttgagacagaatcaatatcgatactactacgtcttaccatttagaacagattggggaaacgagcagaaatttggttctccatacgagagatcggtgttggataacccgacctgagatgaaaggaatgatacatcgtctttctcagagagcagcggttgtttgcttgtggaagacacaaacgaatttgcaatagaggttggacgtctcttgtataaggaagcgatggagctactgaatgatgtctcagtacttctcccttgtatgaaactgaccataggaggtgtaactccggtcaagagatccacagagtgtctgaattttacatgaaaaaaagaaggaagaatcttcacaaacacttcaaataatttcgttagatatcgaaaaacaaagtattttattttacctataactctgaggccagaaagcggaatcattctgggataatgaaaaagatgcattggaatcatcgtcgtcattaacatatgagacatcgacatggcagtcatcgtcatctgtctgaatcaatatgtccctttcttgctcctcaagatccatcttcgtcgtctctgcttcaaaacagagttaaatcagagcaagtaacagattccaggacagaacaaacgaaacaggaaaaaaaggagggaacagagaagtgaaatgaatattggaagaaatataaagagacgacgaagagactcggtattgagttcgatgtgttgtcacgtctgacgtctgtcaactttgtattagtcttaggaaaaaaacactttgtattagtccattgatactacttgatcatatgtaacgaattaaattctggtcgactggtcgttaaatttagagtggaaggtaacgttcacatgtttaaaaggtccaaagtcaaaaggtacatgcgtggcatagatttgccaataaattaaagaaaaaaaggtaaattcaagaaaggcttatcgagctaatttaagcccaataatactgaactatttgggcttgagtcttaaaggcccaatttgtggaggaggcgtcatcgtcttcgcttttccttttcccttgagaggtcgtcgacgaggtttaagatttttaagaatgttgtagtagcttcgcgaataatctcaggtcttctataaaaccaaactagcgattagccgactcttcctctttattattacaaagacgaaaaggcttcgagttttgtaatttcttcttctgttacaagttcttttcactgtgaaagtaattcttcaatg

SEQ ID NO: 27322 - DNA, 3000 bp, Unknown
  misc_feature (1)..( 3000): 2750-1469P.txt file - cDNA_ID_2731405; gDNA_ID_2684240; Annot_ID_137760
ggagaagtactgagacatcattcagtagctccatcgcttccttatacaagagacgtccaacctctattgcaaattcgtttgtgtcttccacaagcaaacaaccgctgctctctgagaaagacgatgtatcattcctttcatctcaggtcgggttatccaacaccgatctctcgtatggagaaccaaatttctgctcgtttccccaatctgttctaaatggtaagacgtagtagtatcgatattgattctgtctcaaaagtctttagggtttaggcattcggttcggttgaatagattttatcgtcataacaaaaagaaaagtttcaatctctctttaagttgaacctatttttggtgaaggaatcaatgtcctttgtggaataagtctactcacaatgccttacgcggtgaaagaaggaggatggctcgggctttgtatactcttatcctttgctatcatcacttgctacaccggtatcctcctcaaacgatgtcttgagagctcttctgatctccgtacctacccggacattggtcaagctgcctttggatttacaggccgcctcatcatctccgtgagttatatggaaatgatttacatatatacttcacatatctccaaactaatatatagggttcttgatctcttttgagagttgcagatacttctgtacatggagttatacgtatgttgtgtggagtatataatcatgatgagcgataatttatcgagagttttccccaacattacattaaacatcgttggagtatctctagattctcctcagatctttgctatatcagctactcttattgttcttcctacagtttggctcaaagaccttagcttactctcctatctctcaggttccattttctatcataagatccttccaatatagcttcgagattcgttcatatattctttaatatgtgtgttccattcttttagccggaggagtctttgtttcgatcttgcttgctctttgtctcttctgggttgggtcggttgatggagtcgggtttcacacgggtggaaaagctcttgatctcgctaacttacccgtcgctattgggatattcgggtttgggttcagtggtcacgcagttttacccagcatttactcttccatgaaagaaccatccaagtttcctttggtgcttctcattaggtgaaaaatctctttgattaaggttacttataatggacttcagataatattaggtcaaaattttcatttctctgtttctttttgcagttttggtttctgcgtattcttttacattgccgtggcgatttgcggctacagtatgtttggtgaggccattcaatcgcagtttacactaaacatgccacaacagtacacagcatctaaaatcgcagtttggacagcggtgagatataactttaaaactcggtaaacatgtttgtctcgacatatatataattactaaaatgtgattggttctttttctcttacttaaggtggtagtaccaatgaccaaatacgcgttagctctcacaccgattgtgctaggtttagaagaacttatgccgccatcagagaagatgagatcgtatggagtatctatctttattaaaacgattttagttctctctactttggttgtcgcacttacattcccattcttcggtaaaatactcttaccttctttttgcatgaaactatacaacaacaacaaaaagcatcttaatttatcgtcgtttgttctaattataactttgcagcgatcatgggggctttgatgggatcattcctcgcaacgcttgtcgtaagtcaccgtttaacataattacagctatcatcgattatataggcatatcacgtatgttaaaaaggattcatattttgtttaccgtgcaggattttatctttccttgtctttgttatctcagtatcttgaagggtagattgagtaagactcaagtaagatatatatatatatattctttttttctgtcataaagtaaaatggttattgtttagagtcaatatattttttacataataatttaatttaaactttatctatttgatcttttggcagattggaatatgcgttttcatcataatctctggcattgtaagcggttgctgcgggacgtactccgccattggaagattagtaggagaattgaattggatggtacaatgaagaacaatgaaacaacatatgttaaattgtgaaacaataagagattgtctttttatatgaaatttaacagagtgatcaagatttgtgaaacgtgaagcagtaattttaataccgtaatgaagctttgttttaacttgtaatcttctattttcacaaaaagatcttaaccttcgtcgacctacttttttttaatttatttttgacaaatcaaatccattccaaatttccaattccacgcatatacctttgacttttgaacatgtgaggggcggatccagaaacttttctagtatatggcacatatacatttatatgaaatatagcgaggtgaaaaatgaagaggaaaaataactgtctaagaagaaaattgaatcttacaacatgttttaacccaaaacttgaactgaaaggtggctataaagataaaattacatattataacaataattttatagaacaaataaggaagtgaaactccaccatctcaatgttttggagaataatcattaccaatggatcaaatatagaacaatgacttcatagtctcattatcctatggcttaaaatttctaattagtatggggcacgtgcctaccctagtggcaatgtagatccgccactaatacttccacactacatatcacgaccagaataaccagaatattaatttgtttatgatcatgtatcaattggattaatacaaactcgacgtgatagcaaatcgaactcagagctcgatctcttttttttttcttatagtattcatttcgctcctttgttgctctgattcgactctgttttgaaacagagacaacgacgatg

SEQ ID NO: 27323 - DNA, 3000 bp, Unknown; identical to SEQ ID NO: 14998
  misc_feature (1)..( 3000): 2750-1469P.txt file - cDNA_ID_2731409; gDNA_ID_2684240; Annot_ID_137759

SEQ ID NO: 27324 - DNA, 3000 bp, Unknown; identical to SEQ ID NO: 14995
  misc_feature (1)..( 3000): 2750-1469P.txt file - cDNA_ID_2731421; gDNA_ID_2684240; Annot_ID_192553

SEQ ID NO: 27325 - DNA, 3000 bp, Unknown; identical to SEQ ID NO: 14995
  misc_feature (1)..( 3000): 2750-1469P.txt file - cDNA_ID_2731421; gDNA_ID_2684240; Annot_ID_137753

SEQ ID NO: 27326 - DNA, 3000 bp, Unknown; identical to SEQ ID NO: 14993
  misc_feature (1)..( 3000): 2750-1469P.txt file - cDNA_ID_2731431; gDNA_ID_2684240; Annot_ID_192549

SEQ ID NO: 27327 - DNA, 3000 bp, Unknown; identical to SEQ ID NO: 14993
  misc_feature (1)..( 3000): 2750-1469P.txt file - cDNA_ID_2731431; gDNA_ID_2684240; Annot_ID_137749

SEQ ID NO: 27328 - DNA, 3003 bp, Unknown
  misc_feature (1)..( 3003): 2750-1469P.txt file - cDNA_ID_2731446; gDNA_ID_2684254; Annot_ID_138080
gtctaatccttttactatacatacgtgtattgtctaccactttcgtcattcgtccaaggatgatatctaattttctttctgcacgacatatatgatatattgtgtgcttaaagaaagctcatgagtcatgtctgatatttgagttcgaatttcgaaaactaatcttgctttactattcatacatcttgtgatatagttactgttgaaagttgaataatgcaaaagaaaacaaaagatagctcatggtgacgatgcctataaaaccattaattattcttcttcccgtcaacgtacttgtacatatatgatgaaatcttgaaaaaaacgaccatcccatcaaaccagattcccatttcctagcataaaatggacttctatagaaaaatacaaaggaaaataaaagtcgaaggcggtgactaaaacaacgagaaaaactcaaacctttgaaaactttagaattcttataaaataataaggaaaattcaaagtctcaatagcgtgggattcactccactcttaccattccccgacttccccctcatttccgccacacttatttccaatcaaatccacacacacacatgttataaatataacacatagtcacatacatacacattattcatttcattcataagacccttcattcatttactcaaagaagtggaagtgaaaaaattagaaaaagagaagaaaaaaaacattgactaccaaatggctccgtgtcgtacgatgatggttctgctctgttttgttctgtttctcgcggcgagtagttcttgtgtagcggctgcaagaattggagccaccatggagatgaagaagaatataaagagattaacgtttaaaaacagccatatttttggttacttacctaaaggcgttcccattcctccttctgctccttctaagagacacaactcttttgttaactctcttcctcattgatttcattttattttattcattgtattcttttaggtttggttttgtagattagatcaacatagggtattatactctttgtatatgcatacgatttatatttacttttgaatttgttcctttttatgtttatagacttaatatatgtttaaggtcattacggccatataaagatcaagaaatcgattaagctttgttagccttctactaaagaatattccatagacctcactcatcatacgctaatcaaacatatgtttttatgcaacttgtaagttatatcattcgtctttctcaaataggtcaatgtttgagttaagacttaagaacgtaataatcaaacatagagaaataaaatcgataggacacatgataagtttattactaattaggaaaacagaaaccaaaaatacaataaaaaagagtaaaagagaggggcattccgagaattgaactcgggacctctcgcaccctaagcgagaatcataccactagaccaaatgcccaatttgcaacattcaatcccaaatcaatcattaactcttacatctattagtctccaccaccatgagtgaaaggattgaaaccacttccaaacaatttctcaagtggccaaaacaaaggctttggtagattctcccaatcataccaatcccatccttcacacttctctggttccatattcttcggttcttgacttggatccaccaacaccgcacgtatcgaaacagagacgtagtgtgatggcgttggtgcttctttgaagacattgtttgtaacagtcaaaagcttcatcttttcaatctttagacctgtttcctccattacttctctcgctgcacattcttcaaagctctctcctgatcaaagaacaaagattagatcaaatcaagatttgggtgatataaagagagaagagagagaggagagagaccgaattcgaggtggccaccgggaagagcgaaagtggagttgccgattgaggaacggcggcgacctaataagattgagtttccgttgagaatgaaaacgacgacggcgactcttggtatcgcttctcctgtcgacattattatcgaacacagtgaaaccctttcttgtcgtgttttagttttgttgacttaatttgagtttaaaacgatgtcgtatcggttatgcgtttatatacgtgttggcaaatgtgtcgccgtgtcggtgtgattggctgtacacaattatcgctgtttctttttccattgcacttgttttcattttatttattaaaaaatttagatgatattatataatatatgttctttatgatgttgccataacgagaacgattatgtaaaaaataacatatacatatacttttctgtttataaatgattatttttttagaaaaaatttatttctaaaatattgatttttttaagttttttatgcaatatttattggttagtattgatgaattgtaattaaaaaaaaaaaattaattatcattgttttttgagttatagaaaactgtaaaacataaaaaataatgtatttataatcaacatttattatgttttcttaaaaaatagaaggagtagtcatttgttagatagtaagacttagccaaattatatgtcatttactgtactttagtttttttttccgatcataagaatgtatgttaaaataacaatcaccaaagaggcacaaaataaattgtaggtccaaagataaaacagagttagttaaaaccagttactcctttcgtagaatttttacccaaaaaaagaaaaaaaaaaatcgtagaatttccttctcttttcttcttaattataatatatcaactgtttgttttgttgtttagtttggaaaggaagaaaattagcttaagaaataagaatatatttttttggggaaagatgactagcaccacaaatttaactacgccataatttactgcgttgaccaccataattagtaattaagcaccatagctaacaaaccatatataatcactcttcaaaatatttaactttgatcactgcaattattcattccttcaccttgttcattgatacaatg

SEQ ID NO: 27329 - DNA, 3003 bp, Unknown
  misc_feature (1)..( 3003): 2750-1469P.txt file - cDNA_ID_2731462; gDNA_ID_2684254; Annot_ID_193067
tgtaactataatgttcatatcgtccgattgtttcttgaatgaacaattattttgtattgatttttttatataatcgtagacacgtataatactatctttgaggtatgaaccgataaatttgttgctaccaataaaaactgaaaacacactgtatttcataaatttaagataccatccgaatatgttctcttactacttactagactactagtccaactcaaattaatttgattaagaagaattaattatatacttgaatccatatctatttaaacactacaatatgtatttctatatcacctctcatcatcccaacacatttaatttatcaattaatatgaaacttcaataaccatccaaatcacatgataagtttgaatgctgaatcagtaataataaataaaaataaaaacatcagcgaacaagaaaattaagcatattttgctaaaccctctcatgttaactatgggaattaatttctttaacaaaaaaagaaagaaaattaagcatattgatagaaaatatcctgagaaaatcgttaaaatgtggatataaatgttgagaaaaaaagacaaataattatttgaaagtataagaaaaggtccatgcaacgtaggaaaaaacatcggggtaaggtgtcgcaacagacgatgtcgtttggtcaacaatttggagatgaaatttaaagtaggagaaaacttgtgatacgttttaagaacgaaaaagtcagctccatcattgtcatttgtcactgttaagtatggacccaaacctcatctcatcctaattttagtaatattccgattccatctcactcgttggttttagattcttatcttccatcgttgagatcgtacagttttggtaagaagacaaagacttcatgtattattgacattttttcgtatttccatcttcggctaatcagacttgactaactaaattatataattctggtggaataatgaaactcgtggcctagttttggaccaccagaactaacttaattaaatgattataccaccagaaccaacttaatttaactaatagattcaattttgtggctcctacatactatataattggatacaaaagtgaaaagaagaaaacttaaatattaactagcgtgcgactaattaaatattatacacatcaaacttttgtaaattgcagcagccactcgttagcgagtttccatgacctcactaagtaatgtttacacataagtatattattgtttccgtttacaatatatataaatgatctcacttataatattgtcaacaatgaatttatgtaaaaatattagacgataagctaattttttttttcatgttgctgaatcaaataatctaatttgcatttgttagatttactcaaaactaaataaacttgaaagtttatcaaatcaatactttatgtaaaagtgactatctgaaaaaaaaaaaaaaaaaaaaaaagtgactatctggaaatgaagcgactttgtccaacttgatgttctgttcataaagccgagcaaaacaacaaataaataaaactaactgaaaataaaattatcattgattagtttagctaattcgtgacttaatgtagtgattagtactatgataatatcatgtgaggcaaatgagaatatatttgactgtatcttttgatcacgtatccacgtcgatacagacaagctgtatatgttgcgcgtacattatggtcaatgttcttacgattcttttcacatttcttttccagtgctaatacaaatatttttatcagtatacacgttatggattcattgtataacttgtcatcggtgggaataatatttctcatctgttatttatccgttatgtcattcgtcgatgtacgacccgcttcaaaataaaagaatttcgtaattagtaaagcaaatacaaattgtcaattcaccaaatagtgatcaaatatatgtttgtcaaaaaaaattcttatatcttaagaagatcagatagctgcattaaatctttgaatatccgcttgattattcgaaacgagtatcataacatcaacaaaactagtagaaagtatacaagtaatgaaagtaattatatatatggactatatataacatttgtctaacatttgatagtatttgttttttctatgtcaaacagtgatttgttatatcgattcataacgaaccatcaagttttggccttaaatgttggcaagaaatatttataaatgcgtcggtcaattgcgtgacaaactttactacagtcattattgtagaatgatagtatatagtattactttgatagggagtagcatgttagttaagagtttaaaagcaccaatttcatataatatacaattatgaaagggaaaatataattaactatctcgcaaacaggattatgaagtcaattagcttacgtacatcgaggtcaacgaagtaaacaaatttgccaaatcgttgtcatataatagttgtacggaaatggtcaaaacacttcatcaagaaagttgatttctattatttcaatggcttaatggtataccatataatatcatatatttaaaaatgtgagattttgtgatacacatcaattgacgtaaatacattttaggaagactgaaagaaaaacaaatttaaatttaaacttaagattagccgagtcttacttagcttcaaatcgataattgatggggacttttctaaaccagagtttatgatcgggtggcgaagaattagatttatggatcttatcactaaaacaacatgagaagcccatttaataagcacttcatcattaatgggcctaaaaataagcccgtttattaaaccttacatatccgaatctgattttaatcgacgtgtcctttgtggtgtaaatctactaattaatttgaatgaacagaaaaaaaaaaaaaaaaaaactagtggtgcgaaatcaacgactgtttaaggaattttgattttttgtcttccaacaaaattcttccggtgaaaaaaattccgccatg

SEQ ID NO: 27330 - DNA, 3003 bp, Unknown; identical to SEQ ID NO: 27329
  misc_feature (1)..( 3003): 2750-1469P.txt file - cDNA_ID_2731462; gDNA_ID_2684254; Annot_ID_138073

SEQ ID NO: 27331 - DNA, 200 bp, Unknown; identical to SEQ ID NO: 265
  misc_feature (1)..( 200): 2750-1469P.txt file - cDNA_ID_2731470; gDNA_ID_99055; Annot_ID_147327

SEQ ID NO: 27332 - DNA, 3003 bp, Unknown
  misc_feature (1)..( 3003): 2750-1469P.txt file - cDNA_ID_2781280; gDNA_ID_1620759; Annot_ID_49964
attaattaaaaaaaaatatgcttctcgtttaaccaaaataccattcacatataccctttaaaatttttaaatgattaatttcatgtagaaatcatatagactgtaaatgggttcacgaaaaaaaaactggaaaacgatgaatattgatagaatgaataaaaatggtattgatagaatgaataaaaatgagaatgtaacaaaaaagatacgtgaaatttgctaatcccatgacaccgtgcttgcactctttttaagatctaaaaacttatatatttcttctaactagtagtaaaaaactaacccttttcttaatacaacttttttgcaataatatatatcttaactggtttaaatcttatggtataacaatttgtcccaaaaaaaaaaaaacttatggtatacaattaaaaaacagctactaatagtctaatacttcttgtttttttcatcagaagctactaatacaaaccattaaagttttttatttatttctatcaattatttctcgtggttttttgaatggtcaaagatcaaattgtatttaataacgtcacaaaataatctgagaaaaaacgagagaaatggtttgcgaaagtttctatcagactagagcaaactgaaaagacagaaaaacgaaaataggttagcaagcaaattgccacttaaaatatttcattaaattaacaactcaacaagaccttgttccggcaaacacatacagtgcgtcggattataaaaacatagtcggcattggtaaaatacaagttaaatgcgtattaaacataaacacataagctttacttttagttttattgtagtgaagcaatagttttgttaaaacatttttccaggaaaataaatcaagaatgatgcggcaatgcaaatcatctatctagcatcaacacctttttgacttttggattcatttctaaattaactagtataatttataatttaggatgatttgttttatattgaattaaaatggatacagaatctatgatcgagtagattacaaaaaatgattaaaaaaagaagaagaattaagttgaacaaaaaaaattgaaccaaactcgcatgaaatagtgaatatacagggtatgatgggaaccaaatatatatttaaattttaaacttacatctatcttaatttttgcttcccatgttatcttttggtactcatatcatagttcatagattatgtgcgtacacactacacatatgattatgatttatgaatactgcattaaactgtttcaaatgcacactttaatttctctttttctccaaccaaactttaatctagatctaaacattatatattcataatcatgtgtacccattagacaattattggaaaataaaaaattatatcacgcgcatgaatggagtctaagatcgcccaagagaaaagtaggtagcagccacgaccgaagtctttgttctcactttggttaacgtttttaagacgatagggagagtgagaaagagacattgtgttattcaacagtttattatgtaatataagcttaattgcaactagtaactaactaataacattttacattgtgtatacgtaacgacggcttatggttgtgatattgttttggatgaattattgagttagaaaacaggttttttaataaagtgaaaagaaagaagtaatattttatggttttataccataatgcactctttaagttgagtaggaatattcgataaatttaattccaatatataattatttgacttgtattctttaattatgaaacatcagatcaacgtagaaagtgtgaaggaattttaagatgaattgatatattaaaaggtggcgaatattatcaaacaagccaccctgtaaatttggtagtttatatcccatatgctttctatttttctgaaacactgatacataatatctcctaaaaacaaatatattagagaatttttttgataaaggtttcttagttcttacatcaattcgaaagatgatatacatgctatcaatatcaccatgaattatccttgatactagaaaattgatggcacacttgatataagaacttgtattttcaatatacatttattctatacaaaaaaaaaaaaaaaatcctagaacaagtgggtagagaatctctaacaagtaagtttcaataaatatacaagacaaaataaattatgtgataaatgataaaaagagacaaattaagcgagttttatggatcaacagatgatttgtctgataaaaataaaatctttatactggaaataattcggacggtgtgcaaagccaaatctaaaatacaaaagaagtaaagtgttacacatttgaaaagaatcctagaatgttacattattgcaattttaaaaattccttataaaaaggatatcaagtaattttcgaaatcagtatcctgaaaatggaaaatgtaagtgatagaactagtctcctttttaggaagggtctcttctcaaatttggttatatgattcaaacgatgggctcaactagtaaactttgtcattcagagttgtttcgaaatacttgaaatctctcattattgttctcttttttcgtaaatttttcaaactatttcgaataaaataaccccaaaagggaagagaaaagaaaccaattgaagtgtataaatagagacccaaaaggaaaatgccaaatgaatcaatctcttaaagaaaggagatggtaggggtccatctatgatgtgctcacatacatgctccacgaactcttgtttcttttactttaacttcttcttttttaacaatttgaatgaaacatatttatacatcttatctatgactatgactcgcacatattttctcagaattttatttattttattgaaagccaatctctctcatttgcgcctataaatagcaaccctctctcattctacaagtctcacatcaaagcaattaacaaatacacaacttgtaacttcaaatagattactttcaaagaagagagagagaaagaaagatg

SEQ ID NO: 27333 - DNA, 3003 bp, Unknown; identical to SEQ ID NO: 27332
  misc_feature (1)..( 3003): 2750-1469P.txt file - cDNA_ID_2781280; gDNA_ID_1620759; Annot_ID_167112

SEQ ID NO: 27334 - DNA, 3000 bp, Unknown
  misc_feature (1)..( 3000): 2750-1469P.txt file - cDNA_ID_2781294; gDNA_ID_2214503; Annot_ID_133708
caaaacttatagagagaagtgaaagggttgattgatatatcctggtcagataacaaggctaacaaaacttatggagagaactaaatctaaccctgaaaaaggtggacattaagacgaaagaagaagtggtgctgcagaatgtaatctgttatcatcctcccgatgtcaggtgccattttgcaacaataatttcttcaagtagcatggatgcatgcgtttctgagttcacaaacctctttccctcaagccccaaaacaagtgcgtgatgggtactctcatttggaagcattcccctttgaaccatcaaaccaatcaactcacatgctttctcaatatctcctacactgcaatatccatggatgagcgtattatacaaaacaacatctggctttaaccccgcatcaagcaacttattaaacaaaacaatagctttctccattctctgcgctttgcaatagccatgaagtaatgcactgcatgttacaacatcaggtttcattctaagatcagccatgtagaaccacaaaataaacgcttcctgaaaatcccctctcttcgagaacccaccaatcacatctgtgaatgctaatgtactaggaacaaagcctcgtcggataagctcactgataatttcatttgcttcatcgatatatcctctaacaaccatgctatgtatcaaaatattgtaggttgcaacatctggagagataccagcagatctcatctcatcaataagctcaaaaactttattcagctgatgtgtcttcccatacccatgcatcagattgttatatgttacgacatccagtttgagaccttcagttttcatattccgaaacacagattctgcatcacttatgcttccaaacctgctgcaagctccaataagtattgtagatgttgtcaaggatggcgggttcccgcttttcaacagcgccccgaagtattgaaaagctttatcagttctgcctagattacaatacccatcaatcatagtagtataacaaacacaatcaggaaggagtcccaactcgaaaatctcctgaaatatggtagaagctctgagcatgtctcctgtggaacatatatttgacagaaagctactgtacacaaaaatgtttggtctaagacgaaaagaatgaatgagcttaatggcttcctctggtttccccaccttacagaacccgtcgataacagaactgacggatacagaatcctgagagataccaaagagtttgagtttaaacaataccgaagtcgcttcttttagaaaccctgccttacacaatttatcaataaaaactgtaaatgccacaatatcaggtctgatgccgtagtgtttcattcccataagcaattcccaacctttatcaaaatagccatccgagcaatacttccttatgaataggctaaggacagcagcatttagatgcctccctcgactaagcatgtgctcaacaaattcccgagctaactccaagccatgaactcgtagaatttccttaagcaacgaaatacaaacccctcgtgaaggaaagatgccaaactggtccactttgtaagttagcttcagggccatgtttacctttctctctctaatgcaacaatcaatcagtatgctaaacacagtctctaaaaccctacgatcaatacgagtttcaaaaagatccttcataactaaacacaaagacctttcttctccactacatttcttcaccagacagagaagcatatctacagctctataattcatatttccagataccaaaatatgaatcatcctgctgatagacctgctcgagtgctcaacaccaatccacaactctgaccacctaaagaagtatagaacaatagatgcatccaaagtctcctcaaacaaatcatccaaaattctaatgacagtgtattgatcaagctcagtactaaacccactctcatatttctgtatccaattgtgtttcacaagcacatttctaatagtctcaacacaatcccttgggacatcaatattcttcagaatcgaaacaaaatcttcaccaaaatgcttacttgaactatgatagtaccgtgatccagagtaaggtagcctactagaatcagtctggaatcttgagttattctcagacaacgaagcaagagaaaaggtcctacaccagaaatatcgaaaagccttggttcttgtacaaaaatgattcaatccagaagacttgaggttaaagattgaaacccacataaacagggactggtcacaagttatctgaagaagaaacaaaatcaaattttgtcaatttttgtggttctgagagaaacccacatcataaaatttatcattactctcaagcattgtatcactcaagtagctgcaaaaacttacaaaatggcttgtcttaattttgatcgcccggaataataacggcgacggcgagcagagagagagatggagagattggtagagacgatgtgaaattccggttttttctcttccagaaatcaaaccggtgtcctaatctaataacaaaaactgggccttcttttatgggcttgaatcggaatctaaggcccattcacgtttcttatgattattatttatgatttgtgattccggtttgaccacaataaaaagagagagaaatatcattttgattccggttttctttctccctggattcgaaccggttttttagaaaccaattgcaataagatttcttattggaaagagagagaaatatgattttacccataatgtatttatggggttattatgcttataggctatatacgttatataccttaacgaaattttttacccataatgtattacagtatgggatttgggccatttggcaaaacctttttttcacatcacttccaaatgggcttttaaatgggtcttaaatctctcctgaaaaagcccatataaataagacaaatactccgacatatctcggcgacggctaagtcttcctctctctctctctctctctctctctctctgcaatg

SEQ ID NO: 27335 - DNA, 3000 bp, Unknown
  misc_feature (1)..( 3000): 2750-1469P.txt file - cDNA_ID_2781294; gDNA_ID_2214503; Annot_ID_184048
tatacaaaacaacatctggctttaaccccgcatcaagcaacttattaaacaaaacaatagctttctccattctctgcgctttgcaatagccatgaagtaatgcactgcatgttacaacatcaggtttcattctaagatcagccatgtagaaccacaaaataaacgcttcctgaaaatcccctctcttcgagaacccaccaatcacatctgtgaatgctaatgtactaggaacaaagcctcgtcggataagctcactgataatttcatttgcttcatcgatatatcctctaacaaccatgctatgtatcaaaatattgtaggttgcaacatctggagagataccagcagatctcatctcatcaataagctcaaaaactttattcagctgatgtgtcttcccatacccatgcatcagattgttatatgttacgacatccagtttgagaccttcagttttcatattccgaaacacagattctgcatcacttatgcttccaaacctgctgcaagctccaataagtattgtagatgttgtcaaggatggcgggttcccgcttttcaacagcgccccgaagtattgaaaagctttatcagttctgcctagattacaatacccatcaatcatagtagtataacaaacacaatcaggaaggagtcccaactcgaaaatctcctgaaatatggtagaagctctgagcatgtctcctgtggaacatatatttgacagaaagctactgtacacaaaaatgtttggtctaagacgaaaagaatgaatgagcttaatggcttcctctggtttccccaccttacagaacccgtcgataacagaactgacggatacagaatcctgagagataccaaagagtttgagtttaaacaataccgaagtcgcttcttttagaaaccctgccttacacaatttatcaataaaaactgtaaatgccacaatatcaggtctgatgccgtagtgtttcattcccataagcaattcccaacctttatcaaaatagccatccgagcaatacttccttatgaataggctaaggacagcagcatttagatgcctccctcgactaagcatgtgctcaacaaattcccgagctaactccaagccatgaactcgtagaatttccttaagcaacgaaatacaaacccctcgtgaaggaaagatgccaaactggtccactttgtaagttagcttcagggccatgtttacctttctctctctaatgcaacaatcaatcagtatgctaaacacagtctctaaaaccctacgatcaatacgagtttcaaaaagatccttcataactaaacacaaagacctttcttctccactacatttcttcaccagacagagaagcatatctacagctctataattcatatttccagataccaaaatatgaatcatcctgctgatagacctgctcgagtgctcaacaccaatccacaactctgaccacctaaagaagtatagaacaatagatgcatccaaagtctcctcaaacaaatcatccaaaattctaatgacagtgtattgatcaagctcagtactaaacccactctcatatttctgtatccaattgtgtttcacaagcacatttctaatagtctcaacacaatcccttgggacatcaatattcttcagaatcgaaacaaaatcttcaccaaaatgcttacttgaactatgatagtaccgtgatccagagtaaggtagcctactagaatcagtctggaatcttgagttattctcagacaacgaagcaagagaaaaggtcctacaccagaaatatcgaaaagccttggttcttgtacaaaaatgattcaatccagaagacttgaggttaaagattgaaacccacataaacagggactggtcacaagttatctgaagaagaaacaaaatcaaattttgtcaatttttgtggttctgagagaaacccacatcataaaatttatcattactctcaagcattgtatcactcaagtagctgcaaaaacttacaaaatggcttgtcttaattttgatcgcccggaataataacggcgacggcgagcagagagagagatggagagattggtagagacgatgtgaaattccggttttttctcttccagaaatcaaaccggtgtcctaatctaataacaaaaactgggccttcttttatgggcttgaatcggaatctaaggcccattcacgtttcttatgattattatttatgatttgtgattccggtttgaccacaataaaaagagagagaaatatcattttgattccggttttctttctccctggattcgaaccggttttttagaaaccaattgcaataagatttcttattggaaagagagagaaatatgattttacccataatgtatttatggggttattatgcttataggctatatacgttatataccttaacgaaattttttacccataatgtattacagtatgggatttgggccatttggcaaaacctttttttcacatcacttccaaatgggcttttaaatgggtcttaaatctctcctgaaaaagcccatataaataagacaaatactccgacatatctcggcgacggctaagtcttcctctctctctctctctctctctctctctctgcaatggactctctggtagcgagctacgcttcgtcggacgaagaagaagatcttcaaccacgtcgagaagctttcactgtaaaatcctcagaaccttccgcttcgtctctattctcagctattcctcaacctaaagaactcaaatcctccgaagatggtgatttaggctcatcttcctctcgaggaaaatcttcttctttcctctcatctctccctcctcccaaatcctcaatttcacggaaaaaaaatcccaatccgtcgtcaattccgaaacgtgtcgtccagatcaggcttccagtaaaccctagaccgagcaatcttgacgacgaagacgacgaagaagaagagaaagctaggaagaagcgtaaacagatg

SEQ ID NO: 27336 - DNA, 3003 bp, Unknown
  misc_feature (1)..( 3003): 2750-1469P.txt file - cDNA_ID_2781298; gDNA_ID_1620434; Annot_ID_156949
acattaagctacaaaaagaaattgaattgtgcaagggttttcgtcgaagaaaatattaaaattctgtaccaattaattaaattcctaatccctagaaaaataaatacaattacagttgaccacaagatttaattaagctaaacgtggctaataagtgtttgatcgagatacggtctccgtctttggagccgtcaaacaagcggccaaagcactctctagtttactgactacctccaccattgacggccttttccgactacacggcatcaaacactccgctgccaagtatccgacatgagccaccgcctcgatttcgtaaggggtcggcggtggaatcctctggtcaagtattctatgagcctcatccagcaaaatgtatggtacaacatattccactaagtttctagggttttcgtcttcgttattgtgtatcgctttgtgaccagacagcaactccagcaacaccacgccaaagctgtaaacatcgctcttggttgtgagctgttgaaacttgtagtactccgggtcgatatatcccaatgtaccggcagcgtgtaaagagagatgtgagacgtcatcttcttccgttggacccatttgagataggccgaaatctgaaactttggctgtccatgtggcgtccaaaagtatgtttgatgactttatgtcacggtggatcaccggaggcacgataaactcatgaaggtattggatcccacgagcagcgtcaagcgcgatcatcaagcgtgtttgccacgaaagagggtcaaattgaggattgtgaaggtgatcggctagagatccatttttcatgtactcgtacaccaaaatcctctcttctgtgtcctcatagaaacccagaagtcgaacaagatttttgtggttaagccgcgacatagactctagctcgttcacgaacgctgaatccttatctgctcgtcggtgtctcatcgttgtcccagacaatgtaggatttgttagctcagctcgtttgattgcgacatgacgtccatccgacaaaacaccttgataaacagagccgaagctgcctataccaagatgaaaccggacagagaaaccatccgtggctagagctagctcgtcaattgagaactccattagctgcccaggattacctaaacttgctagagtgcacagcctcttctcgagcttgggtatgtctattgtcctagtatcatcaagacgtccagagtcatggacacggcatcgacagtggcttttaaagatcaagaaactgatgacaaggagcaaggaaaacgttccaacgcatccgaccactagaaacgcaatgtttcttctgctccaagttttgttcttagagttttgagccctagtatcaggaaactctccatcatttcttttcaaatcgcaaatcatcaactcattgccgcataaggactgtgatcctgacaatggacggtaagggcattctcttctacacggtcctggcattaccacttgagaaattaggccttggaatggagtgaaaacaccggatttaaaattctcattcccccaacaaattagagtgtaatttcttgtggcaacaccgcaaaacattggccctttagcatatattgatgtaaaatgaatgtccttaagcgtttgaggcaaactaaagttgttgttgttgccccaacacaccacagttccattagaccatctaacaccgcaaccacggtcttccccaaccgctagtgctaagaacttttcacgtggcagcgactgtgtttgtccccaacactcgacatcattgtcaacagtgatcgcacacgcttgtcgtgatccagccgctatcgcgatgtagtggtctccactcggcactttggctataccttcacaactgatcataccaggtggctgagatagcccacagaaaaaattatctcccaaggcaatggaacggtaattatccggccgtggcagatagtacggttgccagcaacggaggcgccttgagactctttcaactccacaaatgcggaaattcccggcttctagctcttcgagctcaggaccgtggtagattcttttgtgcaacatattagttccatcaacagagaatctccaacaaagaagtgtggaagtgttggaatccagccgcgatatcaatccgcacacaaacccattccctgaaacaacccccgaaaaccttcgatttcgaaggttaccggttaaagaaaatggaatcgaatttaaagggaaactggaacattgaagataagagtggttgttgagagcacatacaagagtctgattagagatgtgggagatggagacggtggagagggagaagcaaacaaaggagaaggaagatagaacaagaagaaggagagacacaaagtaagaggagaaacaagagattgagatggtaagtgccattgaagaagagttctcatggcgtgtgaatgttttatgtttgaggagttgtgtttttaagacggcaaatcaacgcggttagagagacatgagacagagacagagacacctccttaccaagagaccaaaactaagtcttatttacttcattcatagtgatttttctctattctaaattatttttatggtcaactctttgaaaatttcaacacttactttcagtggcatcgtcgtatctaaaaactatacttaatcctttggttgaaacaaaataaagaatgactttcgtttatatattccaagatcttttaacattcataatagggcttgtacaaatccttcatgagaggatgacactcttcgtcatttaatgaaagcaaatgtggcccattaagtataattgaagcccaattacctttcacacagttaacaattaagtttttggtctgatcacaatgtttgcgttagctgcgaaacaagatgctgttacagtcatagaagtcttatgcgtacacgactccgatttcaaaatctgaacggaatataaactctcgacgacgaaaatctcaaaaaccccaaaatctcctccaactccgagttatg

SEQ ID NO: 27337 - DNA, 1746 bp, Unknown; identical to SEQ ID NO: 973
  misc_feature (1)..( 1746): 2750-1469P.txt file - cDNA_ID_2781324; gDNA_ID_1620343; Annot_ID_154045

SEQ ID NO: 27338 - DNA, 3003 bp, Unknown
  misc_feature (1)..( 3003): 2750-1469P.txt file - cDNA_ID_2781800; gDNA_ID_2214559; Annot_ID_134862
cagcaactacatgaagttcgtcaagagcctcgctgctgacatggatgatcacgttctcaaagcctaaatatccctttcacatcaacccatcatcacctaatatcatgatcatcatcaccctcatacgtacattgctccttttgtgtgtgtgtgtgtgtatcgtttttatggtgttttcaatataataaatgggggtttacatgtatggtttcatctactataatatgctttgatgttgtttattatggttgaggtttcatgtatgctcatctacgcatgtatccttgttaattaatgattttcaagagttatcaatcaatactgcccttttttaaagtgttgcactacgtatgtatcagcttccacaagctcacattgtatacagcatttgtggttgtattattcatcattttgtacgttcaattatggttattattcatacacagtattcattatatttatagtggttgtatagtatatttagttgctgttgctgtctttgtatgttcatttagtgtatagtaattaatgctgactttataagttcatatagtggttgtaacatttatcatttctatgagtatatattattactcatgtcctccgaaattggacaacatttaaacgatacaagcaaggaagacaataaaaatacaaaaatatttccttcgaaactctagtaaagaaagcatataatgaaaccagcatttagcaaagatgaggggtctatgtgggatgggggtcttgttggttcaatgatgtaaaaaatcattacgatttgttttaaggctattgtttttaatgggttgatatatgaatgacgaggacaatggtcatgtatatggattttgtcaaacctactaattagaattgtgttgtatgataagaacttggaaaacgtgaattatgtatggtatacagcacaatcgcaagtatcagtaaatatctattaatctaacatataaattttgagtttatatgattctatatatctttgtaaataaataatgtttatgctgtgcttgacaaaaaaaatgattatgtgtacgtacgtatgctaagagatgatcaaaattataactagagacattattagagcaaagtaccagataagacttttaaagatatttggaatattatatgaaatatgaaagtatcagtttaataaatactaaatgtagaaaaattacaatcgtgacagttagcttaactcaaactttatactaaaaactatctatactattaattgggaatcatcggaaaatttacaaccttttgaaacccgcacgtatgtgcgggtcaggatctagtgattctttaaatttggaaactcgaatatctcaaacgatattaattattcaggatattgatattacatggatggatcatggaaataaagcgacaaattgtttggagcagaatggtactatacatcatcaaatggagagacgtcaaccatgagaactgcaaatctttaagaagtctatcctcactacatgcagaagtggaagcgcttctctgatgatgaggtgtatgattggcgctaacaatcaagacgtagcttttctaatagactattcagatcaggtgaagatggtgtctttcctaaccgaatgaccagccttctcagtgtatttggaggatttgaaaaacgacaatgaagaatttaaaagttttcttttatctttaaattttagtacaaatgttaaagcggataatttggcacgaaaagttctataccaaatcacatcatatcacatatgcaaacaacattcttcgggaatggatctttaatttgagttctaactaatatcggttgacaaaagaaaaaagtttagaaataatattatctcatttaaactagatacataaatgaaacaacaacacacccatacacacaaaaagcgactctattttgttaaatagatgaagagcctcctctagaagatgaagtgatatctctagaaccagcactttcaacctagccacatagtgatggattgattaaggacaacacctcagaaaaagacttgtctatgccatgtatactttcgctaagaagtaagaagggagtgatttggcgccaggtaattgcaatgtttgaagcggtctttttgggggtctagctacttcatccttccaactgtagctatcttgagtctcagggaagatcataaccattgtgagcttgtagaaaaaggcttctacattgtcactgtgggcactcgtgaactgccagccaattttagaggtctatatagaatcttttttatcaagaaaatgtgtataacatataagagcaccctcaatagtgtatcttagcaaaatcttaggattaaaagcaattaaaataaagcaaaccaacaatccaaagctaagaagtgtatttttctttagatgtttttcttaagttaagatgtttttcttaagttaagatgtttatatgtgttatttgatgattggtttaaaaaatgaacaaaaatagaagatattgttttagaaaaaatgaacaaaatagaagatattgttttaaaaatatcaatgaaagtcacagctggcaggaaatctacggtatcgttatctggtggacttttcggcattcaaggaacaatacatcatatcaacaaacaataattatggtttgtttaaggtttaaattaaaattgatgtatgcatttgtctactctaatccttatcattgattcattatatgcttctttttttgttggtaaaaccattatatgcattttgtcaaacctatccttatcttaataacaaacaaaatacattgtatgataagaacttggacaacgtgaaatatgactcattctaaatatattagcagtagatatcaaataagtataaaacccggctcatctattttacgtctaaaccgttacacactctatatataaacgaaggaagatcacacgtgaaaatagtcatcaaccaaagtaagaagcgcacacacacaacatatttctttcactacccaaagagatg

SEQ ID NO: 27339 - DNA, 3003 bp, Unknown; identical to SEQ ID NO: 27338
  misc_feature (1)..( 3003): 2750-1469P.txt file - cDNA_ID_2781800; gDNA_ID_2214559; Annot_ID_185848

SEQ ID NO: 27340 - DNA, 3000 bp, Unknown; identical to SEQ ID NO: 1504
  misc_feature (1)..( 3000): 2750-1469P.txt file - cDNA_ID_2781806; gDNA_ID_1620409; Annot_ID_156211

SEQ ID NO: 27341 - DNA, 3000 bp, Unknown; identical to SEQ ID NO: 2988
  misc_feature (1)..( 3000): 2750-1469P.txt file - cDNA_ID_2781818; gDNA_ID_1620620; Annot_ID_46997

SEQ ID NO: 27342 - DNA, 3000 bp, Unknown; identical to SEQ ID NO: 2988
  misc_feature (1)..( 3000): 2750-1469P.txt file - cDNA_ID_2781818; gDNA_ID_1620620; Annot_ID_162246

SEQ ID NO: 27343 - DNA, 3000 bp, Unknown; identical to SEQ ID NO: 2988
  misc_feature (1)..( 3000): 2750-1469P.txt file - cDNA_ID_2781818; gDNA_ID_2926189; Annot_ID_140960

SEQ ID NO: 27344 - DNA, 3000 bp, Unknown; identical to SEQ ID NO: 2988
  misc_feature (1)..( 3000): 2750-1469P.txt file - cDNA_ID_2781818; gDNA_ID_2926189; Annot_ID_200908

SEQ ID NO: 27345 - DNA, 3003 bp, Unknown
  misc_feature (1)..( 3003): 2750-1469P.txt file - cDNA_ID_2781831; gDNA_ID_2214528; Annot_ID_134235
taggtgatccagcaagagaggtttttaaagatgcatgtcaagagctcatgcaaatgaacagacatgtgagaagcgtttttgataaggctgttgctgagtataaggatgaacaaaagcgtaaggaggaggctgaagaagaagagcttaagaggcagagggatctatttgggtccatggacattgaaaacaactgataaccattgtattctcctatggagtttatactatttttatcttaaatccagattcgtccttcaaattgactcgtcaaattcataatccacaccaaaatttaaccaagaagattcttatattgcttataaccattgtcactactactctgcttcttatatttgaaagatggtgaagtcttcaccgaattcacatagtcaaaattaacaaaaggttatataatgaaacaaagaaaaaaaatactatggatggattttgatttagcaaaatagattgtttgaatattgattgataaatcctcttagcctacgcagagtatcataactactaataacgcaagcgatagttacagaaactataagaacttaatagaagagagttttaaaagtaaacagcaactggaagttgaggtgttcttatcatctgtttcttcaataagtttcttcttgctcgtactcagcttcttcctcttcatattctccttcttcatcagccgttgcatcttgatactgctgatactcagagacaagatcgttcatgttgctttcagcttcagtgaactccatctcatccataccttcacctgtgtaccaatgcaagaaagcctttctcctgaacatagcagtgaattgctcactgacacgcctgaacatctcttggatcgaagttgagttaccaatgaacgttgaagccatcttcagaccagtagggggaatgtcacagacggttgatttgacgttgttagggatccattccacaaagtaggaggagttcttgttctgtacgttcagcatctgttcatcgacctccttggtgctcatctttccacggaacatggctgaagcagtgaggtagcgaccgtgtcttgggtcagcagcacacatcatgttcttagcatcccacatttgctgagtgagctctgggacagtgaggttacggtactgctgagatccacgagaggtgagaggagcaaatcccaccatgaagaagtggagacgagggaatgggatcagattcacagctagctttcgcagatcagagttcagttgaccagggaacctaagacagcaggttacaccagacatggttgcagagatcaagtggttcagatcaccaactgcacaattcagaaaacaaacaaaaaaatatgtgagtgaagtttcaatactaatcaataactaagcctgaaacaataaaccacagagacagatacagtaacaacattgactcataatcgaagaacattggaatacttacaacttggagtgctaagcttgagtgtacggaagcaaatgtcatacaaagcttcgttgtcaagaaccatacactcatcagcgttctcaacaagctggtgcacagatagtgttgcgttgtaaggctccacaacagtgtcagacaccttaggcgatgggaacacagagaaagtcatcatcatacggtctgggtactcctccctgatcttagatatcaacaaagttcccattccagaaccagttcctcctcccaaggaatggcacacctgaaatcctgtaaatccaaacaaccaaaaccataagcaaacaacgaatacaaaaccgaatccgtattccacagttcaaaatcagaaatctaaacctaaaaacaatcatacactaccaatacccaacctaaatttacagatccaaaaacctaaatagacaaaaacctaaataaggaagacggatttcaaataccttgaaggcagtcacagttctcagcctctttgcgaacaacatcaaggaccgaatcaataagctcagcaccttcagtgtagtgacctttagcccagttattcccagcaccggactgaccgaagacgaagttatccggtcgaaagatctgaccgtacggaccagatctgacactgtccatggttccaggctccaaatccatgagaacagcgcgaggaacgtaccttccacaactcgcctcgttgtagtatacattaaccctctcaagctgtaactcggaatctcctacataccgtcccgtctgatcaatcccgtgctcgagattaaccacttcccaaaacttggaaccgatttggtttccgcattgacctccttgaatatgaagaatctcacgcatcttcgctcacagagaagaaaaccctaaaactggatctaaaaagagagagagagagagagattttgaaaaagggaaaggagaagcagagaggatcttttgttttatgagagagagaagaagaggagggtccatttataaagaaaaggaggttttaacggctaatatttggtaattcgaaatcgaatcgacggtttagataatgccacgtaaatcgaggtggcaacgggtggcaaaattcaaaaattaatggctcgtgataaaaagtttttttgaatttcgtaaaaaaatatgttcgtgtgaatgacagctggattccattaaggagagcagttactaaaacatcgtcgcactcgcacgtgctttatgagagataaaaaagcggttccaacctggcaatcgcacgtgagagacttcttattgggcctaaaatgggcttttactcttttcatttcaaatctgcatgacttaaaacggagtgatgtgcactagcaaaatcctcagacggcaagcatgtgtttgtaaagtgaaactcatcgttttaatgattgaatatgcttattggatcctgaaccggagcctgaaccggagcgtgaaccaaaaaatacagtcaatcggaaaatgaatttcagattcaaacttgttcatcgaaattttgcttgaagattcgaatcgagaagtccgtggaagaggaagaagaagaagatg

SEQ ID NO: 27346 - DNA, 3003 bp, Unknown; identical to SEQ ID NO: 27345
  misc_feature (1)..( 3003): 2750-1469P.txt file - cDNA_ID_2781831; gDNA_ID_2214528; Annot_ID_184852

SEQ ID NO: 27347 - DNA, 3003 bp, Unknown
  misc_feature (1)..( 3003): 2750-1469P.txt file - cDNA_ID_2781838; gDNA_ID_1620671; Annot_ID_48169
gtggtcaacacagctggtggtgtgtggtactcatatgccaagtaccgacagaaaaaggctaaaccggctaagctaatgtctgatttggaagctcacaaaaaatgagaatttcggtccggtttggtttcgtttgggaaggcattaccccggtttatagactttgccactcaaatcaatgatcagaacgaaccgatgtatttgagagttgaaccaggaaaatcggtcctagagtgagatttaattttgatgtgaaacttcattgatcagttaatttctcgtttaggttaagaaaaaaaaaaaatcaatacctatttttatatgtagatgcaatcatgctaatgtataattgttaagttgtggctgtagcataaccatattaaacattagacatgtgttggtatcaactatcaactatcaagaacacatgaaatgtttgttctatttaatggtggaaaagttttttaaatgggtctactactactactaattaatactttggattaagacattttgtgatagaaaaagacagcacataagtcattacaacgtcagtgacctctgtttaagtcttaattcgtttccttaaatctacggtttgtgcatacggatcataactaatatttttggtttttgaatttgcaaacgtttttagttggactttagagatttcaaataaatgaagataaataaatgactcataattcatacgaaaggctatagcatttatagagttcattttcttggcgtgaaattagtagtacattcatttattccatgattttgctcagaatattcaaatttataaaagaaatggacattactttggaagagttgaaaaacttataaaacaaaaaacataacaatagaaaactttaatcgattaaatgaattattgaatgattgtatccactaattacaattattgaaataaatatgtataaagtagagggtgtaaagcactgtatgaaaagattatgataacatagttcaaagaatatcattatgagtcataactaataatcattcaccaatacacaatcgatcatcttaatatatacatgattaatttggattcattttaaagcacacttaaaaatatatcatgtccaataatttgtgaattattatttcatcagaattgtcatagttatctaaccatttgtgtttagggcagaactgtgtctgaggctaaattcattaaaaaatgtcactaaattctgcagtttttgtttttttccatctatgacgttatataatagctagccagtaattattaaaaccgtatagaatatattcttgagtctaactttaatctacatgacaaatttttaattactcagcaccgattggtttctgtagatgcatgtcacaagcaacacaaaataaaaaaaggtattacaaaaaaatagtactaacctacaaaattacttatttataattcttttgatctttctccttttagcttttccttttctcttattagtgtttatatgatactttcgtaaaacgttaggtattgtatagtaaataaaaccttaaaaatgccaacgaatatccttatcttctagtgttctacatgtgttgatatcaccaccgacaagtatctcgggtaacctaattgttggttggaactttcagaatttttaaaactgaaaaattgacattatccttctaatgaatcacattcttcttttttttgtcaaatacttccctttgtcaaaggcatgcaccactaaattatcttttgttttacaaaatgaccaaaattagcggcaatattttacgtcaacacttgaccaattttgattgttagagagcactttgtcaataaaccaaagtataatgtttccctccttactctcctaatgtataatatatattttgattatagaactcatagttaatattgagttgcatccctttgttttaacagtaaggctttgacttacgtttgtgattataccaattaccaagtatgatcaacactcaagatttttttttgacaagaatataataatgaaaatgcttatgctttgagtaaattaatcaggaaaacttttaactcatgttaatatagtatttttaacaaatatgaatggactacaaagagaatttgactaaatgtataaaatatataatttggaaaaaacatggaacatgacatggggagcacgtaggagaagcggtgatagcaaaatagagtgattcacttgaaaccgatttggtagtatcttttcttataaacatgttccaatgtaactagtacatagttggtcacaaatacaaatttgaatttgtcttcacctcaaattgccaaacaacccatatggtccccatccatcaatggattttcctcaattttctttcttttgaatatataacaaatttgttttttttaagaaaatacaaatatttgtaatgaagatccatgacatgacaagtgcttgtgaaagattacaaagagtgataataaaaaggggatgaattttgcatgctgaagcaatcaaataagtagctgaaagagtaacacacacatgaaagtgcaagtgacacatcttttacaacttctctcactgatgatacctttcttcctcttcctctgcctttgcttctctctctgagtcactacactctctcaccaacccatccttctctctgtcattctctaaaaaaagaggtccactataaatgagccttgagctgtggatgcttctttgtctggttttttagaatataataaaaaacaaaatgggtctctagatttcagatttctgggatctgggtgttagattaatctctttctcttccattattagtagagaaagctcactcctttcactcaaagtttctacctttttgttttcctgaaaatgggttgtgtttgaaatctcacactttgagatttgggtgtttattttgggatccttcttaccacatttagaaatttcagctagggttttcgatttctctacttctcagaggagattttagaggcaaaagatg

SEQ ID NO: 27348 - DNA, 3003 bp, Unknown; identical to SEQ ID NO: 27347
  misc_feature (1)..( 3003): 2750-1469P.txt file - cDNA_ID_2781838; gDNA_ID_1620671; Annot_ID_164123

SEQ ID NO: 27349 - DNA, 3000 bp, Unknown
  misc_feature (1)..( 3000): 2750-1469P.txt file - cDNA_ID_2781838; gDNA_ID_2926200; Annot_ID_141470
gtcaacacagctggtggtgtgtggtactcatatgccaagtaccgacagaaaaaggctaaaccggctaagctaatgtctgatttggaagctcacaaaaaatgagaatttcggtccggtttggtttcgtttgggaaggcattaccccggtttatagactttgccactcaaatcaatgatcagaacgaaccgatgtatttgagagttgaaccaggaaaatcggtcctagagtgagatttaattttgatgtgaaacttcattgatcagttaatttctcgtttaggttaagaaaaaaaaaaaatcaatacctatttttatatgtagatgcaatcatgctaatgtataattgttaagttgtggctgtagcataaccatattaaacattagacatgtgttggtatcaactatcaactatcaagaacacatgaaatgtttgttctatttaatggtggaaaagttttttaaatgggtctactactactactaattaatactttggattaagacattttgtgatagaaaaagacagcacataagtcattacaacgtcagtgacctctgtttaagtcttaattcgtttccttaaatctacggtttgtgcatacggatcataactaatatttttggtttttgaatttgcaaacgtttttagttggactttagagatttcaaataaatgaagataaataaatgactcataattcatacgaaaggctatagcatttatagagttcattttcttggcgtgaaattagtagtacattcatttattccatgattttgctcagaatattcaaatttataaaagaaatggacattactttggaagagttgaaaaacttataaaacaaaaaacataacaatagaaaactttaatcgattaaatgaattattgaatgattgtatccactaattacaattattgaaataaatatgtataaagtagagggtgtaaagcactgtatgaaaagattatgataacatagttcaaagaatatcattatgagtcataactaataatcattcaccaatacacaatcgatcatcttaatatatacatgattaatttggattcattttaaagcacacttaaaaatatatcatgtccaataatttgtgaattattatttcatcagaattgtcatagttatctaaccatttgtgtttagggcagaactgtgtctgaggctaaattcattaaaaaatgtcactaaattctgcagtttttgtttttttccatctatgacgttatataatagctagccagtaattattaaaaccgtatagaatatattcttgagtctaactttaatctacatgacaaatttttaattactcagcaccgattggtttctgtagatgcatgtcacaagcaacacaaaataaaaaaaggtattacaaaaaaatagtactaacctacaaaattacttatttataattcttttgatctttctccttttagcttttccttttctcttattagtgtttatatgatactttcgtaaaacgttaggtattgtatagtaaataaaaccttaaaaatgccaacgaatatccttatcttctagtgttctacatgtgttgatatcaccaccgacaagtatctcgggtaacctaattgttggttggaactttcagaatttttaaaactgaaaaattgacattatccttctaatgaatcacattcttcttttttttgtcaaatacttccctttgtcaaaggcatgcaccactaaattatcttttgttttacaaaatgaccaaaattagcggcaatattttacgtcaacacttgaccaattttgattgttagagagcactttgtcaataaaccaaagtataatgtttccctccttactctcctaatgtataatatatattttgattatagaactcatagttaatattgagttgcatccctttgttttaacagtaaggctttgacttacgtttgtgattataccaattaccaagtatgatcaacactcaagatttttttttgacaagaatataataatgaaaatgcttatgctttgagtaaattaatcaggaaaacttttaactcatgttaatatagtatttttaacaaatatgaatggactacaaagagaatttgactaaatgtataaaatatataatttggaaaaaacatggaacatgacatggggagcacgtaggagaagcggtgatagcaaaatagagtgattcacttgaaaccgatttggtagtatcttttcttataaacatgttccaatgtaactagtacatagttggtcacaaatacaaatttgaatttgtcttcacctcaaattgccaaacaacccatatggtccccatccatcaatggattttcctcaattttctttcttttgaatatataacaaatttgttttttttaagaaaatacaaatatttgtaatgaagatccatgacatgacaagtgcttgtgaaagattacaaagagtgataataaaaaggggatgaattttgcatgctgaagcaatcaaataagtagctgaaagagtaacacacacatgaaagtgcaagtgacacatcttttacaacttctctcactgatgatacctttcttcctcttcctctgcctttgcttctctctctgagtcactacactctctcaccaacccatccttctctctgtcattctctaaaaaaagaggtccactataaatgagccttgagctgtggatgcttctttgtctggttttttagaatataataaaaaacaaaatgggtctctagatttcagatttctgggatctgggtgttagattaatctctttctcttccattattagtagagaaagctcactcctttcactcaaagtttctacctttttgttttcctgaaaatgggttgtgtttgaaatctcacactttgagatttgggtgtttattttgggatccttcttaccacatttagaaatttcagctagggttttcgatttctctacttctcagaggagattttagaggcaaaagatg

SEQ ID NO: 27350 - DNA, 3000 bp, Unknown; identical to SEQ ID NO: 12950
  misc_feature (1)..( 3000): 2750-1469P.txt file - cDNA_ID_2781846; gDNA_ID_2214583; Annot_ID_135304

SEQ ID NO: 27351 - DNA, 3003 bp, Unknown
  misc_feature (1)..( 3003): 2750-1469P.txt file - cDNA_ID_2781957; gDNA_ID_1971973; Annot_ID_58683
aagatagtattagggccagaactcactcaacagtgacctggatgatatctttgttgtcttcattgaattctaggagaggctgatgtgaagaacagaataaacacagagatcatcagatgagaggagcgacacacccagatcaggaagaacgattgtcatgttgtggcaggaaaagtttttgattcatataaaatcaaagacagtaagatggttgaacctgaagactttggcaagaaatgttgtaccatggagaatctgacagttggcgaccttcgagtgaaacatggtaaccaaagccctgaacaaaagagagaagagggtttcagaacatagctgaacataatcataaccaagaaaatcaatgcatgatctaccatggtgttagtgttacaaaataagacctgatcaatctcaccttacctgattgaaatctgagtaaaaaggcaagacttgtggataagtttggactattccccatgacttctcgacaagtgaccaccatctggagagaaaacacatgcatactaataagatccagcgtctcctttacagcaatagtaaaataaagttttaagctcacagtcacagtaatgctagttcaaactttaaagatgacaaggagattggaaaatatttaaaatattacttattctgagctgtgtgaaaattggggggttgtgcagtctcataaacccatccaggagcaaatatggcagctgacacattgtttctcttcagcaaatccagagcagcatttacctagcatgtaaaagaataggaagaaaagaaatatttaagtatagatcattgttttgtactctacaccaatagagaagcaaatattaaagagtggctgagacatacagtccattgcccaccaccaaaagagccccgcccaaaaacatcaattcccatgtagacatcgaattttctgtccccagcaacttcagctgataggtttgggtagctctcctgatacatcattactcactaatagtaaaacaagacaaatagaagaaactgagactcgagagattgatcaaacccatagacagaccttccatgtgtagttcatgaatattccatcgcataagtcaaagaaaggtttgttcagctcagtcaattgatcttgccactgaagattaccacgaacagtgacactgtcatacctgcagaaagttatcagaacaaagtggtatacaaaaagaacaaagaaaaacttctgatcaactcaccatatgactaaagccccaggtgtcgataaatgcaagactttttttagatggctgacgaattccttcatatttggaatctgttcctcatctatatcattctctatatttatctgcaagtgacagtctatatattatagaagtctttcttcaccagccacccatcaaatacagatatcttataaaaaccaagcaaaaaatgctcaccagccacccatcaaagcctagagcagtagcaagttcagccaaacgctctgcatacatttgagcagactcctttgtggcaagcatctctttgcaggtagcttttccttcatcccattctgtgatgaaagtccccaatacctttatatttccataacacacaagaaagtaaacacttttaccaataaaatcctcagcaatattcatatctctgtacacaaacaatcaaactctctaattttatcatcctaatcagcaaactcagagatatctcaataaaaatcgaaactttggatgttgaacaatcaaaaagttttgagcttacttactttaacgccatgcctatgagcagtattggtccagcaaggaggaggaatagtgaccagagaatgagagaagtaaacaaaaatgtccatcaagtaccaatgccaaatcgcaaatccggcttcgttttcacacccttgtacccacttgtcatctacataccctcctttcatgtcatggcagactaaaacccttgggcgattcggtaaacagtcggagtttcggcggaaaggtactgtggagcgattaaactggaaatgaaaggaatcaaagtaagagcgagatttcaggtcttgaagagctttgatcgggaaagatataggtaacgatggcttgacaagatcaagcaacggaacggcttcagattgtgcaacgtcgtcatcgttggatttgggcatgaggagagagaggggaaatgaagtgaggagcttacgggagagggtgaagaagagattgtaaagagatacgagagttcttcgagagaaataggcgcgaagaagttctcgcattttgcagtggtcaacgaaggaagatgatgacgatggctttttatttaatttattcttcttttggtttattcgtacgccaaattaaagaagaaaaaaaacagagcatgtgaatttatcattcttttgatgtgaatctaaacgacatgacaatttcattttttttataaagtaaacttacacgaaagcagagagataagatatttatatgggccttggcctgtgattactgattaaggcatgaaaagttggattcttctttattggatctgataaaatgcttataaggcctttgaatacaaacaaagttaaatgttattgttgatcctttaaaagttcaaacatgtgattagcaaaaagtgtagtggcttttcttgctttctttttgttttataacaccgtaatccaaattggaattcagactaatttggagatagataagttcattggatacaagcaacgaaattgttccaattttgtaagtttgaattaaaatataaacagtcgtgcttaattatgggcaagaacatgggtttggttttggatcgtgcaagtacaacaaattatagctttgtttataaacattaaaatcatatactataataattcagtatactccaaattaaagttttaatcaaaccaaattttgtcattactacaccataaaaagagaaaggcgtaaaaaggaaaaagaaaaaaaaaggtaaacgttataataaaagaaaaaaaaaaatatg

SEQ ID NO: 27352 - DNA, 3003 bp, Unknown; identical to SEQ ID NO: 27351
  misc_feature (1)..( 3003): 2750-1469P.txt file - cDNA_ID_2781957; gDNA_ID_1971973; Annot_ID_177507

SEQ ID NO: 27353 - DNA, 3000 bp, Unknown; identical to SEQ ID NO: 1158
  misc_feature (1)..( 3000): 2750-1469P.txt file - cDNA_ID_2781970; gDNA_ID_1620364; Annot_ID_154766

SEQ ID NO: 27354 - DNA, 3000 bp, Unknown; identical to SEQ ID NO: 14877
  misc_feature (1)..( 3000): 2750-1469P.txt file - cDNA_ID_2781978; gDNA_ID_2684231; Annot_ID_137613

SEQ ID NO: 27355 - DNA, 3000 bp, Unknown; identical to SEQ ID NO: 5056
  misc_feature (1)..( 3000): 2750-1469P.txt file - cDNA_ID_2781994; gDNA_ID_1620758; Annot_ID_167058

SEQ ID NO: 27356 - DNA, 3000 bp, Unknown; identical to SEQ ID NO: 9122
  misc_feature (1)..( 3000): 2750-1469P.txt file - cDNA_ID_2782011; gDNA_ID_1971986; Annot_ID_177716

SEQ ID NO: 27357 - DNA, 3003 bp, Unknown
  misc_feature (1)..( 3003): 2750-1469P.txt file - cDNA_ID_2782170; gDNA_ID_1620753; Annot_ID_166859
aaatgcctatcattttttttattttaaagatagtgatagagtggataaattgagatgatatttagatctaattaaaagtctatttcgactaatcgttgattaagttagaaaaaagttggataacgaacattttgtttatgtataaacaactcatatgttaaatcatatattacttcaaaattatgttttcttaattctattattttaaattttatacaatctgtaaagtaaaattttggggattaaaacccgaatatattataaaatttatagttgatcatttaaaatttaatatgatatttgtacaatggcaaaaaaaaacttactaacatttctataaaataaacaattatcgattaaccattgtataacgcatgtccttatctagtcacgcttcttttcctcaattatggttaccatgtaaatccaccaaatcactaatcaatattttttcaaaaattataaaatctaacaaatcaatccaaatatatattaaaaagtccctcaaatctctccaaatctaactttcatcaaatcttctaaaattcttagctcaataaatattgaaaaccaaataataaattattgataatatatattgataaataatatatagttttggttttaatatatttataatatatcgagtatcctcgacacactctcatccttcatttttgaatattcttcactaattccaaagaatgagtgagattaaagaactcgtgcgtattgatgaaagcgttacacgtaaatctacatctaacacaatggagatctaacgcgtagaaacaaggtcattgtagtatcaagcactcctcatccgttccacacccctcaccttcttttgaacaacatcgttggctttgatgtatgcaacatatatacttctctatgcagagctccaatatcccaacttatgcaacattatgtcctacaatatcgcttccgaagccaaacgagttcatgggccattgtacatctattttcacatcacattaatcccgcaaatcgagactccatgacaatcaaagtctaggataattcatactaggattaggaagtaatttaaaataatatttagattttatttatttgtatatatagatgatattaccttgggaattaactaagtttaaaatatattaaaatatatattttcacatattctacggtaaaaaattaataatatattaatgtacgtatagtttggttaataattttctacatttaaaaatgacttaagaatctggggtttaacatgatgaagtggtatatttgagttgaacaaatcgatcctctcaaagatttagtattttaatttgaatgttatgtgtggaacaattcgattctattaaagattagagttgaaatagatatttgttatgttattctctcttattttattttattttttgtatagtatagaatgtgtgggataatttctacttatttcctaacttagagtttagaacattatagtagttgatgttttaaggtaagatagataacaaatttagtttttgttgttttgaatgattattatcaaccaaaaataagatcaattagattttaacctgcggtacaccgcggagacaatttattttttaaagttattatatataaaaatttgcaaattgtatttatctataaaatatttttattttatagtttacaattgttattaagtaacgtcctgccaaactcgccccgctaagtctgtcccgtaaaaaaaaaccatttattttattaatattgatcttatttatgatatgtttatgaattattgtctatgtattttagtcgatgcgggacgttatttttcgccaattggttaatatatgttcattttttaaaagtcgaatcacaaaatatgacggaattttttttgagattttttaaaactctatatattatataatgatgttaaaaattgtgatatattaaaaaatttataagtttaaatatataaataataatatttaaaaaattaatattttttggtttttaggtaatgacataataactctaaaagtaaggatttagaaaatttaaatctttaattaaatattttcattcctaaataattaatgccagtagcatgacattgtaaataagttcaaatacaagatttatttatttaaacaaaaaacatttagtaagaataatatttatttaaacaaaaaactttgtttaaaaatattgttaacaaatacgtttatgctaattttaagggattgatgtgaagtttgtttagattaaatttaattaataatgtgattgacaatttaaatcacgaatttaaagtaaaattaattatttgggaatttttttttaatgctaatgacattgggttgtaaatcagttcaagtataggatttatttgctaaaatagctgcaaaaatgtatatgtagatatataataagtgtgtattagttgaagatttaattcttattatttcgtaatagtaaatggtgaattaagtgcagaatcgtccgaatttagtccgatatacaacatacctcacaccattcaaagcctaagtaagtaatttattctagtttttccatcatacatggactaggggacatagtctaaaatttcaaaaactaaaataagtttgttacttgattttctcaatatattcggcaaaatcaaaagatatgataattgaattgcgactatatttcatggaattcatatttcgtaaataaataaaacttataaaacgaaaaaaagttaaattaaattcaccaagatacatcaacataataatttgtgttactcttttgatttaatcttaataaagttagttgatgaaagtatttgaccaataagcgaaagatgaacaaaaccctaaacaatagatgactcacggaaaccaacgccgagaattccgtcgaacacttgagctgcgttttaaagttctccaaatggcgccttttgcctactaaaaaacctttaccttcttcacagagatctaacctctccttttcccaatg

SEQ ID NO: 27358 - DNA, 3000 bp, Unknown; identical to SEQ ID NO: 5512
  misc_feature (1)..( 3000): 2750-1469P.txt file - cDNA_ID_2782654; gDNA_ID_1620797; Annot_ID_168521

SEQ ID NO: 27359 - DNA, 3003 bp, Unknown
  misc_feature (1)..( 3003): 2750-1469P.txt file - cDNA_ID_2783357; gDNA_ID_2685554; Annot_ID_138126
agtgtgtgtgtctatcttaacagtgatggttttgatgctatcaatttctaaagttacgaaaggtaataatgatcatgcgccggctccaatgtcagagaaagggttgctgccaaatccaatatcatgtgtagcggacgcaagaaaaattccagattgtgtagaggcaataaaacagggccatttgaaaattataaaaaaagaatgttgtatcattctactcagtcttcccgaagattgttttgggattttatttcctatacgtttctactatcgtatcatacttaagattacatgcaaattaattggcatcttttaatcacaatttttttttaatctttagatattttttcatgtaacggtattcatattatttcataataaaaccatttttctttcagtgatttgttaataattacctaaatgattatgttaaatataaaataatgggttttctatactaactaagaattaggctagtgttcgtgagacccttcgtttggagctagaagattaatccctagttcggttattggttgggaaggatttcatattccgggccaggagatatatgagtctcacctggtaattccttagagttgtagttaattaacgaatcaaaaagaacatgcattgattattttattggccctttgttatatgttttcttaaaaatgtgtaacgcttaaaatttcttgcaaattacttgtagtttcaatagtttaaaaattttaaagacttattgaatgactttgtatcacttcattttatattcaaagactctgtatcaatatgagattattattttttctttattttgtggtgtctaaagaatcacttcaaatagatcttcattgtaaatattcataggtgaaaagttagacatgctcgagcaccactgaattattttaagatcatatccatgtacttttaatttgcaatataaaaggaaaaatattagttaaaaaaaaggaaaaagtatttctataagtcttcaaatgcacaagattttctgaattgaatgttttatgattagagtttttctcccattttatcatatatactgataatattaataacaaaatgatttgaaccccttacatgtgctcgaggagctgatgcacatggtccatccaacatttttttttataagtaaatctgttacaattagggtccaaatttttattaaaaaataaaatataggaaatgatgaccaattcttttttttagcacatgatttttaattattttgagccagccctaagtaaaaaacgtataggcttttgtcgacgattatgttataaacttataactagataagaactcgcatctagtgtgggatgaaacgattaaaataaattatttgataaaattattgatatttaatatttgtctgtatataataaaacatgtaattaatgtttttattttattttaatttatgtttgttttgtgtaaaaatacgtttcacccgtgattgttaaagctctaattcttgagtgggtcggaacttggtttaatttgcaacataatacaaacatcgatatatcagatcttttttagtttgtgttatagtgtgctcagtggggcggctgttgtacggatagatttgaaaggattctttgttatgattccaacgtttttgcaatcactagagaaaaccaatgagattgtaaaagaaaaacggaaacaaaacaaaacaaaagagaagaaagctagagaacaaaaaaatgatattcactagacatggtttcgacgaagaaactggaaaccagccatcaaacaaatacaacaaagatgatctgagcttagtcgagaaaaaaggatcctgaattgctcggatgataaaatcagacgtggttgggatttctctctaaaatgttctcatcatttaatttggccatttggatatgatttaaatcctaatttctagctttagtttcttgtttttttttttaaattaatcaagcacaataaaaaccttagacttagaaccctccattttttttccaacaattttgaaaactatataagttcattatttttatctctatatatatatataagcttaagaaaatgtacgtataattatgtttgttcaaatgttcatccagaatattttacgatgtcatattggttttgttttgttatcatgttgtgaagtaagtaatcattttttttattgtcatttccgttcttgtattaaaaattatatattgatgtggttgttaaaccgaaaaagaaggtgaatttggtagatcgcaatatttattgatgaaattaagaaaatatcaataatatgatttgggttcattacatagtttttttttttacatgtgtaaccccttctcacggccacggtgaaattttcataatatacacaaaaagggcaacaaataagaaattttcattacatagtatattccttaattttgtttttattctcatttagtttttactagaaacattaaaatgaacttatatttgtaacgtgctattttgttttctgaactatcaaatgaacgtctaacaaaatcaaactcaaaaacttataatttataactctaatttccatttaataaataatatacccactaaattaaaagttaaaagttaactagtaaaatcgactataattgcagaaaattagaaactgttttatcctttctttacattgtcggttttcaccgtccaatactccaatccatttttagtttactaactaaaatttttttattttaatttacttatcaagtttacccaagaataatattaagtcttaccaagtcaagacagggcagtacgtatgaagtgggacttgggatttaatgtcacatttaaagcttaaacgtcagtgtttactagaaactttgacaagttcttgattgcaacacaacaatgattgcgacaatattaatagatatatagttatattttccaccacatatctaattcttcatcttctcaactaaacaaatcagtcaccgggaaaaatataaagagatg

SEQ ID NO: 27360 - DNA, 3000 bp, Unknown
  misc_feature (1)..( 3000): 2750-1469P.txt file - cDNA_ID_2783361; gDNA_ID_2685554; Annot_ID_193352
atttttgttttacataagatctttcaatatgtcatggctattgtttatatagacatgctattttcataaatacatacgagtttgttcaaatgcaagttgtttctttcattatttttatttgattcatgtcacttcttaaaattacatggtttttttctcctttccattaatctttgtcattagatgactttttttcactgaaccttacgttgaagtctccaccaccaaaaacaaatgcatcagtgcaaaaaactataaatttacaaggttaattgtcctttcctcaccttttccccaccacaaaaagagtcagttaccccaacaaactaaccattattaatttatgtgtaaaatttggctagattctaatattaccctttttatacttgtatccaaaaaatatcgtcaacattcaatagaaaacaatcgaaagaaaaaaaaagaatactttataaatttatatattaaactgattcaaaaattaactcccaacctaaaaatatattgatttatcgaaatattaattttttgagtattaatttatagaaattttgttgtaaacatttgttttgcatgtttttaatctctcttttttacatcaaaatgcattttagaaatgtataaatcaaatacttaaatttattggggttatacaaaaatttatatcaacgtattaaaaggttatttttgcattcaacctaaacattcgtactaccaaaatcatgttgaaaggaaaaaccaaagtattgtgatagaaataagttgacaaatttgttgtgcatattttgtgaaataatatgtttggtttgaaataattttgattgttgaacaaacaaagattaatacagtacatacattatatatatatatatatatattattgctatttctataaatgtgtgattaatttttccgataggagccgacatacttcataacaaaaatggtgaataaagaaaggttatttattatggttctgccgaattagtaaatgatggttcttaggagatcactttatgattatggatatattgacataatggatgacaaactcgtggctgaatgcaaagatagccatgacgatcatctgggtgataatggatatatttatgtatcttcgcgactttgcatatctatgtgggtgtagatggtacaccaaaaagtctttgttcgagactcatctgaattcatgcatctactaactaattttgtcgtcataaatatggatgtgaatgaggatgataatgagaaggagtataagaggagaattaactattaataatataatattacctttttagatgatatattaagagaaaaactcaaagtcgaaggaataatgtagagttagcaaaaataaaacgacaatgataataagcaaagatatatcaaactctcgttttctcatgcatgtgattgtgatatataccagtctttcgagtacgacactagataaaattgttcatgttttagtgacactattaggaatatcatgcaccattaatttgatatgtttgctaaccataagaagatacgaggatctacactggagacctactaatatatttaatatatctaagaaacttttcattaaaccgaagtggaaatctctcaaacttccaactttcatagcaaacaaggcttcatttacccaaattcgaatggagtaaaaatatttcgcacataaaagtagaattttacagaaatatcctttaaaatgcatctccatatgatacattgtatcgcattatgacgactaaatctctcaaacttccaactttcataacaaacaatgctgcacttacctgatttctaatagttaaaaatatctcgcacataaaagtggaattttacatagatatattttaaaattcatctccatctgatacattgtatcgcattatggcgactaaatctctcaaacttccaaccttcataacaaacaatgctgcacttacctaatttctaatggggtaaaaacatcttacacataaaagtagaattttacatagatattctttaaaattcatttccatttgacacattgtatcgcattttatggcgactagtttttagcatgtaacttttacaaagtgttgaaaatgaatataactcactatttaaaaaaaaaagaatatagcttactataccaaaactaaattttattcaactaacatgttgtacatagtcaccgtaagtgaatacacattgtgttaaccagggagaaggatcagatcagacttatcttctctaaataacctcaatgagtcaatgttaaacacttttttatctaaaagattttctaatatataatacaaaggaagaatacaagtatggaatacgatttgatacaaaaaaaactggtagaaacttaaaatacctgtggataagtacgatctatatttgtgatccataattttaaagtatattatatataacctcatttaacgtcgttgtacatgaaatgaagacacattacatatacactgtcttctacaaatatgttatttaactttcacaaaatattatattgacaattttagtgttacatattcatgatgagagttaatataatataatatttcctaaacactaatgtgttcttctctcatcaacactcacaaccaattgttttgacttgtagtatatacatatcttctaatatcaaaaactttactataaatgaaaaaataatttttttttgtcgatttgaaaatggtataatagagcagtgtcagtggtatggaggagtagcaaatagcaaagtggtatacggaactagattagatggaccaatgactcattgctcatatcttcttctcaattccaattttgtaatccttatctcaaattaatttctatttttataactacttaatctcaattagaagaagcctgctctctaataacaaaaaaaaaaagccgtttgggatttcttttacacgaacacattcttccgatctttcttgtttttaacttaccggtaataacgaagatatg

SEQ ID NO: 27361 - DNA, 3000 bp, Unknown; identical to SEQ ID NO: 27360
  misc_feature (1)..( 3000): 2750-1469P.txt file - cDNA_ID_2783361; gDNA_ID_2685554; Annot_ID_138127

SEQ ID NO: 27362 - DNA, 3000 bp, Unknown; identical to SEQ ID NO: 15053
  misc_feature (1)..( 3000): 2750-1469P.txt file - cDNA_ID_2783365; gDNA_ID_2685554; Annot_ID_138128

SEQ ID NO: 27363 - DNA, 3003 bp, Unknown
  misc_feature (1)..( 3003): 2750-1469P.txt file - cDNA_ID_2783416; gDNA_ID_2685557; Annot_ID_193374
attttttattataataaatgaaatgtcaaacaattgttattattagatttccaaacagataagacggtgaaataaaattctaattgtttttgttttattatttagcataaatatagttttatttatgtttaacttcaaatgatgggaaaaagtagggaaaatatgtctctaagttaaatgttataagcttttataaattgaaaccataatgtttttatataattaatttaatattatataacaattgttattatttatatgtgatgtaatggcaacaataaatgaaaccaaaaacttaggaatcatatatataaaagtaaagtttcactctttccttaatggtccacttggcaatataagtttttttaaaatttatataaataataaataacttatttaacacacagtttaatataaaactgaaatcaaaaaaatatgtatcaactatatttttccactctactttattcaacacacaattaattaaaaattaactaccacaatttatttacaaacctgaaatcataaatatatataaattaattatatttctccacaccattttattcaacacaaaataaattaaaaattaactcccacaatttatttttaaattgtaacttccatcacttctcatcctataaatatatacattctctcattctctcatttcttcatccccttccaccgtatcttaaatattgttttgtttagttttaagtttttttcttgttgttgttatgagtttaaaaaatattattgtaaacacttaattctaaattttaattttagattatgaaccttacactgttattcttttttgtttaaatacatctcgataatcaatttttcattaccatcttataaataatcattctctcatcattttgcactatattcatgtatatatatcttatgttgttatatgggtaaaacacaataaatttaaaagatagaagttgtccttggggtttaaaaaaaaaaacttttatattaaaattcatatgattttataagaaaacaaattagtttgtcacttacaaaataaaatgaattggaactattatgtatgagtttatatcaacaaattattttgtaatttactttatcatacatttattttgtaaaaataagatatgatatgtttattaatatatacatgcataaataacatagaaaaagaaaaactgttaaaatatgagcaaaagtaagatatcaaattttaacatatttttaattttttaatcatataatattgatacaaaattattttaattaattaaggttttaaaaaaaaaaaactaaagatggaaaattttcttataaaattggaggataatttatagtagtgaactattaatgtgcagtcttattggttcctaatttacaaggaattttgatgacttcaattaaatccttgaaaataaagaaatgaaagattttaaacgattgttagagagttttttataatcttgttgattagtttttcataatcttgtaaagtttctcaaacaatctctttattttgataatactttccatgacttttcatgacttcattttgtgaagaaaaatgtaggaaatcataaccaataacacaataatttaaatcattaacaatcattaacaatcaaagatttttttgttttaattgaataacacaaaacttttaatgactttataaaagtatgaatctaataacccaaaatttatgaagagtttagattactttttacaaatcttaaatgaataacacaaaaatttaacatacttttaaaaaatcttgattgaataacaacagattttacatgacaatttaaatcactaaaactcttttgaaatcatacacgaataacaccccctaaaacataatatcatgtcaaaattttaaagatttgattttgtaattagttaagggagttgcaattatgctagaagaaaattcatttcaaaattgtagtttaatatgaagtaatttcaaagtttaatgactatttttctaaatatttaatatatctattaataaattattttagtcaaactacaattaatgataagtacatgtgtcatcaaagtatagtgccaaatgtcgcattagtaggcaaagttaggaaaaaccttctcttattatataagattttgaattacaggaagtgatgaggatgtctagtaaccgaaaggttgtgatcgataacaagactcatgatgaaggcaaaaaagcagagcaagtccataagcttctctccctagtagatgatatcagaaggagcaagtgtggagaagcatataccgatgatacatatcatatgataaaggtgaaaaaatctcttgcatatattctcctcagatatttttgaaactttaaaatgatcaaatctcgtggtatcttaggaagagtcagagaaactaaggaagcatcatgaggagctggaatcaaagaactattcagaagaatgtgcagctgaaatgaagaatcagtcacttatattgtataaggagaatttgaaacaaatgtcagagcaggtaaaagatatgatcataaatcttatatgactacttccggttttccaatattaacaagctctgagtatattttgttaagttggagaagaagctcaaagatgctgcggaggcgcaagaaaaagcgctaagcaagatgacacaagaaaacaacgagctgaacctggcgcttaagattcacatcccgttgccgccaattactccatgcaacattctttgaaaaatgtcttctttctaacaaaggggtttctcaagaaatatcagtaactattatcgtccaaagggattttgggttgccataagaagatacaatcaaggaggttttgtttgtcaaaatttcaaatgttttaccaaacctttctgttttttttcccattttgtatttcagattacatgttctgtccaaaactatattgtggtttcttttgttgtgtgtggacttttgtataactatgttttcttccatgtttgaataagtgtatg

SEQ ID NO: 27364 - DNA, 3003 bp, Unknown; identical to SEQ ID NO: 27363
  misc_feature (1)..( 3003): 2750-1469P.txt file - cDNA_ID_2783416; gDNA_ID_2685557; Annot_ID_138142

SEQ ID NO: 27365 - DNA, 3000 bp, Unknown; identical to SEQ ID NO: 15076
  misc_feature (1)..( 3000): 2750-1469P.txt file - cDNA_ID_2783455; gDNA_ID_2685559; Annot_ID_138156

SEQ ID NO: 27366 - DNA, 3003 bp, Unknown
  misc_feature (1)..( 3003): 2750-1469P.txt file - cDNA_ID_2783486; gDNA_ID_2685560; Annot_ID_138173
agcgtgatttgggttgtggtgtctaaagaggtgaatgtagagaatattctagatgaaatcgctcagaaagttcatattagtggagagaagtgggacacaaaatataaataccaaaagggcgtttatttatacaatttcttaaggaaaatgagatttgtattgtttttggatgacatatgggagaaggttaatttagttgagatcggagtcccctttccaacaataaaaaacaaatgtaaagtggtattcaccactcggtccttagatgtatgcacaagcatgggggttgaaaaaccaatggaagtccaatgcctggcggacaacgacgcatatgatttgttccaaaaaaaggttggacaaataacactaggaagcgacccagagatccgtgaactttctagagtagttgctaaaaaatgttgtggtttaccattggcgctcaatgtggtaagtgagaccatgtcatgcaagaggacggtacaagaatggcgtcatgcgatatatgttttaaattcatatgctgcaaagttttctggcatggacgataagatccttccgcttttaaagtatagctatgatagtctcaaaggggaggatgtcaaaatgtgtttgctatattgcgctttgtttccagaagatgctaaaataaggaaggagaatctgatagagtactggatatgcgaggaaattatagatggaagtgaaggtattgataaggctgagaaccaaggttatgagataattggtagtcttgttcgtgcatcattgttgatggaagaggttgaattggatggagcaaatattgtttgtctgcatgatgttgttcgtgaaatggctttatggatcgcatctgatttgggaaaacaaaatgaggcgtttattgtgcgtgcaagtgttgggctacgtgaaattctaaaggttgagaattggaacgtcgtgagaaggatgtcattgatgaagaataatattgctcatcttgatggccgtcttgattgtatggaactcacaactttgctactacaaagcacacatttggaaaagatctcgagtgaattcttcaactccatgccaaagctagctgttttggatctatcaggcaattattacctctctgaattgccaaacggaatatcagaactagtttccttgcaatatctcaacttgtcaagtactggtatacgtcatttgcctaagggtctacaagagttgaagaaactaattcacttgtacttggagcgaacaagtcagcttggaagtatggttgggatatcatgccttcataatttgaaagttttgaaattatctggttctagttatgcatgggatctcgacacagtgaaggagttggaagccttggaacacttggaagttttaaccacaactatcgatgactgtactctaggtacggatcaattcttgagctctcataggttgatgagttgcatacggtttctaaagatatcgaataatagtaatagaaataggaactcatctagaatatcacttccagtaactatggacaggcttcaagaatttaccattgagcattgccatacctctgagataaagatgggaaggatatgcagcttctccagcctcatcgaagtgaatctaagcaattgtagacgcctgagggaattgacatttctgatgttcgctccaaatcttaaacggcttcatgttgtctcttcaaatcaactagaagatataataaacaaagagaaagctcatgatggtgaaaaatcagggattgttcctttcccaaagctgaatgaacttcacttatataatctacgggagctgaagaatatctattggagtcctctaccatttccatgtctagagaaaatcaatgtaatgggctgtccaaatctgaaaaagcttccactcgattctaaaagtggaaagcatggtggaaatggactcatcataacacaccgtgagatggaatggattacacgtgtggaatgggaggacgaagctactaaaacccgcttcttagccaacaggtctagtttctcatcttctcttatttgtttttcaaatgatttagtttctcgtgatatgaactgcttccatctttaatgtctctgtctctttttgtgtgtgttaggttgattatagtcagaactcacaaggttaaatgggcttctcaggcagaaacttcaaagtggatgatgcaatttggattgtgtctttttgtgtttaagtctttctctatgcgttgtttttctgtgaactattttttagatttgtgtcggcactgaactctactattgctatgtttggaatttattggaatatatccatgtgccatttgcaaatttgtcctttaaagaacttttctaataacagaaatgcggatacgattaaattatgttggattccttgtgcttcaagtattgcgtataacgttttgatgtccgttatcatcatatcttatttagaattaaatgtaatccaacttaacaaaacactcgcgatccacttgctttgcagctcaattataggaaacaactcaatcatatgtgaaatcttcatgttgaagccaaattaaactagttattttgcatctattttctaatgaaaagctgtctgaattttccgacagaatattagagtttgtttccttgcaatatctcacttgttacttgtcagatgacgaaactataggatttggaggaaataagtcatctcccgagtattgtgataggatatcaaatttgaggatattgaaattttttgttctggtaagcagggtgaaaataggcataccataagatactgcagactgggaaaatggattgatggtgtcttagcttcatctgaaatatgaaatttataatattttaaggggatcagctgacccttcttctctttgtgggtccgcccaattgacatcatctccacaaagtctatatgaccaaagatttgaaaacactttataatcacatattaattaacatgacacaaaaatcccattacatatcctaactaattatg

SEQ ID NO: 27367 - DNA, 3000 bp, Unknown; identical to SEQ ID NO: 15093
  misc_feature (1)..( 3000): 2750-1469P.txt file - cDNA_ID_2783490; gDNA_ID_2685560; Annot_ID_193462

SEQ ID NO: 27368 - DNA, 3000 bp, Unknown; identical to SEQ ID NO: 15096
  misc_feature (1)..( 3000): 2750-1469P.txt file - cDNA_ID_2783490; gDNA_ID_2685560; Annot_ID_138174

SEQ ID NO: 27369 - DNA, 3003 bp, Unknown
  misc_feature (1)..( 3003): 2750-1469P.txt file - cDNA_ID_2783494; gDNA_ID_2685560; Annot_ID_193463
taaacattggaacaaaatattacgcatatgaatgtctatttgaaacattttaatgagactttttgtatgagtaggtacaaatattacttcccatttctcgacacgaaaggcgaagtgaccgttgaggataaccgtgttggaccattatataagcatgttttcccaccagctctttctccgggactttcattcatcggattaccatggcaggttaatgatttttacaattgtgattagaatatgaagtaacaaactcttgatgtcaatcaacttattggtcaatgattcggatatttataggtcattctttttccaatgtttgaactccaaagcaaatgggtagccgcggttttggctggtagggttttattcgaagctcgaagcctcatgtattcccaaaagatacacacatcttatggcagaattagattctcaggttcgtactgtattcctttccataacatgtatgaaaacattatccaaaaagaaagcatacattaatttgaatgtgtttttttggttacagtttgtatacgataattggcttgctgatcaatgtgactatcctcgtatcgagaaatggagagagcaaatgttttacaaggtgttcaagagaatacaatcccaatccagtacatataaggacgattgggacgatgatcacctcatcgcagaagcatatgaagatttcgtcaaattcccatctaactatcccagttctttaatcgaaagagaatatacaagctgaaaaacatcacttgaagtctctgaaatgagggtatgtgggtttattacatgcgaaataatgcatattgtattgtaaacatcacttaaggtctctgaaatgttggaaacttacatgtaacaacattacttgaagtctgaaatgttcatgataggagcgagcttcttgtctttgaaggctattcttgtctcaacaagacaacaagtgattgcatcaacttctgtaacctagcaagaaaataacaaatagaattagtcatacagtattttatagtgaccagacattaccacaacgcgtcattagagtaaaagcaaaaaacgttaattcaactcacagcttttaccctcaaggatgatgcaagtgttttaagaaagcatatcgaggaagcttttgtctaatctcccatcatgcaacatattagcgaccaagccaatggttgaagcatctccaacaaacctgcaactcctcatttctctgatgagttcagctgatgctgctttgtcaccatctctcagatgtgccctgataagtgtattatatgtaccactatctggaagaggcccgtcttctttcattttttttagcaaggcataagcttcctgtaataggcgtttactacacaagcctgagatcatggtattgtaggttacaacattaggcttcactcctttaaggctgaggctacaaaatagatcccacccatcatccaccttcccagccttgcacatcccttcaatcatagtagtatatatgtaaatatcaagttttatctcactcttttgcatatagtcgaaaacctccaatgctttctctagcttcccgttattacagagtccatctaacaaaatgctgtatgtcattatatcaggaggtacaccatcagaaaccatctgtttgaaaaccttttgggcattatcacagtcgccatcatgaaaaagcccttggataagagtggtgtaagtgactgtatcgccaaccaatcctctatgagacatctcgcggaagagttccgtaccatcttctactctcttagacttgcaaaatccctttatgagagtattatatgtatctaaatctgggaaacagtccttgctaaccatgaactcaaacatctgcttggccttgtctagacgatcatgcatacagaacccgttgatcaatgaattgtaagtgaaaatatcaggatctatagaccttttgatcatgtcatcgtgcaatttctcagcctctacaaactttccttctttcacaaacgcatcgatcaatgcattgaacgtgactaaattagggttgattttcttctcaatcatatcactcagtagttgagaggcatcactccatcttccataactacaaaggcaacttatgagggagctgtaggtaacaacatttggtctaattcctttggtttccatttctttgaataggttgagtgcatcatccacatgtctatatttgcagagactatcgatgattgtgttgaagataacaacatccgcctctattttcgcagcttccatcttgttgagcagattaaaagccaaatcaatatcacctctcttacataatccatttactaccactccataagtaaccagatttggttgacagcctctttgaaccattcgatcaactaacgccacagcttcagaagctttgttgtggagaaaaagcccatgaatcaaagttgtaaatgtgattgtgtcaggtctataccccatttccaccatttgatcaaccaaagctacagcatctgaaatcctcttaccgtgacagtatccattgagaagagaagaaagcgtgacaatgctgggctcatagccgagtttcatcatcttgccaagaagagctaaagcaagagagatttgagagcgtcggcagaaacagttgatcaaaatattgtaagtatatagattatgtgaaattcctaacctctgcatcttctcacctagagagatgacaagatcaaactttttcatcttagcaatggcactcaacagtttattgaactcaaaaatggaaggtaaaggacgtgacttgaccatgccaccgaacaaaccaattgcatcatctaacttcaaatcctgtaacacttttctactcaagttctctctgtaatcaccactgctaccagaaaaagctcgtccccagcaacagaaaccgtaaagattgaaggagtaaggagcagttggatgattacctttccccaggagattccgacgaacagacaatctcttcgccgtggatgataatacatg

SEQ ID NO: 27370 - DNA, 3003 bp, Unknown; identical to SEQ ID NO: 27369
  misc_feature (1)..( 3003): 2750-1469P.txt file - cDNA_ID_2783494; gDNA_ID_2685560; Annot_ID_138175

SEQ ID NO: 27371 - DNA, 3000 bp, Unknown; identical to SEQ ID NO: 15091
  misc_feature (1)..( 3000): 2750-1469P.txt file - cDNA_ID_2783498; gDNA_ID_2685560; Annot_ID_193466

SEQ ID NO: 27372 - DNA, 3000 bp, Unknown; identical to SEQ ID NO: 15091
  misc_feature (1)..( 3000): 2750-1469P.txt file - cDNA_ID_2783498; gDNA_ID_2685560; Annot_ID_138177

SEQ ID NO: 27373 - DNA, 3003 bp, Unknown
  misc_feature (1)..( 3003): 2750-1469P.txt file - cDNA_ID_2783514; gDNA_ID_2685560; Annot_ID_138183
tacttttataagcaattcatattggttggtaaaataaaatcaataactattctctgtaactgatagtagtatattatatattaacgcgtaaataattagatgtcaagttaaataaataattatttcgaagagccaaattatttgagagtcaacggtgtgatcacaggaatcgacggatcggagagacccacgcgagcactccacccgtttcggctaaataacaatattacccttaaatcatgttcccatttgtgaaaacgtcgtgacttctgtttctcactttaccaaaacgataaaacatgctccacgatgacggtgagactatagtaaagaggaataatcaaactcattgcaattgaagtttgatttacgaaaagaaaaccctaaaacacctcagcaaaaattatgttattaatcaacacactaaatatagacataaagttacttttagtgtttttcttcttatatttcgttacttaataatagaaatttgtgaacttggaacgatgaagaaaaagatcatggttatataataattacgtataaactaaaaaattgtattatacgtttgaactttcttatagtcaaaggagaggttagtttcgtcaatagaggttaccaatatttaatggacttgagagaaatttcgttcgtttccttacaagtccattgtcacgatcccgtaattaatataaatcttaagcttaactcatcgacatcaacaaaagattagtcaagaaaaaaaaaaactcttacggagagaaaacattcaaaacaaaatgaaagtttggagccaaagattatcgtttctaatcgtcatgatcttcattttggccgggcttcattcctcttccgccggccgcaagctccctagtatgacgacgacggaggagttccagcgattaagttttgacggcaagagaatattatcggaagtgaccgccgacaagaagtatgatcggatctacggagcttctgctagattagttcccaaaggtcctaacccgcttcacaacaaatgatatatttctatactattatagttacattttgtcgccaataattatactatcttaattaagtttgtttagggttttgtttagaataatttaatctaccttgtgtctcaacaaattctgttattgctggttctttaatttcttgtattttgtagatatattgtatgatagatatacgtacagagacttatgtaactttcttttttcatatttacatttatttatacgatgttgaaaatatgtatcaaatattgatttgcacgagatgagaggggtgattattttatattttgattatagttcattataataaatatgacatgttactagtttgacagagttattaatatattcaattcagatcatgtacgtatttctgcagtatagtttccgttcctaacacagtaacatgacatgatcaaagttatttccgttgttacgagtctatctatggtatatcttctcaaataagactagctagactattgaatttcgattttctttgcagtaaatcgatccgtcactcatatcagaaaaaaagacaaaaaaaaaatcgatccgtcaacaatcaacatgtatatatatgatgaaaacattacgcaaaagaataaattcagtcgtccattcaacaacgatagaatcatagaatataagtcaacatctatacttgtaaaataaatttatttttacaacaataaaatgataataatgagttttatgagtcaacagaaggggtaggcaaggaacgacacggcaatgcgttgaccctgttttatgttctatatttaagaaacgaaaaatgtaaacacatctctaaataaaactgattttttttggggtaaggtctgttttttgaaatgtttatagacgcttaggacacttagagcctttcaggtttaatgctattggctgaacaatctctcttagattgcttcaagttacagtcttttttagatttcaatgttgcagtttgttggttctcaagttggcagattttctaggataggatcaatcttcttttactaggttcaggtctcttcacactttggtaagcaagaagctctcttaacacaggcataaaatgcaagttttaagttcagttacgaagctttgttttcgtttgctgtttttattgagaagttaagaagattgactttcaaacactgctaccatggtttggcctcttctctggtggttgatcatcgagcatccagacttttcccttttgatgtttatagtcttgattcagttctttttaatttctttctttagacgtctttggattgtataatatgctctctgtatcatgaatggtttgtacgatatgtttcatataaataataataccctttggcaaaaaaacaaaataaaataaaactgattaaaaccatttacgtaccgatttaatatattgatggtcatcaatataaaaacaagagtgcaaaagagtcaaaataaaacaaaaataaaccccatcacaatcaagataaagacaactaattttctgtgtttcttcaacaatcatagctttattaatgtaaaagatgtttcacacagacattcaacaaaaaacacaaacatacaatttttaacaaaagggaaagtaaatacaaacaaatacatagaacaaatataaatgtttaattagccggcaaaaacttatcaatttgacttcattttcaataaaaaaaccacttcaatgtcaatattttggccactttctttccaactcgatgggatggctaaagcttatgaccttgacattccaataacaaaactttggggttaataccattaaaaagcattatttagggattaacatgcaaagttttcagatattatgtcacgtgtcacgtaaaactccacgacaacgaaatgttatcacttcttcttctgtcgttctcagaaacacagagtgtcaaaacctggtcaccggaaaaaaaataaactctgttttcagaccgaattttctcaccggaaaatg

SEQ ID NO: 27374 - DNA, 3000 bp, Unknown
  misc_feature (1)..( 3000): 2750-1469P.txt file - cDNA_ID_2785269; gDNA_ID_1621122; Annot_ID_56303
tcacgcgagggtttctcttggatccatccagatccttttctatccttttctgtgttcttcttaccagtaaattctcaaaggacgtcgattgtggttttacactaatagtttcacatcgattcgttgcattattaaaatccaatcataaaatttctatttatacatgcacacatacggtacatgttcaattgaaacattttccctaactagacatgccaataaataataagttggtttggtccaaaaaataaaataataagtaaaattctacaaaacaaatggtacagttttgttaataactagatattcatccgggtacacaacgtatttatatttttgttaacaagttaaagattttattttagttaatagtatttataaatgataaacatattaagaagtacacaacgagcctatatttttctcaaaaatttttatttttttgttttaaagatgatttatagatatatgctattgcttttttttatgtatgatacatctcgaaatgatttatataactaaatttctgaaattttaagttattttttgtattaatattgtaaattttgtttaattttagaattttaccatagtatatcattccgtattaatattgatccaaaccgtctcaccatatatcctagttctgtgaaattaaacatcattttgtcattttcttataaagttcaaatctatataatatttgaaacttcaaaaaagttttaaatatattgtattatatcgtcccgtattaatatatttttaaatatatatattatataaaacttcataagagttttaaaattataaatattaaaacgttttaagaagttttaattttaaaagttttacaatttgtaatatttaacttttttggttcttcacaaaggacagaaattgagattaattttgacacaattaaagctccgaattcgcaggggtcagttgattgatatactcaaaataactggagagaatgactatcgcaagatgaatatattcaaactttcctcaaaccaccttctcaagtaaaatttaaaaacatattttcaaatcaatgtaaaatagaaacgttgaagagaaaaacaactgaagaatgggggcaaagcgccagaaacttgtaaaaacaagtaaaaggattggcaaaagtaagaaagcacaccactttaaaactaacattaagctttggatgatgatgattcttcttcgtcatcttcatcaatgtcccaacttaaatcttcatcttcctctgcagcactcagacgtttacgcagctcagctctgtttggactaccaccagaccgactcgtttccttaccatctatgctactcatatcctcgatctcgtcccatcccaaatcctcttcagatggttgttgagttgatgaagaagcagccacatctggtttagctgagtcttgggatggagcagcctcatcagattttggtttgacagaatcttggattggagcctcatcagatgttggtttgacagaatcttggattggagcctcatcagacgcaggaggagcagcatcaacaaatgatttttcttctggaacttcctcactatcagtctccttcttttcctcagaatctttatctgtcttcaaaccaacattgctcacttcagtcactgaatctgcacttgtcacttcatcttgcgtgctcactttagccactgaatatgtactttccacttcatctttcacagtttcactcacatctccaccacccataccatcattcccttcaagtttcaaccttgaaacatctttggtagcttcaacaactttctcgctgctctcctcttcatcatcaatatcccagctcaattcttcttcatcatccagagagatggctcgtttcacaagattagcccttaaatcctcagcttgcttgagcttgttaaccctatagaaatacctaaaccagaaggtctcgtgatcaaccatactcggaacgacccttttatacactcctttcatatcaccattttcctccaacaatttctccatctcctcagcttttccatccagagaaaacgcagattcccactttttgtaatcatctgaatcctcaggctcttcacagtaagtgttgagatctccttgaacagcacgaatctgagcatcgaaacgactatatggtttcgaactgaagctatcacgacgaccaaaactctgactactattgttatcagaagaatcagattcattaccagcggctaaaatcgcttccttaccttgagcaataatctcagccgtaccttttagcaccgtgttcccaagctcatcaatcgcatgtcccaccgtaccaagcgatccctgagccacctcgatctctttcttcaaacctgtgccaaattcttcgagatctcgtcggtaggtttcaatcacggattcggatctggtggctagagttttcatcagaccaccgaagctccatccaccgtcgtcgttagattcagattgctctggatgttcttgctctggatgttcatgctcttcgctgtgtttcggtgaatcggattcggattcggtttctggaggatctaggtcttccgtgaagacggatttgaagaaattcatagcgtaaagctcagatcttaccaatcggtactctcagataatttgtttgatccgtgaaagaatcaatttgaagagtgaaggattcgaattagcgtcagaaataggaagatcacaaaagacttgaagcttgtcgctgcagagacgtctaatttttttcccatttttttaatgaagataaataatactttatttggcgtcaattatcagattaatgggccagaagttttataaatgggccagaagttggatatgttagtccaacaaataacacaaaaccctagaattcattcaagggaactaacgtcaaggtttttgctcttcttctctcccaagtcccaaactcgttttgcatcgccattgttgtgttgctggagctaaatagagagaaagagagagagtgtctgtgatg

SEQ ID NO: 27375 - DNA, 3000 bp, Unknown; identical to SEQ ID NO: 5631
  misc_feature (1)..( 3000): 2750-1469P.txt file - cDNA_ID_2785751; gDNA_ID_1620807; Annot_ID_50567

SEQ ID NO: 27376 - DNA, 3000 bp, Unknown; identical to SEQ ID NO: 5631
  misc_feature (1)..( 3000): 2750-1469P.txt file - cDNA_ID_2785751; gDNA_ID_1620807; Annot_ID_168912

SEQ ID NO: 27377 - DNA, 3003 bp, Unknown
  misc_feature (1)..( 3003): 2750-1469P.txt file - cDNA_ID_2785775; gDNA_ID_1620586; Annot_ID_161302
cttaaggtccatccgcctcagagaatgattgacttaagaccaataagtctttgttctgttctttataagattgtggcaaagattctagtgaataggctaaagaagcatttgtctctgattgtgtctcctactcaagccgcttttgtctcagacagaatgatatctgataatgttttgatagcgcatgaagctatacacagtctgaaatctcatcctgttttttctaactcatcgatggttgttaaaactgacatgtcaaaggcctacgacagagttgaatggtcttttctcagagaaatgctacaactactagggttcaataatatatggatttcttggataatgggatgtgtgacatctgttacatactcaatcttgattaatggccaaccttttggttttatcagacctgaaagaggtattcgccaaggagatcctctctcccctttcttgtttgtgttatgcacagaagctttgattcatctgtttgatcaatctactagagcaggctccttatctggaattcagtttcatccttcagggccagtaattaacaatctgctgtttgctgatgacagcctctttatgtgtaatgctgataaagatcagagtttggagatgttgaactgtttagataagtatgagaaaatctctggtcaaaaaatcaacaaatcgaaatcagcaatcactttcggattaaaaattgatgaggctacaaagaagtggattaaagatacaactgagattcaaacagaaggaggaacagggaaatatctaggattcccagagtgttttagtggatctaagcaggaacttttggattatattaaagtcagattgaaggatagactaacaggatggtttgcaaaaaatctatctcaaggaggtaaagaagtccttattaaatccgtggctatggctctccctgtgtatgcaatgagctgtttcaaattaccaaagacttctatcaagaacttaacaagtgcaattatggagttctggtggagcaattcaaaggatcacaaaaaaattcactggttggggactgaaaaaatgactttacctaaaacacttggtggctttggatttaaagatctggaaattttcaatcaggctcttttggcaaagcaagcttggaggctattacatgagcccaattgtcttttttcaagattcttcaagagcaggtactttgtgaattctccatttatagatgcgtctgttggaagtaaaacatcctatgcgtggagaagtattttgtctggtagggatcttttaattaaaggactgaaaagaatcattgggaatggaaaagagacattggtatggattgataagtggatccatgatggaataaacaggagacccacaggaattcaatccctccaaaacattagacttcgagttgatgctctgattaatatggaaacgggatgttggaatacgaatctgttgagagctttatttcatcatactgatgttaggattattcaagcatcaaagccagtagttgggagatcagatttcttttgctggacagaaactaggaatgatatctattcgattagatcaggatatgatttagcttacaaatttcatcatttagatcagattacagaagctacaaatcgcccttcaaggaccacaattgtagaggcctgctggaagattcccactgttccaaaaattcaggtgtttctatggaaactactaagaggtgcactggctgttacagaacgtttgaagacaaaaggaattcagagttatgatggttgttggttttgtgatgcagatttggaaacaattaatcatatgttgtttctatgtccatatgcaagacaagtttgggctttgtctaatattccatcaccacagacaggtttttgcaagtcagattatgagaatttccattatttgatgagtttgcaatcacaacaaaaggatattgcagaaatttcaaaggtttttccttgggttttatggcgcttgtggaaaaataggaatcagctattgtttgaaggatctttttttccgccaaatgaattgattataaaagcaagggaggatgctactgaatggtttacagctcaagaagctcgagaatcacctatgagaaagcctaacctcagccatgatttccggaaacctccagttcagggagaatttaaatgcaacattggatattcttggtccaagttgcataggcttgcgggtgtatcttgggtacttagagattctctgagtaatgtagttctccacagtcgtcgatcttattctcaagttgtgtccttgtttgaagctaagatcaagagctaggaatgggcagttgagagtatgaagagtttacatgttcaaaaagtgatttttggagccactacaatggagataatcaaagccctgcataaacctaaggattggccatcaataataagtcacattctcccaatgctagttatggctgatggaatgactgattggttcattttatttgaacctaatgggtgcaacaaaggagcctataaaatagccaagagtgttacctctgacataagagtgaactcttatgtagctcaaagctatcctagatggatgaaagatttcttcattaaggagaaatgtattgtcgatagtattaggtcctaagttttttttagttttaagttaggagttgtaattatagagtgtattttattaggttctaggtccttctttttatttattccagtaattttctagttagatagatttttaaagagattacttcgcaatgatagaaaaaaaacaaaaagatttagtccttctagacttaagcggtggattaatgtttatagtcttttctggggtttgaatctttgactttagctttcttacaattaaggtttctccttctcgtaattgatcctagagtatataaattaggaagtctgctttctcttagtcctgtatctttaagctttcataattaggaaaaaaaaaaaaaaaaagagagaaggggtagcgatg

SEQ ID NO: 27378 - DNA, 187 bp, Unknown; identical to SEQ ID NO: 180
  misc_feature (1)..( 187): 2750-1469P.txt file - cDNA_ID_2785779; gDNA_ID_24689; Annot_ID_146455

SEQ ID NO: 27379 - DNA, 3000 bp, Unknown
  misc_feature (1)..( 3000): 2750-1469P.txt file - cDNA_ID_2785791; gDNA_ID_2214514; Annot_ID_133916
attgaaggcaacaaagaacatcgttggattgatccactccgagagacaatggaatacaagatttagttttatttagggaacacatttagttttgtactcaaaggaagaaaattagtactttaagtgatcatcaatgacctaaatacttgacaggaacaagtagaagctcattttttttgcccacggcgagtccaggagattcttccatgtcaatatcttcgaccaccataccatctggtacttcccaatcaaactgatacaacatattcgctagaccaaactccaccattgttgtccccatgtacattccaggacagattctccggccacttccaaacggtaacagctcaaagttctgtcctttagcatcaatgttattatccataaacctttctggataaaacatatctgcatctttccaggaatcaggatcacgccctatagcccaaacattcacgtaaagcaatgtcttgggttgtatcttgtagccattgatctcaaattcagacataacttctcttggaagtagaagaggtactggaggatgtagcctccatgtttctttgatcaccatcttcaagtaaggtagatgatctatatcatctaaggtgatcactgatttgtttatcatttggtttctgatttcggattgtactttcttcatcactcgcgggtttcttattagttctgccatggcccatgtcattgtcattgcagaagtattgatggccccaagaagaacgttctgtgataagatgagaaaacaaagtttagaatcataaggtatctaatgtgttgcacatatttgtatagtactaaccattaagatggctttgacatggtttcttgtgagcttgccatatccaagaacagtttcttctttctctaacttcaagagcaagtccacgaaatcttcgactccttgtttgttttcttgtttatgcagatcaaacatttgttgatagaacacatcaagatccttgacgcttttttctctccgcctttgtagacccgtgagccagtcgatgatccagccaccatttgggaagaagtttgaggccgagaagctccccaaaaacaaaaacgcatcgtggattaacttgtcaaatccatcattattgagaactgaagtatggaagtctagactgaatgctgccttgcatatcacgcttacagttaaatcaagaaacttctcgctcaagttaactggtgatttctgagaggctgattccgtggctgaaacgatcagtttcctcacttcttcttccttgatgggttgaatagagtgaactcgcttagcactaaagagttcttggacacaaatcctccttaattctttccaataatcatcaaaaggagagaaagcaatgtccaagtaattgtaagagagctcttttgcccctaacgaatgatcaaaatcatggtttttgttgagttctatgaacaaaggaacaaatagaaagaaagaaaattgtatgtgttaagttagagttatagtacctgctaagctaggacggctacaacaatgtagatcattgattttcagaacttgttttgccgtctcagaagaagaaactacgaccgttgggacacttccaagcttcaaaagcatcaccggaccatacgttttggaaagactccatagagattgatgtggtaattctccaagctgatgcaagtttccgatgatcggaaagccaggaggggacggtggttgctgctgatttgtccgacgcttcttgtgtttaaaggcggcgaggagaatacaacagagaaagagaagtgaaagaaaccaaatcgtagccatttttccgtattaacgtacgtctcaagttttctttgtgatattgatgaatcaagctcctgctttaaatatatacacatttcttacattattgtttattgctgtcttaaactcttttaatttcgttttcaatatttctttaaaaagattacattttttgttggaaatttcaaagaaaaatgcataccagaatcaagaagccgtctaaatgacgaagacctaccttctcttaatcgtgtctccatctttgttctgcattttaaatttgtcttttaagtactcattacttgtcttttactaattaatatacgaaacccaattaattggttaatgagtacacaacaaagtcatcggtcttttaatatgcaactatgcaagcgacaaggacagcttatctaactacgaaaagaattcttctctagtaactagatttaccactaggtctccactacataaacaaaatttataaatttcaataattatgtaataagtttttgggttaaatattgccttttaaaaaaaacttagtcgtatttcttagcaccacatgtaaatatagtaggcgaatatataaatgttgttaaatatcgcctactactagatttatgaatatttaagcttgactttatcttagctcaaacaattcatataactaaggtctctttgtttaaccaaaaaaaaaaacgaaggtctcattgttacttggtcatactcttgaaaataacacgtcaacgatatatgtatgtaagggccacttgttatttagactcaatgtgattttaacaatagaaaatgtttgaatgaaatggatataggactaaattaaattacggatatgtaagagttggaattccaaaatggacctacataatttttttcttgcaaatttgatcggaagagggggtatattgaataattaatttatttgggatacaactatgagagttacttaagtatagagctaattatgaaattaaagaaacgcgccgcgtttttgatccataggacggtacaaaaacggcgtgctgttttgttttagaataaagcttcttcgttttttggttctttctcttaaaatatcttcgcgacaaagaaccatcggagaagaggaagaagatcagtgtagagctatcgggaaatttatctgaagaggaaactgaaattgagatcgaagttttgagtttgggtaaaaaatg

SEQ ID NO: 27380 - DNA, 3003 bp, Unknown
  misc_feature (1)..( 3003): 2750-1469P.txt file - cDNA_ID_2785798; gDNA_ID_2214694; Annot_ID_136767
ataccaggctgaatcagagcagttcgtcttcggatagaaacgtcgtactcttcatcatctccatcggaatacatggtttcatctttctcaattctatttccgcagaaaccttgctgggttctgaaatggcgatcgccgacggtttcgagctcccggatcttagtacctgaatctcccacacggaaacgcaaagattcatcttcaacgtggaatacgaaccgaggatcgatactgtcgttaacggacatttgcttttccgccggaaaattcagaaggcgatcgatagagactggaagagcacagagagagagtttaaaacgacgtcgtcgtaagtgggacatgagtagcacgcgcgtcgtgatggttaatgattatgaaaccgtatcatttacctataagcttttggtgggtccgatttacatggactcataaagtgatatcgccacgtagacataacatataggtttttatatttatctgaattaccttaaaaacaactaatatcaagaaccgggttacattcagaatttctcgaccacaattcgtttacggtttagagaacatacagtacaatgccattacagattctccattttgttctacattaaagagggatcaggtaaactcaaaaaaaccaaaactatagtgagtaggatcacagtgtagtaaccggtttagctgggcaaatgaaccaagtttcggtttgataaagatgtcctcatttcacagttcagtccctgaggggtttcattcccagtgatgctctcagtctattcatctctgcaatttcaggatttggatgatcggttccatcttccttcatcttctccttcttttctttctttttcttaggttcttcccgatcccgcacatcatcagtttcatgtctcttacgatccctactcctgcttctacttctgcgccttgccctgtctcttctgtctcgttctctatctctgcctctttccctgtccctatctcgctctctatagtgatccctgtctctctccctatcccggtctcgaccatgcccacgttctctttcatagtctctgtcatgatctcgatccatatcatagtctctgtcataatcacgatccctgccaatcacagaaccatggtcaaattataattcatgaaacaatgagctcaagtctcaacatcaatcataatgaaaatctgtaacaaaaagaaaacattgattgagctaaaaactagatgggaagtgctctcatgattaactgatctttttcaaagtaacacaatgacaactaccatatactgtatcagggtaaggattgtaataatgtctgatccataatacttctctctgaacactgtcagtacagagaaacctggaaggatctctacaaatttaatttcggaagctgtatccaaccgctgatggcttgagatgccatagtggaaacagacactcaaaagacagagtactagacatgatgcaagagcattagctagatcaaacagcttccacaatcacaaagaatttttttttgaaaaatgttaactagcatagaaatgtatctagtaaaggtcacggattcagatacctgtgtctatgactgtcgcgtctcctgtctctgtctctttctctttctctttcaggactcttacggcgctgatcctgtaaaagaggaggaagatggtatcatcttagagctgctagatagaaacagaaaacagatcacataaaaactattgcagaatgaaagcactgaccatctcatcttcagatccatcagcaatcccttcattctcctccttttcttcctcttcttcaaagtcgtcttccaaaacacttttccttggctctaataaaccattctgttcaagcgtccacctatcatcagagtgaaaaattaaccatcttaaaatactgcagaaaccaaaaactaattattcagcttcagacaaatgcaaaagaagaaaccttttcttcaaacgtggcattgcaatatcacaagaataatccttggttagaagttcctcaatgacttcgtccacatgtgtcagcgaaaactctattccaaaccaaagaaataaatctagttagtgaacaaatcaatcaaaagttaaacacaacggatccatcgaaagaaaatgaaacttactcccatcagataacttttgtctcactttccggtagtcattgtagagaggttcgaggtagcgatagacatcaacatcagtcccagtgagacgcagatagaacgcaccaagaatacgaacatatctgcagaaaccaaaagagtaaatatttcagtaattcaagaacaaatatctgcagaaactaagagagtagattatctaagaccaatagatttgagagacattccatacctgtatacttgagaaacaactacgacaaggctaatagcagtatccaatctagattacgcagaaataagcttttggttagaaatcttacttgtagtcatcattttttatgaactccacgacaatttccttctcaggctggatttgaagcatcttcaatatgaggcaaaggaacggagtaggcttgcggctaccaccaaaggtaccacctagatggtcgagctccatagctttgtccaccaatgtctccgccgtgagaccaaagcactgctccttccaaaaggtgtgctgataaatcttcgttcgcacaatcttctctaccagattctgcggattcgttcctcttatattctttgccaacggatctgttctgtttgccattatcgcctgaagttaatcagaaactgcctcaaaggcctagtcgtcggaataataaacgtcgagcgacgccgcttcagtgaagccggaatcgatgaaacagcttccacgaatttgccgtcgtcgaagacgaagacactctaggtctttgaagaatctgagaagttaattcatttattttattttattaatgattgctttcggtggtaaagcccatagtaagaacatattaatgggctgctaatatatctaggcccattatagatg

SEQ ID NO: 27381 - DNA, 3003 bp, Unknown; identical to SEQ ID NO: 27380
  misc_feature (1)..( 3003): 2750-1469P.txt file - cDNA_ID_2785798; gDNA_ID_2214694; Annot_ID_189464

SEQ ID NO: 27382 - DNA, 3003 bp, Unknown
  misc_feature (1)..( 3003): 2750-1469P.txt file - cDNA_ID_2785806; gDNA_ID_1620669; Annot_ID_48127
gataaattaaattatttcaatgagttatctatcctaatttatttgtatataaatcttgagatttttttttttaaaattaacaccatatcaagtatataatatgatagtgttgacaccaatttgtttagctttagtttttaaacaaaaatcaaatatacatactactaagcataaagattagtaggcacctttatagtatatactttatagggtataaacttgtgtgtacaatcatactaaaaataaggcataacatataaaataaaatagtttacgcattttacatcattcaaaagacaaaatgttttctcactagaataaaacagtactatgaagaggcaggtagttgataatataaaattttcgtctattaaccagtatagatacgtatcgaaatagtcattaatcaacacaaattcaaagggtcttatccaggcacttaagattatctaagcattatataagatggaaagaataagctttaattacgatgagaatataaaaccatcaaaaggccataaacttggaagcagcaactcggttcattgtgccaaagtggggacctatagtgtgcattctgattcaagaaagagatgatcatgacctcaattgaaattgtaaatcatttttaaaaaaagtaaagggacttcatatagtctatatatagcatatttttatcattaaaaatgtttgtttaaagattcaacttagaaatttgattaaatactagtattacttaactagtgcgttcaaattattagtaaacaagatccaaccttacaaaaaaaaatcacactttattggcacctcaactgaatcttttattttagtcgtcaaagaaaaaaaatggattcattcaagctgtaaatggaaatgtgtcactaaggcccataaatctattttgaaaaagcccattaaaactaggttcttaagtcttaaattgaaatatatcaatctacttttttcttaatagatataattggtcatcattaaaattcttgcattggctaattgcaaagaagaaatattcgacatgaaatttgtacatttggtgctattgtggaacgcatcttttttttcataaactttatcatataagaaagaacttgaaaaaaaaagagattctaaagaagaaagatcaagatgtctccaagtaacaagttgcagaagattcaacagcttcatcgagctcaatatctccacaagtagagagaattgttgcaaatatataatcatcaacttcaaatccctctgcctccattctatacattagcttcaatgcttccctgcaaaacccattcctcgcataacccattatcatcgccttccatgaaaccaagttcttctcaggcatactgtcaaaaacccgaaaagcttccgagacaaatccacattttgcatacatgtgaatcaaagcacttcccacaaagacatttgatagagcatgattcttctttgcaatggaatggattgatctaccgataagaagagattctgaattcgcacaagcttttaaagccgaggagtatgtaaatgggtttggctctacaccttcttgaatcatctctttcaagaagtctagcgcttccgattcatgtcctaagctcgaacatccagagatcatagcggtccatgaaaccacatctctagatggcaattgctggagaacattgaaagcgtcacgagattctccgcatttacaatacagccacaccaaagtacttcctatatagacattcttttcgatcgaattcttgataatctgtgcatgaagttccttccccaacaataaagctccaacagatccacacgctctaagaatgcttactactgtcaaattgttagcaatcaaatgccgcctcttcattatccggaagaggctgatagcttcctcaccaaaaccttcccgagcatgagcagctataatcgaagtccatgtgaccgtgtttctattactcattccatcaaacacttttctgcaatcagaaatctccccacacttagcatacatgtccatcagcgaagttcccacaaaaacatctgtctttatcatcctcttaacaaccaagctgtgtacttgccttccgaatcttaacgctttctcctcactacaagccttcaaaatactgcacaccgtaaactcgttaggcaaaaaccagtgattcaacattccgataaacatgcctatagctttaattccatgcccttttctcgaacacgccgatataacagcagtccaagatatcacatctttctcctccatcatatcaaaagctcgtaacgcacttgtcaattcaccgcattgcgcataaaaataaacaagagaactctccacaatgagattccccactccaactttcaccatattaccatgaacttgtctccctaactcaaactctgctctcctactacacagattcaacaaacacacaaacatcctctcgttcgtaaaacgtattccatgcttcacataatcctcaaacagtgcaaaagcctcatcctcaagaccatacttcaaatacccatcaatcatagcagtccaagtaacagtatttttctcaggcatactgtcgaacactttacgtgcataaaccaaatcaccaagtctaacacaagaactaatcaaattgttcccaaaatagataacttgatcatcaaaacacttcaacgccatcgcatggatccttttaatgagtcgcatcccattagaagactgtagccactccgctaacagagcataatcaactctttcgctatcgaaagaagacgaatcatcctgattcacattctctcctttgaaaccactaaaacccgaatcgaaagatgctctctttccagaaactaatcgaaacccaggtaatctcacgtgtctctgttcctctcgcttagttcttgaatcgctactgtaacatatcgtcggagatttgtaggattgagtcaccggaatctctgaaatccggagacgcggttggattaacgataacgaaaacattgtcggcgatg

SEQ ID NO: 27383 - DNA, 3003 bp, Unknown; identical to SEQ ID NO: 27382
  misc_feature (1)..( 3003): 2750-1469P.txt file - cDNA_ID_2785806; gDNA_ID_2926170; Annot_ID_140100

SEQ ID NO: 27384 - DNA, 3003 bp, Unknown
  misc_feature (1)..( 3003): 2750-1469P.txt file - cDNA_ID_2785812; gDNA_ID_1620813; Annot_ID_50624
ctcatgcctaatgggagcttggattcttttctacacggtacacataaaacagagcattaagcacaaaacgtgtatttgagtggtttctttagccacaagttttttttgttatttgcaggaagaaaagctttggattgggcgtcgagatatagaatcgcagtaggagcggctagagggatttcgtaccttcaccatgattgcattcctcacattatccatagagacatcaaatctagcaacatacttcttgatcacaacatggaagctagggtttctgatttcggtttagccactttgatggagccagacaagactcatgtttcgacttttgtggctggaacattcggatatttagctcctggttggtacacaactgatagattcaaatatataaaccaaaatttggattgcatttcgattttgttcatgtttgtttttgttataaacagagtatttcgatactggaaaagcgacaatgaaaggagatgtttacagtttcggagttgttctgttggagcttttaactggaagaaaaccaacagatgacgagtttttcgaagaaggaacaaagcttgttacttgggtataaagttatctatctattttccttgtataagttattaatcttgtttggtttcaagcgacgtcgttgtggtgtgtaattgtatacaggttaaaggagtggtaagagaccaaagagaagaggtggtgatagataaccgattaagaggatcatcggttcaagagaatgaagagatgaacgatgtgtttggtatagcgatgatgtgtcttgaacccgaaccagcaattagaccagccatgactgaggttgtcaaattgctcgaatacatcaaactttccacacgttcctctttttgatgtttctcttgtcaagaaaaataatcaaattcagttccaaaataaagttttgctgaagaaaaagatttcgagatctgcttctttgaaaagctaaattgtaatttaatactccatattagtatagtaaagattatttataattgatttgttttagtatggaataaaggattattacacacaaaaaagccttatatcaactattcttttttaagattctcgtacaaagtgggcattggatctttaatttttccctaatttacagctcagctcacgttttgatgtcttgttatttgatcccaaatgttctcactactacattaaaccttttgaagcaattagcaaccttttttttttgttacttagcaaaaccaaaccaaacattacgtttatataacgacacttttgctaaaacggttacttttcctagaagcaatttgctggattattcacctcaaaatcctaaaaacattaattagcattagatatctaaaaaaagtgaaatacaaatctttgtttctttttaaattgttttattttataaaattgattcacttgctcatcatttatatacaccaaagagtgtagaagagttctctcactcaaacaaaaatcaaacaatggctaaagcatggatctgcctttccttcctcatcttcctctaccttgtctcaggtatataaattaccagtttaccactaatcagccatcctagtttaattaatttaataatcctaattaacagtatcatcctcatgttctttccttttaacagaacgaaacttcatcaacgtcaacgcagaggtatttgcttagaccaactatcaaattgctatctgatttttttttcttactcaatgagtttttgttctaagttgttgttatagaccaagacttggtgtgtggctaaaccttcttccgatcaagtagcacttcaagataacataaacttcgcatgttctcatgttgattgtcgtgttcttttgagtggatgtccatgttactcccctagtaacctcatcaaccatgcatctatcgccatgaatctttattaccaagccaatggaagaaactattggaactgcaatttcaagaactccggactcattaccataactaatccgagtgagtttgctctttctctttaattatgctatcgaaaaacacttctctatctatatatagagagaagtggttttaaaggtaatttcatttttacctttaagtatctggttaattatattaaaggtaatttcattttttctatatgtgtaggctatggaaactgctactatgaataaacatgagcaagaaaggaaaaaaaaaaaccatatttcttacaagcaaacagaagaggaatgtgttttcttgttgttgcaatgtttatgagttataatttaaatttccaaagttcgcagattttgattaatcaaatttgataacataaaagcaaaaaagaaagtatccaacacttatcaaaatttgatcacaattattccatctcattttcagtaatgacccttattacgtactgaccgtaaacatagaacttaccgtaattaagcttttaaaattgaattcttcaccacatgaacatttggaaatatgtagaacaacgtaacgttttcttttcttttttctttggtgtcagaaactaacgcatttctaaagattttttttttttataaaggtaacgtatttcgatatactcgaatgttagtatgttaaaccattggataaatgacacgtggtgaaatcttagcctcaagattagataagcgtagactaatcaatcgtttccctcttctccttggtattgaacaaaaacacagtcgtcactttcgtgcctcccgaatgatctcatgtgggcttgtctcgtccacccaacaaactatagaaaaaaaactcgatcggctgatacttaatcacccacttgattttgtatttttgtacctttttttgttgtaatttttccatacacccaatttcccgtggaagaaaaggagtcagctttttcgtttgctttaaagcttgaatctttacatagttccagttactttctatagagcttcataatccctagttgcccaaaaggattctgggttttgtgagaatgatgacgtcatg

SEQ ID NO: 27385 - DNA, 3000 bp, Unknown; identical to SEQ ID NO: 5056
  misc_feature (1)..( 3000): 2750-1469P.txt file - cDNA_ID_2785820; gDNA_ID_1620758; Annot_ID_49933

SEQ ID NO: 27386 - DNA, 3003 bp, Unknown
  misc_feature (1)..( 3003): 2750-1469P.txt file - cDNA_ID_2785827; gDNA_ID_2213663; Annot_ID_132596
gctagggtttgtgtgaggagagagatcaagtggacaaccatgtttgagtcaaaactacagggaagagagatatatttttaattcattgaatatatacattggtgaatggagagggaagttgtggtagattagattttgtctacgtatgtctaccacttgtctacatatgttaaagatttagttgtgacttaggaggtcgtcaagcgcacgtgctaagcacaccaacgatttcttgatcttttcttcttgttggtatgaatatgatcctagaggttagtttaacaattttctaatgattttatgtatagtgaaacagtaatattattcacaatttgtggaactggctgatccaaaatatgttaaaaatgacattcggctactagcggaggtctgattcttagcctaacccttattcaattcttttaatactactagtgttggtttgaagtaagagaataataatgtacgtaaatgtatgtaatttgaaagtaagaaaagctttcgatgaagtcttagacagtaacaaactaacaaacatatccgctcaactaaatttacctaacaaatttccatagttttcaaccaagatttaaattaaaaatacactggaaattctaaacaaccctaaattatgttttttttttgttgtgtgagagcgaaatagtcggaattagagtaagaccaatcaaattttaaatatttatcgtaacttttatttcaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatgggtcggctcaagttcgcatgtccggttcttgagatcaatttaatctcagctcaagacttagcccctgtctcaagaaacatgaaaacgtattccgtcgcttggatcaacaccgatcctatgagaaaactcaccacgcgtgttgatcaatccaacagagctaaccctatatggaacgagaagtttgtgtttcgtgtcaacgacaagattctctacgttgacgcatcagcgattgtgattgagatctacgcagcggcttgggctaaagatgctcttgttggtactgtgaatgttcttctcagcgatctttttgctccttggtctggttttggtgatggtaacgacggtggtggtgggaataacaacatgaggcttgtgactcttcagattcgtcgtccttcagggaggctacaagggtttttacgtctcggtgttgcacttcttgacggtggtcaacggagtatgcctttatctattgaggttttcgatggaagtcgaaaaggagagaggaatagtgttaaaagagaccaagaggcttcaagaatgatgcatcgccgtacgaatagcgatcaaacggatttaaccacgtctacgaatgattacggtgtgaaaacaggggttgttactggcaatggaggagaggtggtggtggtggcggtattgttgttggtgcggatagtatggttaatggttcgctttgtagctctgatattggaccatcagcgtctgtggttgcggctgcgattgcgcaagggctttacaatagacagaaaacagcggttaaagcggctaacaaagaggacgcaagttcgatacttgaagggaaaacagagggaattgagcatagagttgaacggtggagagcagagaaaaatggcacgggtggagcgggtggagcggctggatcaagcgatgattctagcgggaaaggaggagcgggaaggagaagaaggaggaggagaagaaaggagaaacaacaagggaggagaaacggtggaggagagggtaagaaagggttgttttcatgttttggaaacgtgtttggatgtgagatttcgataacatgtggcggtggaagcggcggagaaggagacagcacaaagaagagatataataacaataaagtagtaaatcttagtgctgtagacgaaacgtttagtcattctgcgacttgagataagagaaaatgtttacttatttttggtttcttttggtggtgtaaaacgtttgatgatgggttaaaccatacagatttgaaagtattgaggttaaaacgtatgaataaactttcccgttacatttctggtaaatggactaatttgaatatttgtataatactggggttattgtgaaaagcttttaaagaaagggaaaagaaaagagagctttttgagaaacgcattaacacaccataacttcatcatcaaccttctcctctttcttacgcaattacaacttcaacgcctctctatctcttcgccgtgaatgtcgagatagtcgtaagctctctgcttttcaaatttctctcaaattgaggtagagagagagggcacagagatagagagagaggggcataggaaacggtgattttcccagttcccggaggaacaatcggctgatttctctgtaatcgaagaatctaaacctcacccactcgaaatcagctcgtgggttttggggggtctctattaatttccaaattctggagaaaaatcttgtatttcttcaagatg

SEQ ID NO: 27387 - DNA, 3003 bp, Unknown; identical to SEQ ID NO: 27386
  misc_feature (1)..( 3003): 2750-1469P.txt file - cDNA_ID_2785827; gDNA_ID_2213663; Annot_ID_181884

SEQ ID NO: 27388 - DNA, 248 bp, Unknown; identical to SEQ ID NO: 7352
  misc_feature (1)..( 248): 2750-1469P.txt file - cDNA_ID_2918439; gDNA_ID_1621142; Annot_ID_56644

SEQ ID NO: 27389 - DNA, 136 bp, Unknown; identical to SEQ ID NO: 580
  misc_feature (1)..( 136): 2750-1469P.txt file - cDNA_ID_2918666; gDNA_ID_1592100; Annot_ID_151967

SEQ ID NO: 27390 - DNA, 3003 bp, Unknown
  misc_feature (1)..( 3003): 2750-1469P.txt file - cDNA_ID_2918714; gDNA_ID_2214477; Annot_ID_133148
acggtccagatttaaaacactaccccagtaaatacaaaaccaactgaagaaaaataaataaaaagtaaatttttaaagagtccgacccgggtccctcaaaaaaaaaaaactccgacccgggacaagatccgtatccaacaaacttatatgtgtatcggacacagaagaatactttccacgatcatcagcttctggagatctcttctgggaatcgagcttcactgttaaagattttccttcaatcggctaaaaatggtaacaatcgccactccctttgcttttgggcttctctgttatctgttcgaattttggatctgccttcgatcttgtactattgcatcgagtatctacgatttgatttgatgatgaaattgaatctaatcctccggtatccgtagatttctgcttggatctgtccggttcttttctcgcttacgaattgatcgattatttaggaagtgaaaggattagtttgtttcgtgaagcttgaaattgttatgtttctgttgcccattcgaatctcttgtgagttattaaatccaattcattgtttttgaaccactattgctcttgaagtaattaagcttcttggattcaaatgtaatagggtctaagctagttcatgtacctcacatctctttatttgcctctgtttctgaattggcaaaataagctcgttgatctctccatctttccatatctttaaatggtttaaaaacttttcttgagatgcttgtggcttgcgtttaggtgtatgatggtaaatgattctcaagttctggtacttgatctctcacaattccctcttttgcttgccttatgcaattatgtgcatttcaaatctttatgagttgccagaaatcgtgatatatactactggttttgtctggtcttgttttaattctctttatctcgatgctgtctttgtgattctagaattttctcatgcttgatatgggtgaggagacgtcaaaaactaattaatgtgttatgtattgccattcacaatgatagaataatgctttcttgaaaagaaaaaaaaaaacttctaaggtggctgttttgggttatgtttgtattttcagatacatttcgtgttactagtcagtcgacaagggaaagtaaggctcaccaagtggtattcgccgtatacgcagaaggaaagatctaaggtatgtacagcttaagtgttattgagttaatgccgcattatgctttgcatgcctatttaatcttacatttggaaaaatgatctggacaggtcatacgtgaactcagtggagtgattctgaaccgaggtcccaagctctgcaattttattgaatggagaggatacaaggttgtctacaaaaggtaatagacatattttatataagtagcatgtatttgctactttaaaaacaatggttataaacatgatggttttgtaattttgcagatatgcaagcttgtacttctgcatgtgcattgatgaggcggataacgagttagaggtactggagataattcatcactacgtcgagattcttgaccgctactttggcagtgtgagtaaacgcttatccaaaatatactcctaccactctatcataaccttacaaaacatctagattttgattaagagctgtttattctatgatcttcaggtgtgtgaactcgatttgatttttaacttccacaaggtatacatactcaactctatcaatgattctctactctctgtattttacttcaatatgacaattttcgaatctggttgttttgttctaggcgtattatatactcgatgagctgttgatcgccggagaacttcaagagtcaagcaagaaaacagttgcaaggataatatcagcccaggtatggtttcttaatcctaatgcccactgagacaaaaacgattagtccgtaagggttgtgtaaatgatgttgtgttataatatttgaaggatcaattggtggaagttgcgaaagaggaggcgagttccataagtaatataattgctcaggctaccaagtagtccttttctgaacttttcttatgcagctgaaacaatcgtaaatgagttaatattttccttaaactctgagatattctcttctgaatcacacttttgtttgtcatgtcatgtgattgtttgattgattagaagaaagaagcattcatcgttttgggtttaaaagtagtgattgatctgcgaaatcataaatggtatactattttttcacatatgttacgttttaaaacgtggaatgctgaaatttcatcaagttcatcatctcgaaattataatttgtccgattgattgaatagaattggtttttgagcctgaggactgatgcaccaaacaacatgccagtgtctcgttctttcttcttcaacgtgcctaattttgtaattcgggcgacctaacctcattttgtgtaaccgtgatccgccatgagaggaggtatccgctcgaagagttatcctttctcctcacaaaagcaacgccaatgtcccttttctcactttgccctgtttgctccttagtacttgtttcaccaaaataatctataggatttcaaatacatgaagaatgtttgatggtaacaccaaaaatagtggagaagaaacagacacttatgggcttgggctcaaggactcgaaacttgtatacccaaacttaaacgtgactgcgtcttgttcttaccaatccaataatttatagtaatgataataattcatctttccatatataattttttttaattattgaaattaaaaatgagggaaagaatatccgttttctttgccacaaaaacattttcatttgggggttttcataatttttggttcttcagctcctcaagcttcgataggtatcgatcgtcttcaccatacttttggattttttctgatcacgtttcaattccaatctgagagatcttccttgattcgatttctgaatatatctctgtaattttttttctggttttttctagggttttagtaattttccgatg

SEQ ID NO: 27391 - DNA, 3003 bp, Unknown
  misc_feature (1)..( 3003): 2750-1469P.txt file - cDNA_ID_2989965; gDNA_ID_2214494; Annot_ID_183768
agatatagaggctgtggagatggccatgggatttgtccagagtaatcaacccttcttgtgggtgatccgaccaggctctataaacggacaagaatctttagacttcttaccggaacagttcaaccaaacggtgaccgatggaagaggttttgttgtgaaatgggccccacaaaaagaggtattaaggcatagagcagtgggagggttttggaaccatggtggatggaactcgtgcttggagagcataagcagtggtgtaccaatgatttgtaggccgtattctggtgatcagagggtgaatactcgacttatgtcacatgtttggcaaaccgcgtatgagatcgaaggtgaattggaaagaggagctgttgagatggccgtgaggaggctcattgtggatcaagaaggtcaggagatgagaatgagagccaccatattgaaggaagaggttgaagcctctgtcacaaccgaaggctcttctcacaattctttaaacaatttggtccatgcaataatgatgcaaattgacgaacaatgataagtggtaaatttggtgagaacgaaattacgtgtgtggtgttttaatttttaaataaaaatatgtgtttgaagtaatagcggtttttgatgaataaattttacattcatccaaaaaaatacagcaattttgtattgttcttaagttcttaatggttgaagctaattttaggatacaatgatattttcattggtgttaataacaagccagtttttgacatgtgccaagtgtgtatttgcgtacgtaggatccaatcttctttgcaattttatttgtagctattaaggaatatttgtaaataatttatagtttttataaaataaacatgtaagagcatactcactaaacaattcttgatcggtatctttactatatattagtaaataaaatttaagacattatctttccagtgtctaaaatgtcttcctaaagacacaaatgtaatgctaaaagacacttcccattttttaatagggaaaaatgtcaaaaaaagcgcgaactttaaaatttgggacgataaaagcatgaactttcgaaatgtcatttaaatcataaaatttcatttgactttttaaaaaaattgtcaagtttcgttgacttgaccattttgggcacgtcgttaaatttccgttaacagcattaactttctgttacaaatttctgttaaatcgaaacgacgtcgtttttagatctccaaaacgacgtcgtttcattagaaaataatgatgcaaaatccgcgtccgcaatggctcgaacatatgacctattggattcatatagggcaatataccgctgagctacgacaataatttacaataataacaaacattgcatacatatactaaccaatataatatactattaattaaaaatatatgcaattaattaaaaataacaaaattaaaaaatatatattaaataaacttaccataatatattttaaatttcaaatatttaattatatatataaagacatcttctatatttgaaaaattatagatctctctagaattcacataagtctttgcaattgtatttttggaatagataaaaactgaaaaactgaaaattgaaaataatttgcataagtcttttctattgtattttctaaatttggaatacttaaaaattgaaaactaaaaataatttctcaaatataaaaaacatctatatagaaatttaatatttcaaatttcaaaatatatatgtatggtaggtatatttaaaaactttgtatatatttgtttttttgtagttttgtaatatataatttattgtatatattttaaattaattgtatagttttatttgttagtatatatatgctatgttttttttttatcaaactgttctcgtagctcagcggtagattgtcctttaggagtccaataggtcagatgttcgattccatgtgaatgcggatttagcatcattattttctaacgaaacgacgtcgttttggaagctccaaaacgtccaaaacgacgtcgtttcgatttaacagaaatttctaacagaaggttaaccccgttaacggaaatttaacgacgtgcccaaaatgaccaagtcaacgaaacttgacaatttttttaaaaagtcaaacgaaactttgtgatttaaatgacaattcgaaagttcatgtttttttcgtcccaaatttgaaagttcgcgcattttttgacatttttccctttttttatcatattttttattagttttttatttaaagacacccacacataatgatcaatgtggatgctcttacatgcctacaaaacaaacctattttatagttcttctttgggttttcaaatgttcttataatagagattgtgtatagattgagcattatcgatccaaatatataaaaagagaaagaaaaaaatatatatgatttatacccattcattgttttataatgatcggtagacgttgaaaacccaaaaatgataaaattagtagtagctaattgagttctagaaataaggtttgtaaacctcattagtttttttgacatgggatacgacttaagactactaattattaattgttctatttctgttgacacttattttaagaggaaatcgaccctgtttctatttttagggaagaaataaatagtaaaagattgctaggagttagaatattaattttgtaagatgttagatgtgaagtaacaaaagaatgccaaatatagattaagttgacggacacggtggtgaaccaatgaattttcacatcaataatcaaaaaaaggtttaaccaatcattcatctatttgcttcctgccacaactatatttgcatcaccccattgttcttaagctaaaaccaaacccctttcaatctcaaatctaattttaaatctaccttttcttttgtttttttctctcctcacaaattactcaatttatagttgttaattttttgaggagaacaagaaggtggtagtattatttcaaaatg

SEQ ID NO: 27392 - DNA, 1666 bp, Unknown; identical to SEQ ID NO: 1913
  misc_feature (1)..( 1666): 2750-1469P.txt file - cDNA_ID_2989969; gDNA_ID_1620467; Annot_ID_157950

SEQ ID NO: 27393 - DNA, 3003 bp, Unknown
  misc_feature (1)..( 3003): 2750-1469P.txt file - cDNA_ID_2989975; gDNA_ID_1972069; Annot_ID_178536
acttgcccacttcctacatcactcagaagcagattgaaatccctacctcccctgtatatatattgaacccttgtttactccaaccttgggtttccaactttgtgtttccattaagacaaaaacacgattttggatttggtttgcaggaaaaacaatcgccaccagtgcaggaaggtttgggtgcttttcaaaaactgcccatggtcatgccatctattgatttgtatgcttctgctctcaggaagtctaaaagagtccaaccaactaaaggttatttgattctttatcttgttgtctttgtttacacattaacttcttcaaactctttaactgagtctttgtccatttttggtctcaggcattgctaatattgctaagcgagaaagaaatagaggtgctaaacagcttgatgcattcatgaaagtaagttcattgcatccttcgctgtgttatggtttaaattctgaaacgttaattgtctttaccaaatcagaaattgtttttttgtgaaaggaactggctctacctttaaaaggctacatggaaagttttcccaggaagaaactcttgcatccatatgaaaggtctcttattgacttgacacttggtgatggaaagtatgaagaggtatctatttttaagtaattcagcatcttagcctgcaactgattttagcaaaggcttatagataagtttttaggtgttaggaaaagttgatgttctgaggaagaaggtgcaatctgttggaaaggaacatgcttctctctgcgccaaggtcagactcctcagttccgtcaaaagcatattgtgtcttacattttagttaatcccatatactgtagattgtgattggtactacatcagtaaaggccttataagcttcataccgatcccatttttttcatcttattctatcatatatcagtgtaggaaaagttaaacatctttcaatttcgttgcaggctttgtcaaagaaggaggcagaggaacgcttgagcgaaggtgtggagaagctggaattggttttccaacaacaagggggagctgttgatgatttgctaactatagcgaaggttccttactagaatcttttgtttgtctcttccagtgttatcagaattgtatgtatgaacagagttacgcactttgcaggttttgagggctatgccagttgttgacttggaaatgccgactctttgccttgtcggagcaccaaacgttgggaagtcatcattggttcgcatactgtcaacagggaagcctgaggtctgccttatgtaccaatctttatatatgtgataataacttgcattgtctaatgcttatggttttttcggttgtcagatttgcaattatcctttcacaaccagaggaattctgatgggtcacatcgttttaaactaccaacgatttcaggttgcgttgcttacttcgctgcgtctaatcactttcctcatgatatagattattgaatcatccagaaacgcattgcaggttacagacacccctggccttcttaggagatgcgatggtaaagtctagttgctacgaactctcatgtggatgaataactatatgatatttgattaagtcttgattcttgtatttttttatttggtaattacagaggataggaataatctagagaagttaactcttgctgtactcactcatcttccaaccgcggttctatatgttcatgatctaacgggagaatgtgggacttctccttctgatcaggtatatagtaagaaacaaatccttatggatttcgttgcatcagatgtgtcaaaggaaagcacaagaatgtgcaccgttatctgatttgccgaataattgggtctgatatatcctgattcagttatatgtttgttgtgagggcattgcagtttcaaatatataaagagatgaaagagaggtttaaggattacctgtggattgatgctgtgtccaaatgcgatctgctgggaggctcaccggtgatgtatgccaaagaagatagaagcagtgatgacgcggaaatcattaagtaccgggaaagaggacctgatgaatcaattcatgtctcggtgaaaacagaacaaggtctcaatgaggtatgaaacttaccagaaatatttaatgtggaaagaaagcaagagtgtgttttgagtggtctgtttctctacatggctctgcagctaaagaacaaagtgaaggaagtactgagtagtgagatggagaagatccaaagtggagagaaaactgatcaaagtgttgctacttgctagtgcttagctagagattttttgcccattttagcattttgacattaatgtctcatttgtttttaatatacttaaataggattaaaatcttaatgcattatatatacatagctatttctctcctcccttgttagtagtggatttggtacgcatatatatatatacatatataagttttagcaataatgcaggattagattgtttttaaaaaaagagaaaaatgttgccaaaggaaaattgtgacgcacaaaaaaaggaacgatcctgaaattgtcagaagtagacagaaacaagaaaacttgtggagaacaataaaatatcggattcagaacagagattaaaaaaaaatattaaaaaaatagaaatcgataagtaataataatattatctcttcttctctgcttccattttgggtatcgataaaccaccacatccttccctgaaaccctaaccacaacaatcgccgccgtctctagaaatatccatccacctacttcggctttgtttatcaggttcgatatatctatcaccaccgccttcttatctcaatttctgtgtttgatttttgctttgttggtgtttgattttaccgcagattttgatgaaaccagatcgggtcttcctctagatccgttctaggttttctatttccaccgtcttatcattatcatcatcatcaattcatcatcatcatcaataatccagatgctcaccaaattcgtcattcatagacatg

SEQ ID NO: 27394 - DNA, 3000 bp, Unknown
  misc_feature (1)..( 3000): 2750-1469P.txt file - cDNA_ID_2989983; gDNA_ID_2926300; Annot_ID_205685
gttgagaaccttgtttatcatcctggtcttactgattccggttctgtcaatttgaattccgttactgagaatcctgaggagaatttttgggcatattgtacagaggagcatttggaagagattttgctgaaacatttggagtttttgtataatcaagctgtttctaagcttcttgaattgggctatgaggaacgtgttgcgttgaaagcggttttgagtaatggacactgttatggtgaattggatgtgttgactaatatagtgaataattcattatcttatttgaatagtggtggaggtggaggtgggagtaatgggaacggtgaggatcgaacggagactggttttacggatttgagagatttggaggagtattcgcttgcgggtatgatttacttgttgcaacaagttaagcctaatttgagtaaaggtgatgcaatgtggtgtttgttaatgagtgagctccatgttggtagggcaagtactctggatgtcccaacgaataggtctagttgttgtactaaggaagatagcaatgtagaagatgttggtacgggtggtactctagatattgctggttttatggcaccagcgttgtgtcgattccatggaggttggggttttgggaatgggggaggacctgagttttctggtaatgggttttctatgaaaggtgctgagttgaagttgcagagagagattgattgtcctaaaaggtttaatctttcgccatccatgaagtccttgttgaagcggaatgttgcagcgtttgctgctgggtatcgtgctagtatgaagcagaagcaaatacagtcgtctgatactattggtgatagcaaagcttgtaatgatcctgcaattgtgaagagttgtgggcagcaaccacgtaagtcagggagtgaagaaagtgttagtacggtgttggagaaatttcgtgatctgaaccttgatgataatctggaatcggtgggtgtggatgataaggattgtgtgatagtcgatctgcttcatcaggttaaggatttcgagaagaaagtaaaggaaaggaaagagtgggctcagaagaacgcaatgcaagccgcacaaaaggtcagcgaggaattagctgagcttaaaacattgagtagtgaaagagaaggaatccaactgctgaaaaaggggaaacaggctgttgaagaatcaactgcgaaaagatttactgacaaggaaattgaactcagaaaagcttgcagtcaaaatgacagggccaatgtaattgtaagaaagcttgagaatcaaaatgcagagattcgagcagagcgggagggatccaaattaagtgcatcagaatcgcttaaagcgtgcatggaagcatcaaagaaggagaaaaaatgcttgaagaagcttgtggcatgggagaaacagatattgaagttgcaggatgagattacagctgaaaaagaaaagattaaggccctatataagactttagctcaaatcacagagtatgaaaaggagattgaggtacgttggttcatattatattcatttatactgtgaaagttctctagatcctctatacttttaactctagaattgtgggaagtacatttacttaggattcaaaatatttacgtacgttatcatttgaggcacacatctagttgcgaagttggttctgtcttagatggtagtatgccataagacttcaaagatcattcaagaggtatagtctgtgtctgccacatattttgctagggtagatggaacctggatttgatatgaatataatcttggagaatccgtctcgagttgtagaagccaaatgatttgctatacctattgatatgttccactggatagcttttctctctacatggtggtctatattttcttttcgttcctgacgttttacctgtttgcgccttgcgggtacgttatctatgttgctgcacattgtgttcaaaaccttgctctagatttgcttacttggactgtggttgatgactgataattgaaatatcaatttactttacctcaattaaacatggaatgatggttagtctatcaacttctttttatatttacctgttcatatgttatttgcaggcgaaatggaggcaagagcagaaggcaaaagaggaggctctggctcaaatggaggaagaacaacgctcaaaagaagcagctgagggtcacaacaagagaaagcttgagactttacgactcaaaattgaactagacttccaaagacacaaagacgatcaccaaagactggagcaagaactcggtcgactcaaagcctcttcagatagtgactcaagccacatatccaacaacgcttggaaacccaaaaaatctcaaggagaaaacattgctaagctgcttgaagaaattgataagcttgaagggtcttatgacaatgaagcaaactatgatcgagaatgcataatctgtatgaaagatgaagtctctgtggtgtttcttccttgtgcgcatcaagttgtgtgtggtagttgcagtgatagcttcttcgcgagcaacaacggcggaagcaaagtcacttgtccttgttgccgaggtttggttcagcagcgaatccgtatctttggagcaacctcataaaagcagaaataagcttctctttgggtttcagagagatcaccacaacttcaggttttactttgtaagtacaaataatatgtttagcttcttcctcagagctttttacactcaggaaatttgatttttttcgatgaaagatctttgcacgatgtaaaataacttattatcgtgattatcttgatgaattcgatttggaggaaacatgcctctctagtttttaccaaataaaaatcaactatcgtttggtttgtttttggttttgtttggttaaaccggattggacacttgttagcaaaacaatgacaaccacaagttcttgaaaaccacaattattgatgctttgtctacttttcttcttgtgggttttgttgtgtggccgttacttgcaagaaaatg

SEQ ID NO: 27395 - DNA, 3003 bp, Unknown
  misc_feature (1)..( 3003): 2750-1469P.txt file - cDNA_ID_2990006; gDNA_ID_2936587; Annot_ID_195145
gacaccgtcacaccccaaccagaggagtaagtctcttattacagttctaacctaactgatttcagattcgggttatagtgttggaggtttgattattgcgtttatgtgaaatgatgtttcagatggaccctaagttcctgaggaaccagaggtacgcaaggaagcacaacgtcaaggccggcgagaatgctagcgctgaagaataagtgttttgattatctgtgagacattttgaagtttttttttaatgaatttaagactttcttagacaaaggaaccaatttactttgcgcttttgatcatgtttacgcaattgtggtttgtgtactctcttatcctggccttaatttaatatcagcagttttctatgcatcttctcttatctgcaagttacttgattcgttaccgattcttttattgtttagcatatatgtttgtgtgtacctgaaatctgatagccgaatttgatctacaaattagatgttaagcatataatccgtacttgatctacaatcatctttgattgttaaacatatatgttttgtgtttttattgtttcttttaaattacatgtagcttcgctatttgttggttcatgattgccctagttgctgcatcttcaggatgattctctataatcctgttttgtataaaattgtctattggtattgaccatttacaatactgtcgttcctgtttggttttgtgtatgcctagtgtttacgattagtaatcgtttgaggtttcattttggataaaatagggcatcttctttgcatcccactggtcttcatgcatcaattttgtttagcaacatcaataataatctcggaatagttttaaaacaaagttaaccctaccaatgtttaagtttaaaactttaaacaaatgaagttgtgatgactaaagaacccatttactctccccgaatgttacacagagatcctgataggtcagaagaactgttaaatatcgtttcggcaagcctgacgttgtttaatctcatgtctcgatcagaaggaaaacgttctaaattttatttctagaaaaatttcactctagttaacgaaagcagttgttgaatagtgcttctaactcaattgttgacgttctcagtccacgtcctgtattaccgactcaactcacatcatcaaccctcagatgcagccaattccaggtcatatgcctcctcattaactattttccttcttatcatttatttagatgaattttcaactcttaaacattttcttgtattttgtccctaacagacaaatgtgttctgcttaagagagcgagatcttctagagcgatttacttctgaagttgcacagcttcaagggagaggagaaagtcgagaattctctttcctcctggtaaagcatttttttcacctaaaatttgcttccttttctgttctccgacctttaggattcagtaatagttttcttctcctttccatccgtacttgcagagtcatcaacttgctgaagacttaggtaaagctttcacagagaaagcaatgcttcaaaccattttggatgctgaggcaaaactacctactggctcagtaaaggtaggtcaaaaggattattacctgtgacgttttgaacctattcagttgaatcatggttgttttgctagctctagggatcacggatggtacttcaggcttccatgtcatatgattagccattaacgtgcagagtaattgattttaaactatagttttttgctcgatagattgtaaaaagctgtgagacaagtgggatgttttgcttctctgagcacaataatagttcatcagctttagtcactagcaaaggagactacgcactagcagaggaaataatctaaactaactagtaacgacctccatgtatttgatgacaggatgtgttgggtcttgtaagatcaatgtacgcattgatcagcctggaagaagatccatcgttgctgcgatatggttacctatctcaggataatgttggagatgtgaggagagaagtttcaaagctctgtggagagcttagaccacacgcgcttgcactcgtcacttcattcggcattccagactccttcttgagtccaattgcattcaactgggtcgaagccaatacttggtcttcagtttagttacctgctagtaacaatctcttccataattcccatatatctcttataaaagttatgtttccacaaatctacagaaactgttgtatgctcgtcataataaaagggtatatatgatatgtatccagggtttattctttacttaaaactggtccaaacaaaaatgtttggtaataatttcaaattcttataataattgttattatgattcttgattggtttgagttgtggataaaattttttgagtacttaattcattcaattttcactagacatgtttatatttttaatttatattgaagtttgccagattaattaaggaaacacaaacgactaaaaaaaaaaaaaaaaaacacaaacgactacgttaggtgtgaaaacaaaattgaatttgtacgtctctaacgaccaaatgactatcaaatgacaggcaaacagttttcttaacggaaaaaatacagtaaaaataagaaaaaaccgtttgatcatgtttataaaaaattgaagtgggctaattttgtcaaattgatttagctaatgaaacgggcctaagtgggtctattttaagcaagtatacaaaagcttcattaccggaagcccatattctcgccaatcacatataagaggccactatcgtaagcccatatattatctaagaggccactgtggtctgtggggtgatttaaattccatctagggttttgactattgtgtatgtcacctatctttcctctcgcgtctctcccctttactcaggttagctgcttatatccggctgatcgctggatataatttgacttttaactcttctcgtttgtttcgttggtgattgagtttgaaaagttgtgttgtgccgttgttacagaaatg

SEQ ID NO: 27396 - DNA, 3003 bp, Unknown
  misc_feature (1)..( 3003): 2750-1469P.txt file - cDNA_ID_2990010; gDNA_ID_1971873; Annot_ID_176651
agagagttaccggagatgaaactcggtaatgttcttcaggagatcggaagatttcttcctggtcatcagtttgcttctgtaagtctgacatcttgtatagttgatgctaaagttgtgattttgaggtcaagttaaagttcaaattttgggtctacattggctttgatctttctctcaaggaagaaaataagaaaatttctgaagtgggttttaggtaagagctgggatggagatggctatgattgatgcagctgctaagagtgtaagagtgccattgtggaaactatttggtggagcttcaagtacgattactacagacataacagttcggttctaactttagctcttcctgctacaatttcctttcaatttttgtgtgtttgcaaacaaattcctaaagtttatagtcattggctcctaaagtgattcaactatgactataacttagattatgtgtgttaacactgcattcatagtttctcaagtatgaaagtatggaatgttaatggcttgaaatttggagcgtatgaagttttgaattgtttgtagaatgttaatggcttgaaaacaccgggaacactaataaattactcaagtatgaaggtttgtgtgatttgtggttctcagattccgatagtttctccggctgaagcttccgtattggcctcaaagtatagaaaacgaggttttgaaaccttgaagctcaaggtgggaaagaatcttaaggctgacatagaagttctccaggctatacgtgcagtccaccctacttgttccttcattttggatgccaatgagggttatcaaacagaggaagctgttaaagttctcgagacgctgcatggtaaacaggtttctgaatcatttttggaattttctcagttaggtattgagcgctagaggttttaaaaaaggataggtgtttggaaaacttctagcctgttcaaactttagtagctggcgtttcttttctcggttaaaacctgaattgttgtgattgttttgcacagaaatgaaggttacaccggttctctttgaacaacctgtccacagagacaattgggagggtctcagtcacgtgactcgaactgcaaagaacagattcggagtctctattgcagcagatgagagttgcagaggcttgactgatctcaaaaaaatcatagaaggtaatatcgtagatgttgtgaacatcaaactcgccaaaaccggaatcctcgagtctcttgaggtaattgaattggctagatcatctggcattgagcttatgatagggggaatggtggagactagattagcaatggggttctctggtcaccttgctgctggccttggatgcttcaggtatactcaaatttgtaaacaccacatttctttctaatgtgaacatcataattctaacaagttaagaaggaatacacagattcatcgacttggacactccgcttcttctggctgatgatccagttcaaggtggctacaaaggtaaaatagtctctgttttcttcatcttgcatttttccttgttaaaaagatgattgaaattcaaaatgaacaagtctaatgcttgtggttttgttgacagcatgtggtgctgtctatgagtttaaagatgaaggcggtcacggaggatatcttcagtggaatgatgttgctcagtgaaattccttttgtctacttaggtcccttttcttttgttcaataggattttaatcgtaagtttaatgttggttttgggttttgtaaaggctaatcttggtcctaaattctcagtatgtgttagttgagagtgtatgtaatctagaatctttgtaacttcagccccagggagtaataagtgtatgaattcattacagtgatctgcttgatatctgtctgaaacacacaacacaggtctaagtcacagagcttataatagatcacaatatgtgattcttgtttcgatctttgattattggggatttcatttgcagagtctgttttgtcaactaattccagacttttattttagtcattatttgtgagtattgatagagagaaagtgaaaatgaaattgcttttcttgtggaagaaataagagcaaaactggtaggtgtagtggtgactggtgaggcgtgaaaatctcaacagatgtacagagatttctggtaaaggtccaattaaacactggactagctatttatttatttttaattacagaaaatattatttggctaattacagaaaataaaatgtcaatttttatggtcatctgagttttgaaaagaatccaaaatagaatacaaagcccaaccaaaagaatttaagccctaaaaaaaaaaatacctataaactaagtcgaaaaaaaactttaaatttttcggaaactaagctatatgcaagaaaaatataaacactagaattataaagcagaactcttaaagccaaaatccaaagatatcgaaatcatatactaagaatagagacaaacaaacttaaacccgaagaaacaccactaaatccaaagacaaaacatggtctttttttgaaaaatttacgaaatagatttaccaatgttttttttttgttttttttttagatgtaccaatgttgttcatggccaacccatcaatgacatatgcctcctcctattacgaggaaagatgatatttcgaatccaagtaaccaagactttataacttggcaagcaaatgcaaaaaatgagcttaatacttggcaagtaaaatgtcaacttgccaacttgtcaagaatatggcttaaatgcgtattcaaaaagcttaaaatgtcaaaccaaagttgacattggtggctagtccggaatggatgaaaccaccctttaaaaaagttttaccaaaaaaaaaaaagaaaaagtaaaatgtcaatataaacagacaaatacaaatgtttattcaaattgtattggtaaaagctaattttgagaatcgttttctaaaaacaaccagcacaatcaacaattttttatataaaaaaatctctaatatg

SEQ ID NO: 27397 - DNA, 3000 bp, Unknown; identical to SEQ ID NO: 4888
  misc_feature (1)..( 3000): 2750-1469P.txt file - cDNA_ID_2990026; gDNA_ID_1620744; Annot_ID_166569

SEQ ID NO: 27398 - DNA, 3003 bp, Unknown
  misc_feature (1)..( 3003): 2750-1469P.txt file - cDNA_ID_2990045; gDNA_ID_2684113; Annot_ID_190694
aaattcgagtgttttcatattgttaatctttttcttcaaggaaagaagagattttgttttccgtttctgggggtttttcttgattctgatctctgatctgatctcatcatcattgtccgtggattctccgatgggtttctgattgtgggttctttcaaatttcttcacttttggagcttttcttctctctgtcttttgttttccctcagctatggcttggaatgagaccaaactcaagaggctctatcaagtttggagaggaagcaatgtaagtcctgacattttccactttgctttcgtttctttcacattttcataacctggagaagatttatcacataggttttggtcattaatgaaatcgctcttggattcctttgagtccaagtcatagcatttcagactcttgactctttattttggtaatgaaataagaaagaagcaaaccagttttgtatctaattgtcaccttccgttgactcagtttagctcttgtgttttagatcattttagactcttgactcttattcattctcttagtagttgtagttgttactatcttgagtcttgattgttcttatatggaagttttcaggcgatggtcattggaagctatggatttaaaactgactttgattttccatttttctttgaagaaatttctatgtggcgggaggctaatatttggtcctgatgcatcatctctatatctatcaaccatcttgatccttggtcctgctgtaatgttctttgtcaaaatgtacactaaaatggctgatcctcgtaccaagaatccaaatctatgtattccaattctctgtgtgtcttggatactcacaattttggtatgtcttctgctttcgaactttttttaaatgatttttttgtgtgtaaaaagtgaactaaagtttcaatagttttcttcaggatatatttttcctcttaatgacatctagtagagatcccgggattgtgccaagaagttttaggcctccggaaaccgatgatgcaccggattcaactactccatcgatggaatgggttagcggtagaacccctaatataagaataccacgggtcaaagatgtaactgttaatggacataccgtaaaagtgaaattctgtgacacttgtttgctttaccgtccacctagagcttctcattgttccatatgcaacaactgtgtccagagatttgatcatcactgcccttgggttggccagtgcattggagtggtaagtttactccatgactcttgccatatattcccggttctatgttttgaacttgtttggattcttttgcagcgaaattaccggttcttcttcatgttcatatcaacatcaaccactctgtgcatatatgtgtttgccttttcttggttgaacatatttcaaagacatatggatgaaaagattagcatctggaaagctatatccaaagatgttctatcggatattctcatagtttactgcttcattactgtttggtttgttggaggactcacaatatttcattcctatctcatctgtactaaccaggtgattagaaagatatatgctttcgtacatttcaggtctttctttttctgttcgctctgttttgttttaatggtgaaaatctgttttgtgcagacgacttatgagaatttccgataccgttatgataagaaggagaatccatacaacaaaggaattttggggaacatatgggaaatatttctgtctaagattcctccatcaatgaacaagtttagatcatttgtcaaggaagaagattatatgatgatgatggttgaaactcctacttcaaatctaggtgaaagtctagttagctcgaaagagaagattgatatcgaaatgggaggaggaaggattgttgatgagagtggaaagagctactctctacctgagattctccggaatctaaactatgaagatcttgaggatgattgtgaggaagatgacttgaaggctaaggatcatcaccaccaccatcaccatcaacatcaacataatgagggaatcatccctccttttgaccctttttttaccaatgagattggtagtaacaaagatgagagaaatggagaagaatcaggaggatcttcaagtgatggtgaaaatacagggaaacgcgttcgggtctcagatgaagatgaagagaaagttgaagggtatgaacgaaattggagtacagataaaggtatgaatataaacgcaggatctgaagatggagcaagctctcctgtatccacttcaccaatgcttcgtaaatagaggtaatcaagctttacctctgtgtttctctagttgctaaagcaagttgcttgcttttcaagaaaccgttctcagccctaaagctttacctctttgtttttttttacttgctagagaaggaaggacttgaagctggagaaatggagtttgtgctttatcattcttttaattctgtttcatataattgtgggaaaaaaaatccgaaaaataacaatcatcttagaaaattgtgagtttgagcactagatttttttatttttaaaattctcctttttagttgtatttatatataccagaatggtctggatatcaccagcatcacatattttctctcttttttatttttccttttttgttataaaaaaagatttggaccacgaatttgtaacgtatatactgttgtcggaattatttttccttattttattggttgattttcatattttatttgtttctaatgatttatcaatcacatatttttctttcaaaaatgttctgttaaataacgaaatcgcaaaaataaaacagtgatattatcaagaagacaatgcaaatcaagaaaaaccaattaattatcgccacgtgtctggctcccacatcagaattcagattttcacaagatgagatttttcacaaatataaatcaccacacagcctcatcttcttcctctagctgcttttgctctctatctcactctttgcttctgcaactcacagtcaatg

SEQ ID NO: 27399 - DNA, 3003 bp, Unknown
  misc_feature (1)..( 3003): 2750-1469P.txt file - cDNA_ID_2990057; gDNA_ID_1972122; Annot_ID_179042
caaaatcgttgtttagtgctaattacttatacattcaggtgtcgagactcatccaagaacttgcagcagctgctgccgcggaaaaaggactaacctttgaagagaacatggtggaaagactatgtgcttattcacgagctgtttctcatttcccaactgctgttaaagaagtacatatatcacttttatcatccttgatctctctctttcaatgcatgtgcatgtgcatcagtatctgtttcacaactagttttctgattattgcagtttaaatggaggaatggttggttttattcactctcagagaaggcgattgcggaagggcaaccggatccgtgtcccctccataccgaatggctgaaagagcttaaagtgatatagagccagtctttctaaattgtgagtatctggattaagtatcattcttacatattttaagtagatgatctgaaactagtgtcaactgtgtacacgcctgagaagtgaaaaaaagatgtaattttttaataaagaaagagaatcagttcacgctttgtaaaatgtccagacttttatatgtgtaaacttgtgcattttcaagaatcaaaacttttctgcttctagactcccatcaattagggaagactagaatcttcaataataaacaaattatgacagatacctatgtagactctttggaatcatcaatagttgacaaagtaagaggcaggatcgtccacgcttgtttgaattttcagcctttgcaggcaaggtggtccaagtaggcaactgtggtttcttcggttagttactatataacacataattctatattagctttagctttagcttcacataacataactcagttttctacaaagaaaaaaaaacagagcataatgagcagagagaagttttccatatataacttgctctctcttctggttctgctgatccatggtttgattgcagcatctgctcaagatctcactgtcttcagttcttgtcaaagccattgcgggggaatagcgattccttatccctttggaattggtaaagattgctatctcaacaacaatgagtggtatgaagttatctgtaaccgaacctcaggaaaccctctgccagttcttaagagtatcaacagagaactggtgaatatctctctcccggacgactcaagcgatgtctttgggctaacccgaatcaagaatccggtaacttctttaggctgttccaatatggaagaaatcagcttggctttgaatgtgaccgggagcccattcttcctcaccggccgtaatactttagtagcagttggctgtaacaacaatgcctcgatgactgatgataagctgcagattggaggatgcgagtctacctgcgacgtggggtttggtcagagaggacggaacagaagctgcaacggctatagatgttgccaagcgaagatactctctgaccgtctgcaacagattggcatcaagatagagagtcttgatggtaacacaacgaaataagctgggtgcagagttgctttcttgacagacgaggcatattctcctttaaatataaccgaaccagctttgttttacgataagggatatggaacggtggagttaggttggttcatagataggttacacaatatgtccgttgtactggggtttgctattcaattaccgagggtacaagcggttggagttacagtaactatgaagcttgcatatgtagatatggtaagtatttagagcgaagctatagaagctgcaggtgtaacagtggctacagaggcaatccatatctctcgagtggatgtacaggtaaactaacattttctggtataactttgcgttagtttctgtaagctccatgaatcattgatgcattcttcgcctaagtagatattgatgagtgtgaagaagccaaagctgaaggaagcaaccattgtgggaaagggtatgattgtgagaatatcccaggaaactttaggtgtaaatccaacaaaaacaaaagactagccatcattcttggtaagctaccgatcatctgcgatatgtcatcatggatagcaataaaacggatttggctttaaatgtgtttcttttgtgttgggtaggtattagtctaggctttggcttgttggtagccattggagcatggtggttgtataagtttatcagaaagcaaagggagataaagcggaagaagttctctaagcttaatggaggactattgatgcaacaacaattggtttctaacgaaggcaacattgagaatacaagagtattcagctcgaaagaattggagagagccacagaaaacaagagtattgcaacatagaagatccttggaacgtttgtactgattcttcctccaacatcaccaccacatcttcatttggtcgaaacattgtgaccatcagagaccactagatgtaaccgtatcatttgaaattttggtgttattcgatttgtttagttgtatgtattttgttttatccggtttggagaatgttatattgaataataagaaccacaaacatatcaacgaaagtaatcgctcttgactgaatatttatgagattggactatgactagaatagtagtctcattgcatttgtagtactagttgttcgcaacagctcagattcataaggaccaccagccaatcaatagaacaaaaatgaaaagtgaaattatcgcccaccgtggggctcgaacccacgaccacaaggttaagagccttgcgctctaccaactgagctagacgggctttgtgcttagcttaactgttaattgttagatagtctataactgtaggtaccaagtcaaattttaaaatatctcaagtcaatgatctgcactctgcagaaactaaataattgagatgaaaggatccatacatggagttgacttttgatgataaaagcttcacgcgtctatccaaacttctttgaacgtggacttttgtcacatagaagataagagaagatcaatcagattaaaaaaatgcagaagtatg

SEQ ID NO: 27400 - DNA, 1250 bp, Unknown; identical to SEQ ID NO: 364
  misc_feature (1)..( 1250): 2750-1469P.txt file - cDNA_ID_2990066; gDNA_ID_1564380; Annot_ID_149357

SEQ ID NO: 27401 - DNA, 3003 bp, Unknown
  misc_feature (1)..( 3003): 2750-1469P.txt file - cDNA_ID_2990070; gDNA_ID_2096295; Annot_ID_195529
aagaatgtattagttagttagatataattagttatatataaattgccaaatcaagtccataacaaattagaaacgtggatacacagctttatccttaattttgtttttgttttaattagcttacatgattgcatgtgacacataaatgacaaaaaacaaatttgacataaaccatactttaaaaataataaaattatgtattaatgatgttattggtttaactgatttttattttagaagtctacactttaaagtttaatccctacctccaacatctttaatcctaacaatcctatgaaattgtatatgcttaagcagttaaccctaacactgtgtacccttacgctaatttaaaagattctatgaaagtacttctaattttatattatttttagcaatagaatttcataacattaatttctatgctttataaacatgtttaattctagatatggtataactatatttcttaaattgttaccctaaagtcgtataaatgtgtgtaaaaaaaaaagtcgtataaatggtgaacaattaaattgcaaagatgaaagaacacaaattattcacgtggccagcccagcccagtaattgatagatttgttgtttaagcccagcaattagtatcgaatcgaaccaatattctgaaccgaatacatcatggttacacgaccgacacctataaggttgtcttctttgatgatcaaacctaaagtccgaaaaagaaaaaaaagaaaaaaaacccgaaaaactttagctcattgaaagactaattgactaaagacatggcaaaaaggatactgtatttagtaattgtttgtgtttgaattgattacgtcaaatatagtttgataacgagatgcatattgcaatcccatagccaaactagaaatatacaaatttgaatagaaaaagaaacgaactaaggcaagtcatatacggcaatgaaggacatcaatacacttcccatccaaagcttcccatctttctcctccacttcactcactgccttcaccactttccctttactatcttccaacacctttagcactttcccttcttcactgtacttcacagctacagcatgaggccaaccacctacctgcagcaagtactgaaacttcactgatatcggcagcttcagaaagaacttcctcaccctcgggtaatgcgccatcaagtgtgtgaatatgtttctgtggcagtgcaccgccacccagaaatctccatctttgtttgtgcggatgttgtctgggaacccatgtaatagagctaccacttctgacgttccagctttctcccctttcaaccagtatttccgtaatctgaacaacaacaacaaaaaatgacttagattctgttcacagtattggagtttgtttctagcagaatcattgaaacgatatggaaacaacatgctaatcgttccattttagcttcaatcagaaatgctgattgcagaagttatgccaagtatatatacagacaatgatgtggaagtcagagaggaattaagatgaaggactcaccttccaatagatccttcacaaaagatgaaaaaggagccgtctttgccgagggataatccgttaggaaactggagatttctcacgagagtggtagtctcctttgtttttggattgtatttcaacaccctcccactgtcttcccccgagacaatcaaaagcataaatttcctacaaatagcgcaatcaacatactcaaacaaaagtagtaactagacatcggaagctcattgcaacttcttgtagatcctcaaaagataaacagaattcaacatttaaggctctgaagttatagccgcagtcaaaattttcaatttatgtgcctatgacagatcatttcaatcaatataacatgagttccaaaaagcaacactttatgcaagccactgatcaggagagttagtaaagatcaaaactttaaaaccttacataccttcgttggaagaaagagctgctatcagtaaagtaaacattgccttcatcatcaatgtcaagatcattggtaaatctcaaaggcacaccatcagcctcgtttgtaacagaagttgctaaacctccttccggaccaactttcattatccccaaatacgcatctgcaatgtacaaatccccatttttcttgtcgaatcgaagacctaaaggccgaccacagatatcttcatcctttaagtaatccaaaagcgatggcttaggatcacatagctctgacctaataaaacatcaaagttgagaactttactggaaacgaaatggtcacaaagactcgattgcaatcacaagactcaccgattgttcgaagtatatgcgaaatctgtccaacgagtgccattccaaaagagaattcgaccgtcggcgactccggtataaggaccacgaccttgcggatcgaaagcaatgctctcgggaccttgaacctcgttaagaaacctgatctctgaattctgcaacagattctggcggtctctctcctttggaagtgacgataacggaggcatgtcaatcttgtaagttttgaaatccgggaacttggaaatggagctgtgactgaagggatcgatagcgcaatagatggcaaagacgagaaagatcttcgcgagtatgctcatggccattttctttgtacgagggatgatgatgatgatttgaagaagaaaatggttggggaagttttaaggtagagaagtagagaagaagtagttgcagtagagtacacttttctggttgaaaatttaaaacttttctcaattgctgctctttttcgatatattaagaaaagtcaaggagcaattgcaaatcggctaatctgatggcaacccggtattaaattaaaaaaagaaacatgaaaaccgggtgaaccggatcgaccttccattttttcggtagaccagttttatttattctgcaaataataatcgtcttcaatcagagaaaaagtttgcagtgagaaggagattgattaatcgatctgagaaagatg

SEQ ID NO: 27402 - DNA, 3000 bp, Unknown; identical to SEQ ID NO: 9642
  misc_feature (1)..( 3000): 2750-1469P.txt file - cDNA_ID_2990072; gDNA_ID_1972164; Annot_ID_179697

SEQ ID NO: 27403 - DNA, 3000 bp, Unknown; identical to SEQ ID NO: 7216
  misc_feature (1)..( 3000): 2750-1469P.txt file - cDNA_ID_2990081; gDNA_ID_1621133; Annot_ID_172559

SEQ ID NO: 27404 - DNA, 3000 bp, Unknown; identical to SEQ ID NO: 6652
  misc_feature (1)..( 3000): 2750-1469P.txt file - cDNA_ID_2990093; gDNA_ID_1621099; Annot_ID_55823

SEQ ID NO: 27405 - DNA, 3000 bp, Unknown; identical to SEQ ID NO: 6624
  misc_feature (1)..( 3000): 2750-1469P.txt file - cDNA_ID_2990093; gDNA_ID_1621099; Annot_ID_171310

SEQ ID NO: 27406 - DNA, 3000 bp, Unknown; identical to SEQ ID NO: 6652
  misc_feature (1)..( 3000): 2750-1469P.txt file - cDNA_ID_2990093; gDNA_ID_2926167; Annot_ID_139962

SEQ ID NO: 27407 - DNA, 3000 bp, Unknown; identical to SEQ ID NO: 6624
  misc_feature (1)..( 3000): 2750-1469P.txt file - cDNA_ID_2990093; gDNA_ID_2926167; Annot_ID_199230

SEQ ID NO: 27408 - DNA, 3003 bp, Unknown
  misc_feature (1)..( 3003): 2750-1469P.txt file - cDNA_ID_2990097; gDNA_ID_1972144; Annot_ID_179322
acaccgcgaaatacaaatgaatacatcacaagaaatctgcgtgtatgatagtcttgatgtatgagcttaccttggcagtgttgaaggctacattcttgcagtctggcaggacacttacagattttggagacaaacgatatgaagaattacgaaactgtacagtagactcgcatttgtcttgattcaccagaatggcagcgcataggttcgccttcttcccaaacacaaaagcctgttaaataagacgtaaagatcactattacaacattcttcatgatatcacgatactgttagaattttcttacagtttgtagcttccccaatgatattgtagtttgcagtcctgaaagtagaggctcttcacacaacttaactgcagcatgtaattccttaaggtgtccccattttggttgcctaagtaaccctgcagcaccaaccatttatgttgtactttcagatgaacatctgattttgactgtgaatggtttgaaatattaccatattcatcaagtggagcctgatcataataactggtgattacgaactgtgaagcatttctcccgaagttggttcctccatgatactaaaataagatacaatgtcaaatcatcattattcttgcttctcttatacattagagatttttttagtgagactggaaaaggtaccatgtagtagtttacaaagcttccattcttagcgatgaaaagagcaacatgaaacgctatatcctcagctgaccttatcaatggttcctcaccatatgtttgataactatacaaaggggtcagctgaaagttagtagtttatatctggggattgggaagtacacaataatgtagtgaatttgagtgaagaccatacaaactcgtccagttctcagtccatattgcaggtttgttgggtgaattgggtcctttgaatgtttctccacattgcctcccattgcaagcattaacctgaggcaccatagaaacaataagaaaactaaaaaaaacggattcagaagtggaaaattggcagatgagccacattgcaggacaaacataaaaaccaaccaaaggatcaggggcatcatcttgcttgcacataacccatggcactcctgtgtcaagctcaacagccaattttgctgtccatttgacatatgatttcccttcttgtcgaaaagctctaccaaccatcccatactcgttctcaatctgttttgcacataactttaagatcattaaaaaaaaaaaaaaacttcgaaggaaacatacatgaaaaaccataatgtaaacctgtgagagtatgataggtcctccttgggaagcatacaagttttccgatttcatcagcttaacaatcattttcgcatatctcttcatgtgatactgcaaataaaacgtaatcttctttagaccatagaagtaaggaagccatctgagttcagtaaattaattaccttgaatggctcattatctgtcctgaagacaatcccttggacattatgcaaccagaaaggcaaacccctgcaatgtgttattgaaaaccctaaaattccacgaacattgtgttttaccatatcggaaaatctcaacgatctaaagacggaaagagtttacccataagaccattccccttggataaaaggtccaatccgaagacagacatataagccatgattttttacttccttgataaacttcacgatatcacggcttccactgaaatcgaactgtagattcacaaaaaccatcaatcgcataaatacctaaattcgtctgtatagggtatagagacggagagactgacctggccttgttgcggctcgtgaacgttccagaacacatatgtgtctactacatctattcctccagattttgcctttgctatcaaggacggccacatctgcaagttcgatttcccattaatatttgcagaagaagaagaagacaaagagatcccgccaaattttattggaagtttcatacgtttcagaatgtttggggtcgaataataataaatcagaaaataagagcacttaatttcacgaaatccataaaactaaaaccaaatcagaacgtttggggtcgcataagaataaataagaaactaagagtacttaaactcgcaaattcgataagttcaaaacggcctagtcggaaaagacgattttatcctctctctctctctactcttaacggctcatgtgtttcgtattagcaacctgccgccgacttagtgtgctaattcacgtgactgatcggcgcgatttcgccgggaaattgcagaaattaaattccggcgacgttacgaaacttctagatatagacggatcggtgagaacggagagagaattacctgaggagtgctgcgagtataatggattgagccggagaaaaggatcttatgttcgccgtcgatgatcagcgagcgaccgtcgtatgttacgtttgcgacgtctccggcaactataaccgccatgagaacgagaaaaactagcgagtactgaaaagtcgtcatttcttatgtaaacactgacgtttgaagattctagagagtttttatagtttgggactatgcacaactaactgtgcagtgtatctcaccatcgtctcgaatttatgcgacccaatcataaatttcttctttattttttcttaaatccggtttatatatgattcaatggaaattgcaattataaagtaaaagcccaatagcgtcaaaaaaaagtaaaagcccaataatagtgaggcccatcaataatctggagtcaaacaatggtggataatggaaatctctcaaaatccaaatccggttttagccggttataaatgggtttgactggtttcgggtcacaatcgaacggttgacgtcgatcatcattctggtagttgaaaactttgtcgtcgtcgtcgtcgtcgtcgtagcacgtgttgcacgtgagaaatttcccgcacaaaatcttactcttttcgtcttcttccccaatctgggattgaatctccagaatccatg

SEQ ID NO: 27409 - DNA, 3003 bp, Unknown; identical to SEQ ID NO: 17711
  misc_feature (1)..( 3003): 2750-1469P.txt file - cDNA_ID_2990119; gDNA_ID_1621202; Annot_ID_174959

SEQ ID NO: 27410 - DNA, 3003 bp, Unknown
  misc_feature (1)..( 3003): 2750-1469P.txt file - cDNA_ID_2990123; gDNA_ID_1620815; Annot_ID_169197
atttctttacctaatggaaagggcttgttcaactgaggaaccaaaatcttgcaaagcaggtgcgagtggaccttgtccgactgggtcaagtggggaaccgggatatcgaattaaagctataccgccaaggtaggaatcagtgaaccgagctgtggcgaatatgtagtaagaccggtaaattccaaccgggtcggttttggcagtgacaagaatagagtatgattggcctacgtggatgtccaggctcgagtaaacacgtttttgaacatacgtaccctctgtctcaactagaagcatatcgtggtcttggattctgaagtttaagcatgttttgagacccacgtttgatattcttagcctatatgttttgcctgtgattatatatagacaacataaaaagaacatttgtgtgtaaactacattattaaagatataatgtaatatttttaaaagaagaaaaaaactcacctggttcaaatgcaaagaaggtctcttcagggccacgcccgttaaaaagaataccatcaggatttggcaaactgtgaccagcgtcaagtgaagctctcataaccttacaccaaaatttggaaaccaagtgttaattatgcaaatcaagcaaaacatcttttacaatgaaactaataacacattcaataaatgggcaagataaaactcaataaccaaaatgattatgatctacaaaattagtttttttatatataaaaaggatagtattggaatgtaggtttgatgataatacggtaatttatcaaagaaacatactgtatggtcgagataaaaccaatctccaatcaagatgtcgtattcttcgtcgggcttagggaatgggactgggacaagttctgggggatagattctaatagcaccgtatcctccggcagctttctgaagtagaagggtcggaaaataaaagtaacttccaatttgatccttcacctgaaaacggtacgtccaatttgtccccggtagtatgggacagtttgtccctcgaactccatcttgccacgagttcttccgcaattgcaatccattcctttaatttacatagaggtttaataacaattattcctaaaattaacccaaaacaaaaagttgaaaatatataccaagtcatgaggaagggttcgggcaaattgttgaaaatgttaacgacaatgatatcgtttgctgttgcattaaggatcggtccagggaacatgtcgttgatcactataacctatagattttttttttggtgaatactataacctatagattgatcatgcatctgaaatttcatataagatagctaaaaccatattattgtaacaaataaaaacatattcaaatgaaaatggttacctgcttgttgcctccaagaatgaaacgttgagaatacgagacgacccattgatacgatgagattggtgcaaacgcatagctcaactccaagatgaccaaagagatcagaaccaacacctcgacaaagacatgtctcatcgcgaaaagagtgatttaagaaattttaagatgcttgtgatgtgaaaaagaggtgttagaggcaagacgtagctacatatttttctttggaacaatatattaattagacgacaactattgttactctgtttggagttaacgtttgttttgtgctatgttttttgaatatgatcgaaaagttcatgcaatctgcatttccaacctaatttatgggcagcacatttgtgcttttgttaaaatttgctgggcttattcattatactaaaccatgcataaaggcccattaaatatcttattgtaatgtgacggacgaaaaaaaaaacgtgagggaggacgatggcaattgcttacgatatattgtaaagtggatgtgacctgtctgtctacacaatattacaaagatggtcgctattactcctacaaaaaataatacaacgcaaaacaattattgaaaaattattcatcacttttgtatctttcaaactttcacagttcacaccacctaaaaaacagtaaaaagtaacaacattatcactttccacaacaaaatatctaacaactttgagtatacagaaatgtacatagtacatacgtataagcaaaatgaattttgtttctccttttttttcctggtgtatatcgttgcaaacttgcaattgatcaataaaacgcaaagatattatattgaacaaataaataatttttatatagccaagatattatatggatcctcattcctcaaatataataatttacatggcccgcgattatcatgaaagacgttgaaacgtccactaatcgtacctagttgttctgaaaatgaaatgatgattttataaatgatatggttttagacttttgaagttcttcatcacttattgttagatgaaacaacaacgttgcattcaaatctcaaattcctataaatcacagataaaaaagtaattttgttttacacgtctacgtggttacaaatcctaatcacgtaactaaacagtaaagttaaagaatcttgaaaaataaagatctactttacgttttgtagatatttttaattaaaagtgaacgtcaaaaggtaattggatattttcgttaaaatgttatcaatcaaactcggacaacaattagtggtaatttaactatttaaaaaccagactaacccattatcgtatagtgctaattatgaactatgaaccgattaaacaacaaaatttactatataaaatcatcaggtgcttttcttaatctcaacggttaaaaaaaataaccaattagatgtgtccacgtaagcaggcgtaccataagctaccaaccaacacatacaccagattctcaccaacagaggaaaaaagcttctactataaagcacacatcttcttcttcatctctctttcgctctcagaatcctcttttaagtctctgtttcataaataaaactaataaagaagaagaagaaaacagagcaattaaagtccttaaatcttcttcttctccaattcaatg

SEQ ID NO: 27411 - DNA, 3000 bp, Unknown; identical to SEQ ID NO: 5505
  misc_feature (1)..( 3000): 2750-1469P.txt file - cDNA_ID_2990123; gDNA_ID_1620797; Annot_ID_168504

SEQ ID NO: 27412 - DNA, 3000 bp, Unknown; identical to SEQ ID NO: 6719
  misc_feature (1)..( 3000): 2750-1469P.txt file - cDNA_ID_2990142; gDNA_ID_1621102; Annot_ID_55901

SEQ ID NO: 27413 - DNA, 3003 bp, Unknown
  misc_feature (1)..( 3003): 2750-1469P.txt file - cDNA_ID_2990142; gDNA_ID_2926189; Annot_ID_140937
atcactcattatcatattgttacttgatgtttataaatttgagattcctttttcattttctcactgcctctttctgtaacaatagcaatttcttagatgtcaccactggcttttatctggttggggatttaaggggagatcaatttaatcttatttgatgctaggattttgaaaaacattctgcaggtaaatcctacagatgtaataattcttgaagggatacttttgttccatgatccacgcgtccgaaagttgatgaacatgaagatttttgtttgcacaggtaatttgttgcctcttcccgttataattattgtaaactcttgtttcgactacattccatttcccttttgtagattcacttggctttttttttctacaaaatttcacatgatggaacaacttcttatgctttaagattttgctgtttcacattgcttattttgttttctgcgtagatgctgacgttcgtttggcaagaaggataaaaagagatactgtcgagaatggtagagatatcggcacagtacttgaccaggttagcccgtcttagtattgttactgtatatattatcatcaagaacaacaagaaatggtttacctcttgcattttaaatattacattgctctgatctgtatgtttttttctcatattagttcggcgttttcaaatctatatgtttctacccatattttatatgatgtcaaccttttgatgcagtactcaaagtttgtgaagcctgcttttgatgacttcattcttccaacgaagaaatatgcagatattataatccctcgtggtggggataatcatgtagctattgacttaattgtgcaacatatttgcaccaagctgggtcaacatgatctctgtaaaatatatcctaatctctacgttatacactcgacatttcaggtaattgatatatcaatctcatctacatacgagtaacattctcttaactaccaaacaagatccagaaaattgatttctcttgcagataagagggatgcacacccttatacgagattctcagacaaccaaacatgattttgtcttctattctgatcgattgattaggctggtaggattattaaagctcatttaaatggctgaccaaattctcctatcacgtctcatttctgttgtctgagtttttttcttatatttatcaggttgtagaacatggtcttggacatctgccttttactgaaaagcaagtgattactccaaccggtaagcttggtgatttttgtttttgcagtgttgttcgtgaattcacaagattattatgtatatatttagaggttaaactcgtgactaataggtcatagatatcccggttacctgtctcaggatgtgtgtattctggtgtggatttctgtaaacggttatgtggtgtctcggtgattaggaggtactttcctatatcttagctttagtttatacaataggaacttccccatcctttcatatcccactctctcaccaacttgatggtgttttgaaataatgctagtggtgagagcatggagaatgcgttacgagcatgttgcaaaggtatcaagatcgggaagatcctaattcacagagaaggtgacaatggtcaacaggtaaacgagtcactcctatttcattccaggtgttctgtttcatcactgttgatgtctgtatcactgtgcagcttgtttatgagaaattgccaaatgatatctcagagaggcatgtcctattgttggatcctattctcgggacaggtaattaacccgtctttcttcatcactttttactgaaaacattttatttcatatttctctttgctgtaatacacatttgttagccaattcaacacacttgaagtgcctagtgacactgaaattatacatcttgtcaggaaactcagcggttgaagctatcaacctccttataagcaagggcgtacctgagggaaacatcatatttctaaaccttatctcagtaagctaacacacaccctttgcgtatcatttatacaccccttgtgattactccttatccatgtttatccacaagaatgcagctggattgagatattttttttctttgttcaatcaggcacctcaaggtgttcatgtggtctgcaaaaaattcccaagaataaagatagtgacatctgaaatcgataatgggttaaacgaagagtttcgtgttattcctggtatgggggagtttggggacagatattttggcacagacgatgactaggccactgtgttcctgcagcattagttgtcccatccatgtcctgcatagcagtttactgatgcattcaccatcctattctctacaacggctacacaaactatcaaaggaatcacctttaactttgttggttttcccatttaaaccccctcaaggtgttgggaacagttttgtttacttataaatgcccaagtgaggggttgatcgatcccgggacttgggattcggtgtaccatatataattacccttggaactcttgataattcatctacaactcttgtgtaccatatataaatatccttggaacccttgatactccataagcataatacatttggcttcgaaaggaacatgtgggccaatggttgcaccacctctgttgtcatctcatgaattcaggttcggacctggtctctctctctcccaagtgggaggtatatgaacggcccaattatgacaaaaggaaagaaaattatatttggcttcaatgtccaatatatctaagtttggtggtgacttatgttggttgaagtgtgagagaggtattatagaaaatactctgctcgttctcctccacatatccaagactttggagataatgctggtatccttggctagcatttggtagtgtcgaagcaatcattcctcgggctctcctttctaactgcattcctagaaaatattaccctaaaggcctttgtcttggcatcctcgtcctcttcagcaggaactcatctgtcttggaagaattattaccatg

SEQ ID NO: 27414 - DNA, 3003 bp, Unknown
  misc_feature (1)..( 3003): 2750-1469P.txt file - cDNA_ID_2990145; gDNA_ID_2214553; Annot_ID_185630
tggaaactagaagaagtgaaatgtaagtgtctaccaaaaaccattattccttcttcagaatatatgcagagttcagcagaaccagttcagagattgacataataactttctcgtgagctgtgaattcacagatcttgaagtggagcttcctgtaatgtatattcttttcatttttggtcgatataaacagcatcaacatcatcaagttctagtagtttctgcattagctctttgttcaattccatggcctcatcatccacctgcaacaaccaacaacaatcccaagtgattacattttccaagtgaatcgttgatgaatactgataagggtgtgactcttatttgggcggaacaagaagttaaaattaacgaacgaagaacacaaacaaattttctataagtttattgccatttccaattatgcttatgtagcatatgcaatttacaatgtatttaacacgttaagagaagataaactacatgttgacgataaaaatagaatcaataagttaatattagacagggcacagaggttacagaacagagcgggagatttgatacctcaactgtagtcagagggagcagttcagagccattgtcaggctcgaagttcactccttcatcacgtagctttgataatattgttgagtagttctcattagaagttacaattttgtagtacctgaacagatatagagacaagaagctgatgaaacaaaaaaagagcataatagttatgagtcacctaggtatcatctcgtcttagattggcaagatggatttcttatttcaaatcgtttggtgtgaaacttttattgcaatttagctgtttatgagaagaaaatacactaggtctaccttcagtcgcttgattactttttcaattcaatcttgaaagaaatttctaacgcatttgaataagtgagtcgactatctctatcttccctaacttaggattcaccagcaacagaaaataataaatgtaatactgacaagaagaaaagaaatgcggaaagacattatattggttatatacctctcttccctgtcttcatcagtatcatcttcataagttgggggttcaataacatcctctgctccagcatctaaagcaataataaggagctgatctttgtcagcttcggtgacctttatattcactaccctaactcttttaaacttgaacatgacagatcctgaatcagccatttttcccccataatccttaacaaccgatctaatagctgccactgatcgattaattttgtctgttaagacctcgactaccatactaacaccaccgtagccatatacctaaagcattgaaaacaagtttattttagagtcatcaaatcttataattggacccaaagaaatgataacgaggaactggatttatggtcctgtaaattgaacaaggtgctgaggtagtgaagttatattagctacagtaaccacatacttggcctgatagagtgatgaactaaaacagattcataggttttaaattaccaggccatttccccaccttactaggatgattcaccataacggccccacttacaaacataaaactagaattgaagctcatgacctcacctcgtaaatcttctctataaaagcttcttgccccttctcagaagccctcttaatattacgctccacaatgtctttcggtacatccagttctttagctttgtcaagaatagtagctagagtcgtatttgaaactgggtttggaccccctttcttgacactgcatgatgataaacccacagatgatactttttctagtaagcatatgtccataacaaagtaagaagttgaatccaacaaactaaacaccatctatatctacaactaatgtgcaaaatttcatctcaaaaaaaaaagatgcaacattgtgaaaaaaatgttgaagacttacgcagatacaacctccttgccaattctacagtatagcttcgccttctttgaatcttgagcgccctgtaattcaccagaaacttcaatctcaaaagttcttaaatacaatcttcgtcttggaaaaagagttttatctttctgctctgctgtaatatgtaattctcatttacaaaaacaaaccacaactttcaagaggaagattgttattcacattctgaaattcatactacacgagcaagagaaacttccactataggcttcacaattcaaacatggtgaattagctaatagctttcaagagtgacataacactgaaagctagactctttacaataacacaattaattgatataaacccataatcaaaacaactctctctatctgaggcatttcatcaaacaggtgtttggcataaacaattacgagctctagactcatcaaaacctataaattttatatttttaaaacctagtaatagcaccaacgcacttctaatctatatgaacccacaaactcagaagcttaacgaacctttcgaccagcgattttggaagaacgacgacccatacaaagaggagttgaaatcgaaatctttctgagttgaagcttgcggaagcagttctggtcatctgattgttgtgacgcagccgtgaaatgcgaagtagtagtgtggggagagattgaggaaagagacgagagagtgttggtcatggtaagactaagaagacgatggttagtggagttgagaatggatctggaagagacgccattggagaatctgaggaggattactctcatggagcaatgggaggccatatagtctttggtgtggattgagaatagagggaatgaggtaatcaatcgatttctcaatgttatattggtttaaggtaagaaactaggataagcgagtaaaaaacttctttttgcttggaaaaagttgcgattgtgattttgacttgaaatctgttgttgagccgcgtgaccctcacggactcaaaaaccaatccttcctttgcttataaaccccaatcttcttcttcgagagagagagtgaaagagaagaaaacgacaatg

SEQ ID NO: 27415 - DNA, 3000 bp, Unknown; identical to SEQ ID NO: 11425
  misc_feature (1)..( 3000): 2750-1469P.txt file - cDNA_ID_2990156; gDNA_ID_2214495; Annot_ID_183806

SEQ ID NO: 27416 - DNA, 3003 bp, Unknown
  misc_feature (1)..( 3003): 2750-1469P.txt file - cDNA_ID_2990159; gDNA_ID_1621150; Annot_ID_56852
ccttggagttcagattccaaacttagtttctccgtaatacctgtgtatagcaccaagatatcctcaataccctcttcacagccttttccatccacacaattcacactttcaataaactcctcggtacaccgttttccaagacgaagcttgaggagaagaaaacacactggccaaacatcagagttatgtgaaacaaaagattttgagctggtattttttattaacatattctgttctttcaaaaattcaaacaacacctctgagctaataaaaatccccttctgttgtaacccaacaaaaatcaaacccatttccgaagcaccaactggttttctcaaagagctagtttcttcagcgataattcgatacacattccttccagtttcaatcaactcaatcaaatcaacataagcattctcatattcgtcaaacttcacacaagaaacactcaaacagcctgtgatcaacccttccttatgcaaattaagtagtgcctcacatatttgcataccaattattcctaaacgtaaagtctcatcttcgaggctatcaaactcctccaacgaaaatccaatgagcttttcacccactaaatacaaaacaccattcttcaaatcaccccacaagccaaaaactttagaaacacctctctgtttaacagagatgatcgcatcaagctcatctctttcctcctctcgcataccccacagacaactcatcatcctctggacataactatacttgaggacagaatcacaatcaccatgctcgaacgaagcaacccgtaaaagactcaccttcgaatcatccctcagacttccacataaacgcgaagatgaatcaaaatcactactttcactctccctaatttccacggaaacggcgtcgtgcactagaatccgatccttccaagtggcgtaaaagtcgtcggaccatgatcgagtgacaaattcaacgactttttcaaaattccggccaggttccagcttaagcttcgaaatcgaagggaacaatctgagaagatcaatgtttttggggagagctgatggtccttgaggtggaaacttgacgagaacggtgcaagcaggacatcggattgtgtccggaaacttcttgggtagatttgttaagcattcttcgcacgccgtgtgtccgcaggcgagtacgcgcgggacagtagactcgccgtcgtaagactgtagacacaccggacactccggttcctccatcacctccgatgattcgatgcgacgaacaactgagttaatccgacgacgttttagactttaactaaaacaacatttagtcccgagggtagttctgtatacctagtgtgtatatacatgaaaactatttgtgttataagtcatcaattttctaaaatgtctctttagtctggtggtaaagtcttccagatgagctcataatttatgggccggctctgattctgatgaagtgaagtgcatttgcaaaggtatattgtcatcttacctctgccaatatcttgcggatcctaagacatatgaagtattttcatagtacaagctagacccgtaaaagctaaagatcaaatgtatatagaattcgtcgaagtcttggaaaagaatgatgttacaaatccaagactttatcaatgccctagcaacatgcattaataaagtcttgcattaggaagattctctcttgtccatctatgatatccacaagccctggctcactagaatagggtggatgtgtgcgataacttaaagtatatgctcacttaaaaaatttacatgagaaaaaagcttttatttttttggtaaaaaaaaaagtccaaatataattgataacaatcctaaatttcttttaaagatatattagaataacccagttcttttatatacaaaaatgccatatttttaaaaatgttaaaacactatttttttatttttttttaacactcaaaatttacttcaaaaaagttctaaaaattgccttttttttttttcaaataacaaaaggtccaaacaaaaacaaattcccgtaatacacaaatttatgttgggtcggggctggacactcagtgtcagttgaaagtttaagcatatttataacttaatactgaagttccataagtttattgatgaatgtgataagtttgtctcaatgtaacagctcgagatccactcaatgtagcagctatgttctccagattcattcgtgtttgtaaaaaatgaaaactagaggtggcttgattgttcgacgagtattgttccaggaagcagccgtcttacttcttttcaataacacatgttaaataaatcgatattgtttgttcaatcatagagagaacttcttttcttcttttattattattgtagtagtaatcatgttcattccaattgagcaattatttgctttccatctacgcccaaaaaccaacttctcaatgcatcgacatgtaagaaaatttgcttttatgttataaagttgtgtaacatttctcttggaactattgattgtctcaacgttgcaaataaagtaataaaatcctacaagatactaataatatccaaactgggcttataatcctaaaaatgacttccataattaaaacgaatttagtttattaattagtgtaatggaatattttgtcaataaaataaataatcacgaaggattatataaaggaagaaaaaaaaaggaaggtgggaattttaaaagggaaagacacctgtctctctgacccacccacccattcatttctgtggctactctatcgtcgtcgtctccacaccgtcggtgccctcacggatcaatttctagagagagagagagcgagagagacgattcgtttttctagattctcgtcaaaaaaattttccctccttcgatctctcctttttccttattcagcatttccccattttttcacgcaagatccgtgattttccagggattgatctgattgggggatcgtgaaattcgtttgtgttttctgctcgattaaccggagaaatg

SEQ ID NO: 27417 - DNA, 855 bp, Unknown; identical to SEQ ID NO: 513
  misc_feature (1)..( 855): 2750-1469P.txt file - cDNA_ID_2990159; gDNA_ID_1591559; Annot_ID_151167
  misc_feature (279)..(279): n is a, c, g, or t
  misc_feature (507)..(507): n is a, c, g, or t

SEQ ID NO: 27418 - DNA, 3003 bp, Unknown; identical to SEQ ID NO: 27416
  misc_feature (1)..( 3003): 2750-1469P.txt file - cDNA_ID_2990159; gDNA_ID_1621150; Annot_ID_173203

SEQ ID NO: 27419 - DNA, 3003 bp, Unknown; identical to SEQ ID NO: 25741
  misc_feature (1)..( 3003): 2750-1469P.txt file - cDNA_ID_2990166; gDNA_ID_2214526; Annot_ID_184753

SEQ ID NO: 27420 - DNA, 3003 bp, Unknown
  misc_feature (1)..( 3003): 2750-1469P.txt file - cDNA_ID_2990170; gDNA_ID_2926090; Annot_ID_196549
cccacggtacaccgcgaatcaatatctaattagcaacatcatttgttttaagacattaaatactttgaaaataaagtatagcatttaaagcttctaactttttgttgaattactcatgttttattttatcaaattgaagtactctctttggtaaagaattcctctacttttattggagtcattctgtatttcagaaacattatttgttgttaaactggtttttaaattactcagctttagtatctattatatttatgtatttcaaaagcttattttctgcattatgtttttactttttagttaaaaaccaaaaataataaataatactaattaaataaaatatagctaatcccctgttaatctcgaaaatatgtaggatgataatgtaagataaatcataaacgaatcttttttttcaataagagaagaatcttacctgccattaaagatttaaattatataaataagattatgggacaagaaaaatgacatacgaataaaatcactaactttctttatacataataacagccaatggcggaggcacaatattagtaaggggtcagatgaccgacccccataaatctttgaatttttgcttacaagcttatgctctatttgattattgtggtaaattgattgctttctaataaattgacctcatgtccagtggtcatatcttttctttgcacctatggaaacgatattatatttattcaactatatcttttgcaattatgttttaagaaataattactgaaactatcacaaaatatgtaaaatggaattatatatatactgtatttgatgaataaagaacaataatgattatcttttattttatttatttttaaatacaatgaattttaaatttttaaagttagatttttttagaaatgaaatattatatttaaatatttaattaaaactaaaaataaaatatgacccctaaacaattttttctagctctaccactgataacagctagacattgcatgtctatcaacaatctccccctgtattatattcttaatcagaacctcttggggatcacaaggaaacgaaatgaagattaccaaaaagaaaaagaaaaaaaaagtagaagaaaagaaatggatgatatcaaaggtccaaaaccaccgtagaggagtactctttttgttccttattaattgtgtttttagagaatttttttttttcaaaaagattgatttttatatttctatgccttatttattagttattattgatgaattttaaactgaaaaacaaataattgaataacattgatgtagaattacacaaaaatgtaaatcacaaaacaatacatttgtaaatcaattttaatataatttcttaataaatttgttttttctaaaaaaataattaaaataaataaaggaaatatgaattaaagacatgcataattcgaacatgggggttggttgcctatctactctccgtttccgaggcattaaaataaatttaatttagtgtacttaatgtaaattgaatataattaattagtctatacttatccatcggttaatttattttattctgtaatgacccttctatttttttagtaatcctacaagtacaataatatatatatatatatatatatatagtacaagtacagtaatatatatatatatatatatatatatatagtacaagtacagtaatatatatatatatatatatatatagtacaagtacagtaaataaatgtgaaaatttgtgataattattggattagttttgtcattatactaacatttgggtattatattcctaagaccatattcaatggtatgagtgcttgagagaatcttacctattttttaattttaaattttgacaatttgaaagtttagcaattctattggcctcttaacaattatcttgttcaatggtaaggtccttaagaaataaaatttggtgtttggtgttttgaagttttgaatagaaagatagaaaagagacaagtgaagtttggcattagagtcttgataaacacattttgaataacaaggattcatgaaaaaaaaaaaaaatacaagaggttttgtattaacaaagattcatgacaatacataacaataatatgacaaagtatacaaactgtgtgatgaatcgccatgttgtaatcaccgccttgtcctaattccataaacttgatctcagtgttccctagattccacagtccacttgaaccatttcatcaaaaatgacacgcgatgttaagctgtgtgagacaatcacaaagtttagctcatgagacgggttgatgtggagtctgttcatgtcgtcgatgtctctgtagagacttgagaaaacctgtacaacaacactcaaaaaagaccaacttctagggtttgatctgaataatgcggcatctgtggtggctgttgctagttacattgctggaagacacaattgagctcttgctagttacattgctaggttggtttaataagaatctaggataaaagttttatccaaagttccccactttcaactgttttggctgcattgctcttaggacatcagaattgtgaagatgagcatgacgtttgacttgttagttcaaaactcacttgatcctgacaaaaacaggtgcttcgttggtttaataagatggatgctcaaggaaaaaagttttacctaaagctccccactttcagctgcttttgatctaaggactgagcatgacatatgacttgttcaatatttacataatcctgacaatatcaggtgaaccattttatacaccagcttatgttatatgatttttctatggatccgcttgttagaatatgtacataaaatgtgacttattcgaccaaacccataattgaaaattcatataattttgttggcagattacagttttaagacaacagtaaggacgttgaccttcattgcttccaagcattcgaaacctattaagagctccacttaatataatattatatcggagaaggtggatcggccatg

SEQ ID NO: 27421 - DNA, 3000 bp, Unknown
  misc_feature (1)..( 3000): 2750-1469P.txt file - cDNA_ID_2990180; gDNA_ID_1972029; Annot_ID_178216
ggattaaagaagagaaggaggtttgtcttaagcagaaagcagagctaaagctaataagtttatgtgatgtggaagatgttttgaaaccatcatggaaagttcctcttaaagattgtgtgcaaatcagtggacaaacagaagagagaccctcttctttagctgaacgtctttctgcatatccagcaactctaagaaaaataggtatatctttcttcttcggtggcattattatgtttctgttagattccctaactaaccactttagcaaaactttcattcagggatcagtgaagatgaatatacatcagatacagtgttctggagagaacaagttaatcattactggcggttaatgaatgtcaatgagactgaagtacggaatgtgatggacatgaacgcattcattggtggttttgctgcagctatgaattcgtatcctgtttgggtaatgaacatagtacctgcaaccatgaatgataccttgtctggaattttcgagagaggcttaaatggcgctttccatgattggtaagctgataagagttcttctagtctatcaaacacttgtttttgttttgtttcggatccttgccataaagcatcagcatcacttgaataagaacaaatgtgtcttaggtgtgaggcgttctcaacatatccacgcacgtatgatttggtgcattccgatcatgtcttctctcactacaacaaaagctacggagatggttgtttgctagaggatatcatgcttgagatggaccgcatagttcgccctcaggtacctttgcaacaactaactaaaggtgacattaaactgttgaatcaaaaagaacacttgtggtctggtcttttattatttccgggtggttgggcaggggtttgtcataataagggacgaggaatatatcatctcaaggatccgaggcttggctccaaaattcttgtgggaagtggaaactcatgagcttgaaaacaaagacaagaagataacagagtctgttttgttttgcagaaagagattctgggcaatcatttgaaatagactcactatttttagctctgatgatagtttacatgatcgtaaaaaggaaaaacacatgttcttcacttctttcttcttctcttcttacgatcatccttcctcttctcaatctctgtttttcctttttaccaatttggagattaatcaaataatgatttccaacaagatccgccgttttctttccatttttagcacctttttagaacatagagattcgagctcaacaaagagtaaaattcgacccgctttcgaaaacaaatctaatactggtactggttcggtccaaaatcaatcaaaaaccagattgatgatacacgagtgtttaatacattagattactctatacaacagacacaaacatatagaggttctagctcaacaaagagcaattgtactatgagacccatctgttctcgtagcggttgagagagaacgatgaagattgaacctcgcttaactggaaaggatccggttcgattccatagtccgttaatggtctatgctcgagcacattgtcatggttcttcacaaagtcgggaatttccacctcgcctttctttatgtcctcccaaaggtactgcaacctgctcacgtacttaatcttccagtacagtctgcaatgttgaaagagatattgttttgacaaaacagttaagtccacagttgttgattctaaagtaatctagatcccataaccgtttcaagttacaagctcaaaagaagatcaatactcctagacgccagagtttattagatcatgaaagcttcaaactttagggttcaatattcgattatgcaagtttgaaataacttgtatataaatcaactgatacatatgaaaagaaatgattaccctccacttaaaagaaggcggccaagagtggcaatgacaagtcttgaacgaagaccagggtggatgaaataaacaagttgaagcctgtctttgatatctgaaggaaggtcctcgtaaatccaccgtaagatggtaattcccggtgaattgtcgtccttttggactgtgctatgcatgtaaaccaagcacaaaggtccctcaggacattggttgcttatcttctgggatatatacttcttcagccgctccgcactcactacacgagctgcgtttcatacacacaattagaagagactgaagtggacaatacatgaccagacgttatctaaagcagcaggaaataccaaaacgctaatctaataagccaaatcagagaacatcaacatgtccttgtgatcaagttagcaactttgtcccaaaatcacagtatttttaattaagacacatttcaactaataagaagagagagtgattaccagggaaatactttccgacgatgcggaaaatccggttaccggacctatccaagccctggagagtaaagaactggagaagatcgagatcagagaaatcttcatctcctaagtattggggacaatcatgccagttttcttgttcatcaacgtcatcgcttctcgtcaagaagggtctagcgtcaattcctagatcagaagccaacacaaccaccgaaaaatcttcagccatcaccggaatattcctcctcctcacggattctctcgtgtcctttttgtttagaccagggattagaggatttatactaacctgcgggtgagtacacagtgtttaacgtgcgactatacacgtgcctaaatctaacgagtctaatgaccttttgaacactagagaaaactacgtcgttttattaatcgtctctctcgtttctcagctacattctcagcggtgcgtctccgatccggcgagattcgattcgatttctgctgacaagtcaaactctttgcccagaaatagctaagaaggtaagcgtcttttgttacccaattcgagaaagtcgaatttttttttgatttcattgagataagtgatttaacagagcttttttgtcaggtctagaggtgaaaaaatg

SEQ ID NO: 27422 - DNA, 3000 bp, Unknown
  misc_feature (1)..( 3000): 2750-1469P.txt file - cDNA_ID_2990184; gDNA_ID_2926273; Annot_ID_143477
atgatgatgatgatgatgattgtgtcgtcattgatattggatggtagaggtgataaactgtaccctgacagaactatctcgagagacaagagaaatggagtttacgttgatagagggaggagaaattgaggactattgtttataatatcactcgaagaataagaaaataaaatattataataatttatttattgtaatagatttctttgtttggactagctattaaattttttaattttcctttgactttttttttttgaaaaaaaaaagatataaggaaattacttttaaaggacattttaaaaatttataaggagaagaatatccatttgagctattaatttctcccaaatacattgaagttggacaaattaaattgattctgtgtaaatacaagattatcttcaaatgaaagtaaattgtagactatattcttagatacgtgtacgaacgattattactctattaggcgtgagatgcgttacattttaaaataaaaaaaaatcacacatttaagataattctcccaagtagtgatggcttataatcccacaaaaaaaccctaaaataactaacaattttcaaaagtacagacgaatatattacttcttcttattgtttttaaaagttgtgtttgattgagattacacacatttagggtttcaatcccattacatcataaagtccaagaccaagtctatcacttcttttaggagtgtaaaatcaagtcccaagtaattatttatgtttcattagcaactgagtgaaaattagacttctttggttggccaaatcaggaggaatattaaaggtatcatgggtttgttctcatctaattcaaaaataacatttttgggaaacaaatctagaagcaaaaggaagctatacatttggaaacaaatcaccaattacttcttgatgtggtgatattcttttctatctattacatgattagaaatggtaattgttatggaaaaaatacatgacattgtttttgattaaaagggaaaacaaaaacgttgactaacgcttaaacaagtgttcctctccagatcgaggatctatgtgtttaatccaacggctaggaatcttcctcaaaccattaccaccaccactggctcccacgtgtacgatctctaatcctctcccgacgggtaagaacaccgatctcacgacacgtgtacctcgtctcaaaagaccttgccatttaaacccagggatagatttcagcgtggcgtttttacacaccaaaacggcgcccattttgctcgttttcgctaatcccaacgcgtttacgaactcgtggcgtttcgaatcaaccaccatgaaatccacgccggagattctctccaccacgtcctccgccgagtctaagaccataacctccgttgagtcactcgtaacggctcctctcatcaccgcctcgtactccgacctcgactcttcgtcaggaactatgcacacgtgtcttccacatgtgtgtatcgctgccacggcgagtccgacgctagttgcgatcggatctccacgtgaccaagtctcaacgatcagcctcgtgttccatcccgccgccgtagccgataaaaactccgccacgctcgagtctctgtagcttttacacttcaaagacacacatatagaaataattacatcaagattctaaattcatatatgtacatgatacatcaagatcgactaaataaaaaccacatatacttcacagcgaagaaaatattaattataagaactataaaaattgtaattcatatacatattgaagatttccttgatcaaaatacaatttaggtcaacaagttgaattgacggtgaacaaacatgaacaagaaaacaaaagatgatgtacaaaatgcgccatctgaattagaggaggattcttactgatctaacggtgtggatgtaagcgttagaggcagtttccggcgaccagacgagcctcatgatcgtattcttgtgttaatatcttgataaaaatgtttggctttcgagagaagaaagggtttctatataaagagaagttgaggaaaggaaggtgatgacaagacggttaggcagttaggttaataaatgggtgtggtttggctttaaggaatggacttagcgttgacatttgtttaacccaatcatttacgtgtccttcattcccttctatcttcccatttatttactcacttcgattcttagattttgttttgaataacatttaatgtcgatagcgaatttatttctttaggtctagggtttaaattctacaccctgtgcaacatattaaatgacttttgattatgatcatgtgtaatgtgttaagtattcgtttgggactgtgatatatatgtagtgtaacgtgcttgttaggttaatgtgtatacaatgacgtttatccctattttgtgtctacatacattgtgaatagatcggtattgcataaaccaatttagctaggttccgtttttgtttaaaatgagttttgctattaatgcgtctttgttgttcacttatccttaggttgatgactacttgattagacttctaatcagaacgattggatactttcttatgcatcctattgtaataatatagtttcaatttaaaagttcattacacaataaacaactaacaaaattgtatacttaaacctgctaatactgattatgaaaaagaactaaatgctaactaatttaaaactaacgaaagtttttatctattttcgaaacggtaacgtttacatatgtgttgttttatacatgagtttcaaggcctccttttgtagacttttaattttaattgggcctatgtatgaaaactaaagcccatatagattagggaacaaaaagacctgtggcacgaccataagatacgaggtatatataaagaagcaatttagggtttgtggattctctgaagcgcagcagcagccgtaagaaagaaaccgaggaagaacgatctcagtgagaggacgatcacttcgccgtcgcagtcatg

SEQ ID NO: 27423 - DNA, 3000 bp, Unknown; identical to SEQ ID NO: 27422
  misc_feature (1)..( 3000): 2750-1469P.txt file - cDNA_ID_2990184; gDNA_ID_2926273; Annot_ID_205204

SEQ ID NO: 27424 - DNA, 3003 bp, Unknown
  misc_feature (1)..( 3003): 2750-1469P.txt file - cDNA_ID_2990187; gDNA_ID_2936584; Annot_ID_195021
ggagagtgtcggtgttgagattgaataagaagagtataccggatgttaaccggaaagtacgtgttctaggccggttagttcccggttgcggtaaacaatccgtaccggtgattctagaagaagcaactgattatattcaggctctggagatgcaagtgagagccatgaactctttagttcagcttctctcctcctacggctcagctcctccaccgatttgatgaggttaaaatcgtctttttaattctaccatctctcgatctttcacagcttatgtgtatatagaagattcggtttgattataatctgtaactactcttcccaaccgctgattcttctctgctacaagtaaaagtaaattttgaaccgagtcttcccatttttacgatcctcaagtctaaattaagtatatgattgattaataaagtctttaccattagggttcaaatcgtagttggattatttgatttagattgatgaattcgttgttgatcaaaaaaaaaataagattgatgaattcgttattggagttagtgggaaaatgggttcctcttttaacctcatagtatgtgataactaaaccaatatggaacttttgatgtacttttagttcattcaatatggctttgtactatatcatcttatgtactatatgaaatttcaacatgaaatagatttgtactgcaataaagtggaaagaaaataatttcccatttagaattttaaaatacattatagtagatgtaggaagataatgggttaactttagttttgattatggtagcatgtgatgatgcattagagaatgaatggaatgatacattcaaattcattgaattgaatgatgactgatgagattgatctgtcactcaatcatctactcgctttattgcccctcctttgaatcccatttttgatacttataggttgtttgtcttctttttcttttcttttccttatttcacaagaaatataaaggaaaaaaagaagaaaaaagattaaattagctaataattccctgttactaaataagttttctcaaacactaatctgcagttctgcacgtactgtatatccttcaatattcatcacgaagcaaaactgaataacctgtagttaaaattgacttaacaggagtttgattcattagcttaattaatatacgaatttctgtgatagggatatgatttaagaacactggagtatgactaggcgacaacaagagacaagtgacgacaaaagcaaaaaatatttaaaacatagagagaagtgaccttaaaagtatgaggaggcacatgggagtggccatgcctttgtcctcttgtttctttttaagccttctcttattaacttgcacgacaactcttttcatcacatatttcataagttatattattattgccaaaagggacaaactattagagaaaataaaccgcaacattgtagaagattggattaaaactcgccaacacactattagagaaacttgcccagataaaattatgtccatgtcgaacacagttataaccaaggagcctaattcccaaaaaatgatttttatatttggaaaccatccattgcagatactcctggaggtttctcctagtcttcagtgccgaagatttcacgacaaaagaagacttgaaaatctcgatactcttttgcggaactttcccaccgcgacacaaagagatcactccacagagatatgaggcagctttgagtcctttagacgcggcttttgcaaacattcgatccctttctcttcatcaacaatattactgaataggtaaaagcacttcacaattccttcacgagccactgcttccgtgtttccgctctctctgcatctcttgagaaaactctagctttagttataggtcatcgtttgcggttttgatttcgtcgaggcagacgtgttcgagaacttgagggtcgttgcagagattatgtaatgatttgcatacgaggctgaagttgaacaagcttgagtgaagaaagagccacgcgtggcaagatctccttcacaaccacttcttctgggagagactccattttatagtgatttgagaaatgatattttaatttagggtttcaacttagacgtttgcttattaaattgtgtgaataaataaatatatatatatatatatatatatatatatatatatatatcattaataaataaataaacgataagagtaaccttaaaaatctagttgaaccctaaaccctatggctaatatatacaatgtaatatattattcctctaatcatcttttagaaattttttattatttttaatttacacataaatcaatatctttttcagatatagttttatctacattgtatgtaatacctccatgttgctacacgttaacacttgcatatttgttactcaatctaattaagcaggaattaaaaacaacggttaaccggaaaacttttactatttatccattcagtattatcttatagctcaaattacttttagtttttacatataggatataactctcacacacgtaaaatacgattaaatttaaattcaaactaggacacttatctaatctagtgttatctgaattcatagagtgttagaagaattaggaaacgttttttaatcaataacatcatttttgggaataatatgtttatcaaatataaacctacccaaagaaaaaaaaaatcaccaacaaatatagtacgaattaagattcataaacgtgttccggaatccaaaagatcgaaagttttggataagtaagatattcacaaatattcatttttaaaattcaaaatattcgataaatacaagcgatcttccggaacagatcttaaatacgataaacaattaatatattttagaaataagatcggtggcaattaataattatgctctagcgaagacgtttcgtgataactgtgaacattagaggttaagtgacgacaagtgatcgagagagacagagagagccaaaaggagaaactacaaaaatg

SEQ ID NO: 27425 - DNA, 3003 bp, Unknown; identical to SEQ ID NO: 27424
  misc_feature (1)..( 3003): 2750-1469P.txt file - cDNA_ID_2990187; gDNA_ID_2936584; Annot_ID_143812

SEQ ID NO: 27426 - DNA, 3003 bp, Unknown
  misc_feature (1)..( 3003): 2750-1469P.txt file - cDNA_ID_2990191; gDNA_ID_2926247; Annot_ID_142969
aggtttggacactgatccgtagtcatatgccctatatctgatctttgcaacaattcactatgtatatgcgttattaccaaaccgaaagatacccgtttaaaactatctctacatatttagtatttacataattacatataatcttatttaagagaaaacaattatatttgaagttagaaatcatggtctttgaaatatgatgttagctttgaatattataatttttggttaaatattctgaaaagaatatgactttttaagcattaaaatgttataaaagtatgaatactgactaaaacgtaacttataaagtattattttgtttatatggtactttttttgtgtgatgaacctgtaggccctgaagtagaaaagttggcggagttggccgggaagaacaatgtgtacttggtaatgggagcgatagagaaggatgggtatacactctattgcacagcacttttcttcagtccacaaggtcagttcttgggtaagcaccgtaaactcatgcccacaagtttggaacgttgcatttggggtcaaggagacggatcaaccatccccgtttacgacactccgattggaaaactcggtgctgctatttgctgggagaataggatgcccctctacagaactgctttgtacgccaaaggtcagctcttgatgcaatttagtttgagtgtttgacaaatgtagcctttaataaaagattctaacacttttttttttttttggtgcgttcaggcattgagctttattgtgcacctactgctgatggttcgaaagaatggcaatcgtcgatgcttcacattgcgatcgaaggtggatgtttcgtattgtcggcttgccagttctgccttcgtaaagatttccctgatcatcctgactacttgtttaccgattggtacgacgacaaagagcctgactctattgtttcccaaggtggaagtgttattatttcacctttgggacaggttcttgcgggaccaaactttgaatcagagggtctcatcacagctgatcttggtaaaaatatatataatcttctttagtttttatcttaggctatagaaaaggataatttttttagctaatcatattttatttttgtcatcaagatcttggtgatgtagcaagagctaagttgtacttcgatycggttggacattactcgagaccagatgttttacacttgaccgtaaatgagcacccgaagaaaccggtaacattcatttcgaaggtagagaaagcggaagatgactcaaacaagtaatcggttgtgattcgtcagttcatgtcactcctatgaaggagtcaagttcaaaatgttatgttgagtttcaaacttttatgctaaactttttttcttaattttcgttaataatggaagagaaccaattctcttgtatctaaagattatccatctatcatccaatttgagtgttcaattctggatgttgtgttaccctacattctacaaccatgtagccaattattatgaatctggctttgatttcagttgtgttcttttctttttttctttgcatatttgcatttagaatgtttaataattaagttactgtatttccacatacattagttccaagaatatacatatattaatttatttttcttaaaaatgttttggaatgactaatattgacaacgaaaatagaagctatgctaaaccattacgtatatgtgacttcacatgttgttgttttacattccctatatatatggatggctgtcacaatcagaaacgtgatcgaaaaaagacaaacagtgtttgcataaaaagactatttcgtttcattgacaatttgtgtttatttgtaaagaaaagtggcaaagtggaatttgagttcctgcaagtaagaaagatgaaataaaagacttgagtgtgtgtttttttcttttatctgaaagctgcaatgaaatattcctaccaagcccgtttgattattaattggggtttggttttcttgatgcgaactaattggttatataagaaactatacaatccatgttaattcaaaaattttgatttctcttgtaggaatatgatttactatatgagactttcttttcgccaataatagtaaatccaaagatatttgaccggaccaaaacacattgatctattttttagtttatttaatccagtttctctgagataattcattaaggaaaacttagtattaacccatcctaagattaaataggagccaaactcacatttcaaatattaaataacataaaatggatttaaaaaatctatacgtcaaattttatttatgacatttcttatttaaatttatatttaatgaaatacagctaagacaaaccaaaaaaaaaatactttctaagtggtccaaaacatcaattccgttcaatattattaggtagaatcgtacgaccaaaaaaggtaggttaatacgaaattacaaacatatctatatacatagtatatattattacctattatgaggaatcaaaatgcatcaaatatggatttaaggaatccataaaagaataaattctacggaaaaaaaaaaaagaataaattcttttaagtttttaatttgttttttatttggtagttctccattttgttttatttcgtttggatttattgtgtccaaatactttgtaaaccaccgttgtaattcttaaacggggttttcacttcttttttatattcagacataaagcatcggctggtttaatcaatcaatagattttatttttcttctcaattattagtaggtttgatgtgaactttacaaaaaaaacaaaaacaaatcaatgcagagaaaagaaaccacgtgggctagtcccaccttgtttcatttccaccacaggttcgatcttcgttaccgtctccaataggaaaataaacgtgaccacaaaaaaaaaacaaaaaaaaagtctatatattgcttctctcaagtctctgagtgtcatgaaccaaagtaaaaaacaaagactcgagttgatatg

SEQ ID NO: 27427 - DNA, 3003 bp, Unknown
  misc_feature (1)..( 3003): 2750-1469P.txt file - cDNA_ID_2990191; gDNA_ID_2926247; Annot_ID_204255
gtagtcatatgccctatatctgatctttgcaacaattcactatgtatatgcgttattaccaaaccgaaagatacccgtttaaaactatctctacatatttagtatttacataattacatataatcttatttaagagaaaacaattatatttgaagttagaaatcatggtctttgaaatatgatgttagctttgaatattataatttttggttaaatattctgaaaagaatatgactttttaagcattaaaatgttataaaagtatgaatactgactaaaacgtaacttataaagtattattttgtttatatggtactttttttgtgtgatgaacctgtaggccctgaagtagaaaagttggcggagttggccgggaagaacaatgtgtacttggtaatgggagcgatagagaaggatgggtatacactctattgcacagcacttttcttcagtccacaaggtcagttcttgggtaagcaccgtaaactcatgcccacaagtttggaacgttgcatttggggtcaaggagacggatcaaccatccccgtttacgacactccgattggaaaactcggtgctgctatttgctgggagaataggatgcccctctacagaactgctttgtacgccaaaggtcagctcttgatgcaatttagtttgagtgtttgacaaatgtagcctttaataaaagattctaacacttttttttttttttggtgcgttcaggcattgagctttattgtgcacctactgctgatggttcgaaagaatggcaatcgtcgatgcttcacattgcgatcgaaggtggatgtttcgtattgtcggcttgccagttctgccttcgtaaagatttccctgatcatcctgactacttgtttaccgattggtacgacgacaaagagcctgactctattgtttcccaaggtggaagtgttattatttcacctttgggacaggttcttgcgggaccaaactttgaatcagagggtctcatcacagctgatcttggtaaaaatatatataatcttctttagtttttatcttaggctatagaaaaggataatttttttagctaatcatattttatttttgtcatcaagatcttggtgatgtagcaagagctaagttgtacttcgatycggttggacattactcgagaccagatgttttacacttgaccgtaaatgagcacccgaagaaaccggtaacattcatttcgaaggtagagaaagcggaagatgactcaaacaagtaatcggttgtgattcgtcagttcatgtcactcctatgaaggagtcaagttcaaaatgttatgttgagtttcaaacttttatgctaaactttttttcttaattttcgttaataatggaagagaaccaattctcttgtatctaaagattatccatctatcatccaatttgagtgttcaattctggatgttgtgttaccctacattctacaaccatgtagccaattattatgaatctggctttgatttcagttgtgttcttttctttttttctttgcatatttgcatttagaatgtttaataattaagttactgtatttccacatacattagttccaagaatatacatatattaatttatttttcttaaaaatgttttggaatgactaatattgacaacgaaaatagaagctatgctaaaccattacgtatatgtgacttcacatgttgttgttttacattccctatatatatggatggctgtcacaatcagaaacgtgatcgaaaaaagacaaacagtgtttgcataaaaagactatttcgtttcattgacaatttgtgtttatttgtaaagaaaagtggcaaagtggaatttgagttcctgcaagtaagaaagatgaaataaaagacttgagtgtgtgtttttttcttttatctgaaagctgcaatgaaatattcctaccaagcccgtttgattattaattggggtttggttttcttgatgcgaactaattggttatataagaaactatacaatccatgttaattcaaaaattttgatttctcttgtaggaatatgatttactatatgagactttcttttcgccaataatagtaaatccaaagatatttgaccggaccaaaacacattgatctattttttagtttatttaatccagtttctctgagataattcattaaggaaaacttagtattaacccatcctaagattaaataggagccaaactcacatttcaaatattaaataacataaaatggatttaaaaaatctatacgtcaaattttatttatgacatttcttatttaaatttatatttaatgaaatacagctaagacaaaccaaaaaaaaaatactttctaagtggtccaaaacatcaattccgttcaatattattaggtagaatcgtacgaccaaaaaaggtaggttaatacgaaattacaaacatatctatatacatagtatatattattacctattatgaggaatcaaaatgcatcaaatatggatttaaggaatccataaaagaataaattctacggaaaaaaaaaaaagaataaattcttttaagtttttaatttgttttttatttggtagttctccattttgttttatttcgtttggatttattgtgtccaaatactttgtaaaccaccgttgtaattcttaaacggggttttcacttcttttttatattcagacataaagcatcggctggtttaatcaatcaatagattttatttttcttctcaattattagtaggtttgatgtgaactttacaaaaaaaacaaaaacaaatcaatgcagagaaaagaaaccacgtgggctagtcccaccttgtttcatttccaccacaggttcgatcttcgttaccgtctccaataggaaaataaacgtgaccacaaaaaaaaaacaaaaaaaaagtctatatattgcttctctcaagtctctgagtgtcatgaaccaaagtaaaaaacaaagactcgagttgatatgtctagtactaaagatatg

SEQ ID NO: 27428 - DNA, 3000 bp, Unknown; identical to SEQ ID NO: 12585
  misc_feature (1)..( 3000): 2750-1469P.txt file - cDNA_ID_2990201; gDNA_ID_2214559; Annot_ID_185836

SEQ ID NO: 27429 - DNA, 3003 bp, Unknown
  misc_feature (1)..( 3003): 2750-1469P.txt file - cDNA_ID_2990205; gDNA_ID_1971748; Annot_ID_175267
ttaataaaccagtgcttatttagttacctatcccactgaagaaaatgccataattcattcctctgtacacggttggtatcactgttgaataagggcattccttggaaaatccaaccttttggttgttagattcttggattgattgtttaagctcgtttacgcaacgctggaactgcttgtggcagtcaacataagtcatacctgtaaaaaagcaccaaatgcagcattctcagatccaagatgcagagtgcaattagatttgtagtggacaaagtagttaaaagatgttaacttcactttgtgtttctctgtttatagaatagttttacgtagatattcttgattggtttaccttttaaatcaacacaattatcatgagtcatacaacaatcatcaagatcatcacaaggtggctctccaggacatccaaagtaacctatcccacaatacttcccatagcgaataccgagaactgaaacagagataggttttgcttcagaaatgttctccatgttcaaaggaatgcataagaaaaatgaaaatctcaccattgcatttctgtgcaatgcaggttttgctgcacttttcctgacattttgatccaacccatcagaaagaactagcaataaccatcatttggaataaaccacaacgcacaaacatgaacaaagaacagtaagtgatatgtatcaacctggctgtgaacgacggcaaggaggaggaagacggttaagcctaaagcaacatgtgtcaaagcaccaccgcggatcatgtttctatcttaccttctccagtagaagtttgttgttttgttctttcaaattctgaccccaagaattataattgtgtctctttggaatggaaggtcccattcttggtcctcctgctttctcgtccctcctctttctcatatgtaaaaaaagaagacgtttcatgattaccaatcaaccaccaaattttatggccgttctttatcaaaaaataaaaattatggatgttaagaacagagtatcatgaagatctacataatcttttagaaacgatatttattagattgcaaatgataatatggtttcaaattttgtatcattgctgatattgatattaaacaaggacaaaaacattatagtgaaagcaatttcctgggaaattttgttcttattgagagcaacctttatcaaagagttatagcaaaatggatttttctcagcttcaaagcctccgtttcagggataaactggaaaaaaaattgattcaagagagaatcatgaaaactaaaaacggaggggattacacaatcttcaagttattgttactctccttcatgggtaatagcctgtgaaggtgaatcctctgccggcgatttcacctgcgcaataccatgcaaagcattcgagaccaaacaatgcagcgattcctgcatcttctaccttcagaccggatctgttcttccataggttctttgcgtagtctacttccttccagaaggtttcatagcgtccgggaatgctgtaataaggagtggaagagtgttagatacttaacactatgggcaaaatcaagattgcaaaatgtgaatcaccaaaactcttcaattcatggcaaaacaaaaggtggtgatagaactcgcatatgtataaacttttcaagattaaggaacaggacatgctctaaagccgtcatcaagaaaaaggcaatatactgagacctcttttgtacccgaaaatatggaccgtaaaagattaagagtcaggttattgtataatctaagacttagtagactggaatgatcgttgcaaatgggcttattagagattaataatcgaacaaacttaagattgactactttaatacacaatcctgcaacttatgaaaacagattaaacaagacaaacagctcaacaaaaagatagcatcacgaggtcatagaaataagaggatagaataaaggattcatagtatgccattttcagttccatgaacagccaagttttgtatgagctcagcattccctggctatcttatacctcaaagaagatgctttattgacaaaagtctctttctaaccagaatctagataaggtaactatgaccagggaaatgttcatatagaaggaaaagagagatatcgacctagcaagacgggtgtagagcaactgcttagacaactcttggcacttctcaacagtggcaggttcctggatatactgcttgttcttctccaacagctgtctgtagtaggaagttccatgcttagccacaaactttgaagcctcacatgcctttgattgaacttgtatcaacttcgatgccatcttcacaaccaaatccttcaaatacaaaaagagattctttgaatcataaaatttaaattaatcaaattttgacattgaaaattttgtaaatttccctactacagcaaacaagagacgtttcagtgaattcacacaaatcaagcttaaagacttaaaaagcctaaaaccccaaatcctatattccataacgatagatcgaacaaactacagtgtgaatcaatcaagcaaatcaaaattacaaatcagtcactcctagaacgaacaaatcgttatcgaagcaagaagagatcacagatatagatctaaaagtcaaaccacaaagcatagcatatacaagagaagcaggagcaaaagcctcgacccaattgagaaacatcggtcagagaccagaaactcgccgtaccttcctgcagttttgataatgcagcaccggtgagctgagagatgagtcgattcgagatttcgggccactggttcaacaacaactgcgtaatacttctcttctttatgttagaacgacggcgtaatatgcgtttcgattggaacgatgtcgtttctttcacactcttagaacgacgtcgtatatattcgttttcctcgagttctataaaaacgacagcgttttggatatttggctttattattaggccttgccggaaaaacaaaaaactagctcatcgtcgtcatg

SEQ ID NO: 27430 - DNA, 3003 bp, Unknown; identical to SEQ ID NO: 27429
  misc_feature (1)..( 3003): 2750-1469P.txt file - cDNA_ID_2990205; gDNA_ID_2926196; Annot_ID_201444

SEQ ID NO: 27431 - DNA, 3003 bp, Unknown
  misc_feature (1)..( 3003): 2750-1469P.txt file - cDNA_ID_2990209; gDNA_ID_2684112; Annot_ID_190671
agatctttcccaattaatccggtctattgccatgtcttcctcgaagaaggttacgttcgattcacaatcttcatttcttctctttatgaaattatttctcgtatgatcttagtttttctctgatttcagggttccgatcggaatcaaatcaggaagtcgttgaggaagttaaaaaagcagattggggaattggagaaacttgaatctccggatcggttgaataatgtgaagcctatcttcatcaagcgcagtatccttttctgttgtcacaagatgctatttttttttgtcatacaaaactgtggaatattatttgttttcacatgacgagcttggttttaagatatatacttgaagaagaaactcaagaagaaagttaaggatcatggcatattctgttcttgctccttggatcctggttcttcaactctttgtggcagcgattgcaattgtgggtatgttccatatctgatcacaagtacttgtctgactaaatattcgtggcggcattggttctgattgttgatgtattgttggttttttccttgatgtataggattctactctcaagctgttcgtctagttgcaaatgcagtagtgaatgcaccaacaagccgttccaacaacgacatatcaagaagatgaagttagttcaggttggtttattacaatttgttgtcttatataaagaatgcattttcaacgttagttgaataagttgttgcttgcagacagagaaatgtggatatgggattgtagcagatgaagatatcaactcaggagagtttatcattgaatatgtgggagaaggtgatgttattacctttggtttctcatatatagttagagtactgttgtgattactctgcttactcttatcaatcttcttatatccatttcttattgtagttattgacgacaagatttgtgaagaaaggctttggaagctgaatcataaggtcgagacaaatttctatttgtgtcagataaactggaacatggtgattgatgctactcacaagggtaataaatcaagatacatcaatcacagctgcagtcctaacacagagatgcagaaatggttcgtttgtaacttattatccatcttctcacttttcttctgttcaaaacaattgagcaaagttatagatcatgaacctttttgttcccatttaggataattgatggcgagacaagaatcggcatttttgctacccgtttcataaacaaaggcgagcagttgacttacgattaccagtaagaacatttccttgcatcacaacaataaagtatttgaatgtaaatgtttagttgtgtgatactaataaatatagcaggtttgttcagtttggtgcagatcaagattgctactgtggtgcagtgtgttgcagaaaaaagctaggtgcaaaaccttgcaaaactaagaacacaaccttagaagaagctgtgaagccagtggcatgtaaagtgacctggaaaacgcccaaggtaaatttgagctttgccttacttttttttagtcatcctgtgattgctaaacagtaacttgtcctttcaaacatatggttagggaaaaactcgagggagacgcattgctggttagtattaattatttggctcgattatcgacaagcttctcaattcagaggtaagagaaaccaatttggatgcgtcaggacaagcttggaacaatcatagccagaggaaaatatgttgccgggactgcattggtgcggtgatctggttagcacgtcccatgaaccaaaagtataactatctttctttttttctcaaaaaccaatttcttccacaccaaagaacagtattacacggctcagatgaaggttttgactctagtagttgacatttttcaggtgttttggaatcattacacaatatgatgagttttaaataagcacttggtatctattcatttgacttattgccaacactgttgttcacattctatctcagtttacgaaatctaaagaatgaacattgactttgtccaggtcatgtatgaggatggtgttaccgagatcatcgacatgtgcagagaagtttggaaggttgtaactgcttgatattgtgactgttccaagtctgatttcattcccttacataggattacacttgaattgtcaagaaattttgtaaccaaccaaaccgtgtcggttggcaaataggtttagactttgttgttgtatgtatccaacttgaatcagtagttcagtagtacattacactgtatgtggaatctttggaccaaataaagaaaagtgtttttggattttaaaccggggttttggttatttaagagacaaaaaatctcatacccggtttgctctgtctataactcgagtttgttaagcacgtgattctccttggcaatgctgctatatcactagcctactgtccgttgtagcggatgatacccacgcgccggtgaccgacagtggatttgccgttaccggtggtaggtaatgtggggtcgtagctcacctacctaactaaattttctttttcttatgtttagttggaaaataagaaaaatataaaaactagttttttgtaaaggaaaaggataaaattactattatggaaaagataaattccaaaagtgaggaaatatgtatttagcacaataaaaagtgatagcaatgtgagaaaaaaaacgtgataacagaaatgctgtgctaaatttggatttctttgttgaaaatatatttacattgataaatattatgtaattagaaaaaggaaaattcaaaatagatgtgtagaaaaacaacaatgttgataatataattttttatctaaagtttttaccggttaccagttaccaccaaagttgttggatctctatcttcatttttagagattagtataaatgagtgagtaaacaaaccagagagaccaaacttgcctctccaccaccacttcctctacctatctaattccgaatctggatttggatttggatctcatttcgattcaacgatg

SEQ ID NO: 27432 - DNA, 3000 bp, Unknown
  misc_feature (1)..( 3000): 2750-1469P.txt file - cDNA_ID_2990213; gDNA_ID_2926239; Annot_ID_142834
caagagaaatataaacctcgatcatgtcgataaagcgaatgatgttaggatgattaatcttccttaagatgataatctccgacatgagactctcttgcaacttcttattaagccgagccatagcgatctccttgatagcaacgacggtgccatgaacaagatgcctcccttcccaaaccacggaaaacgaccccgacccgatttgtcgacccaccgcataatcgccgataacccttccgcttctccccgccgccgccaccaacgacgactgagccattttacctccgacaaaggagtaaaaatacaactccggagatccgaaattgagctgatgatgactaaaagtttcagaaattgattgaaggatcgatttggagttgaaaattaaaggattgaatttgggaggcggattcagataaaatgatagagaagaaagaaagaaagaaagaaaggtttattttgaattgaattcaatgcaaagtttttttttactaatattattagagcaaaggaatcaacttgtaaaatgacgcttctgatttatacgatcggagatgatgatgatttgtattaaattttaatagtatggttttatttaaaattacggctttgagtggacataatgacagcatgattagtggtcttaaactatgaagtcatcgctacaagctacaccaatcataacaatttaaagttatgaaataactacgaacttatgtttctacgcgtcgttactacaaatcttcaaatattttcgaattgtaaacattactaccttaaacaaaacaaaaaatctgttgttccttgatcagattaattaatatctattgaaattattggtgtccgttacaaatattttttgtgtttacatttccaaaacaaacttctgtatgaactgcttttggattgaagatttgaaacaattcacagaaacaaatttgtcgataaaataaaaataaagatggagtataaacgttttatatgaagtgtgaaaatgggattacgtgtatattgatataaacgtataaataaatagtaggaaatagcgttaagtagtcacacaagaattttaatttgtaggatccagagcagcctatatagcgtgccgttgtgaaaagcccactagctttttctgcttgattgtgactttagccgcttttgctaactctttccagccgtttatttctttccataatccttacgtttcagtttcaaatttgggagataatatactcaaactaaatacctaaaggtcctggttcgaatctttagcatggtatttggcaaactctctcatgattggtcatttgttgcaatgttgcatgtttatgtctatgattctcacatgtgtttcctttgaaaatcagattttttttgttcttaactcggatagtacaacattcataatcttcaaatggtctttcaaatgatctggaactctttggatataagaaaatgctgacaatttgatcaaaattgttaaccataccggaccaaatttgtgctttttcatatattagcggaaccatgtatgaacttgtcttcttgtccagtgggccataaaactttttttataatctccatggacttctctttatttttggcccagtagggattcatatgcatccacttagacttagaaccatatgtgagtcaagagacagaaaaacttagatgatacactaaatcaaaataaaaatgattcaaggaattcttacacttgtggcaatatataaatgaagaactttggcaatgtataatatattacacttgtgacagttttcttaaataaataacaaaaacatagcattattttcataattcaaccaaaccatctatgtacagtaattcacttttaatctccagcataaaaacaaacagaaaacttaccttccttttaaaaaacttgaatgctttgtcttttttttcttcttctttattcctcgtgtttggttcatggctgaataattcagttatgtatcatttattccattaaaggtaattaaaatgaggttgtaatagtcatatacgcatacataatgataaataacataaaaaaagaatcaaccaacaaaattattcgatctggcaaaaaaggtcattaaaacatataataaatcccacacatgcccacagatcattcaacatcatatcccatcatggtttaatatataaaggagtcacaggtcattttatactctcgaacatgttggtcttgattcctctttctctataaattaaaacacttgttcacatctttctcgatatgcatatctacaatgttccattcttttatttctgccgatattaaaatgaaattttcaaggcttttgggtggtttattagagatgtgatcatgacaagaagaggaattgtatgaacacaaaaatggagaaattcttgaagctggcacaatcatttgcatttgtttggggattcatcttgctggcggctctcgtgtgttgctgcatcagcactaaacctaatcgcgaaaatgatgatgatgatactggttgtgccgcctgcgacggagggcatgccggattttagtcgatgatcctctgtttctttcacttttcttttttggtcctctggtagatttgtacaacatagaatcctcatggcttatctttttcataattacacaaagcattattttgtcttctcttttaatatagaccaagtttatatttctttacgtttgcatttcatgttctagtgattaggatattgctataaacatatacattgaatgaaaacgtcggtttattcagttatggttgcataaaatttggatttgggtttagatattttgtgtataaaaatttacaactgagtaaaaaaaaaaaaaaaaaaaaaaaaaagagtggcaacgaaacggagagagggaattaggcaaattagaagagagaagtcgtagaccatacaatttgcacacaaactatatctctccactgactccaatcatctccttcctccgctcccatctgcgtctcaatg

SEQ ID NO: 27433 - DNA, 3000 bp, Unknown; identical to SEQ ID NO: 27432
  misc_feature (1)..( 3000): 2750-1469P.txt file - cDNA_ID_2990213; gDNA_ID_2926239; Annot_ID_204004

SEQ ID NO: 27434 - DNA, 3003 bp, Unknown
  misc_feature (1)..( 3003): 2750-1469P.txt file - cDNA_ID_2990217; gDNA_ID_1620325; Annot_ID_153471
tactatttataacaaggaccaatctgatgattagatagccgataaactaatctcgcatttgtttgctaactaaaaggaaaatggagtctagagacttactggtggaggaaccagaggcagaagcagatgatacaacgccgaggctggtgatggtctcagtgagaccgccgtagacggtgctctttaacaactcaatggcgaatctttctccgtccggttgaatttgtggtggtgattgtgtggtgtttatactcttcctcacatctatatattcttcaactgcatatagtttgcaaattttctttgggtacaaaatatatgtagttctatcgaatattcaaataccaaagataagcctataaacattttttatgatcaaagaaaccgttgttgattttttcccaaattgaaatcaatttgtctagtccggtttaggtgagaggagtaatatttttgtttcaattcacgataacatacctgatttctcaaccggttttcccctgatataatcaagttgtaagaactttgttcctgaaatttaaaatataaaaccagggttgatccatcaagtttacaaaaccaagaaaacctggaaagaattgactcagaaccggtttaattaaggtttgatttacctaaccggatgaagtactttagatcacaaaccaagcaagtaaagatagttccctctttatcttcttgatcatcctcaatccgagtctcagggacataaaccttaactggtgattccatctcctcaatgtcgcttggttcgtccggttcaacaaccggtatatcgggtttcagatccagagatgaattaacgtgcttccctcgttttcttttcttgagaaccacatttctggtgatacatgtgctacagctaggacagtaaagctcgtagttttcttgtgtcgcaagcaaattctctaggtttgacttctcttctgaatctgacgatgatctctcgttcttttcttcatcctcatttccaagctcatagttttcttgtgtcccaagcaacttctctaggtttgacttctcttctgaatccgataatgatctctcgttattttcttcttcctcttctatctcacaatcttctccattccgttgccttttgttctctacatttggcaagtttgtggagctcgactctaaccaattattaccattttcttcgtttgaaccggtttcagattcttcgtttgaaccggtttcgctcacagtactctcaagtactattggatctgaatcggaaaatagcgatgatgtactttcactaacagaattgttacctacgatggcaattaataccaaaaataaacgagagattgatctaccggttaagcaggtttgtgtccggttaaaaattaggatcctaaccaattagtagaggtaccaaaaattaaaagacaaaaaaacatgtaagaaactgacaagttgactaatgtaccttgagcttgagatccatcattatcctcttccaactctatctcggtggtgttgaccggcgccggagccgtcgctgccgccttggatcgaaattctcgggcgggaacattatctttaccaaatctatagctctcaagaagatcaaccaaaaattcagcatcaacgatttctttatctccgtccttcaattcggacaaggttacatgaactggttggtttgacttttccatatcaatccctatgtaatgaatctgattccaatgttctttaaagtgattatgagttaatgaaggagatattatgatttgtgagtctctctctctcttttcttcttttttcttttttaaatttaaaaaaaaaacacagttgttcctaattatcgtgtccaatcatatgatcttttatatatatacataaataatacccacgagggaagcacgaggggttaaatattcgtaacgaggattacttttggattttggtaattagggaaggtgtcatagttaattagcactctatttaaacatgttaatatatgtcagtttcaaaacaaaaaaaaaaaattgtgtggtatagtatatgtcttctttttgtcatcagtatatgtcatgaaattgatccataaggttttagaaaaatgattttaaatgattaaaaaatattagaagtaatacgaaaggtgcaatattgattaaataaatacaaactgtgatagtatgataccacgtaaaataaattactacagaaaatgaatatcacatgataaaaatactagtagtcaactctttaataactcataatgacgaggaaagtgggaaacgttacagttagttggaaacaacgaaccatattcaaaacgtgtatagttaatgacttcttatttattatgaagcccattagacatttgtttcttgggcctatatatttcattcacaataatcggcccataaaattaaccaaaagcccaatccaagtaaatcaccataaagctggaacacataaactggagcccactaatttacacgtggcacaatatgaggctccaatttcggcaagaagtgtgtgatcttttttttactcgttcttgatcttcgcgcttttctgatagatcctcttgggacaataaaaccattaaaatatcggagagtaaattttataaaaccaaaggcaaaaattgcatagatcagaaaatatttgttgcaactattgaaattatttttgttggttcgaaatttttacatatttatgttggttatgactcttatggaaatgataatgtgttttaaggaataaaattaaaattgattctgtttcatactaaaatatcaaacaaaaaaaaaaaatttgttttggcaaagaataaaggttttagtgtactctttctctgtggttaactttaaagttttggaagcatgtcggcgaagctggaaggagattctttacgtagtagataggccacaggtggtttcaatcttccccaacaaccagacgaaatcaaacataaatctgtaacagtcgaagaaactctcactctttaattgatcaatg

SEQ ID NO: 27435 - DNA, 3003 bp, Unknown
  misc_feature (1)..( 3003): 2750-1469P.txt file - cDNA_ID_2990229; gDNA_ID_1620505; Annot_ID_158989
ttgtcccttcaagcgcttgagtgtagaacgccgtctctctcgcaaggtcatcgtttacatccacagctcctccctggtcaatctcaacagtaagcttatgagtccaatcaacatcttcaggccagctaatatcttgaagcttatcaagcaacccatctctgttgtatatcgcagtcttcgtaggctcagccaatttctcggtgatctcgttctctgtatccgaatccgaaagagactccgcttcggagtcagtagcatcatcctcatcaatcatgttcatctcatcatctgatactatatcctcttccaatgacatctactcaaaattcgataacaacaaacaaaattagattcagaatcaaaaaagttcagacttttatacctttgggtaaaaaaaaaacttggcgaatcacagaaactagggtttataagtcaccaacgcaaagagagattccataactggttccgttaccttctatatgacaataaagttcgatactttatctaaggacttaagattataaccatgaacaaaattagggtttatcattctattgacacaaaccctttgagaaggaatagaagaaaacttactgttgattacggagaagattgaagaagcttgtgcttgagtagggtttttgagagagagaagagagatagtgaacccgccggcgcaaggaagaagaagaagaaacttagttttaaaggcttcgactttgtaaaacccttttctgctttatactaaaccggaaatctcacaaaaccggatcataccgggttcaaattatcgctcaattggttcccgttactatttataaaccggatctaagacatgaaaacttgtgacaaattgattcatttcattttagtaaaggtcacatgatttgagatctaacatagtataagagtatcattcaacagaaaggaaaacaaaactttgagccaaggctccaaaactctaatctctacgaaacagataaaggactgtgagaatcaatcattgttttcgattgaaccaaactctgaatcttgagttttgcttctgccatatttttcttctcaagctcatctaccaacattttgcaagtgctatctctaggaaccattccttttcgtactgcttcctcaaagaacaagcaagcttcttcaactttcccgctcatacataaccctctaatgagaagaatatatgtcgaaacatcgatactaacatcgtttttcaccatgtgatgcaataatattccaagtagcttcattttcttcttatggcaacacatcttcaacaatggagcataagtctcaacgtttggactacatgattccccctcctcatcctccatccttttaagcaaacgtagagccatctcatctcgtgagtgatgaagcgcagcggaaatcatggtattgtagactaaaacatcacgacgaactccttgattcgtcatgtcctcaaatatctcagctgcatccttaaacctaccagtcttcgacaaaatatgtatcaatgagctataaaacttagcatcaggaacacaaccatcttctttcatcttctcatacactcctaaagcttcagctacttgtttagatttacccaaagaatgcatcacaatagtataagtcacaacattaggattacacccattctctcgcatctcttccaacatttcattaaccctcctaaaatccccttccttgcaataagcttccacaaagctagtgtaagtaacaacatcaggagtgaactcagtaaccttcatcaaatccatcatcgctctagcatcatcaaatttccgagctttacaaaaaccgtgaatcaaaatgttgaatgtccgcgcatccggcttgattgtatcgaaaagcttcagaaaaacttcatgagcatgctctatactattctctttcacaagtgcatccatcaaactgttcatagcaatagtatctgttttcacaccataactcttctccatctctaaaaaagcatcaacagctttattatatttccctgacttggccaatctcctcataaccttactcatcgtatcaagcgtaacaagcttagattcttcattcttgttcatctcattgactaattcccacatcaaatcaaaattcctacatttccccaacacatcaaccattgcattataagtatgacctgaatgcacataacctgtttgtgaatttgcccaaatgaaaaacccgtaagcttgattccaaccattactaaaccttcttagaacttgcaaaaccaaactctctgtaaccaccacatcgcatttactcaactctttaacaacatcctcatgagacgtgtccttcttattcaaaaagtcgcaaactttatcaatatcttccactggtttcttcactacatttccctctgagacttgttgacgactaaacttctggctctcgacccaattcgccaaagaagggataacaaaatcttcatcatctttggaaaccgaactcgatgaagaagaaggcttgtttgatagaaagtctttaatccaagacggtagctccggtgactctgcggcaacaatcggcgactcctctgcagtgttattcgttaccagaaacctccgttggaagattctccgaggtaaagtatacgaaacaagcttactaatcctaagcttagtgagcattttgttccgtttgaatctaaacgcagacttctctcctgtttttccgatcaaagttcgaatcttttagacctaaagcttgctgctttgtgccgggtcgggtcggttcgttaattggtacaaccccggttcgatttaatttaatttagcgtttagatttttggtttaccccacatctgacaagtgacgatttttactgacacgtgtacaagtcattctcttcgtcttcttcctctaaaaaccctaattttaaggaacctcgtgtggtcatcgtcttcgtacctttctgctttctacgccgtcaaaatctaactgctcgacagtgaccatgcaaagctcaatgacaatg

SEQ ID NO: 27436 - DNA, 3000 bp, Unknown; identical to SEQ ID NO: 9703
  misc_feature (1)..( 3000): 2750-1469P.txt file - cDNA_ID_2990233; gDNA_ID_1972173; Annot_ID_179929

SEQ ID NO: 27437 - DNA, 17 bp, Unknown
  misc_feature (1)..( 17): 2750-1469P.txt file - cDNA_ID_2990236; gDNA_ID_1563305; Annot_ID_147435
acttgaaattcgaaatg

SEQ ID NO: 27438 - DNA, 3000 bp, Unknown; identical to SEQ ID NO: 13339
  misc_feature (1)..( 3000): 2750-1469P.txt file - cDNA_ID_2990239; gDNA_ID_2214619; Annot_ID_135845

SEQ ID NO: 27439 - DNA, 3000 bp, Unknown; identical to SEQ ID NO: 13339
  misc_feature (1)..( 3000): 2750-1469P.txt file - cDNA_ID_2990239; gDNA_ID_2214619; Annot_ID_187613

SEQ ID NO: 27440 - DNA, 3003 bp, Unknown; identical to SEQ ID NO: 26407
  misc_feature (1)..( 3003): 2750-1469P.txt file - cDNA_ID_2990249; gDNA_ID_2214604; Annot_ID_187166

SEQ ID NO: 27441 - DNA, 3000 bp, Unknown; identical to SEQ ID NO: 9495
  misc_feature (1)..( 3000): 2750-1469P.txt file - cDNA_ID_2990259; gDNA_ID_1972133; Annot_ID_179123

SEQ ID NO: 27442 - DNA, 3000 bp, Unknown; identical to SEQ ID NO: 1818
  misc_feature (1)..( 3000): 2750-1469P.txt file - cDNA_ID_2990274; gDNA_ID_1620452; Annot_ID_157528

SEQ ID NO: 27443 - DNA, 3003 bp, Unknown
  misc_feature (1)..( 3003): 2750-1469P.txt file - cDNA_ID_2990278; gDNA_ID_1621182; Annot_ID_174316
ctaaatcacaatgggtaaaaatactaaaaattgttgtatgtttgggtctaaaataattatatattttagtctaaataatttattattttatggatgattttttggatgttgtgatatgaagctttttgatggttcatccatgaacaatcataatggtgaatttgattgcaattgcgctggggcttgcaaagactatgtattgttagaccatctacattggtaatctctcaagagagtttttcactattaaaataacagaaataataaaaagagaagagagagtgtagaaagtttctcaagtgagaaactatgagatactctctacaagccatcattacatttctcttcttttaattgattcaatttttacactaaaataaaaatttaatcatataataaaattataataaaatactaatatttttcttgttcgagaaactttttgggtttctccttgatggagatactcttaggttttgttaaactctacaacacatcaagcttaaacctttgccatccacaccaactcacggaaacagagtaagcaagatataaagaagtagaggaaataacagagcagaataggaagaagaggagcacacaagtatttgttcacaacgaaggagaaagagggtgattacaggataatactagtgaacgtctaaaacttttctctagctaaagactcactctccatcatgtactacttgaaaaactaccccaaagcatatacagttatactttacagtttctctcaccccttatgatctaatctccttagatctacattgcttgttctttctctgctccctagtgcagcttccagacgttccttttgaatttacaaacggacaaattctccttattggccaacaatgcagaggctatagttatcgttgcctttaccttgtatactagaaaatgtgaacatcaagttctcatcttcatatgtacagtccgttttctgcattcgagtaagcttgttggaggagtgttcttcagcttttgggtgatttgtcatctttatctgtttgctaaaggattgattgtgtttgtggtcgattattgtgtctctgctttgggtgtatgataatcctccttctggtaaacaagactacgcagtttcagtttccttgatttaggggttttctttgtttgtggtacaagccttgtttgtacgaactcagagctaatctccatctccttgtatcagctgattcagacaagacggatactaagttgcaagtttcttagatgcaagagttatataatttgactttgcagcttgtatcaacttatagcaattgaaacagtcttgtcaccatcaatgtttttagattataatttgtttcatgcaagtttttgtgaaagatttttatggaagttcatatatatatgaatactactgaaaaaaaaatcaacttaaaattcaaagcaaaatctccacaaatagatctgtttcattatagaaatacttaaaaaaacaagaaaaaaaacgtggcagaaggaatttagaagcaaaaacagcttcaatctctctctgatccgcttgctacttcacaattgactgactcttaaggaagcttcaatgttttttcttttagacagatttgttagcagagaagtcttgagttgtcagaaaaacaataactgttagaattgttgtggagaggtggcagagaagatgtgtgaagcagactgctcggatcatagcttgaaaacatgtcttgagagaagctagtgttaccgacagcattaccataagtgttctggttgaaaccagaagagaattcatgtggaaccgtgtttgagagattaggatattgtagaacgttgtttttgttgatgatttcactcatcatacacatgttctgatcaaaaccatgaagctgatcctgtcgctgcatcaagtgattattcaacccgtagttattcactgcagatgcttgtaccgaaagaaacggtgagtattcttgtgtgtttgacacgccaggatgttgaaagttgttgttgttggtgatgttgtccaaacacatgttctgaccaaaaccatgccgcatcaagtgattcaggtaattggagttgattggagagtgaagcagacagtgggagttgtgagagagtagcagcatctccatggttgtacatatacggcgagaagttgctaggattcaagtgttggatctggttcagatacgatggtgttaaactctgatgcaccaagtttttgttttgttgtttctgcgactcaacaatacgaagcctttcttgcagagtagaaagagtccgttctaaggaatgaatcaattgagagagttgttgaggagagtaatgatcaaagtcaggataccaattcttcacataattcttctttttcgaattcgtcttccccttgtcatttgtctttgtctttgtccttgtccttctccttctcgatgaagtcatgaagattgagactcttcttgcgttttgtggcctctttatatctcgaagccatgtctttcactgtatttctctccttaggccatgttctcagttcaccgtctggtccgtaatagatgacgcaaacgtcaatagcacagagaatcgaaagctcttcagcttttttgaagatggttttgagtctgtttgttaaactagttgaattacgtgacgaagaagaagaagaaaaagaagattgcttcatcgtgattttgccttgattcggcaagaaactagggttttttcttccgagagagagagaacacacaaagaagaaaaattatggaaatgagggtgaaacattgtgaactcaatacgtttctatagatgccttgatgcctacggaacaacgtgtacgcatctgtgttaaattcaaaactaggcctataatgggcttagcagaaagcccaattagaaaacgattggtttttgtggaagagtaaccctagaaaatatcatatataaagatattgtcttcttcgattaactcttcttcgccaaaatcagggagaggctaaaatg

SEQ ID NO: 27444 - DNA, 3000 bp, Unknown
  misc_feature (1)..( 3000): 2750-1469P.txt file - cDNA_ID_2990278; gDNA_ID_2926183; Annot_ID_140640
aatcacaatgggtaaaaatactaaaaattgttgtatgtttgggtctaaaataattatatattttagtctaaataatttattattttatggatgattttttggatgttgtgatatgaagctttttgatggttcatccatgaacaatcataatggtgaatttgattgcaattgcgctggggcttgcaaagactatgtattgttagaccatctacattggtaatctctcaagagagtttttcactattaaaataacagaaataataaaaagagaagagagagtgtagaaagtttctcaagtgagaaactatgagatactctctacaagccatcattacatttctcttcttttaattgattcaatttttacactaaaataaaaatttaatcatataataaaattataataaaatactaatatttttcttgttcgagaaactttttgggtttctccttgatggagatactcttaggttttgttaaactctacaacacatcaagcttaaacctttgccatccacaccaactcacggaaacagagtaagcaagatataaagaagtagaggaaataacagagcagaataggaagaagaggagcacacaagtatttgttcacaacgaaggagaaagagggtgattacaggataatactagtgaacgtctaaaacttttctctagctaaagactcactctccatcatgtactacttgaaaaactaccccaaagcatatacagttatactttacagtttctctcaccccttatgatctaatctccttagatctacattgcttgttctttctctgctccctagtgcagcttccagacgttccttttgaatttacaaacggacaaattctccttattggccaacaatgcagaggctatagttatcgttgcctttaccttgtatactagaaaatgtgaacatcaagttctcatcttcatatgtacagtccgttttctgcattcgagtaagcttgttggaggagtgttcttcagcttttgggtgatttgtcatctttatctgtttgctaaaggattgattgtgtttgtggtcgattattgtgtctctgctttgggtgtatgataatcctccttctggtaaacaagactacgcagtttcagtttccttgatttaggggttttctttgtttgtggtacaagccttgtttgtacgaactcagagctaatctccatctccttgtatcagctgattcagacaagacggatactaagttgcaagtttcttagatgcaagagttatataatttgactttgcagcttgtatcaacttatagcaattgaaacagtcttgtcaccatcaatgtttttagattataatttgtttcatgcaagtttttgtgaaagatttttatggaagttcatatatatatgaatactactgaaaaaaaaatcaacttaaaattcaaagcaaaatctccacaaatagatctgtttcattatagaaatacttaaaaaaacaagaaaaaaaacgtggcagaaggaatttagaagcaaaaacagcttcaatctctctctgatccgcttgctacttcacaattgactgactcttaaggaagcttcaatgttttttcttttagacagatttgttagcagagaagtcttgagttgtcagaaaaacaataactgttagaattgttgtggagaggtggcagagaagatgtgtgaagcagactgctcggatcatagcttgaaaacatgtcttgagagaagctagtgttaccgacagcattaccataagtgttctggttgaaaccagaagagaattcatgtggaaccgtgtttgagagattaggatattgtagaacgttgtttttgttgatgatttcactcatcatacacatgttctgatcaaaaccatgaagctgatcctgtcgctgcatcaagtgattattcaacccgtagttattcactgcagatgcttgtaccgaaagaaacggtgagtattcttgtgtgtttgacacgccaggatgttgaaagttgttgttgttggtgatgttgtccaaacacatgttctgaccaaaaccatgccgcatcaagtgattcaggtaattggagttgattggagagtgaagcagacagtgggagttgtgagagagtagcagcatctccatggttgtacatatacggcgagaagttgctaggattcaagtgttggatctggttcagatacgatggtgttaaactctgatgcaccaagtttttgttttgttgtttctgcgactcaacaatacgaagcctttcttgcagagtagaaagagtccgttctaaggaatgaatcaattgagagagttgttgaggagagtaatgatcaaagtcaggataccaattcttcacataattcttctttttcgaattcgtcttccccttgtcatttgtctttgtctttgtccttgtccttctccttctcgatgaagtcatgaagattgagactcttcttgcgttttgtggcctctttatatctcgaagccatgtctttcactgtatttctctccttaggccatgttctcagttcaccgtctggtccgtaatagatgacgcaaacgtcaatagcacagagaatcgaaagctcttcagcttttttgaagatggttttgagtctgtttgttaaactagttgaattacgtgacgaagaagaagaagaaaaagaagattgcttcatcgtgattttgccttgattcggcaagaaactagggttttttcttccgagagagagagaacacacaaagaagaaaaattatggaaatgagggtgaaacattgtgaactcaatacgtttctatagatgccttgatgcctacggaacaacgtgtacgcatctgtgttaaattcaaaactaggcctataatgggcttagcagaaagcccaattagaaaacgattggtttttgtggaagagtaaccctagaaaatatcatatataaagatattgtcttcttcgattaactcttcttcgccaaaatcagggagaggctaaaatg

SEQ ID NO: 27445 - DNA, 3000 bp, Unknown; identical to SEQ ID NO: 27444
  misc_feature (1)..( 3000): 2750-1469P.txt file - cDNA_ID_2990278; gDNA_ID_2926183; Annot_ID_200394

SEQ ID NO: 27446 - DNA, 3000 bp, Unknown; identical to SEQ ID NO: 9524
  misc_feature (1)..( 3000): 2750-1469P.txt file - cDNA_ID_2990282; gDNA_ID_2926139; Annot_ID_197343

SEQ ID NO: 27447 - DNA, 3000 bp, Unknown; identical to SEQ ID NO: 9524
  misc_feature (1)..( 3000): 2750-1469P.txt file - cDNA_ID_2990282; gDNA_ID_2926139; Annot_ID_138948

SEQ ID NO: 27448 - DNA, 3000 bp, Unknown; identical to SEQ ID NO: 9524
  misc_feature (1)..( 3000): 2750-1469P.txt file - cDNA_ID_2990282; gDNA_ID_1972140; Annot_ID_179262

SEQ ID NO: 27449 - DNA, 3003 bp, Unknown
  misc_feature (1)..( 3003): 2750-1469P.txt file - cDNA_ID_2990286; gDNA_ID_2926241; Annot_ID_142890
acaaccacacagaatcaaaagacccacaagctacaaagaaacacaaatcaatttcaagtatctagtggattgagaaaactcaataacctaaaatctccaaagagaatctaccaaaacgcatgcaaaatcacaaaagatgttattttggttacacccatgaggaacaagaacaaaagtcggagaatttcgcagaaatttttctgaaaccctaagcttcaaagttacgatttttaagaacaggaaacgattacagagcgagactcatcactaaggtagaaaaaaagacttagcattacgtcaagaaattggaagatacaagagctaaaagaggagagagaagaaccttggtgacgacgaacgctgaacgcagagaagggatgcaaacgtttcttcacaagactaaagttatacaatgctacaatataaagggacaagtactttctcctaaccggatctcgttgcgattgaaccgggttcagttcagtttaaatttggttcggattgatggaaatccagaattctgattggatgaattgctttaatttgatttacattatttttatgtttggtacgatttcgttagggtttaggtcaatttgttactacaataaatgtgaaccggttatgctatttgctttttaacctttttttttctgacatcccctctctggtttcatctgacgacggacaagatttaagggataatcgaacggtcaaaattataaactacgggacagatttcgtttttttttttttttgacaagcgacgaagatttttctttctttcaaattgtgtttttctctatattcgattcgagattaaattctgaaatattgttctttttttttttttctcttttgtggcatgaacataattgttttcttttgttctaggaatgtcatttgtcacttttgttaatgcaattgagaaatttgaggttgcagttaggtatgcatttaaaataagattgtctagtagaaattggacttacgatttatatgatcttcataagtaaaaaaggatgctaacatattttaaaaaatctgttgttcaaaaaaaaaaaaaacatatcttaaaaaatcaataaaatctaaggatgtaagatattattacaaatagtagagatttataacttaacaaaaaatcgaggagggactaaaaaataacgctcgtaattaagccctagtacacttgatctgtgaaagaatctgattgttcaagaacttagacatgaatctataagccttttgagtcaagtgcactccgtcccaacttatgaacttgtgtggattctgacacaccggaactcccactgctccgtatggcctctttccgtcgtagttgtaagctccaccggtcccgcaacacgatttcaaagctacactcttgtcgaatctttcacttcgtagaacgtattgaaacgcattgtagtaatctccgtatactatagccacgtctggaaactcttttctcaaagaagctatagcttcttggagttggttattgtgatccattgcgaattcgttgagatgcgtcaagcaaccgttgtcgtcgtaatcttttgtatctttcacgggaaaagacgtcaagtaaatcggaaaacatcccactggaaagtttcccgggacgaccacgttaaccgcaccagcacggatcacctctctagctgcggctgtgatggctccaaccacgtgagggatgtagcttctgatttcttccattggtttgccttggaagaaaccgtagttgtagtcgttgcctcctatctcaccgaccatgaaaagagagtgcttcaagcaatccgaagaagagccgtgacacgtggaacgtagatgacccttgaaccaagcaagctgcatggagagaggagtgtttgttgccggaacgtggagatttctctcggagaagaaagagctgttgagtgctgtgcttccggaaactccgaagttaacaaagacgttgtgttcccgttgaggtaagggtttaggagtgggagatgaagcctgcgtgccaagtaatcgatcattagcagtccgttagatagacgaccggtggcttggtgaaagtatgtttgaccgtatggataattagcggcgtgagaagatctggctccaacagggccgttgcggattaagtttccagtgtcggagatggagtcaccgaattggtagatagagttgataggacattgatccgatgaatgaacaagggacacgaagagtataaacacaagaagcgataatgctttggtcgtagacattgttagagaagtttgagagatttgtttgttggttttagacaaagagaaggatgagagaatttgttgcctatgtgtgtgtatatatagagtttcataatctagctcctagttagtctgtgatttagatagatatattcaataataattattgatagtgataaattcaagaaaaatatttgatagaacgagatctgagaaaatatgtcagaatttttattttattttatattattaaaaaacattattatttaatatttaatcaactagaatcaggcaaaacgaggcaacgtatcgaaaattcctctttttattaatatcaatattttgcctaaaacaaaaaggaaataaatattaaaacgctttctttacttttttattttcacctgaaaaattcgaaattaagaatgaaaaaggaaaccacaaaaaaaaaagaatgaaaaaggaaatttctagagagaaatctctgtgttctttgatttttcttcacctcatcttcttataaatcatctgtttcgttgcagagagctctaaaagaaacaacaacctttctctctgattatcttcgccatttctcgtcgaaattagggattttgttcattaaatcttcctgatttggaaggtattttcattgtctgcttgaaaaaaattcaatctttgtcggttcattatgagtaattggagaagacaaaaacccagaaacaacaacagcaataattatagtcgtcaacgagggacgacgatg

SEQ ID NO: 27450 - DNA, 3003 bp, Unknown; identical to SEQ ID NO: 27449
  misc_feature (1)..( 3003): 2750-1469P.txt file - cDNA_ID_2990286; gDNA_ID_2926241; Annot_ID_204091

SEQ ID NO: 27451 - DNA, 3000 bp, Unknown; identical to SEQ ID NO: 7168
  misc_feature (1)..( 3000): 2750-1469P.txt file - cDNA_ID_2990290; gDNA_ID_1621130; Annot_ID_172458

SEQ ID NO: 27452 - DNA, 3000 bp, Unknown
  misc_feature (1)..( 3000): 2750-1469P.txt file - cDNA_ID_2990294; gDNA_ID_1620682; Annot_ID_164501
aaattctaacttcagccctttttggttttccattgccattgtctctgaaagccgtgcaggtaactgcattagaagccttagaactacctccactgccacatgctgacttattgataccgtttcttaagataggctcattatcttcggttccttggctgccagtaatcttcctttgcagcttccccaaaaacttatccgcctacactagtgtatatgcagatttagcttataacatgagacaataatcgttctaagaaatgtcaatgagaagtgtcttgtttaaggagccaacgaagacttaccagtgagccatacttctcgaaagttgtggaggcaacaaccggaacattttcatctcggctcctcgaattatgatttccattgaaggaatcatctccatttctctgtggtagaagcttcgacgccttcttggtttgtgcagaaaacagcaaaacaaacaatcattcatgttgcacacgaattattatataaaaaaaagtactgagaaacttcgaacattcatgatgtgagatctaccaggtttgaagcaacagctgatgaatattgtgggacaactggaacctgtgatgctgcagcgatctgaggcctcgggaggtgccactgatgttttctcaagtttgattcatgtctattattactacgagcttgttgttgatgctcattacttagtggatgcatcctattgaaaagggttgcatcgctcgagacagtaacaacaccaaccagctcaccgttttcatacacagggcttttagtcaccaaagccataaatagttcaccagttttcttctgaaacggaaactgaccagtccaagtctctccacggcacaccctattcctgataccagtaagggaattacggtattcttcggttacaagcacatcaatagttctgtagccaacaacttcctcagcataccaatggtacagattctcagcagaacgactcctgaataataataaaagaatctctccactcagaaacaaatagtaaatgtccacttgcatatacaatgaatcgctatatataactttgtttaactacttaaacacacaattcaatgaaacagtacttagaagaactataagctcctgatctacaaacaccatagatgaagaagaagaacttatcaagctcaccagaatgtaatttctccagacgcagctgatgttacatgaatcgcgtgtcccattgaatccatcaaagtccgatacgcactatcagcgaaatagaatcctgaaacagctctctcccaagtcgccgtcggattatcccaggaatccgccgcctccgcttccacctctacctcagcctctttctccgtgtccgtctccaatcccgtcgccgattccttaccggttcgactctcctcctgaagcaataagtcatcaacatcctcccttagtctcgcttgactcgtctccatcctctgacaccactccaccaaaacctggtagagactcgattccgagttgtttccggccatcgtaatcgccggtgactctgtttgagcagtcgcatcaagatccgactctgatgaaaattcacaaattaaaaatataatttaaaacgttggcattccctcattgtttattatttttcagctgcttcttaaatcactcgtgacgccataattaacaaaccccagctattataaacactacgacgcattagcttacgccacgtgtgtttgttactaataggatgctgccacttgtagaattgccgatgtaattgaaggttgaagaagattgagagataatagacgaatttgtcacgatttaaaagtggtgattgacgaaattaacctcaatataatacccattcttgttgccgccattgccaaatgggcctgagtttgatggtgtttttatacctccaacggtatttgtcaagaagaaaataaaatacacgtctcttcaatgttcacattcacattcctctaaaagtaatgtgcccaataaactcaaagttcaagttgattgaagaacaataacaataaattatagttgaatttaaatgtaatcaattattagtagtatacttcaaatcattgtagaataatactctccataaggtttcttagaggaagcaaagtttaattggagtcacaaagctagttttgtttcaatttatctaaagatttactttgtttctgggacacaaactgaaagccaacccttttttttggacaaaaacgacaattcttatattacaaacggccgaaagagaacatgacagctcctttaaaggcactatatagagggaagattgggatgatcataaagtgaggatatctttggatattttagttttgggtttggttttggtttttcgttgttggaccgaaaagcctttacattttaaggcttatttccatatttactgtcaaattgacaaataaaatatgtaattggtgtgaaaaaaaataaattatgtaactttttttttgtacattaaaaattatctaacttttaatgtatatacactataacaattaatatcatgttaaaaaaaaaggtcaaaaagttcttggctagtaaaaactaaaaagataagtttaatccactctgaatttgactcgaattccagtttataaaatataaagactctgaaaaaaaaaatccaatttcaactgaataattatttatttagttattcagattaggacactccatatattatctcaagttctctgaaaataatatcttgaatatcaccgaaaatatacaaaaagaataaagaaaataaagtttaagaaaatccacaccaaataaaaaaggagaattaaaaaaaatggaaaagaagaaagaccctaaaaaaggctttaaaaatcttaagagtcaccgatccaattcctttcttcactgcaatttttgtgatttacaacatatattaattcttgcctcctccttcactccagctccaaacacaaatctccgacgaaaaacttctctcaagctttctcttttctaatg

SEQ ID NO: 27453 - DNA, 3000 bp, Unknown; identical to SEQ ID NO: 27452
  misc_feature (1)..( 3000): 2750-1469P.txt file - cDNA_ID_2990294; gDNA_ID_2926181; Annot_ID_200277

SEQ ID NO: 27454 - DNA, 3000 bp, Unknown
  misc_feature (1)..( 3000): 2750-1469P.txt file - cDNA_ID_2990300; gDNA_ID_2936581; Annot_ID_194901
gggaaatgtggaattagatgcaaaaaaagatttccaagattcaacaatatttcaggtacctcattttatctgcgaaactgtgtacaataatgtagaccacaagccaggccaggctagcatataatatacaccaagggaacaaatatgtgtaggctctgatataaccttgtcgttcattttttgttccattgacagtctgcagatgactgcgcgattgccatagccaatattatcaggcaccatgaaacagagtaccttgcatctctagaggttcccaattagcaactcatttatctcgtacttttccatttcatgtgttgttaatctcgttgtatctgacccaatcattaggtagcttattcaaaattaccggataacactttcaaggtaattgtctctttccaaataacgatttcagtggctgcacaatggtaacctcgaggtgtatttagaaatttctgagcagatatatggaattttgcaggatttgaggaggaaacttccggtgacacgaactctgttcccatggcagaacactttacagttcagcctaacaagagaggtcgagaaagaacttggacttggcaagtgactaatcatcaactcgcaaccttttgagtgctatatttcgttgtcaaagtttctgtgatttccattatgtaagtgaaggataagtattatttctgttgtgtcttgtctttcctttggagtaatgtatacaaatcgcattagtaagtatgatagatattgttccgcaagccgcatgaaagaattgaagtttggtcccaaaaagagctccgttgccgggaatcgaacccgggtctcctgggtgaaagccagatatcctaaccgctggacgacaacggatatgttattggaactgttaaagaactaaatatgtattaaactttaatatgaatgataaagatttccttaaataatctgttaataaaaaaaaagcaaaaaaaaaaaaagagagcacaatttgaaaggaaagcccaataatagaggcccatggtgaaagtcttaggccccgggtggtaatctaatcacgtttgtagtgataatctaatcacgtttgtttttaatgataatgcgttgtccccatccttgttcttaattcaattgtcaatcacctccattaattttgtgttcacctcggttagaaagctttgttttaatttgttaagacgatgctgatatatcctgaatcatgattaaattaaaatccttaagttaaagtcattacaaaaaccacttttgaatattgatcagatattggtcccatgcccaaaacgatggtgcaaaatgtctaaagagtgataagctagcaattactagatatatactaaaagaaatagtttcagttccaagcatgagcactagtcatagttgaggctcacaaatttcttgcaaatcatcttcgagttttccacgtccagagatggtctccttcctcctgatacacacacaaacaactaagtatcttccatcgtctaaaaataaacaaaagcatacgtaattacccatttcctccaccttcttatttataatcaagttgaacaattttcaaatcatccaagacacaatcatttattaaatattgatatatgcaatgacaaaatatccaaaagtattgacttcaatgacattcaatttttgctatttttttatttttttgtacgaatagtcttcagatctttttcagttgatgtcaatccaaactttaatcatgagtctatcacaatattgttgaagtacataaaacaaggaattgatttatttataatcgagttaggaaaattttaaactacaaacataacatagttacacagaattgtatcaaaatatcattattgttgttatatgtattcatttagtgaaaaaatattaaaatcttataaataattagctttatagacaaaatatataaattgatatttcaaatcacaaatgaatctaaccataaaaattatcactacatattatggatctaattttattaataatacaaaaataaacaaataataaatataaattagcataaagaacaatcaatgtaatttttttttaacaatttttaaaacaaacccacgcgtagcgtgggtagtcatctaatacaaatataattttacctgatttcataatcgcatattgctgactttggacgtcttcagtgatcactttcatcctcctgctttttcgcctcagatctagccgaatgatactgcacaataaatgtgatccctatgggaatcactactcttgaaattgcatacatcccgccaactcccgtgaacgtcatcgttttgctatatgaagatggctccactatcacaaccaatgctgacttagctacaaaaaaagcttgtttaatgctactacttttctgttgttgattattgttttttttagattccgaggcattacttgtcatttatgattgagttttgagcatatatatgtttacttaacgctcgaatatatgacaagaatttgtaaaggtttatgatgttttaatgaattttggttttcttttaaatttcggatgagagacataaataaaacagcatttctaataaagtttgtttttttggaagaaatctttctgttgcagttcttgtgattaaggttcttgcaatttcaagagtagatttagacattcataattggaatgtaaatctgaaagctatagtcaggggggtttaaattgtcttatattgagttagttcgagagaatgtggaagactctaactcgttcagaggttttcccctatgcatttctttgaagacaagttttcctaagaaaactcttttttatttttaatagctaatataatttacttttttctttttggttatttattttctctcgtcttctctccttattggttttttttctctcatagtcgctctccctctcctctccctttgagaaatccctaactctttgctcttctcttcccggcgatctatctctccgatttgggtattgaaatg

SEQ ID NO: 27455 - DNA, 3000 bp, Unknown; identical to SEQ ID NO: 27454
  misc_feature (1)..( 3000): 2750-1469P.txt file - cDNA_ID_2990300; gDNA_ID_2936581; Annot_ID_143748

SEQ ID NO: 27456 - DNA, 878 bp, Unknown; identical to SEQ ID NO: 276
  misc_feature (1)..( 878): 2750-1469P.txt file - cDNA_ID_2990304; gDNA_ID_99881; Annot_ID_147394

SEQ ID NO: 27457 - DNA, 3000 bp, Unknown; identical to SEQ ID NO: 7166
  misc_feature (1)..( 3000): 2750-1469P.txt file - cDNA_ID_2990311; gDNA_ID_1621130; Annot_ID_172464

SEQ ID NO: 27458 - DNA, 3003 bp, Unknown
  misc_feature (1)..( 3003): 2750-1469P.txt file - cDNA_ID_2990315; gDNA_ID_1621153; Annot_ID_173324
tattcagcgattgtgattcctggaattcacattaaaaaaaaaaaaaaaaaatgagcataggcaatgggattcatcaataactattaaatctgtgtgcctgaacattacctgtgtaaattgaggcttcacgagcagccacaggcatgttagaggtgttagcaacaagtgtggtacgtttcatgacagattcctcacggccatcaggcaacgtcattgtcaattgtgggaagtccataagaacctaatttatgagaaacaatcagatcaaatgtccgatttgtatgaacaatatgcaaatttagaatgagaagagatatacctcagccatttcatttcctctctctccacaaccaacatacacaacagcatcagagttggagtactatgtaaataagaaaaagttagctttggaaattcaatctatccagtaattaaatggaacaaaaccagagagtgtcacaaggtaccttggaaagtgcctgactgataacagttttcccacagccaaaagcaccaggaatggcacaggttccaccaagaacagaagggaaaagggcatcaagaacacgctgacaacaggaaaagaaagcaatcagcaacacatgtattcaaatgactatcaccactgtaagaagaattaatcgagtaatcacctgccccgtaagtagaggagtatcggcagcaagctttgatgcaactggcctaggcgtacgtacaggccagctctgacatatatcaaccaaaccaatttaacagagtgaaccaaatagcttaaaatttacgtttgcaagtaggaagattaaagatacatgcaaacctgaagcatggtgtaagatttcttgatcccctggaattcaagctctatcacggtatcctgagaaatgaaaatcaccgacaaacaattattagcaacaagccaaacatgatctacaacaggaagtgattaccaattgatcaagttagccatatattaactcaaacgttgaattcaaagaaatcaaggaagaaaaagtttgaaacgtatttattcataactgtttgagggaaacttaaagtcaaaccttaagcgaatattgaccagctggagcaatgtaagtgatcttccccatggcatccggaggaagggcaacgaggtgattcatcaaagtgttctcaaagacagtctgcattccaaagtttaatttgactttcagaaaaaactattcccagtgtaaacaagggaaacaccacggtaactgtgtaaatagattcccttgtcaaaagcagattaaagaggagaccaataaacttacagcatacaagtcaccaccagttattgtgtctccctcgactgcaaacaaaacgaattcaattgaccatcaagattaaaaccaaatgaacacttccatagacaggcatatggagtaaaccacattaccaaatttattgggctggaactcccaaagacaatctttgtcaagagctggaacagacacaccccgaggaatgtacacatcaccggatattcttgcaatagtcttcaaaggcctctgtgacatttaaagaaatgaaaccaaagaatcgtaagaagccacataaaacgaatcataaaagtaaaaaaaatcatgtctagcaagattataaatccaactgaacctgaattccatcaaagatatttcccaatattcctggcccgagctccacagaaagtggctgtagtaaattcaggacaaattatatgttagctgcagatgaacaacactagaaaaaaccaagataaataactcgcgaaccttgtgtgttcgaagaacgggatcattaactgtcaatccagctgtttcctcgtaaactgatcaaaaggaagttgccaaatatcagttaagatatcttacttcgacagaggtcacataagatgccgtaaagtaaattacactaggaagcacaatagaagaaacaaaccttggatggtggcagaatctccttcaagacggatgatttcaccaatcaaattatcatgaccaacacgcactaactcatacatagcagcaccggccataccatcggcaacaacaacaggacctgaaacctgcatcccataaaagaaaatgtcaaatcactgagaactatcagatcagatcagaaattcaaagacgaggttactgaaccaacgcggaatcaaccgattcaatcactgataactatcagatcaaatctagctatcccaccaatcttacctggtaagcagatcaactatttcatctatccatcaccaaaaactaacatcgcaaaacagaaaaaaaaacaaattgaaaccagatcgaacgaaacaggataataccttacgaacgtaaccatactcgctctccttctcatcgtcctcgaaggtcgtaagctttcctccgtaaaacgccggcattttctcagcaatcagagattcaaaaactcaaatccgatcggccaaaaaaatcaaaattcacctcctagaaaatgccgagatccgatcaaacaacaacaacaacaaatcagaaatcgccaaaatcagacaactcttaaggtttttcaaagagagcgatacaataaatcagaaagaaacaaaaaggatcagagagagagggatagagatctcctaaccagtgaacagacaggaagagtggtcacaagaagaagaagagagaggtggatgcacgtagatagatattgaaagagttggagaagttttgatctgattgacgaaatcgtggagtgatccggtacatgactacacacgatacgcgcgtagatctggactttgtcgttaatagccacgtgacagtttatttattgggctttataatatatacttacggcccaataagtgggtccgtttagtcaacaaagacatgcggcttgagaatctctctctctctctgatcaagccggaaaattcacaaaagtgatcagttttgttttctcggggaaattttctgaaagtgaagaaagggaaagcaagttttttttgaagtggggagagagatgggagaaatg

SEQ ID NO: 27459 - DNA, 3000 bp, Unknown
  misc_feature (1)..( 3000): 2750-1469P.txt file - cDNA_ID_2990319; gDNA_ID_2926267; Annot_ID_143342
atattcaggacgtaaatgttgcgcatatgagctgaaatacatagaaatttctgcaatagcccatgtatcatcctctatatgcctcgagcgtcgaagaagtttcacattccgagtttgaatgagaggagagatttgtggcataaaattcacattaatctacaattataaagatataaaattatcactagttctaatttttgtacggaaaataaataaatgtttggtaccttttgcaatccccgttgttgtgattccacagacacatccgcgatgattgacggaaagattttttgccaacttacctgaatagataaacaatataagaaaaaaggataaatgtgtatattattatgatttcatgtagtttgtcacacacttacatgattcataagatttgccacgagcgatgaagcatcacatgggacaaaagcagaagctcttgatacctcatgtacaaacccgggtgcgtttcttgcgtaccaaggaaataatttagagtagtattcgtcgagattcaatctcccgttacttgtccacatcggagttctttgcctcgcaagaaaaacaacttctttcagcgaaagtgacgtcataaccgccactccgtaacccacttcagtcaaagacgtagcaaatgcgggatataggttcctgaacgaatttaatctccatatgaaacaagtcaatgtatcaatctcggaccgaagacgagcattctccaaccatagctccctctcttcggttgaaatgatgggctcctcacaagatctgcagattgatggagaggtcatagcatgaatcctagctctgttttctgctctcagcaaatcattttgttggtggagaaaaatcctcgtttgaagatgatgatacatatctgaccttttcatgtgttatagtcatagaaaaaaacaaaaaacaaaaaagttaaacaactattgtgaatttgtgatatgttgtttaaaaaataaaacctcgtttgtttaacagaaaacctaaattgaaaagaattgaaactttagtcgaagatttaagaaaccatacctaccttgataaactcacagaactcctcaaacgatgaatctgtagagaaaaaacttctgctagttatgagtgactgagtattcattctctgaaaaccattaaccatatatatatataaacaagaaaaactattatgtgtaggttaataaatgaaaggctcacgagattcatatttttttgactaaaatgagacaaatgttcatcattatttattgtaattcaaagtggattctctgccaataaatttccttcttattttgtagttaatgacttttttattcttaaagatatataaaaaggcgttacggttattcagaaaatacttattctcgtaacgcttttttacaacctatctatgtatgatacgttgacatgaaaccaaaacaaagttaaagatgtagctctaaacttccgaaagattaagccatcttttccggtcctcgtgtccatttatccgtctctacctttagacaacatagatatttgccaagggtgcaaagtcattctaaaaaaatattagtaaagaaaatgatcccaaattttagaaaaaaaaagttttttagtaaaaaggttaatttattttggttttaccaaaggccctttaatagattaagacggcacatcacacataagatagtttccatctactctgtgtgaccacagaccatataacatcgtatgagtgttccgtaggcattcaaagagtaatggcacacctctagctgctacatcaacactaaacccaaaggaacaatgtttcgaaaatgtcatacgacaactattatgtgatgagttttcaactggattaaataagtctagagatttcattatggtcatctcgactagcatcctaagtttaactttaacgttcaatatataccttaagaagaagcgacgaaaatcttttaaaacaaatatcaagatgcgcttggtacgcggtgaccacatcttgatccaccatgcaattccatacatttattccacgatcaataagacacatattaccggcatggttattatgatcctttttctaagagggattttacccatctcccacaaataacattctatatctctaaactaatattcctaatggtccacacattcgaataaaacattataatcatctcttccggaaaaaaatctctttgatatcattccaccaaatatcatattaggtcttcaacgattttcgactaagacctaaaactttactcattactatattttcggaacccgattattcatttaataatgttgttcatattaatttaaacgttagagagtcctcaacataacaaatatatgttgtttttccgatattattaattgatagggtatcaagtccagaagtttagacatttacacgagccaacgaaactttcttaagaacccccaaagacaaaggaaacaagagcaaagtatcatacatcacagctttatactatcggagtatctgattgagatactcatcaattaaataataattaaaaagagaaaaaatatgaaagaagagagaaaagtggagaaatgtttctggcaagaaagaagattctgagcatttattcagaattgtcattcaattaatggttcatttactttaaactaattaaaatatattaatttaattaaaatattaattatttattttttgagatactctctaccacttttgccgatggagatgctcttaaagcaaatttggaaatccagcgcacgttagctccgttacgatacagtgtgcaatagaccacggtacaccgtaacacgtaccacaaaaaccggtattatacatttacacgtggaaagatttaattggttaacagaaacccactttctcacccactctcaaggtttaactcttcttaccgccttcaatccaaaaaaaaaaaaaaaccaaccaaaacaaaaaaaacaataaacaaattacagacagagaagagagagatcactatg

SEQ ID NO: 27460 - DNA, 3000 bp, Unknown; identical to SEQ ID NO: 27459
  misc_feature (1)..( 3000): 2750-1469P.txt file - cDNA_ID_2990319; gDNA_ID_2926267; Annot_ID_204972

SEQ ID NO: 27461 - DNA, 3003 bp, Unknown
  misc_feature (1)..( 3003): 2750-1469P.txt file - cDNA_ID_2990323; gDNA_ID_1620631; Annot_ID_47252
ctgtactgctggaatctcaggttcaggatctgttcttgctctgaattttgtttaaagttttcgaatttaggttgaaggaatctggaattagggttacttggttgtgagaaacttggatataatgaagaaagtttgatacttaaaagtaatttcacatttaaagattgaaactttgagtaattttcttcttaaagtttgaaactttggttagtttgccccactttgtttcttctgtgtgaagatcataatctgattttgacttgtgtgtggcgaattggtttggtaatgagcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctgtatgttgctaattctctagtatccttgagttgtgttgagttcatattcttcacatagagctcatgtgttttttggttatcgaacattttgcagatcttggctccgcttccaattgggtttgctgtcttcttggtgcacttggctaccatcccaattactggaactggcattaacccggccaggagtctcggagctgccatcatctacaacaaggatcatgcttgggatgaccatgtaagttttcctctttaattacatcaacggttgtgctaagtatgataagttatgaattgcatctaaatagcaactcagaatttttgataattctgctcttatctgttgtctcttttgttttatgtgtctgcagtggatcttctgggtcggtccattcattggtgctgcgcttgctgctctgtaccatcagatagtcatcagagctattcctttcaagtccaagacataaagtttcctacatattctctgatcatcatcaagctaagaatatatcaatctttaattctatatgctttcttcttgtttcctatgtcatgtgtgatgatctctatatgtaccactagagctttgatcttgtaacagtgtaaatgtgtaatctattatgtatcaatggcattgtatcttgtaacattaattatgtcaatggaagaatacattgtgtacatgtgtaagctcagaatcttgtttgaatatcacagagacataactgaactggacataggtatgctaagttgctaacattgtcaataagtgtttccaataccaaacattagcaacataattgtaaaatgtgtagaatttgatagaacaacatctaagccgaactgaactggtctaacaccatcatcgcaagtatttcttcatcttctttcttctataagagtctttcattttccactttttataacatgcttataactgaattttcaacttttgaatcacagtttcagttatagatattcttggatgatgttcagttcggggttttggttttggttttggttttggttgatagtcatgaaaatgcatgttctgttccacatggtagggttccagtaaaataataaaagaaccagatttagtaacatctttcacatgaatgataacatatttcacatgtttgatgcagcaacttgtaatatggatgatagtcatgaaagaatctaatgggccaagaaatgtgaaagagtctacatgactatcatccaaaaaagagttgtagcaatatggatgggccaagaaagtgcaagacttcagcttgagcttgactttaagagaataagtaatttgcatttgccctttggtcatgtagtactcgggttgtttacatttatcaaacaaatatcagagttgtttattgttatttgggaaaatctttaaactttctacataatctttgagactagtgggaattaagagtggtgatgtagtggatcaagattaaaaaaagttgattgtttaaaacatcgagtatcttgcaatacaaaacaaaacccttaaaccaatcaatacgaaaaagatgaagatgtcaactttccttttcaaaaatatgcaagtttgaatccggatggtaacatactgatgttactagttacacaaatatctaggctagatgtcctaatcatcttcaaaatattttgttgatgttttatcttaaataatcaaagtttttcaattattgtgggtgttgtatatatttaacataatcttaatccataaacaaaaagtaatataaaggtgttgcgggaaaaggttacttaatggttaagaagtttggcttatgatcatcccactttgtgaagtatggcatgaactttctttttaccgatattagagccaaatgaaagcggtttcttaatcgccaagttccaaccaaaaaacaaaaagcccacatttacgaaaaatactcttaaaccaacattttgaattcatatgatacaaagcttcaaatatccaaatcgaggaaattattttttaaaaaaaacaatacataacttttaaatataaattgcgaaaaaaggtaaagccactcatcaaaattcaaaagtgatgagattaaagcaagtgaagacgcatacattatcacattaaaagtagcaaacacaccaagaaattagataaaaagataacaaaataattccatccactttctttttcttttgttttgtcaagattttgttttttgtatttcagtcatacgtgtgaatgtatatcaacaacattgtttttaatgtataaaaatctcaactactataaagtagctgaatgatatgtgattaagatatatatcgagagagacaagccagcaagaattttcagcacacatacacacacaaaagattcaaagaatcatctagtaacaaataaaaaaggagagagaaggaaaatgaacagaatg

SEQ ID NO: 27462 - DNA, 3003 bp, Unknown; identical to SEQ ID NO: 27461
  misc_feature (1)..( 3003): 2750-1469P.txt file - cDNA_ID_2990323; gDNA_ID_2926182; Annot_ID_140608

SEQ ID NO: 27463 - DNA, 3003 bp, Unknown
  misc_feature (1)..( 3003): 2750-1469P.txt file - cDNA_ID_2990331; gDNA_ID_2926046; Annot_ID_196095
cacaaaatatcaataatggactgtttggctacaagtttgcggcggtcaacgctaaacactgtactaaacgctaaacacactttccagatcgatatttgttatctatttctatttgtacttgatccaatttagccagccatttggtattcacatattcgctaaaattcaaatgtttgatcaaatatcgatcagtttgctaaatcttattggggaaattaaatttagaagagttctacaatttccttcatgttctaaaatttccttcatgttctaaactatatgtgaaattgtattctaagaatttctatagtttctaaaaacattagaaaacgtttatcgacaaattccttcatgttctatagttttttggagagatacttatctcattcattaaattgaatcaaagtacaaatataagagagattcaaatatcccaaaatttatcgacattagatctataagatattctccaatgctaaaaataaaataaaaactatgtatcaattagatccacaagaaattggagaaaaaagtggatagcatcttagtgcaaagtgcaaactagttcatagttaatcaagggttcatccacaagaaatgagaaaatactcagttaaaaaacatactaacttgaagacgattctaaaaccttggttctcaccggcacgagaagttctacacaacatttaacaaacattttttttagcaaacatttaatttatgtttggatttattttttatgtataatgacgtcgaatttcatataatgttttaacaaacatttaacatgtgtttggatttatttcttatgtatagtgattagtgacgtcgaactccatatgaattaacttttaccaaacattttaacatatgtttcgatttattttttacttttacagcaaattcaaagtttttttttttaaagaagattttttagaaaaaaataaaaataatcataagtagctattcatttcaagatgaaatcattaattatagtgttactgtgtaagtttaactaaaatatataactttgtgatattttaagtatagttttcaatagtataactctataactataaacttgtagacttgtatccatagacgagtcacgagagatgatgtgtttctctcaaaatcacacttcaaataaacaaatgattttacattgtttttggttcaaaaagacaaaaagatgtttgtttttcaaaagcaatggtttagtctaaagactccaaaatctaaaccgatatataacgttttgaaaatgtgcaaaaatcagtgatggactgtttggttacggcgatcaacgctagacactttacgaaacgcactttccagcgtttttgttatgtataaaagttttttttgtttaaattcttagttattgtgctttcataaggttttaaagctttaatatatagtttgctaataatatttaccagctggagttgggtatttgatcgaatatttgaattttaatgtatatgtgaaagatttgggttagatacgatcacaaattcacaattccacaaaaccgtataaataataaaactcacaaatattaaattatctaaaaacgaaacaaatcataatttaataaacaaaatcagtggttttaaaataaaagcgaaatttaatatgtaaaaagtgaaacaaatcatatatattaaaataaataatatttgatatatatataaatgtatatatatatgtgtcttgtttatatatatatatatatattgattttgtttcttaattttataaaattcaatgaatttataactaatttgatcactattatattttttatatacatgatattgatcaaattagctataaaataattgaatcacaaaattaaggaacacaatatctatacaaaaagatacacatatatctatatttttcaaagcatatataatcaaagatttttaatttaaatctttgtgatttgtttcgtttttagagatcaatatttcatttgctctgttaacttatgttagccaaaaaaaatgaacaataataacaaagcacataaggtatcgaaactgatatttaagaaatttgacaagccccaaaattaactattcttgtcactatctataataacgactaatagtttaagattaaagtaatttattgtatattccttggatcgactctataatctattgtctagtagtatgatatagtagtatctttttttttggtcctccatagacgaacaatttagacgagataatctaggtgtgaacaaaaagaacggctttcttctccctctttattgttagtcaataaaagataacttataaaccaaaacatagcttatacatcaaagagtcattacatcgacattcatgtatctgaaaagatattaaaacaaaagattccgtgaatatattaattggtacatataaaaatccaaaaacatactactaaattcgaataaataattatgtttagggagcttcacttatttaagtatagcatctatgactaatctaattactacacaactgatctacacaaaataattaactgaacaaaatacttaaattacaaattaattaagcaaacggtcttcccttgttaaccaatcctatttaagttacgaaactagggatagtatatgaaatttaattcataattaaacatttagtggatgaattaattgtaagagatatataattactattaatttataagattctatgttaggttgaatatattagaagagtccagctcataactcttgtgcccatctccacaagtagtttgtgaagtcaaacaaaaacttccacttttaaaattttctcttatttctttctctctcataagtcataatattcaactaattaagtgcatatatatacgatgtatcagtgcttataatcttcatgaggagctttatatatttagcataatatctttcagaagtgtgaggccttgttaattaagctcttcttctctatctctctctctccctctcaacctctcaccatg

SEQ ID NO: 27464 - DNA, 3000 bp, Unknown; identical to SEQ ID NO: 15075
  misc_feature (1)..( 3000): 2750-1469P.txt file - cDNA_ID_2990335; gDNA_ID_2685558; Annot_ID_193394

SEQ ID NO: 27465 - DNA, 3003 bp, Unknown
  misc_feature (1)..( 3003): 2750-1469P.txt file - cDNA_ID_2990339; gDNA_ID_2926232; Annot_ID_142691
caatgtcaaatgtatgcaaaagatgtttaatgctttattgttgaatgtctttgttataacacaaaaaaaatctctttcacatttttctttgctctcgtttattcgcatagcattggattatcctctgctttgtgaagaaaagttggacaatagaaatcaagtgatcaatgaaataaacttatgttcaacaactatgccttctttaggtatttgaacctacattgttttcactaataacttaaggtatcttcttttcccaccaactcccatgaactggttattacaatgtacaatgaatacaatttaccactctcatgacctgattattatatcttacccacaccaatcagtgagactatatacattccttacaataaaaaaaactatgcaaggcgccacacttcattctctttttggtgagtgtttaattaggcatagatatatgcaataccaatcgcttgaatctttaacttagtgaatgtttctctgaagtaacatcttcacactatatatatgcgctacttctgatggaatgtgcaggtctggtatttgacttatatatctacatctattatttattctctccggtttttcatggtgtctttctataagatcttataataaacctctcttttttttgttgtcaaattctaaaagcatagccatctcttcatttattttgttttctctggatgagaaagatcaaaaatagtttgggcaaatatcatatgtttttaaatatgcatgtatctgaaaaataaaaatgtctgtagaataaaaataagaatgtaagtaaaatactaaaatcaatcttctaaatagaaacagaaatcttataacaatctttaaatatatgtttaattataattaagaatttcatattcacaacctgccaagtatatcagagtggcgcagcggaagcgtggtgggcccataacccacaggtcccaagatcgaaacttggctctgatattaaaatgcataaatttttttagttagttttacatttagataaaaacacataattctttatagtaaagaactaaagattaatgttttgtactttatgtactattccatatcaacatatatttgtattagtcttgggaaagcaaaaaaatttgaaagacttttttttccaagtatgaaagatttagttaaaaattttaatcagtaacagaattcaagagtaatgtttattacataattatatactttagaaacctgctccagttttgaataaaataaaataagaaaatatttgttcgaaactccaaatccagctgaattagttttgcatgtttttgcacgaaaaaaaagaaagaatatatagtttacgtatgaccatattttatgttttaattttaagaatttccatccatataatgtaaacccgtatattttgggatctactatcatgtaggctgtagtctctagctatagccaagaaaaaaaaatgacagatagattgacaatcgttataagaaaaaaaaaagattaatactcttaatcatacacaacccaaataaatattaaaaagatacttacgtaaatgatatgaaacttatttagataaatgatcaaatagaatcttaatctaataattagtaaaaagtcaaatacacatgtgaacgcgatggagatatctatatttgttgtgggaatgacttaagtcgactgtcgacgtcggaaaacaaaatttcagagtcatgactgaaagaaaattgaaaattccatcataatgttaagaaaaaaatgtaataaagtttttgcatgagtgttgattttccttttgtttctacaaagtcaagccacgtacattgcgtaaaggctgattttgatttataaattcattttagacttttcaatactcaactttctataaaaatatatactttattgttatctcaataacattgtgaaagctgtgtgttaccgttattagactcagtcattcgcttcgtcacttgtacaataaaatgtcgtcactcatagacatattaaatcctcatgtgatttttttgttagcctatcttttttttttttaataataaaacagcctgttttagttgcaccttcatgtgcgttttaccgactgaattggcgagataagcttcggattatagcaacaaagaggagatgtgattcgagtcgattgatatagatacgaatctatttgttacaatagtaaaaaaaaatataaaaatatttcattttcaagaaataatgtcataagaagtcaaaggaagatattgtcattatggttagtcaaataaaaaaattgtaagccagcagttacgttcatacctgctttccgttgacttttataataactacactagtcttttgaaatactccattacctaattgcatttgttccaaaaatataccactactagtcttaataaattgtaattagactaggaaataatttttatttgaccaaaattatattaagaaatttggatttttcttaataataatcagttgatagtaagattttatggattggaataattgatttcctttccaaaaataaacaatcatgagatcctttcataattattttacactcaagattcttttctattaggggagaacaaataaaaaataaaagtgtttcctttttttttttttttttttcaaaaataaaagtgtttccttcatatataaatacatataaaacttgcgttacccattttataggatctcgtgcaaataattcatacatacagacgtatcgatcttgctgacccatcaattaaattttgacccaaaaggtcaaattcactataagaaaaacagaattcatttcatcaaaattccatttcacactttttctgtctgttacgattcttgcttgatttctttctaaacaaagcaaaagttgtctttttggagttgtgagcaactaattctctgaaattgaggaagagaaagcgagaaggtttttttggagtcagagacagaagaagaatttaacagattcttgtcggaaacatg

SEQ ID NO: 27466 - DNA, 3000 bp, Unknown; identical to SEQ ID NO: 6558
  misc_feature (1)..( 3000): 2750-1469P.txt file - cDNA_ID_2990343; gDNA_ID_1621097; Annot_ID_171133

SEQ ID NO: 27467 - DNA, 3000 bp, Unknown; identical to SEQ ID NO: 6558
  misc_feature (1)..( 3000): 2750-1469P.txt file - cDNA_ID_2990343; gDNA_ID_2926165; Annot_ID_199067

SEQ ID NO: 27468 - DNA, 3000 bp, Unknown; identical to SEQ ID NO: 10913
  misc_feature (1)..( 3000): 2750-1469P.txt file - cDNA_ID_2990347; gDNA_ID_2214462; Annot_ID_133003

SEQ ID NO: 27469 - DNA, 3000 bp, Unknown; identical to SEQ ID NO: 10913
  misc_feature (1)..( 3000): 2750-1469P.txt file - cDNA_ID_2990347; gDNA_ID_2214462; Annot_ID_182805

SEQ ID NO: 27470 - DNA, 3003 bp, Unknown
  misc_feature (1)..( 3003): 2750-1469P.txt file - cDNA_ID_2990351; gDNA_ID_1620797; Annot_ID_168508
aagacgaatatgatgaagaagaagaacaagtttacgaatcttgatcttacaacacaaaccaaaagatgaaaaaacacagaagtcacatctctatctcttttattgaaatctctattcctactattaccactatatatatatatacatgtatcaagttgaagaatctgggaaatgtgtttgtttgtttgttactttatctttgtggttctctcttattgtattttgcaacttagtttcttcttttcttctcattgcctttataataaagagtctgtccacgtatctccctctttagccttttatttcatagtattcaaaaaaacgattcttagaatcctttcagtttatagtatagacaaccaaaacattggaaacttggttgcatattcgttacaaaatcctgctatttctgctatataattatcaccccaaaaaaaggtttatcaaaaactacttaaattgataagaagagatgaatctattaaaaagcttcttagatcgaatcaaacctagtcttctttgtcttgcttgagcagctacttggactttatttggcactctctgaaaaccctcctctgctgctggaagaaggttcagatcaaagccacgtcgttccaagttatccattcgcaacgacgccgtttcaacatccctcacattgaccgtacgatcaaccgcaaaaaacggtagttgttgatcgtatcttatgggctgggctattaaaccagcttgctccctaagtaaacctgtctccgcctgtatctccacagaatattatcaaaacggaaacaaatatcaaaaatgctaaacatttttttatacaaaagggaaaacaaaaaataaaaaggtaacaatgaacacctcgaggactgaagaactctgatttttcctacaaaattcttcttctaaaccctttttaatctgtcgtttatatcaaaaacaaacacaaaaaacaattactcaataccaaatttaccacataatgaattttacacagatacaaattagaaaaatttaagaacaaacacaagaaaaacaagtctctgtttaaactgagaaaaattaagacttacgatttgagaattggttttcttggcctcaccggttaagcacgaagaactcgaattacttcccatatcgccgacatcagccatacacggcagcgattttatcaccggttccggcggatgcaggtgagaagaagaagaagacctctttttagtgcgaccccatttatgtaacacaggagaatcagaagagaatatgacaggatgtgaaagttgcaataagatagaagaaatttcgtagtcaatgctatcgaaaaaatcatctctcttcttgcctttgccgtcacggtgatcttccattgataaactctgtgtcttcttcttcttcgacattgaatgaagagagacacgaatgaatagtcttctcttcttcccggcttgaaacgattgggttaatgagataaatctttctcagaagattttgtttgtttttatttttcatataataatttgatgggtctaagcttatgacacgtgtcagtacatttttttggttaaattttcttttctcgtcttttgtttcttattttttttattttcgagtttcttgttttcgtcgtaactacctttttggccaactaatttcagtcaattttggaagtaaaaaaataggattaatccccaatatgtcatgtaaaaaaatacaaaaaattatttttatttctgatattttttcgactttcatatcttttttttatggtataatattaatttccatccaaattgggctttggcaatgggttacaacaaaaatcaatggtggtctctttctttctccaaacttagcaaaactcacacaagactttgttctgatgaagcaaaccaatgttgaatgttatgagcttaacaagtttggtaagagaggtgtgttgagtttttcttaattagtttttatgtttggagtttttgactcaccaagtttcatttgattgttcagtggcaaatgacttgaggatgaaaagaaaacaattctgatttctgactatattagagataatcatcaacaccactagaggaaagattaggagaacaagaacctcataaaataggggaaagtgggattgtatttagatattggaaagagtttagctgtattattaaaaacaaatcgattattgaaataattgcatcaatcaaatctaaaacttcctataacctatatttttataattaaagctctaatttttatttcatctactgtttaatcttaattactattatcgcacgtatattccaaatcaaattcttgaagatcaaaactgattctgcaaagatttggggagtgttagtggattgatcacctcagtacattttaagagcactatactaaattaataattaccactctaactaatataatcattttgtggaatctgatacagtctaaaatcagaaaacaagatatttacatagccgtagaaacaatcattttacaacacataaaattatgcaagaaaaaaatacaaataattatgaatcaatactacacaatccaattataatcgtttaacaattcattacaaatattttgaaatgaacttacattaagtttgaagaaaacctattcaataaagtttctctatgaatacaaagagacaaattaaaccagagtcgttggcttaccacgaatctaatttccacctaaacatacttaacaatccacgtgtcaccgtcataaagtgttaaaacttttggacttttttgttctgtaagaaaaaaggagtgatttttagcaatgggtgcgttaccaatttctccagtttcccactccacatccaaaaaaacagtgtaataataatcataatcacctgatcaatctcttacataaaagctacagatctggttttatacaatcatcaccgcaccaagttcctaaaggtttcgactttactgtttctattttcggaaagagagtgcaagattgaaatcgaagatg

SEQ ID NO: 27471 - DNA, 3000 bp, Unknown; identical to SEQ ID NO: 5045
  misc_feature (1)..( 3000): 2750-1469P.txt file - cDNA_ID_2990358; gDNA_ID_1620758; Annot_ID_167068

SEQ ID NO: 27472 - DNA, 3003 bp, Unknown
  misc_feature (1)..( 3003): 2750-1469P.txt file - cDNA_ID_2990367; gDNA_ID_1621103; Annot_ID_171498
tgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatacaaaacaaatcgttttctacttctttgcttcacataagttaaaagtcaaatatttaacaaaaaagatattaaaagtcatattgtagttgctttcaaggcaaaatatgtggacagatcattacacgtggatgatgtttgtaaatatgccacaaaacctgcattacattattttattctatctcatgtaagttacagatcttacaatttagcaacagaaagccacaaaatattacataaattggctcgtctcgaatctagcaaccaaaaaaattcagcccagttcactataaagaatataaaaaaaagtttcctaaaatagtgtataaaaccgaaacaaactaattcaacaaacccgaaataaacaaatccgtacgacaaccaaaaatatctttcagatgggttccacaagataacccagtgccaatcagaattctgaaagcgtggctcgaccgcggaaaccattgtccataccttctcttctttgtccccccttacgtggctcgctgtggagtctcgtaccacgtgtcgcgtcacttcactctttactttctattttccactaaaatcataatttgtctttttcttgaccatacccactcttttttcttctcgttgtcgtcttgcttctcctaaatatctcaaataacgtgagagacttgagtgtgagaggtaggtaacgaggcagactttttttggaagcgaatataacttatgctgatattttatttagctttctgattggagttgagatattatataggtattattgagatattatatacgtattattgagatttgagatattttgtagattttatagttctatcggactaattcttggcttaatccactaacatgtttttgtttagttaattaaactgattattttctgcgctatagttttgttaaacaccttttagacgtaacaaagcaattacgcttgatcatccatcgtagactctttttctttttttacatctcatagaagttttgtttaaacacagcaggaagtaaattattttcttattacgtacgtatgattgtttttagactattttagtactttgagaagtaaaattggggatacgagataaaagacaattgattaacatgctttttattttgacttccgaaactaatcatggttgtctatgtttataaattgtgttctttttgttgaaaaactcagataatgattaaatcagtagcgaatggatggagaacacatgattttagattgcataccgtaaaacaaaaaaaatcatgatggatgtagaacattcaaatgggtcaaataaatacgtatgtgatcaaaagaaagtatgtgatcaaaagggttagcacgagtaccttgggaggaaattcttctaattatgaattatgcaagaattttcgtcaagggaaggtggggaagaggtagctaaagaatagagaatcatatgactaaggacgtggtggttgaaggaaatgagagaatacatgaagaagagaaacttctttgagtgagaaggaagtgcgctggctggagagaaaagagagaaaagagtttcgagtgagagagagggcgttgagattgtgatcaacttaatgtaatatgttcttttattacattttctttttgtcatatactcaaaccttttactattttgtctcataaatctaacacaccccaccatttgttaatgcatgatggtagaaaatattaaatataattaactacttttatgtgatcaaaattaggtttcagactcgtttcgcgatccgatctacaattacaactgcatgcttctaattgatctaaattctaaattttttatacatattaaaaaaacaactttttgttaaattctcaatcatcatttttgtgattaacaattttttataactctaaaccaataatatttgattatttattttatatgtataatgatgattgagaattttaattagcagtctatttagggttttcctaaagttacaatatgttgttacccttctagttaaattttccaaaataccatatttcataacttttcaaactgtttattaattcaaccgtaaaaagcactaaaatgttacatttgatcattcacccaaattaaattcaaaagtttttccgccaaaactacttggtgacttacgtgcttatatacggacgactattattatgttctatacttttttatactttgttgcacaaatatctactctcccaattcatattctagaaggatgtgctataagaatgggagaaattacacaagaagagcatctttaaatatcctctcacaatctttatgtctaatacacgggtgaacaattaacgacaatttctttattcaggaatataataatgaataacggttaccctacacctagtacactaaatccttaacagccacacattcatacgcaaagagtttataaaactcataaaggtataataataacgagtgaataagtcaaaaaaagtcttctctggacacatggcagatcttaatgagtgaatccttaaactactcattttacaattgcttcgctgtgtatagtttacgtggcattaccagagacacaaactccgtcttcgccttttcttttgcctctaaaatatcttccgccattataaaacagcatgctctcactccaacttttatttatctacaaacattaaatccacctgaactagaacagaaagagagagaaactattatttcagcaaaccataccaacaaaaaagacagagatcttttagttaccttatccagtttcttgaaacagagtactcttctgatcaatg

SEQ ID NO: 27473 - DNA, 3000 bp, Unknown; identical to SEQ ID NO: 4703
  misc_feature (1)..( 3000): 2750-1469P.txt file - cDNA_ID_2990367; gDNA_ID_1620723; Annot_ID_165876

SEQ ID NO: 27474 - DNA, 3000 bp, Unknown; identical to SEQ ID NO: 4703
  misc_feature (1)..( 3000): 2750-1469P.txt file - cDNA_ID_2990367; gDNA_ID_2926187; Annot_ID_200725

SEQ ID NO: 27475 - DNA, 3003 bp, Unknown
  misc_feature (1)..( 3003): 2750-1469P.txt file - cDNA_ID_2990381; gDNA_ID_2684116; Annot_ID_190814
acggatctgccactatctccggttcgattatttttggttggcgtcggttaaagactgatttaatttggtggtggttttatttcaacccaatgattatattttaatttttgttcttctacatatccgatattttcagaaatcatgtggaaataaatctaaaaatttagaaatttagttacaagttttataaaactaatcgtctaatacaatgaaatttcatcaaaataattatttttctataaattatgatgatctaagtaccggattaagaacaaattacaaataagaatactgtacacaacaaaactcaaacatgtgacttcagaaaatattttactcgtaaattaaaacataaacatacacgaatactatccttcatatatatctttgtatctaagagtaactcaatgttcaaaataaaatacagctaaaaaaagtaataagcaaaagaatatgggataaactattttaagctgaaaaagtaacaaagtgatagaacacactcatgcatcattagtttatgtaacaaagaagaactcattttaagttgttgcaatggagacttgcttcaaaacctttgaacagtccacaagtttcaagcttttaaacgttctacagatgaacaatggaataaacgactaggccattcttttcaaaagagtgttcataagggaaatatcatccacatgcatttggaagctctttataagctttcgattttgcccgtacctaatgattttcgtttgtccatctaggaagtactcgatttaaagtttagaactaatttaaacaatcattgttttgataaggttaagtatttgaaatcacttttagatgactttggaatagttttagaaggttataatccagtgaagtttaacgatgcatcgttattccttaacataaatagaactctaacttaaataaatttcataacaaaatcaatatttttaacgataatgttggaacataaattatatagcgcatacgattatttagaggaatttgtaaactaaatattaatatcttgttcgaactcgaaaatagcttacttttttttcttcataagtgttggctttgatatataacaacaaagtgttacaatagtggaaaactccacttacagaattcgataggctaatgagcattacgatattaaattatcaaacacatatagataatctcctttaattttcatctactcagaattgaacattttcataatctgcaagttctgctttatcttgtctgctttcattggaaatgaaatggtatatgttggtcggtaaaagacgaatcaaatttgtaaactaacaatgaactattgaaagagtaaatcttacagaaatctcaaaagaaaataagatactaaaaagggagaaactgaatctctcacttaatccccattcggggaacctttacacttaacacgcgatctgatggagccatgagtgcaatccaatcaatccaaaacttctgcaaggccctcttacacagatatcctaacgaaaagtaaccacaaagatccgcttctcaactccaaaaccaatttgcgcaaatagagattttgcctattttgctatctctttcttcttaaaacaaagccttcttaaaacaaaagtccaacaacaaaagtcaaaccgagcccaatatagtaacccatcgaggaagggataagaaagccatacaacacagagacatgtgtcgcctcatgaggaaatcacagacacgtgacgagaagaacgtgtttgtcgagaatgccaaccactgccggcatgttttctgagatcgaagaacgcctacccaccgaaagttcgttcactccgcaaaaccagaagcttcaagtagagcactgaagaccctctaaagaaattgcacatctagtcttcctcttccaaacgaaattaaactcagatttaacaaacgaacgaaactttctttcatatgaaggaaagcgtccaccattccaaagtagcatgaagcatcacaatgacgtaagcaaccaaaaagattttccggtgagacttaacgtcgccatgcccatcaagtgaaactactacaaaatttgaacgacaaggcttatgaagccgaaactcttaaacttccactttttcttcgtaatgaagaaacttaataagtttattagaaataaagacaaataaaggcaaaataccaaagaacggcgacgataaaaccggatttaccggtaactataactagaactcaccgtacggtattgaaacaaaaagttggaccatgtccgaacacaacctcacaaacatacgggaaggcatacgaaacaaagaattttttctttttctcaaaattttagagaaagaagagaataaaaaaattctgatcgaaaatagcttacttaaaaatcataattgaatagtatcttttgtttttaaactaatttagtctatataataataatattattaaccatcgtaaaccacacatgatattcaatacttataataaattaatcgcataaaatacaatacttaaaacgagtgttatataattttacgtaacgtaaaacaatacaaaattttaattcctgaacgaataaaacgagtatattaattaatttattgatcgtattaaaacgaatatgatccaattaagattacaattactaaaatccccacactattattgtcattatttaactatggcagatagatagatacagaaccgtaaaggacgttaggaagaggaagaacgttgacgaagtcaacaacgaacagaaaccgtcgatttgaggcggctctaatctcaaccacacgatcttctctgcctttccctcttctctcttcttcttcttcttcatcttcttcctcgcaattaccgcgaaaactcatctctgctcaatcctcaatctcagtctctctgttgactccgactgttatataaaaccatacaaataccttcagattcactacttcaaacctcaaagcaaccactgaatctcgactttgatcaattgagagagaaatg

SEQ ID NO: 27476 - DNA, 3003 bp, Unknown; identical to SEQ ID NO: 27475
  misc_feature (1)..( 3003): 2750-1469P.txt file - cDNA_ID_2990381; gDNA_ID_2926275; Annot_ID_205289

SEQ ID NO: 27477 - DNA, 3003 bp, Unknown
  misc_feature (1)..( 3003): 2750-1469P.txt file - cDNA_ID_2990389; gDNA_ID_2926232; Annot_ID_203724
aatattcttcttctgctagtcgtttgccatgataccatttttgtcaccaaccaaaaatgatggcaaatgatgtactactaaaaactatgtgaaaatgatttaacaatagttttttacaattaaaatgaatatttaaacaatttagatactataaacctttataaagaagaagcaattctttctcttactactagttttgaaattcttgtataaatgctgaatatattggatcacgttccttaaccacaaagagaattcgaagaacgtagtgtcgtaatctggcccatggtttcttctatggatcatgcaaaattaacaatttggccgacgtgcaaaacaaaaaaagaaagcaaacgaatatttatgtgtacgattatgattatctatatatgtattttaactattattgtatatattcattcgtggggtcgaatggtcacttccaagaatttatgccacatttcaagatatatgttcagccgcatggccgacatcatcgttatagtttgatatcttataagggttcacgatccaaatttttggtacatgacaaactgacgataataatcaaattagtatacgaattttcgctatgtggatttaaattagggttcaagtgcaaagatgttgtaagtatagttaatcgaaatcagagaatctaaattactttaaattaatgtctgatcaatatatgccgcacattctattttctataacataaggaattttattattatttcaaagtaagatgagatactttgtcaacccatgcacacaaaatatgaaatatcttatcttttctttcttttctatttttagcaaaagaaagaaagaaagggaaaaaaaaaagaataatatcttttgtgcactacactatcataagagttcagccaatatgcaacacgagccatttggattttggtaggatggtttcaatggagttactaattaatttccgtataatggaattaactatatagcgtttctcgactcaatagtgacctccgaatttttataaaacaataataataattaaaggcaaattttgattggtactgtttgaattaaattgttaaaaatgtattttgaagaaaaagaggtcatcacgacgagcttccaaaagtggaaaagtctagtgccgtcacgttcagagactatataatacaagcaaacaagaagttacacttatttctttttccttttctgcagttttcttcacgaactggaaaatctcgtagccgtttagatattttccttgcatccttttcacgagagttttaaaaaacttgaacaacaccggctaaaaaaggtttctcttttgtttggaacgactctattagaaaaacgtttgattgttctaaaaggttggttaaaattaaaactcttgacataataagtcttctattttgttttattttaatatacgtggtgacaagacgacgcatatagaagaagaaaatccaaagaatcattatcactgtgctattaaaaaaatttcatcgattaaaagttaatagagacatgtcgacaagaaataaaagttaatgtagacataagtgagctatagaccgacaggaaaataaaagaaaaacagttaatacattttttttatttatttatcaaacagttaatacattattaaagttaattcagtcatcgtgaaaaatgctttgagtgataatcaaaacgagatttagcttaatacaaaccaactactatagaagaaagaaacagaaccctttattaaacataaaaataaagataccattcgtgctacatcaggaaaagtattcgacaataattgaatggagacactgcccattatgtttgatatgcatatgttctcgagatgttgtgaagttctaaaaaatcgaatagagatatgcagatgttttttaaaagatttatattccaataatgggctttagctgccctctttcctttgcaataatgggcttttactctaatttgtagtagtttttttttctataccactaacttgtagattatttcaagtaagagacataaacaaatacagtataaccacgtttgtaaattttggttaaattctgcttagcaaaatgccccccaaataaaattaaatactataaacaccaagtttacaagccaaaaccaactacactactacagtatttttaattttaaagaatccacaacatacaccattaatatcataatctcaaacccaactttaatgacttttgattgccacttaaaacatctctacaatacctcattttacatgctccaattccccattaccaactataatcttactccatctcttattcaccacttacatttttccaaatcacattctcaccaaaaaaaaactgatttcattataaaaactctcaacatttttttccaaatataatcaaaatagttttcaaaagtagtcttgactttcaacattacttttttttttttttaacatcttcattttattgatattgtactttcaacattccttttcctccaaggctttcaaacaagataatttgtcttcttttttttttaatttatttaaaatctttttttaatgatgtataattggagcctcctttaaattagggcccaaacggtggcttcttttagattataacccagggccggcgcaacccttcttcttaacaaaaaccttttgattccaattgttcttctctcttcttcttcttcttcttcttcttcttcttcgccgcttcttctctctcgaattcaccccatctcaagtaagcttctcctatttccttgttataccaaacaaacaccatcttcaagtcaattgattttgttaccctaattgttcccgtccccgtcttgtaatataatcgaaaaatcgaaactttctgttttagagacatggattttgtgaaccctaattgttaacgaatcgttgatatctgtgacgtatataaaccctaatttcgttttcatgtttctttatctacgcaggtgtacgttagcctcctccctctaatg

SEQ ID NO: 27478 - DNA, 3003 bp, Unknown
  misc_feature (1)..( 3003): 2750-1469P.txt file - cDNA_ID_2990391; gDNA_ID_1972029; Annot_ID_178214
gaatcgggagtttttcaaagcttactatcttaggctaatggttaaacaccagataatggaattcaacaagttgcttgagcagcaggttcaccacatgcgtcagatgcatccaactggtgttgcttctgtccaaaacacaaatggttctcatcttcaatcaagtaagattcgtttggagtgagatggattttaatttctgcattttagggtctctttattgcttgtatacttttgctatgaattgttgttcaagtgttgtagtaaacagtcctcatatgcattgtcttgttttctggcttccacttttgctgccttagttcttttcaaggtttctttttcctgtgaacattatgtgtttgttgttttccttagattagtcattcattcaagtcgctaactgatgagtattaaatagctaatctatgtgattttcttaacagtgaatcagaaacaattatgctatccctctgagcacactgaccaatctttgaagtctgaaagtgcacatcatccaatggcttctagtctgtctaatgcattcctcaatggctcttccacactcaatacaaacgtgccctcttctataaacatatcaacccatgctaggagagttgatgcttctccaaatatgctctcatcgcagaccacaaacatgcctatgatgcaaggaatgaatggaggaatgatcaagtctgagactgcctttacaaaccctgcttcattcatgtatggtggcgaacggaatgccctcgaaggacattcggcagttggggatacttcgattcctaatttcagtaacgagtccaacaaccaacccctcagtgatccgcttcttgaagcagaagcttctacttttgggttcttaggtcaaattcctcgtaactttagcctctctgatttgactgctgatttttctcagagctcaggtctttctccatctcaatatctcatatactcctttctctctcgttgttctgacgtcttagcatgcgtataacaccaagtagttattagtggttttctagtacaagagccagtaaacagctaataggataaattatttgtcgtaaccataagtttcctggttgatttcagagattctggagagctacgatagatcacccttccttgtgccgaatgctgaaaacttcctggactcccgtgacagaggagaatatcaaggtgagagagctctaggaatctttcttactttctgtaatatatcgcaagtaatcgggtttcaaattcttcaagacacaatagactagctcgctggtttagagaaagtagaagtattgaggcaacagacagaagtgataatggtaagtgtgtgtttttgcaggagacaacaagagattggataccatatctgaaggtttcagttacgataacatcgggagcgagtagttgggtattaggtaagaatatatatactcatctgcctcaaatctcaggttgcactttttttttgaatttgcatttccaacatcatcattttttggtttctggaaactatgcaggttttgctttatcactaataacataggacacgtttgtgtacaaaagattcagcatttgatggttttcctttgcaaagactacttggtggggtgtataaaaagggctttctattaacattgttacttaagcttgaagttagtaataagtttaagaagaagatcatgtaattttcagtgtgtgattttgtctcttttctcttgtgttttagttatcttttttacttgttacaattgttactctttttttttccggatataagtggtttggatagtgccgaaggctaaggatagagtcaaagtaaggaatcgaaaagaaaccagaaacttgcatataaagcaagtgtcattctaaagaacacaagaacaaaaaaaacaaaacgaagaaatttcttaagtaaaagagatctgactctcaacgtgattcgggaaaacatggagcgtgtaaccatgttcattactgagcacaaactcgtcgtcagtgaaccctttaagctcgaaccttctagaagtgtttctcaccggatcataaaagaaaatcttagccgatttatgaaacatggattctacataaataatctcaccagcatgagtgaaaccttttagtaggaacttattagtactcaaactcttatctatgtgaacaagaggtgcaagaaagtctttactcgaccacttgttgtgtttctccaaaatccacaatctaataccattcttctctattatttctctaccaacgcaagctaacctcccattataatctatcagcacatccttgtgaacatccgatgatggtaactcgatcatatcgaatatttcagatctgacatcaaagctcattagaacccacacacacatatccttgacataggctatatgatatacaacaccgttgatgcatctcccagaatcataatagtcagaacgatgcttattatgagttttgaccgttctccataatttttgagctgatcctaaggttaatactcgacacgtatcataagttgctgaaaactccatgcacattactttgtgtttaccttccactggatcgtatcctaaaaagattgttagatcattcgagttcccattgggttttggtaaaattaacaactgtcgcgtactagggttccaaacaatcagcctagctgattcttgaaagcagatcaagccattgacagattccgtaggggggaagtaattcatttcttctgagaattccatatgataacgatcaataagctgagaataagagtgagacttgttccaagtctcaaacgtctgacgatgttgcggaatcgaggaaacaaaaaacttttcatttgctttgaagcagagtaaaagccgtggagacctagttgttaacaagttgatgaaatatggctcggtggtgattgatgaccaaggcttggacacgcaacgaaacctcgcaacagatttctcaggcagtcttaggagtatctctgagactagatctagaggaatg

SEQ ID NO: 27479 - DNA, 3000 bp, Unknown; identical to SEQ ID NO: 11166
  misc_feature (1)..( 3000): 2750-1469P.txt file - cDNA_ID_2990399; gDNA_ID_2214481; Annot_ID_183347

SEQ ID NO: 27480 - DNA, 3000 bp, Unknown; identical to SEQ ID NO: 1526
  misc_feature (1)..( 3000): 2750-1469P.txt file - cDNA_ID_2990403; gDNA_ID_1620413; Annot_ID_156318

SEQ ID NO: 27481 - DNA, 3000 bp, Unknown; identical to SEQ ID NO: 852
  misc_feature (1)..( 3000): 2750-1469P.txt file - cDNA_ID_2990406; gDNA_ID_1620328; Annot_ID_153574

SEQ ID NO: 27482 - DNA, 3000 bp, Unknown; identical to SEQ ID NO: 3291
  misc_feature (1)..( 3000): 2750-1469P.txt file - cDNA_ID_2990410; gDNA_ID_1620636; Annot_ID_162910

SEQ ID NO: 27483 - DNA, 3000 bp, Unknown; identical to SEQ ID NO: 3291
  misc_feature (1)..( 3000): 2750-1469P.txt file - cDNA_ID_2990410; gDNA_ID_2926204; Annot_ID_202060

SEQ ID NO: 27484 - DNA, 3000 bp, Unknown; identical to SEQ ID NO: 14374
  misc_feature (1)..( 3000): 2750-1469P.txt file - cDNA_ID_2990413; gDNA_ID_2684112; Annot_ID_190647

SEQ ID NO: 27485 - DNA, 3003 bp, Unknown
  misc_feature (1)..( 3003): 2750-1469P.txt file - cDNA_ID_2990417; gDNA_ID_1620682; Annot_ID_48359
catacaagttatttaaaaaattccaaacaaaaaaaagaattgcatatgtaccttttccgaggaaataaaatttgtgataagtttagttcgcatatctatttatattgctttgaacgtgaaaggtatacagccaattaatcataccaaattaaaccaaattttcaagaacatgaacaatgtacagtaccaaattactaacaaattttcaaccattttgatacttgcgttttttctgtagattattatttggataattatactaaaaatataatttatcatgttggatgtggtagatggttgtttacttgtttagacaggagagaagaaggagattgagccataccattaagtagtggagttaagcccaaatatataattgggttaaaaaggccataccattagtaaacaatcgattccgaagttgatccataccaatagcacacaatcaatttggccataccatttgttgagttcagtgactgctttgaaagaaggcacactaatgctttcgtagatacaaaagttaactaattcaggggaatcaaagtttggtttgcatgtagtttgtttgggttttatttttatattttattttagaactttgtttctttaaattaaagtttgcttgttaagctccgcaatattcactataaaaggcacaaacacatcaaattcatgagaaagacacaaacacattataaaagaaactcgcacatagagtttcaaaaataagagtaaacacagaaacttaatcatttttctcggataccaattcctcttgttccttcccaaacaacttatgctcaatatgttgagcaaaagtccgtggaggaaacttagccggagactcaacactcaccatctccggcaacggcttaagaacaatcttatcctttgggggttcacaaaacacagcccaagaaatcctaaccttctccttattcaccaacccacgatgaagtatactcttatacttcccattactaagaatctccaaagtatccccaatgtgcatcacaatcgaatcaggaacacattttgcagtgacccatttgccctcgtagaaaagctgcaaacccggaaccatgttgtgtagaatgaaagttaaagcgcttacatcggtgtgagcttccacaccgagtgctagctcaggctgaggacattttggatagtaatttatcttcatttgtagaagaagctcttctaaaccaccaacttctttctctagacggtcaggctctaaacctagaccgacagagagagccttgaagactttagtcgctagcaaacgaagacacttcgcgtactcactcgttgcttctctacaatcatcgaaaaacgttaataaaagattctaaaaccaaaacaagattttgttttctttagtaaaacaattcaaagcttacatgtaatcacttggtgtcttaggccaaattgatagatctctcttctcttcaggatacgcaagatgaaagaagtaatcttcccattccaattgtccactcgcgttgttagccaatttacttccatagccttgaatctttccagtggcttgatcgtttgcatacttctccttctcttccacagacaaactgaaaaactcttctccggctttcttgacacgctccattagatcagctggtattccatggttgatcaaatgcatcactccccaatccaaagatgcctttttcagctcctcaatacaattctcacggatcttttcatcgtctgactcgatgttctttagatcgattgtgggaacttgaggaccgtcttctttcttctcttctaggaaaacatcgttgatgctctcgagctcttcttttggacgaatatattcttttggaatcgatatgattccgctttttgctagactctcaactctttcaaccgcaaccatcttctttagtcttctgtttaaagctaaaacagagcagaaaacagagtaagaagtaaataaacttaaaaacaggggaaaaaacagagtaataaaaaaaatggatttgttttgtttttcttcttacactcttttttgtaattggttgcaagtaaatgaaatgtgcaaagactctttcttatatagcaaagtttttactatacttttagttagaagagtttgttaccgaactaagagacattgtagagctaccggtggttagtgctattgttgtgaggtaagtgcgtgactcacttcacggtcaacgggagaggatggttgggttgactgattggtcaaaaagattactactatatgggcttgggtctagactcccagaaaaggcccaatagaattaaacccataatcgctatcaacgtgttcttcgtcgcgtgctttaagcgtgtctccacgtgttcacctctactagttcttctactaaccacattttctttttgtagtttggaaatcaattactaaaaaaacaatttgactggttttcaatttcaaatagacaattgtatgtggatcaataattcttttggaaaactaaattatttatcttgtttgttttttaaaatttggaactcatttttattttaatggtttgtactaaagtatattatcagctgaattcaactacacatactacatgtcaaatttttttaaaaaatcaccatgtttcgaaaaaaaaatcttcttactcatctcacagtattttttttattgtataatcaaagcctaaaattatgtcttttctctattttaagtttttgttttgtttaagaaaaccggatatttaatgctgacgtggatattctgattatgaggatgagaggaaggaaaaaataagagaaatctgcctaggaatttatctccacacttctcttatctcctaatttcttccctccaaatttataataaaaccaaaaaaaaaaaaaaaaaaaaaaatcagaagaaacctgagaagctcacagtaaacacatcttcaaccacaggttcatacttactgaaaaaaacagaggaaaaaaaggagctcccttttctatctctaagggaaaatg

SEQ ID NO: 27486 - DNA, 3003 bp, Unknown; identical to SEQ ID NO: 27485
  misc_feature (1)..( 3003): 2750-1469P.txt file - cDNA_ID_2990417; gDNA_ID_2926181; Annot_ID_140557

SEQ ID NO: 27487 - DNA, 3003 bp, Unknown
  misc_feature (1)..( 3003): 2750-1469P.txt file - cDNA_ID_2990421; gDNA_ID_1620302; Annot_ID_152671
gaaactttgggttggtgagtcaggaaatgaaaatgataaggtaacaacaacacttcaaagtgctgccctaaagttaagttgcaagattttttttgatgaagtttttttttttcttgtcatagggagaagatgtaatagcaatcttaccatgggaggagtggtgggcatttgaacaaacaaaggatgactcgaatcctcagattgcactgctacctttgcatcccgatgttcgtgctaaatttgatgttgctgctgcttggaaatatgctcgcagcatggagggtaaaccatatggttatcacaacttgatttttagttggattgataccgttagtgaaaactacccgcctcctctagatgcccatcttgtaagtttttgtttttcatttctcacaatatagttcttgatgaatgaatacactttcaaatcgttttaacttcgggcttctctttctttcaggttgcatctttcatgactgtttggagccaaatgcagcctgagtatgctgctaacatgtggaatgaagccttgaacaagcgactgggaacagaggtattaacatcttcatgattcatagatgatttttttaattaatgcttatccttattagagatggtcctaatatctgattcttctgtactatcgtatccttcatgttgtatacgattctacatttttctctgctcttatagtttgactctgttccttgttcttcgttttttttctcttcttctctaacatggttaaaattgcagggtcttgatctttctgatgtactggtagaagtagagaagcgtggatcctcatttgacaaattactggcagtacctgaactagacgattggatatacagcgatggtaaatcaacctcatgcatcgctttcattctcgaaatgtacaaagaagctggcctattcggtccacttgctagttctattcaagtcacggaattcacggtaagaatttgtacacagtctctgcttcccttcatgcacgcaagctcatgtgaccattttcatttcttaatctcttgaatctgcagataaaagatgcttacatgctcaactttttcgagaacaacgcaagtcgtcttcctacatggtgcaatgacaatgacagtgtgaagcttccttactgtcagatacttgggaaatacagaatggaacttcctggttacaacactatggaaccatactcgcacatgaacgaacaatgtccaactctgcctccaaagtacaacagaccagataactgctaaaagaattctcctccgatgtctgtttgattttaggaaaaaagttcaaatgtattaccgttgaaaactcaacaattactttatctgtttgtatataactatatatatatcattcaggtttgtagcaactgctcatcatgtaaactgtgtttggatatgatacacacaaatagaaattacaagtttcatcttttggttatgtttcgtcttccggtttagtttggtttatctggattaaaccggtctcatcttcatcgtaaagaaagaaagtagaagcaaagcttgaagcttttggatttctaatgtgtgtgaatcgtgatgttgtcatcaggacagatgatgggccatgtcgtggcccgaactcagatgatcttgtctcgaagtaacttcgccgattgtatacggtgtcagggcgtgagagtttcaaaaaccctaaaaatggggacaaagcgacccacttgcccttcttgcgataaacctagccagctctgtctctgcaagaagatgagatctccatgttttgataatcaggtgagtattactattcttcagcatagtctcgagagaaaacacgcgctaaattctactcgaatcgctagattagggcttaagaatgttggtgtgactactgttttcgatgttcatgatgaggcagagttcttaatcagggttattggatcgggttgcagcaagattgacacgaatcatttggattctgagtatagggtagagaatgttgcttctttggaacttgatgatagctttaagttaggtagtagtggcaatgtggagaacttagaatctgagaagaatgtggtgcttgttgatcatggaagcttggaaattgctgaaagtttgaatctttctcaacatttgagtgaaatttcttatcgggattcgcgggttagggataagataggttcttatgaagaagatttgataaaaatctgtatgaagaaacatggtgtcatcagcaatgtctcacactctttgatgcttgaaaccaatgtgaaggttcttagttttgatcatatattggcttctcctgcagccatggatgtcttggcaaaaggttttatggtaacaaagttttcagaaggaaagcaagagtttgagctcgaggttcctcctggatcagctttgttgttcccgagcgaagaatcggtaaagatcaattatcttaaagagaaagaagagttaaaagtaaggaatctgattgttcttgatgggacttggtcgaaggctagaagaatataccttgagaatccatggctaaagcttttacgttgccatgtgaagctagaaatagaaggtacaagtttatacaaagaagtacgacggcagccaagagcgggatgtttatccacgatagagagtattgtatacgcgatgaaggagatcggtgaagatcctgaaggtttagataatatgttgaatgtttttgaatccatggttgaagatcaacgaagatgtaaagatgagaactttaacaagattatctgaaagacaaaattactctgctgttgtaacttgtaagctgaatgaattagattcttcaattttgataattatgccgaaagttggagtcgtttttggcaatttattaaaacaattgaagatataaatgttggggtgtgaacaagaaaaattcatagttctgggccaatatgtaaattaggaaatataagttttgttgagtaagacttttgttaattttgaactcagagtgtgttttcgtttccgaatg

SEQ ID NO: 27488 - DNA, 3000 bp, Unknown
  misc_feature (1)..( 3000): 2750-1469P.txt file - cDNA_ID_2990429; gDNA_ID_2926151; Annot_ID_198075
gtccccttgctctctccgccgctcctcacccagacgacatcgtttagattcccttcgttcggtaaatccttcttcggtttcgccttctttttatttttggtgatctagaaattgtatcaacttttgattgtacatgccagatttggtgtttcttcaaatgtttatgtgtaaacctgactattattacctgcgtttgattcgatatggtttgtgatttgtgaagtttatttatatatatatgcttgattttgggattttgatttttacatagttagtctgttgaaagattcaactgcgttgatgaatgtgattctgggaatatcttgtgtgtgattcatctttagagaagtttgcttctgtatctttcataatcattggtctcttgtggttgttggtgatgtactgatgtttaacacatgatctggcttcattttggatacaaagataacaagtttgctttgtaggtagattggttcagatatagatagagttttgtttagtagtccaatgatgagttgcaatgagattttacactcatcgttccaattgctaaagcagtttgaagttgctatgttgaagcacaataatgactctgaggactacattaggtttttcttcttgtttttgtttctctccttttctccatctctatatgtgccaagttttagtgaagctgcaattttgggatatgatgtcatctataggtgttggggaaaacaaaagtttctgaaactgttgtgtgtttatgtattgattttgtcatattagtttaccaatgacctttctcaatctttcttcctgaaatttgtggttttgtgtccaaaaacttggcatgatggtttccataaaacctgataaatggcgttttataatttatctctttttgggtactcaacaaagtacatgtgcaaggaggtgtttgcttttgaaaagaggtatcaaattattcattcagcttccatgtttttctgccgcaaagaaatcttgattgggtccatgcattgttgaatgacttttctctttttgtatgaaaattataatacttttgttacggttcaaatcaaagcaagaagaatagttgtacattgcttaatcttcttaggccaaactgatttctctttctcaattcacaaccaatggggttgtcaacgtatcaacaaaagtttggtccttttacttattagcttaaacatagaccgcaccatttatatcatttaatcaggatcaaagttacaagaatcagaagctttatgtcactcctaatacaatctagcattacaacgaagcagcaaatacgcctgaaattatcgggttacctcgcttggggtccactcttaaggcattgtgagtgaactgtgaattgaacaaagctattatccatcttcattcgaccttcgaaaataagcagaccagcttgtaggaagaagaaaagcctggaacttcaaattgcttagctacatcttcatttaaagtttaccgaatctcgaaactgatatacaccattcaatggtcaagatttacaattgcaagtctatcacatctttccaccaatcttctctttgcagacttacttctataacaccaaacctcaaacgcttcacttaaatccggaaacttcacaccttccaacccaatacctctcatccattcaccaaacacttctgcttggtcatttgaaggcaatgtcaaaaccaaagacaccatagatccttctataaattcacaaagatcttcatccattctatactcatactcacatccctctgcatcaaccaaagtctttaatctccttatgaaaggcaaccatatcttcaaaagacaagtcctgcttttagaaggaacaatcacaattccataacctaccgcttctaaaatcttccctgtaacctcaactagcttaaccttcacacccaatatcctagaatccaactcacacttctgagcaatcacaagaatctcactcgatgcatcggtccacttaacgacaagatctttcatcaactccatccttggcaatactttacacaaccactcaatatcatataatgtcttaagaacactaaactcagtacattcaggaagaatcacaagcaatgatgataatctatccaataacatcgatataacatttgagatacctaatctcacaacggatttcacttcctcttcggaaatcagtaaccgtacctcttcgtcttcagataacataaactccacttgttcttgagctgatgttttcagctcatcaacaagctcaggagagttctttagtgtatcaatggacatggcgaaatgaagagctgacaagaagacattctttgtattgagggatacatcaatgacatcgtcctgcatttttcgatgttttaactgcgaattcatcaaatcaagaaacatattttaagtagattatcaataaatcctaaatccaatcaaaagacttaaaacttttctataatcaacaactctaactacataaacaacaaaccaataagaacacaattaccaaatttgtaactgaaatttccttacgttcatcgatttcaagaaccctaattagcatttcatagctctgttttcgtcaatctaatcacattttacagagtaattaacaaaacaaacaaaacagagaaaaatacttactttttccccaaaattttcttcctttaagttaaacaacaatggaggatgataataaacaacattgctttgaatgaagagtgaagaagaaagattgaaactttagcaatccaatggggatcttcacacgctgatttggtttaactaaaccgaatcgaatttggttgataataaaacgacgtcgtataactgaaggatattacggtaatttaagtcaaggccatcgtcattgtcattgaatagatcaaaccattttactaaagaacacagttttctagattctctagagagataagagtgagagaagagaagagaagatccaaaagcgtgggaaaatcgaattagggttttctgaaaatg

SEQ ID NO: 27489 - DNA, 820 bp, Unknown; identical to SEQ ID NO: 7714
  misc_feature (1)..( 820): 2750-1469P.txt file - cDNA_ID_2990429; gDNA_ID_1621158; Annot_ID_173605

SEQ ID NO: 27490 - DNA, 3000 bp, Unknown; identical to SEQ ID NO: 27488
  misc_feature (1)..( 3000): 2750-1469P.txt file - cDNA_ID_2990429; gDNA_ID_2926151; Annot_ID_139310

SEQ ID NO: 27491 - DNA, 3000 bp, Unknown; identical to SEQ ID NO: 6941
  misc_feature (1)..( 3000): 2750-1469P.txt file - cDNA_ID_2990433; gDNA_ID_1621117; Annot_ID_171926

SEQ ID NO: 27492 - DNA, 3003 bp, Unknown
  misc_feature (1)..( 3003): 2750-1469P.txt file - cDNA_ID_2990441; gDNA_ID_1620313; Annot_ID_153061
gtttaccttccaatacttctggaatgaaatcgactctttcagacagcatatttgcgattaaaactccagtagtaacacaagatgttgcaacctacagtgaagttcagtttatgttacattataatttgagatatattcaatggaaagcttcatataaacctaaaattacctcggctttgtcctgaagtttcataagatcacagactaattgaaaaagttctttgctagagcaaatctctttagaatagctatctgaagcagaaagggcttcaatagctcggagaataatttcaaggacggggtacctgaaaacatacacaagggttcattgtacatactacatagtaaagcataacacttgtttttttttgcaagaatagaaatgccattcactaacacttgatgatctttaagatgagtttctgttcttccatacctttctggaattctttctttagtcaacttgctcatttcaaatgaaagaagattgatcaagagactcgtcaaacccagattcattagtggaggaatcaatagctgctcaacctcaggttgaccttctatgatacctaacaatagccctacactctatggtaaaatagaaatgaattagcaaattaagaaaaaccatgataaactaaaacttacagaaaatggtggagggacatgaataggcataaagtagagaatttcagaaaattcattaactcagagttcattaaataaaattcaccacttcgatcaacctttcaacaatcaagtcgtccagtgcaagaatgactaagttacaagaacaaatttcagaagttaccttttcaataagatgaggattcaaggtattttccgcaatccacaaaatatggcgaagtatatcatcagactccaaacaatgggcccaggaagtacacccagcgccagagagtcctgtggtgagtatcctattggagatacatgtcggatagttagataacccaaccaactaatcaagcatgaatctacatttgaggtaacaaatttattgttttacctgcaaacttcacttaggcattgggtatcatcaagaaacaactgccccacaagtgtattgacgattccggctgtagactctatatgtttcaacagaccttcatggcaagcaaggttcctaataatcccgagacagatttcctagcaagccccaaaacgaaaaagaaatgtaaaaattaaagtcaattcaagaagacaacaataattagaaatgacttagacttatcatacatacactgagttacttactcgaatacggggagattttgaaaccataaggtttgcgtgaagcacttctaaaattaggttctgtacctgcaaagccaaagcattacaacttcaggtctcaactccactacatggattcaatagatagagcactgtagtacatttccaaaaccactatacggaaccaagctgctcttttatctacatggaaaccaattagttctttttcaacaactctgccccaaatttcctattggtctaaactcaactttaaaccaacgttactacttggcaattcaaaatccagagtaaagaatatataaaggcattacttcaaagtataaatccatttaccattagctcagcatgagttctactggcggcaagatcccacaaaacacaaccatgatcttcccatgccgatgacccgtcttgcattcccggcgctggacatgaactaaccgtctcccccacctcataagtggattcatcatgattatctccaatgtccatgctctctggatcaccattggaagtctcaacaaccccatttccagatatagctactacaccttgaaccacattatccgtattcatatgatcattatgtcgttcgtcacttcccgaatcaattggaaggagtttccttatcagtgaaataagatagctaggatcaactgtagtcgaaatgtcaaacaactgcacaacacagaaaataagaaacatcactctctacacaaataaaaatcacaactttaaatccaaaaactactcttaaatagccaactaaaaacccctaattgcacaaagtaccattgacgctcaatttcctacaatgaaactacctcaacaacaacgaagagtgagcaaattaagctcaaaatttacctcatcaggcggaggaggaggatgatgtgagggaaactcgttttcactttcttctcttcttccagtaaaattttcttcttcttcttcaagtattcctcgctgtttcgtcgcttcatcgtcttccattttaatctctctggttttttaatttctcctttgcccttatttctcttcttctctcgccagaaaattcgaaacaccgctttacttgttttacaaaatagtccttgtactaaatcatgtcttgttttcacacctacataatttacttctcttataaagtaccttaatcttttcaatagacgattacacccccattttgaatgaaccacaaaaatctgccaactgttaaataagtctcggtgacaggtggcagattattcacaggtgaaaagatcgtgggtaagaaaagcctcagccacaaaattaacggtcaactaccataaattgtttattcattaatccaaaacaaatctctatttaataattttttggaaaaaattaaattttttaagaaataacagaaatatttgtaagaaataaaaacttcgatagagataatttgatatatacagtaaaaattctataaattaatacacacggtaaattattattttgatattttttataaagttttcactttatttattttattgttttgtccaaaaatttattattaaaaacacattaatttgtaaaaatgccaaaaaatgattagatgtttcggaaatatttgagagtgacaagtcatacaaattggatgttgtttttacttttttagttttttggtaaaattatccttaaagctaaaaatctccataaccaaagcttcttcgttccaccagcaccaaaccaacaatg

SEQ ID NO: 27493 - DNA, 3000 bp, Unknown; identical to SEQ ID NO: 12776
  misc_feature (1)..( 3000): 2750-1469P.txt file - cDNA_ID_2990445; gDNA_ID_2214570; Annot_ID_186152

SEQ ID NO: 27494 - DNA, 3000 bp, Unknown
  misc_feature (1)..( 3000): 2750-1469P.txt file - cDNA_ID_2990453; gDNA_ID_1620653; Annot_ID_47800
gtactaaaaatctgggaagtacactgatccgatggaaatgaaggagaagattgtacattttatcgtgatgattcgtcataaactgagactggagagagcgaagctgaacagctttagcagctgaagctgcttcctcttctggcttagaagcattccttggacgaccgtgcattcttctccgacgactgtgagagatgcgacagtgtgattcaacttttccggttaaatctgatcagaaattacgaaaacagttaaaacaaacactagatcgaggaaagaaaaaacgtgatccaaatctagaaacaacagagatgacgaaatggagaataagaagcagatcacctgaaaggagcacgttgcggcgtcgatcgagagagagagacttttgttttcgggcaattgagcgactgagagaaggttctatcggaaaatttaatgggccggtttaatgatttcaatcgcttaaaccagtaaaccgggtttaattgaaaaatacggtcgaacactaacccggttttggaagtcttcgtttatgtagtgaaaggcttcgtcatcatcgttgtttcacagttgaaggttttcacgagaaagtgaagatttttggagaaaccatacttttgtgaaggttcgtttcaccttcaatttcgtttttccaatttgggtatccgataattgtaagaatttggggttttaaggtcagattgattatgtatctaatgcttttacattgtagtagctcgtgttttggattttgaaggattgatttctaaatttccttttgatcttgtagttgaatcacaatggaagattcagagaaaagaaaacagatgttaaaagcaatgcgaatggaagctgcagcgcagaatgatgatgatgctactacaggtactgaaacatctatgagcacaggtcacctctccaatccattggcagagacatccaatcaccagcaggattcatttgaaacgcaaaggtttgattattataccgatcccatggctgcttattctagtttcaagaaaaacaagacccctaagcaacaatacatctcatctcctagtcatcaaggaagctctcctgtaccacctcagtttccaccatcagttcctccaggtgcttgtttctgccttgatagtcaatgactctgtcttaatttttgttttgtctatattcttgtgaggccaaagaaagtagtccactgataaagaagattgcctaatatcatgagagtttaacttacagtatgttagttggtccttggtgagtataggtataggattgaacagaatcaggaattcactttggtatttggttgttgggctttcgtagagttaggtgatgattctcttctacaaatctatatgaaatttttgttctttgtttgggtttagtcatgtgttcttgattataatctacaaatcaagatcaatggaggaagaaatttgtctctcagtctcaggcttcaaacttattagctttagctactttaatttgatatatctctttaagtttcactttctaggaattgacagtatgaaaatcacatcaattatggaattcagttaggtttgtgtcctgtgccttgcaatgaacagtaatccagttctgatccttgcattataactttgaacaggatcattatgtagtgagtatcaggcacagaccaatcatggtggctttcatgcagctcattatgaaccaagagggatggcacatctttcaccctcacacagaggtccacccgccggttggaataacaactttaggcctccaccagttaaccattcaggtccacctcaatgggtacctcgcccttttccattctctcaagaaatgccgaacatggggaataatagatttggtggtcgaggcagctacaacaatactcctccacagttttccaattatggacgacaaaatgcaaactggggtggaaacacgtatcctaactcaggaagaggcagaagtcgaggacgcggtatgaacacaagctttgggagagatggaggaagaagacccatggaaccaggggcagaacgattttactccaactctatggctgaagatccatggaagcatcttaagccagtcttatggaagaattgctcagatgcttcgagcagcagctcaacaggtcaagcctggcttcccaagtctatagcaccaaaaaaatctgtgacctcagaagctacccacaaaactagcagtaatcagcagagccttgctgagtaccttgctgcttctctagatggtgctacatgcgatgagtcaagcaattaatcaggacaactggcctagtgaaaatacaccaagtccaagcatctgaggtacctggaaagatcaccgttgactctttcgaactaggtattgttcagtgacttgtgtttattttcttaacaagacacaacagcgaatgatgaacatctctgagggcgcaattaggagtagattggttggcaatagggatgttctctaccaaaaattttactgttttttcgcaagatttagttatcgtacaattatgtaaaatcattatcaggaaatttgttgcatgattgtgtttgaggtggaaatgaaccgcatccgtattaagatcatttttgctggtggaaacaatgttaccaggaaactgaacttggttttttatagattaatgtgacttgttaggtaccgtaatataatactagttggctacgacacgtacatgtgcgtttattgcttgaagccaataaggacaaggtggacgtaataaagtgtgcttgttgttggatggatctgaatatgatgactcaactgtccaactctaatgttgttgctaaagacccaaatcccacccacatttaatgttgccgtcacggaaacagttttcccaactgtcctaaatcagtgatacccatgcctattctgaactcaactctctttcgaaactcaatccttatataacacatcccatttaagcctataagctacacatatcagctctctcacaaaaataaaatg

SEQ ID NO: 27495 - DNA, 3000 bp, Unknown; identical to SEQ ID NO: 27494
  misc_feature (1)..( 3000): 2750-1469P.txt file - cDNA_ID_2990453; gDNA_ID_1620653; Annot_ID_163560

SEQ ID NO: 27496 - DNA, 3003 bp, Unknown
  misc_feature (1)..( 3003): 2750-1469P.txt file - cDNA_ID_2990453; gDNA_ID_2926185; Annot_ID_140760
atcgtactaaaaatctgggaagtacactgatccgatggaaatgaaggagaagattgtacattttatcgtgatgattcgtcataaactgagactggagagagcgaagctgaacagctttagcagctgaagctgcttcctcttctggcttagaagcattccttggacgaccgtgcattcttctccgacgactgtgagagatgcgacagtgtgattcaacttttccggttaaatctgatcagaaattacgaaaacagttaaaacaaacactagatcgaggaaagaaaaaacgtgatccaaatctagaaacaacagagatgacgaaatggagaataagaagcagatcacctgaaaggagcacgttgcggcgtcgatcgagagagagagacttttgttttcgggcaattgagcgactgagagaaggttctatcggaaaatttaatgggccggtttaatgatttcaatcgcttaaaccagtaaaccgggtttaattgaaaaatacggtcgaacactaacccggttttggaagtcttcgtttatgtagtgaaaggcttcgtcatcatcgttgtttcacagttgaaggttttcacgagaaagtgaagatttttggagaaaccatacttttgtgaaggttcgtttcaccttcaatttcgtttttccaatttgggtatccgataattgtaagaatttggggttttaaggtcagattgattatgtatctaatgcttttacattgtagtagctcgtgttttggattttgaaggattgatttctaaatttccttttgatcttgtagttgaatcacaatggaagattcagagaaaagaaaacagatgttaaaagcaatgcgaatggaagctgcagcgcagaatgatgatgatgctactacaggtactgaaacatctatgagcacaggtcacctctccaatccattggcagagacatccaatcaccagcaggattcatttgaaacgcaaaggtttgattattataccgatcccatggctgcttattctagtttcaagaaaaacaagacccctaagcaacaatacatctcatctcctagtcatcaaggaagctctcctgtaccacctcagtttccaccatcagttcctccaggtgcttgtttctgccttgatagtcaatgactctgtcttaatttttgttttgtctatattcttgtgaggccaaagaaagtagtccactgataaagaagattgcctaatatcatgagagtttaacttacagtatgttagttggtccttggtgagtataggtataggattgaacagaatcaggaattcactttggtatttggttgttgggctttcgtagagttaggtgatgattctcttctacaaatctatatgaaatttttgttctttgtttgggtttagtcatgtgttcttgattataatctacaaatcaagatcaatggaggaagaaatttgtctctcagtctcaggcttcaaacttattagctttagctactttaatttgatatatctctttaagtttcactttctaggaattgacagtatgaaaatcacatcaattatggaattcagttaggtttgtgtcctgtgccttgcaatgaacagtaatccagttctgatccttgcattataactttgaacaggatcattatgtagtgagtatcaggcacagaccaatcatggtggctttcatgcagctcattatgaaccaagagggatggcacatctttcaccctcacacagaggtccacccgccggttggaataacaactttaggcctccaccagttaaccattcaggtccacctcaatgggtacctcgcccttttccattctctcaagaaatgccgaacatggggaataatagatttggtggtcgaggcagctacaacaatactcctccacagttttccaattatggacgacaaaatgcaaactggggtggaaacacgtatcctaactcaggaagaggcagaagtcgaggacgcggtatgaacacaagctttgggagagatggaggaagaagacccatggaaccaggggcagaacgattttactccaactctatggctgaagatccatggaagcatcttaagccagtcttatggaagaattgctcagatgcttcgagcagcagctcaacaggtcaagcctggcttcccaagtctatagcaccaaaaaaatctgtgacctcagaagctacccacaaaactagcagtaatcagcagagccttgctgagtaccttgctgcttctctagatggtgctacatgcgatgagtcaagcaattaatcaggacaactggcctagtgaaaatacaccaagtccaagcatctgaggtacctggaaagatcaccgttgactctttcgaactaggtattgttcagtgacttgtgtttattttcttaacaagacacaacagcgaatgatgaacatctctgagggcgcaattaggagtagattggttggcaatagggatgttctctaccaaaaattttactgttttttcgcaagatttagttatcgtacaattatgtaaaatcattatcaggaaatttgttgcatgattgtgtttgaggtggaaatgaaccgcatccgtattaagatcatttttgctggtggaaacaatgttaccaggaaactgaacttggttttttatagattaatgtgacttgttaggtaccgtaatataatactagttggctacgacacgtacatgtgcgtttattgcttgaagccaataaggacaaggtggacgtaataaagtgtgcttgttgttggatggatctgaatatgatgactcaactgtccaactctaatgttgttgctaaagacccaaatcccacccacatttaatgttgccgtcacggaaacagttttcccaactgtcctaaatcagtgatacccatgcctattctgaactcaactctctttcgaaactcaatccttatataacacatcccatttaagcctataagctacacatatcagctctctcacaaaaataaaatg

SEQ ID NO: 27497 - DNA, 3003 bp, Unknown; identical to SEQ ID NO: 27496
  misc_feature (1)..( 3003): 2750-1469P.txt file - cDNA_ID_2990453; gDNA_ID_2926185; Annot_ID_200565

SEQ ID NO: 27498 - DNA, 3000 bp, Unknown; identical to SEQ ID NO: 9369
  misc_feature (1)..( 3000): 2750-1469P.txt file - cDNA_ID_2990461; gDNA_ID_1972105; Annot_ID_178712

SEQ ID NO: 27499 - DNA, 3003 bp, Unknown
  misc_feature (1)..( 3003): 2750-1469P.txt file - cDNA_ID_2990465; gDNA_ID_1621144; Annot_ID_172965
tagaggagccaatatacgtgttagccagtataacaatctgattcaggccgaccaaatatcatcaagatcactaattttgttcctcaaccaaatttccacaataagaaactcgatgtaaccattcaaaatccttcttctttcatcttaaaaagctacttaatctaacaacaaatctattcccaaactatgtaaacaaggaaaacagaaacttacaatagaacaacactcaccataagccgaaatggcaatggagagaaccggaccacgatgagcttgccatgacaaagcttcttcaataccatgatcacctctcaatctccaacacctaatcctcccatctctatgtccactccaaacaactctactaccttcatcaccaatcatacaaacaacagcagcagacccaaactcattccctaaactctccttatacggcgccgtatcctctacctctaatcccctcccacttccatacaattcactaaactcccaaactctcaacgcaccatcctcaccaccagtccataactgtctctcagtactagtcattgtcctcaaaaacctcccaatttgagtttctctcaatggatgaggtctcacatcaagactaggtggtcgattcggatgaaccgctgacctaatcggaactttgaagatcccagattcaccacacttaccaacaaattccggtaacgaatcggagccgtttccatcaccgatcccgtcgtgattaccgtcttcgcttagtctccggtcgagaaattggatcatgtaatcgatacgtttgttgctgtcgtcgacggaaggctgagattcatcgtcgccggaggaagatgaagaggagtaagctgaacggttgaaaagcgtggacggagttgcggcggagaaggaaggagagaagaaggagaaaacgtcatcgttttgatcgttttgacgatcttccatgagtattggacttgaagcttttacttggagcagagagagacgacgagtttttcggtacaaagcctctcgagatatttctctctcaagctaaatcgcagaaatgcttgaaacgtgttgtttcggatctctcgttttctttgtttttttcagacattcgaaattatttattttataacaacaaaatttgtacttgtaaattggtaaaaacaaacctttataacaaaaaaaaaagtagattggtaaaaagtaaaacttactgatgtcaaattctcttttttggattaacagtccagaaatctgtcacaaattctctgttttggattaatttttttagttcttaaaatcgtatgttaatatatgtcatttgattctctgttttatattactgttttggtctaattcttcttttccgttgttccctttcgattgttcaatgtgttggtttgattttggtttatgataacttacctcaaaaccaagagaatttggaagacaatttcaacaagctgtttgaacttcataaggtacaaaatatccctctcagcaatcgattactacctttttggatgatgtggaggatatggaaatcaaggaatgctttcctctttcaaaagaaaaactatgatcctgcaagtgaagcaagaaaaggtttctatgaagtttaggaatggatagatacgactgggataggttctgaagtaaatcatgattctctctcgccgtttggtcactcacatgagcatttccgtagtcggcaatggataccccctctcccagaatgggttaaatgtaattttgatagcggctatgtgcagggacgttcatttacaaatactggatggatagtcagagacaatagtggttaagttattcgatttggttgggcaaaacttcaggcagcaaattcggcgatacacgcggaggcactgtgatttctccacgctttacagatgatttggactcatggtttccggtgtattgtgtttgaaggagataacttggaactaataaagttggtaaatacaatgggagatcacaacgaaatagatacccttctctttgacattcggttttggatggataaactgccacagatatctttgcgacatgttaattgagaacggaatgcagcagcggatactatcgctaataaggcttgttctttaaatggtttgtatcaaactttcacaacaccaccacaatggttggttaactatctgtatcatccctttacaatctaatgaaagtctagatgttaaaaaaaaaaaacaagagaataaaaataaaatattggctattttaaaaatatttttaaatatacataaaactaatgtttatttttaaatatacataaaattagtgtttatgtagtatttcatatttttcttaaaataaaccgtaaattcaactaatattctaataccatattatataatattgatattttaatgaaatatacaattaaattaaattttaattaaattttcattgattttatgtttatgcatagagacatgttgtcaacacttgagagagtccctttatcaattaaagtttaacacaaatagcatagtcccctatatcaagatcacctgcaactaaccaaattctcaccaaaatcactaacaaatgaaacaaaaaggaaaaaaaaaaaaaacagcatcaatgttcatcttttcccctacatacatatatataaaatctaaaataaacacaattttattacataacatattaagattatatttattggatttcttcctctcttttttaagtgtgatttactgttgtctctaattctttcatcagcaaacaccgattacgtacaaaataatacattattaataacatttcttactcaaaaaaatgcgccaattcaaaggcttgtctaacgtgtgtatataatagtgttacttgcttgcctatactatatataaagagagagagacttctaagattctcctccatttttgctacatttttttttctttgattaaaaacatttttactatttttcgctttttgctatttccttgtaacttaaaagaagaaaaaatg

SEQ ID NO: 27500 - DNA, 3003 bp, Unknown
  misc_feature (1)..( 3003): 2750-1469P.txt file - cDNA_ID_2990469; gDNA_ID_2926157; Annot_ID_198517
taagaatcgagatatatctcgacatcgatgatataaagaaaaaaaaaggtatagtatatatttttaaaaacatacacttattgtttttagtgatgatactggtaaaacactttcatgcaatattattgaaataccacttcaaagactaattttcggtatcgatagagttttagttcgtcgacgtcgagaaattttatatcctcttcgatttctttacagtttttatcgattttttttgtatatacttctaattttcttctctctatatgacttttctctcaatttcttctttttcatatctactttttaagatattttaaagagtcgtgaaagagcatcccttcaatatgctcatgccattggtattgaattcaccaaaagagaagcctctcatcaaataagttcttcaatcccgaaacttgagcttagtctccaaatcctttgagttaagatgtcttatgaccctcgtcatttataaattaaactcaataaaattgatgtctacactttgatcggattgaacaagaacattgtcatgttcacttgcaatattcacataagcctttatcggattcagttgtccgcaaatattttgatatttactcgatgaaagatctgctataagggtgaataaatttgtaattcaagccccatcacaaatcgcggtagatcaactgcatctagcttggaaatcaagagtactatatgctcgttgacgccttcatcaagaccaaaagtaaactgtacattgttgcctctattccccaatcttggaatctaaatatctcttgatcaattttttatgcttggttctatcatatagttactttttaacttgatgaatttccaaacatgttttaggaaaactactttgtgaaaattttatattatataaatagaaaagataatttaacggaaaagaaacattaactttatagcatgtggtatgtggatattatgctcactctcaattagtcaattaagatataccaacaacaacctggttgagatatcacagaaattatcaattaatatcttataaatgaattcgaaatatgctaaatgcaaacatagttttgtaagtacgtaatttataatatattaatactcaaatctaagacttacttttgaaaacaaaagaatatcttgtcaaattgacactttttaatgttcaaaagagatagtaagaaatttcgcctaaccaagaaaacaataaaaacaaggaatttcagtctcaatactatatatatttttctgttattcacttatatatttggatgtgatagaatacttttttaagaacacacatatcttatcttcaccgatatattagctgatacattttttacattcctttttattattattattcttatttattttctattcacatgtacttacaaacaaaaacttaaagactttgcaatttgcgttacgaatatttttcgtcaggctgtaatttgaaaagtcttctagatgatttcaagtctctgcttaatgtgccaactaggctctatgtcactactttgtgttgtctctaattctcattcttcttgacaagaccaaacatatcactaatgatgaagagatgactaatatttgtttatacatttgcttgtaatgaagacatgtagtatagcaaagcaccatataatatagtgatagcattctattaatttgttcttttttacagccgaagaagaagagtataagaaacatgtttaagattcagccttaaacaagtgaagaaaaaacaaaaagaaaggctcaacgaatgggaactttgatccaaccattggcaaaagcaatggctaagatgacgaatggagttgacataccgaatatgataatgtaaggaagaggcgtcttcatcggattctctccttctctttctccaacgctttgccaatacctacaaaattccaatgcaatcctcatccataaccatttcttcaatcacaattgcatgtttatgaaaaatgaacatgcaagaatttaagttctttttctattttaaaagagtttagttcttttgactaaactacaacccaaatatttttattcttttgctaacacggatttgagtctggatattgatacaatactaacacaatgtcacaaaccaccagtctacatgtcattgacacatacaaaaaaaaaaactacttaaattctgcaatggagactaaaatttttgtattaaattggtaacctacatatcgttttgtaattttccatgttttcatcaatttcctaggtttgtttttctgtgattttgcaaaattacattaccattctatgagtttctgttattttctacaatctcatgatgaaaattgagaattaagattaacttactgttcaggttcttcctctttggttataaactttttcttatctttaggcttcacttctccatctcctccaccttatgcaataaccaaagattaacaaaatttacatctacaaacaaataaaagatataagagtacctaatttggcatgaagcttgaattctgggaatcctaatggtgatggtggacaaaagaattgaggtaaagcaagcaatgatgaatatgaagaagatgatgaagttgaggaatcactagccctgtggctaaacgaagaagaagaaattcgaaatttcgctgccatttccaacaactatatggatgtgatagaatatttttacattttatttttctgttattcacttatacatttggatgtgatagaatatttttttctgaacacacagatcttatcttcaccgatatattagctgaagcctgatacatttacattccttatttattttttattcacatgtatgtactaataaacaaaacttaaagactttgtattatgcgttacgaatatttttcgtcaggattgaaaagtcaaccctaggcctttagcttccttcttttatataaacagagaaacaaaacactttctttctcagcctctctgtttcatcttcttctctaaactctcaacatg

SEQ ID NO: 27501 - DNA, 3000 bp, Unknown; identical to SEQ ID NO: 8704
  misc_feature (1)..( 3000): 2750-1469P.txt file - cDNA_ID_2990473; gDNA_ID_1971867; Annot_ID_58422

SEQ ID NO: 27502 - DNA, 3000 bp, Unknown; identical to SEQ ID NO: 8704
  misc_feature (1)..( 3000): 2750-1469P.txt file - cDNA_ID_2990473; gDNA_ID_1971867; Annot_ID_176470

SEQ ID NO: 27503 - DNA, 3000 bp, Unknown; identical to SEQ ID NO: 8704
  misc_feature (1)..( 3000): 2750-1469P.txt file - cDNA_ID_2990473; gDNA_ID_2926155; Annot_ID_139469

SEQ ID NO: 27504 - DNA, 3000 bp, Unknown; identical to SEQ ID NO: 8704
  misc_feature (1)..( 3000): 2750-1469P.txt file - cDNA_ID_2990473; gDNA_ID_2926155; Annot_ID_198330

SEQ ID NO: 27505 - DNA, 3000 bp, Unknown; identical to SEQ ID NO: 7316
  misc_feature (1)..( 3000): 2750-1469P.txt file - cDNA_ID_2990477; gDNA_ID_1621140; Annot_ID_172803

SEQ ID NO: 27506 - DNA, 3003 bp, Unknown
  misc_feature (1)..( 3003): 2750-1469P.txt file - cDNA_ID_2990481; gDNA_ID_2936572; Annot_ID_194789
ccggagcatttggatcaaaacacccaatttcttcaaacatgcctcctcctcccatgaaaaccggtccaaagggctaagaaagatggtttcaaaatcagaaaacattgacacagttttgatttgctagattatatattgaaaactgcaacctaatcttgaacaaatctgttctaaccaacttaaaaatcgtctaagcttagatgaattcttgtaatgtatatctaatgatcaggttattaggaataaaagagtaagagaagggtatattgttaccgacttggctgatgatgattctccgaagaactttttccgaattcacgccaagaagagacttaacattaacaactctttctttttctctctctgtctctctttttgaaatgcctatacgtttgcaatttgagagtaacaaataaaaagagtggaagatgacacatttaactttttttttttgtattaataaaatacgtctgttatttatttgtggtctaacggggaacaaaagtttaatttcaacaactaacatttttttcctttcaatatattttttattttctcaaaacgctagtgtttttttttgttcgtaccgtaatattcaaaaattgaaaactaaagttttttttttatcaataacaattaatggtggtactctggactggactttggttaaagttcagattttttttatgtgtgacaatacctactttgatacatcttactgaattgaaatatttggttaccttattggtaaaagaaatagtaattttatgacctaagttacaaatttgagttctttttctttataagttgcatcttttagagatttttttttttaagttacatcctttttagaaacgagggttttggttggatcatgaaatttttgtttgtggcaagacaggccggtggttagttacagtctgtaagttccatgacgtgtctctcttcgcgtgggtcccgtcacgattctctcaggttttgccgttttggtatatgatctttaggggtatttctgtctattgattatattttctcggtaatattacgcttgatttgaatccttcgactataatagagattttcttaatttcactttcacgttcaaagattttttcgcattgtcttttggaaaaatagcagagttttttaaaaaataaataagaaacgatacattcaaaaaatattatgtgaagttgagtttttttttacatatagaggaaataaaattgatcatagtcatagacatagaaatttgtcagtggaatcttttctattaggtcaaacaagattcaacttttaacattttatctaggacttctgaattctgatatacaatgatcgatgatattataaataagataaaaaggctttatttgtattatttccttgtaaagtaaagtatttcttaatttcatgtttgttgggtcatgcaaaatatgtttccaaggcaaggtagcggattttttgtgaagaatattagctgggtcccacgtgacacaaaagctatgcggaaaagggtgtttccgtaaactcacttgaaaatttctgctaaccagttttgtccggttaagttcatgttatgtatgttacaatttgggaattgggattcagttaaaccggatcagccgaagacattattatattcgttttgtaactttttgtttagagggtgtcgagttaggttatcgagctgagctgtatataaaaacatctcaaacaaaggtgaggaggggatgcatttgcaaaatggaattaaggggtgtttcgtaatcgtgacagttacgtttttggtttctctcctatgaggcttattttgggcctcaacaagaagtaggcgttttaacacgtttcgtcatctagagccagatgagagggcctaaaccctacctgtggctggttatttattgctttaacttacccgacagatgcgactcaatttgaaatatctcttttgggcctactgatcttattgacgagaggattcatcacccttttcttcggccacttggaaagattatatagattgtatgttttctcttttcattttctatcctcgtgaagtttttatttttatttttttattcagattacgaaaatcttgagaaaaagaataagacccggtgagcgaaaggaatgtgtggcgatggcgatgcctacacagccgtgaagccgagtcatcgattataaaatgagatgtgtcgatgataacattgctagtataattcttggtgtggtccattatttgataaatttatggtatgcgtccctcatgggaagtgtgataagattaaacctagtgttcgatataaaatttcaaattttgtgtcttagccattctattgaattttaaactacggtcagattgaagcttacatatatttgatgtaaaacataaaaatatgtggctgttactcgtacacatttatggttatataaatgaatagtctcaatcacagccgtgctctgtagttgtcaggtattcgtgtggtttgaagtataacattgtcaactatttgtataaagtttctctatactattagttccatgatctagttatatatacaagtcatatcagtttacactaaaccactcgacactcattgataatcgcataccgttactacaaaactaaattcaccttcattgcttattaaaatcaaatcatcacaatagctgatagatcgtggccttagcatttcctcggtaagacttatgaaaaaattaagataactattctttgaaaaaggtaaaggaaaagaagttgggaaaactttggcctttgtgtaccaaaagtagaaaaataatttccagcttgtcattttcctacggtcccaattaattatatctctctctataaatatagtaacacacttagccatcgtacacttactagttacttccaacatttggcttcctttgctttcacgaatagaaaccttagcttcttccatttcttctttctctcctcgtttaaattagtttttgacaaggaagaaaaagatg

SEQ ID NO: 27507 - DNA, 3000 bp, Unknown
  misc_feature (1)..( 3000): 2750-1469P.txt file - cDNA_ID_2990483; gDNA_ID_1620317; Annot_ID_153211
ttaatctacttttgagtaaaaatatttaaagtttttagatattttgtgtattttcgagtagtttagatagatttgattataaaaattgatttttgggaacttcgggtactccgaatctaaatccgaaatatctgattcgaacccgatccaaatctgaaatcttgaaatatccgaacgggttctatacttttaaattcgaaaattcaaaaacacaaactatttgatcccaatccaaacggatatccaaacgaccagacctaatggttcataccgttggttaatataatgttttttttttcgagtttagaagtgaaagtcttcatatgaaatttacactgattaaccggcaaaatcaaaccgattaacatgaattaaatatcattttacttcgaatagttcggctcggtcaaaccataaataattacattgataaacaagattcttcaattaacttaaatgtctccacaaacaactatcatctggattatatggagatgttggatgccactaacttgtatttgctccgttaacgtgaattcatatccactacccccacaagtcaccacagctcacaataattcaaaatacaaattttacaactccaccatcgccacaagccattggaatatagaagagagaaaacgaatatagagaggtgttttgaaaattgtattgtaacttgtacgttatcctatctatcatctactccaattggtagctcaaaaattaatttgtgaaatttgtattttggattattgttaaaaggaaaattatgtagtcttcatgcatctagtttaatattaaacatatgatattcaatctcgaattgtagcattaatgttgtttagattagaatgtttggtagacaaagaaaaataggtttgttatcaaaaatatttattaacaaaataataataatctatgatttaataattataatttaacatgctttaactatataaagggtggttttgtgcaaacaaaactctcaaagttgccaatatttgtaattttactctccaccttaaaaaagtacagaatagttttataaaatctaaaataataattattatacccatttcgctattgtcaagtttataaaattttgagaaataatatatttaatcgaagtcctcgagacgaaaagttcaaatctacttttagaattttaaaaatccaatgtatgtgatcctgaaaacatttacaatgtatatatgtataaagactatactacgttttattttggacttatataattattctgtattttttaaagtggaaggtaaaattgtaagaattgacgactaacccttatgtaaagtatacaatatgtaatttaatcatatgatttctattttttgtattaataattatgatataaaaaattataatgaaaaccattacatgactagaaaatatgttacatctatgatttctatgattattagtatataaatataggttaacaaagaatattattatataaatctagatccacagattttgaagatgctattttgttagtcatattttaatgaaaatattagtaatatagtttcttaattataacaccaaaatgacataagcttcaatagtttattactttttcttcttttttcattataactatgttgtttgaaatttgtttaaaaataattatgtttaactatttttattgctaatttatgttattttcgtatatgctattatgtagttaataaagttatattcattttattaattatatttgtatagttagattcacttttgattcaaatatcaattatatttttttcatgtataaatctttttatctatatacccaagtttctaaaattttttaactatcatgaaatacttacatcaacaatatgatacaatggtatgcaattatgctacttatttggtttgaaagttatctaatttgattctaagcaaataatttcttgttccatgtattctctcctaatctagtattccaatcacatcatgataggctcatggctaaatattggattgacataatttgaataacaaatatataaactactcatttgctttaaaagttttcatatgaaaaaaaaaaatcataaattaaatagtcttttgagtcaacacttttaggtttctctctttgcatttgcatatattcatattagagaaaggatcgtatattgaactttttggtatatctaacatctcaaaagatcactatttaacaaaagatacatgtcaatattaatgttaccaatttatcataaacatacaaaaaaaccatatcatgtaaacaaaaaaatataataaaaagaaaagactaagctaaaattactaaactaaagaaggttaagtaacaaacagttaagttgtaatacacgaaaatttttagtcattatcaaataatgactattacaaaaataataaaaataagaaaactaaaatgagagtagtgtttgatacattaacatgatttttgtattttttcttggccaaatttcatatatgatttctcaaatgcgaactcagttgatttttttttttttactcataacttacttaatttcttatgaaaaaaaaaatatttgacaaacaagaaataaaatatcaaaactataagtttttgtttgttttttagaaaagaagtgaaagctccgtttgacaaccgccatttagagagaagcgcgacattttacttttcgactttcgtgtttctccagtggaattcttttcaatatacacgcgccgcttattatccctcacgcgccaccgtcgtgtaaaccataaaaaatctcaaatctaaactctttcattttcaacttttccttttcttcttcttcttctttatctttctcacttctcctttctccatcgttctatcattttctcctttccttcacctcaagatctcaaaaacacaaaaagagaaatcaatcaaaaccttagggttttctactaatttatctgtgtgatgttaagagaatcatcatcatcttcgtcgtcatg

SEQ ID NO: 27508 - DNA, 3000 bp, Unknown; identical to SEQ ID NO: 21280
  misc_feature (1)..( 3000): 2750-1469P.txt file - cDNA_ID_2990489; gDNA_ID_1621138; Annot_ID_172744

SEQ ID NO: 27509 - DNA, 3003 bp, Unknown; identical to SEQ ID NO: 21104
  misc_feature (1)..( 3003): 2750-1469P.txt file - cDNA_ID_2990489; gDNA_ID_1620713; Annot_ID_165530

SEQ ID NO: 27510 - DNA, 3003 bp, Unknown; identical to SEQ ID NO: 21104
  misc_feature (1)..( 3003): 2750-1469P.txt file - cDNA_ID_2990489; gDNA_ID_2926152; Annot_ID_198133

SEQ ID NO: 27511 - DNA, 3003 bp, Unknown
  misc_feature (1)..( 3003): 2750-1469P.txt file - cDNA_ID_2990493; gDNA_ID_1620478; Annot_ID_158237
atacagatagaagcggtatgtgtattataaaccgtaatcaaatagctttcttgttcatcagtttatacttggtaattcaaataagtatctggttccaacaggcttccgcaggactaaattcttcgcactgttatatattacacggtgattctactgttttcacttggtgtggcaatcttacttcctcggaagatcaagaacttatggaaagaatgttggatttgattaaggtaatctgttaattatatttgtttctacatttcggaacttacctctcatttctcacatatggtggaacctctgattcttggtttttctgttttgttcagccaaatgaacccactaaggcacaaaaggaaggctcagagtctgaacagttttgggaattattaggaggcaaatcagaatatccgagccaaaagatcaaaagggatggagagagtgatcctcatctcttttcttgcacatatacaaacggtaaaaccattttgcaacatccgttcccgggatttacacttcaacttttctcatttcaataactgttctgaacttttatttgatggtttttgctggtttggttgtccggtgatactctgtggatatcttaccagaaagtctgaaggtagagtatggatttcataatagtcataagccacattcatgttatgatcccacttctcaggttctaaaattgagactcttctttctttctttctttctattaccatataggctacagagatcttcaacttcactcaagatgatttgatgactgaagatatcttcatacttgattgtcacactgaggtctttgtctgggtgggacaacaagttgacccaaagaagaaacctcaagctttggacattggagaggtacttaaagatccattcaactagattaactaactaaactgaaaactgttcttataaacactctgctttattgtcttcatcaacagaactttcttaagcatgatttcctcctagagaatctagcaagtgaaacaccgatatacattgtaacagagggaaacgaacctccatttttcactcggttcttcacctgggactcttctaaatctggagttggacttctctctctcttcacatttgcttttgaaaatcacacctcatggagctaactcgtactaagcgataaagctgcttcttgcagatgcatggagactctttccagagaaagcttgcgatcctgacaaataaaggaaagccgcttctagatgtaaaagcttgtactcatttggttacatttgtctaaaatcaatctcgatctgtcttgatcttgtgtccttttgttgctcagaaacctaaaaggagagtccctgcatacagtagcaggtccaccgttccagacaaatcgcagcctcggtccagaagtatgacttttagtccagacagggcccgcgtgaggggacggtctccagctttcaacgcacttgcagcaaactttgagaaactaaatataagaaaccaatcaactccaccacctatggttagtccaatggtccggaagctttacccgaaatctcatgccccagacctctcgaagatagctcctaaatccgctatagctgcccgtacagcgctttttgaaaaacctactcctacttctcaagaaccacctactagccccagttcttcagaaggtctgtagcaaaaacaaagctccacttttgaaccccaaactatcaatttggtgaataaagttgagatcttgagcttacccttttttgatcattttttatttatgaagctacaaaccaagcagaagcaccaaaatcgacatcagagacaaacgaggaagaagcaatgagcagcatcaatgaagactcaaaagaagaagaagcagaagaagagagcagcctccctactttcccatatgaacgccttaaaaccgactcagaggatcctgtttcagatgtcgacctcactagaagagaggtcagattcttcaaaactctcaacacatattataacattcgtttattaagtttgtgtttcatgagttcagcttggtattttgcaggcatacttgacttcagtagagttcaaggagaagtttgagatgacaaagaatgagttctacaaactgcctaaatggaaacaaaacaagctcaaaatgtctgtcaatctcttctaaacaacactcttcttcaagaactcagttttcttgttcttcatcttaacccaaagacccgtaagtttttcgccttctactctggtttgtttgatcactttggtgcaatcttacacctactgataggcaaggagtatcgctagacctatttaacatagtcttattgatctttgtttctattgcttttgcagctcaagaaacacacaaagagggcatcatacatttattcctttgagctgcttacaaataaataatcaagcacataaattttttgaaaaatcatatattctctttatataattataacatattcaagtttctgttttgataattaggatttttttgtttgtttgttttatgatctcacataatatgtctggctgtaagattctttctttcctggccttgaaattctctaattgcttttatgttattgaagaaccaatgtaaattaaatcttatctttatcatgtgttatattattctatggtcgtcagtaatcttcactaatccataactttatttctcttgtcactttatgatataaactttttgtcatttaaaagtctgtcagaggtaaaaacaaaaacaaaaacaaaaaatcatagtaaaccaaaacaaaatctagaataaacaaaacggagtcgtaagagagaaccggttcgaacaaaaacggcaaaaaaaaaaaaaggggagcagcaacctttttccaattttgcgtgaagcagcagtgaagaaaaaaaggaaaaaaagtgagtgagagaagaagattagaaacgacgatatatacggagaatctcaggatttcgatcctgtttttgttttttctacttttggtactctccatg

SEQ ID NO: 27512 - DNA, 3003 bp, Unknown
  misc_feature (1)..( 3003): 2750-1469P.txt file - cDNA_ID_2990498; gDNA_ID_2214638; Annot_ID_136192
tctgaggtaatcttcttcctaaccttctcgtttttctgtttcttcgatttgttgaaccgagcatgaagcgtcttaattcttgtgaggtcttggatttgaagatcaacaactgaatgtgttgttctctttgtttcttgtttaatccttgattgaggcttcaccgattctctggtatgttccttggaaggatcatgttccttggaggagaaaccgcaatcgttgcttgttgaagaagaagcagaactgaaacgcatcgtatcttgggaattaaacatgttaagggatgaagagtaatgctcatgtttccctgaaagagttctacagtctccggaaaatggtgagacagagaacaaaatcaggccaagaagaaatatactgagtttggtcgacattaagctgctgctgagattactaatattaataaaaccattcaagaataaggaagaaaagaaaagagaagagagacctatgagtgattttgaattatagcttctaaggacaaaagaggagctaacataaaaaagagtagaggattttgtgaaagtcaatggaatcgaaaatattaaaataagttacaattcgatatctatttgactgagacagaaagccatatcataccagaaagcaagaaaaataaacaagaaaacattttaaaaaataagagaatattgtaggtggtgatggtcttctcttcagtgagactggttcaaacatgtggaatctttagtatttttgtttttctgattcgtagttttcgttgaaatgtgaagttacccgcttaacagtagttggtagtactacaaaagtaaaacttcaggtaagaattacttaatccaacttttactatgataaacaacctaatttccaatacgctctcctctacgtatttttatattcaactagattttgtggtgtatatatatatatatatatatataagctcttgagcaatagtcacataattagctcaaaagccagccacatctataacgggattttttaattaaattaaagatcaaatagatgatatactttaattgactgtagaagagtctttctaagtgtgtttgactgtgactaaccacatatgaacagttaagaaaattctttatttaaaataaataaattaaaagatagaggaaacaagaacggagaacctatgttggaaatgcccccaaatctttggaaaatttgtaagtagaaaagttattattttcctttaatttgcaacactattcttgtattgtaaacaaaaatacttgaatcaattattttgaaagaaatgatctaaagatagtgacataattcaatagatttttattttaatataccagtcaattttgttttcctaccattcatattacacaaatgaggaatttcatgaaaggctgcctttcagaatttctgtgtttatacgaatcaaatagtttgttaaaatctaaaatgattatttataaaatgaaatcaataaaagatcaagttcagaaaaatgtatgttgttttacttagatgtatttttgtaaataaagcaaaagattcgaatttgactttcagagttaatactgtttaagtgtaacgtattcctaactatattgtgatgaacaaactgattagcattcaatttgttataatcccaaccaaacatttcatttttaagtgtgcacgtaattccaatatattcccatgtctatctttcaaatctacttttcaattttcatattcaattaacaaaccctacatgtgtttttctttttcttttttgtcaaacgctacatgtgtttagtagattaatatttcatttcagttttttaaaatatgtagtgttatattataaccgatttgtttgacgtaaaaaatgtggtaaagttgtagccaaattgcttgtttttctaatgtgaagaaaacatcctgaatcactaataagacaactattgagaacaaatcggtaatcaatatcaaataataagtaatcgtatgttaaaagaataaaaaataacaaataaacaccattttcgtacgtcgttagtttttattaggtttggattaaactattaaaacaatatgattgttacgaatcatgcggttcacggggtcagacgaaatcataagtgtggaggtgcaactaccagaactacgtacattattaaaacctaccattatacatctcttctacatgtgccgtttcatttattacctcaccacccacttttctcactataaccaaaatttaatacccttccacactatttcttcgtttttttgtcttccacatatttcacttatttgtgttttctcacctgttatagcaaaattaccaccttgcattcatgtggcgtttcacttatatattactgacacgtctactaaaattcaacataatttgaatgtgctatgaagggttgtaaacaattagagtcaattttatcaatatgatgtatctaatttttatacttgactggttttaggtagatatctgttaatgagcgcactgagcatgcatgcattatatatcatacacccaccaacttctaattcaataaatacttccaactttgtccacttttttggttatttaatcaactttgtgtagagtttatatatgaaaccaaaaaaaaaaaaaaaaaaaatctcaaataaaagatatgaaagatcaaatatcttaaatctaatgttcctaataaaaataattgattcaccgaattcgaataacttaaaaagtacactgaaattaacccaattcatatacaaagaattcgtacatatatatctaaaattttagtttattaaatactacatgttatgtatataactgaatgaaattcctaggtaccatcgccgcatgctaaacaagttgttagcatggcaacacattatttgtcaccatcaatattatgcattattttgaccactcttgtctccatcgccggagcaaaaatcccggcgattatagtcttcggtgactcttccgtagattccggcaataataacttcatatcaacaatg

SEQ ID NO: 27513 - DNA, 3003 bp, Unknown
  misc_feature (1)..( 3003): 2750-1469P.txt file - cDNA_ID_2990498; gDNA_ID_2214638; Annot_ID_188217
tcaagaatcaatgagaagtgttttggtggtgtgcccacaagcacgtccatgaagtattcaccagaaccgagcgtcataccagactcaagtgttgctatcagcttccccggtgaaacctctggagctcccaccaaagaaatatctgaggtaatcttcttcctaaccttctcgtttttctgtttcttcgatttgttgaaccgagcatgaagcgtcttaattcttgtgaggtcttggatttgaagatcaacaactgaatgtgttgttctctttgtttcttgtttaatccttgattgaggcttcaccgattctctggtatgttccttggaaggatcatgttccttggaggagaaaccgcaatcgttgcttgttgaagaagaagcagaactgaaacgcatcgtatcttgggaattaaacatgttaagggatgaagagtaatgctcatgtttccctgaaagagttctacagtctccggaaaatggtgagacagagaacaaaatcaggccaagaagaaatatactgagtttggtcgacattaagctgctgctgagattactaatattaataaaaccattcaagaataaggaagaaaagaaaagagaagagagacctatgagtgattttgaattatagcttctaaggacaaaagaggagctaacataaaaaagagtagaggattttgtgaaagtcaatggaatcgaaaatattaaaataagttacaattcgatatctatttgactgagacagaaagccatatcataccagaaagcaagaaaaataaacaagaaaacattttaaaaaataagagaatattgtaggtggtgatggtcttctcttcagtgagactggttcaaacatgtggaatctttagtatttttgtttttctgattcgtagttttcgttgaaatgtgaagttacccgcttaacagtagttggtagtactacaaaagtaaaacttcaggtaagaattacttaatccaacttttactatgataaacaacctaatttccaatacgctctcctctacgtatttttatattcaactagattttgtggtgtatatatatatatatatatatataagctcttgagcaatagtcacataattagctcaaaagccagccacatctataacgggattttttaattaaattaaagatcaaatagatgatatactttaattgactgtagaagagtctttctaagtgtgtttgactgtgactaaccacatatgaacagttaagaaaattctttatttaaaataaataaattaaaagatagaggaaacaagaacggagaacctatgttggaaatgcccccaaatctttggaaaatttgtaagtagaaaagttattattttcctttaatttgcaacactattcttgtattgtaaacaaaaatacttgaatcaattattttgaaagaaatgatctaaagatagtgacataattcaatagatttttattttaatataccagtcaattttgttttcctaccattcatattacacaaatgaggaatttcatgaaaggctgcctttcagaatttctgtgtttatacgaatcaaatagtttgttaaaatctaaaatgattatttataaaatgaaatcaataaaagatcaagttcagaaaaatgtatgttgttttacttagatgtatttttgtaaataaagcaaaagattcgaatttgactttcagagttaatactgtttaagtgtaacgtattcctaactatattgtgatgaacaaactgattagcattcaatttgttataatcccaaccaaacatttcatttttaagtgtgcacgtaattccaatatattcccatgtctatctttcaaatctacttttcaattttcatattcaattaacaaaccctacatgtgtttttctttttcttttttgtcaaacgctacatgtgtttagtagattaatatttcatttcagttttttaaaatatgtagtgttatattataaccgatttgtttgacgtaaaaaatgtggtaaagttgtagccaaattgcttgtttttctaatgtgaagaaaacatcctgaatcactaataagacaactattgagaacaaatcggtaatcaatatcaaataataagtaatcgtatgttaaaagaataaaaaataacaaataaacaccattttcgtacgtcgttagtttttattaggtttggattaaactattaaaacaatatgattgttacgaatcatgcggttcacggggtcagacgaaatcataagtgtggaggtgcaactaccagaactacgtacattattaaaacctaccattatacatctcttctacatgtgccgtttcatttattacctcaccacccacttttctcactataaccaaaatttaatacccttccacactatttcttcgtttttttgtcttccacatatttcacttatttgtgttttctcacctgttatagcaaaattaccaccttgcattcatgtggcgtttcacttatatattactgacacgtctactaaaattcaacataatttgaatgtgctatgaagggttgtaaacaattagagtcaattttatcaatatgatgtatctaatttttatacttgactggttttaggtagatatctgttaatgagcgcactgagcatgcatgcattatatatcatacacccaccaacttctaattcaataaatacttccaactttgtccacttttttggttatttaatcaactttgtgtagagtttatatatgaaaccaaaaaaaaaaaaaaaaaaaatctcaaataaaagatatgaaagatcaaatatcttaaatctaatgttcctaataaaaataattgattcaccgaattcgaataacttaaaaagtacactgaaattaacccaattcatatacaaagaattcgtacatatatatctaaaattttagtttattaaatactacatgttatgtatataactgaatgaaattcctaggtaccatcgccgcatgctaaacaagttgttagcatg

SEQ ID NO: 27514 - DNA, 3000 bp, Unknown
  misc_feature (1)..( 3000): 2750-1469P.txt file - cDNA_ID_2990502; gDNA_ID_1971814; Annot_ID_175895
aaagtggtataaatgaactaacaagaacaaaaataacaagatttagtcgcttttactggtcactaataactacgaaacgaagtggaccttaaaaatctaaggtggttatgttagcgaggaaagtgactgatcttttctctttatgggcttaataaaaaaggcccaagatgcacatatttttctaatggattagtgttcttctcttagaaagcgacgtcgttttgttagactcaacttcacaattaatttttttttctttgactaccgtccctttaaacgacgacggttttgtttttgacagagatctgttacgacagttatgtctccgtcgacgacgacgattttcatcggtcccatcttagcggtggacgccgccgtatctcacgcgattcacacggcggcgaaaccattcctcccaccatttgtcctcctcctcctcgaaatctcagctgatttccgattctccttccccgtatccctttccttcctcctctcccctccattacgctctttcctcgtccctttcctcctcggcctcctcttcgatctaatcttcgtcggaatcgtaaaattaatcttccgtcgtgctcgtcccgcttacaatcacccttcaatgtccgccgctgtatcagctgatcactactcgttcccctcaggtcacgcttctcgcgttttcttcgttgctgcatctgttcacttcttctctgctgctgctgaagcttccatgactggtccaagctactccttcttagatggatggatcagagatcataacgatggcgatgtgaaggtagaagttgtggtcgttgtatggatctgggcaacagtgactgcaatttcaaggattcttttaggaagacattacgttctcgatgtagctgctggtgcttttttagggattgtagaagctctctttgctcttcgatttctgagatttgatgaaatgatctttgggaggtaacaaatgtatccaaattgttgttgtttttaacaaattgttctgtaatttttgtttcgattacattgagaagaagaattgtattgttcatgaatcaaagattgttccttttgtttcactacaaggctcttgttgtattacataatcgttagtgtgaataatgagagatcttattcacttgcatcgtaatcgagctaggcttgaaaactgaaaggctaaacctttcacattgatgtcattgttacctgaggttgagatcatctgtgagcaatctaattgtttgaaacagtgaacttgtggttgtggatgaatgtaatctactaatcttcttaccttactttgtagtttctagatcttttaccatgttctttctatgtaacttctctacgttgtttggagcttcgaaaagataaggaataaacactggcatgtggaatgttgggaatgagaccttgactgattgattagatgtttttcgttactgtgaacatgctatgcttgccaatatctgtggttcctctgcgtttgggaatatttcgtacctgtaactaggtttctatatctttgctctctttcttagtgtagccagcatgttctgtactatgttatagagtcctttgttgtcagagaagataaccgttgctgaaattgccagaatcaaatgattgattcatccaatgccttgaatatacttttgcaagcttggttacaggttttcactcgaatctctgtctctttatgttgcctttggtttgctaatctcatcttttttctaaggttatgcatctgctaggcataggtttatatttataggtattagtttcaacatgtaatccaagtacatcaaaggttcagtagtaacttagaatgtttaaggttgcaggagatgctgtgaaactggacccacatctgcaatttgtaagagactgtcttctacactcgtggagctaccttgttgagagatagtatttataaaacagctataattgaagcttgagtgagaaaggtccatgattgtttctttcttgatttatcttttttcaccttctacatatgaagttgtgtattattgtgattgattgattgtgacatcataaacttgctcaattatcgctgacagaatttgttatgtgtcagctgtttctacagcagttcctgcagaaaactctgttgattagactgagaaaacacagtcaagcttagatggccaaggaggtgtaaagtccctatctcaaaattcagttgacatgtccttctcacggtaataatctctcttttaaatgtttccatccaccatattgttcccggttcttggtgttaaccaaataaaccagataccagaaccaaccggttatgagtttgtgtcatgaattatgggattggtaagtgttgtcattgttggattggttcttaggcatcatttatgagaattatgggattggtatgtgttgttttctttggtgtaatgtatgctgcaaaagtagaggcacacagagtaggatggtacatgaagaacaatgcccaccattggaaaacttttatattatgagagttcacatggttatctcctgtagatcaaacaaggacataccttgtttcaaccttaatgatcacacttagttttctgtggctaccaaacaaaccctcttttcatatgttagtgtctcctcatcagaccctaccaccatttagagcacgaggcgtcgtagatttttgacgagagcaccagtttttgtgattagcaaaagagagtgattagagaacactaataaaatcacacagttataatataaaaaaagggattgagatttgagttgagaggtggtgatggaacttagtggcagtgtgaatcttctttaacatctgagagtggcagagagttgaaagaggtatggtatggtcatctctttgttaccatatttgaggtgaattattgttgtactagagtttcttatttttgccctaaattttgcaagtcctgtgactgtgacctaactcaggtaaaaagtggatctgaagctatagagagagagggtctgatg

SEQ ID NO: 27515 - DNA, 3000 bp, Unknown; identical to SEQ ID NO: 27514
  misc_feature (1)..( 3000): 2750-1469P.txt file - cDNA_ID_2990502; gDNA_ID_2926180; Annot_ID_200186

SEQ ID NO: 27516 - DNA, 3003 bp, Unknown
  misc_feature (1)..( 3003): 2750-1469P.txt file - cDNA_ID_2990508; gDNA_ID_1620511; Annot_ID_159124
agttatgaaatgataaatctcaaccaattccttgtttatcattctatatcagttgtgattcttcattggttttacgttatctcttgaacaaaaaaacatggcaaacgcagagaagacaagttcaggttccgacatagatgagaagaaaagaaaacgcaagttatcaaaccgcgaatctgcaaggaggtcgcgtttgaagaaacagaagttaatggaagacacgattcatgagatctccagtcttgaacgacgaatcaaagagaacagtgagagatgtcgagctgtaaaacagaggcttgactcggtcgaaacggagaacgcgggtcttagatcggagaagatttggctctcgagttacgttagcgatttagagaatatgattgctacgacgagtttaacgctgacgcagagtggtggtggcgattgtgtcgacgatcagaacgcaaacgcgggaatagcggttggagattgtagacgtacaccgtggaaattgagttgtggttctctacaaccaatggcgtcctttaagacatgagatttgtgtattagtgtgtgttttactttggtcattttatagtttttgtaatctttttatatcgaattgtttcttctcattactttctgaattctgatacaattgcatatcttattgttttcaacattttcatttaacgttatatgattttcggtggttaacccgaaagaaaaaaaaaaagtttttttggtaccttgcatgtaaatggcagaactgatgaagtaatcaaaattgaagcaaaaagtggggaagtagtatatgttctggtcataattgagtattaccgataaaaattgctttggtaacacgataacaattttttgtgtcaaatttttcaattttatgaataattcaaaataatatagggcttgaatggtatgtgtcttatttgcatgttcatgtgtttcaaaacgtgattttgccgagtgtataccattcacaataataaccacggagtgataaaccgtgaaaattaataagctattttccaatctatttcgcatgtgttaaatgtataactaactagtttagacaaagtcatttattaagtagctttttggcgtgttaagtttattccgttttgaattttgtcgtcctggtgattccgctattgtattgttcagttattcaactaatgtaccagtcaagtctttaccccttagtttagagttttctcgttttgatgggtttgattggtatgtgagatggatagctgaacaatagaataactaaataatggttagctgaatgaaatgaactaaagaaagtttatgtagaatgattataaattgctaaaaaaaactagttattgtagattaatcacgtttcttagttataatttttaatacgctagtgctatataatggaatcatttttttaaacatgaaaacgttaaaacttgataaaattttgaaaggtaaaaatagcggaatcacgttttaaaaacgtgaccacgtgaactggtatacggtaaaccattcaagcccatagattaatgaaaatgtgataattataagatttttctatctttttcaacatggagtattctaaacgcgtaggagtttaattgattttaagtgatttatttgtctataaatgttatatatatattcgatgtatagaacaatagatgaactatcataaaccataaaattcaatgatttcaaatatgatcgaggtgattttttagctctagtgatatgtctatcaatttcaagaaaaatcgcctccttaaactgaaacaattcgtagagcatatccgttctttgtaggagtatgaaatatgcaaccacaagtccacagcaatggtcaggaatgaaatatgcgaccacaagtccacagcaatggtcaggaaacctcacaacggcataagtttatcttcccgataattcttttcgctcagaaaatagaccatatgacaagtcacaaaacaaaaagtccgtaagacatagtcttagtatgataacgttctagatcaagcaagagaaagtgacataagtatgcatatattcgtgtagagctcatctatatatgcacaataaatctttatcactttacttcaatatatacgaacataagttttattgcacaattgattaaccactttcacttccataagaaagtataagccaaaaaaagagtcctcctctctttctatcattctctccaagtattcattagtcatgtttctttacatttatttatgtttgtgattaggaagaaattataacacgttctaacttttaaaatacttcaaaaacacattaaacaatgttttgatgaatgcgtgattcacaatcttcaaaaaatattgctgaatcttgaagacaaaacagcctattcattaacaccaccagcaaggacgacatgttaacgaccaaaattgcaataaaataaaacaaaagatgttacaaaaacaaatttgtaataaaaaaaaactgttaggtgtttctctttgtcaatgtaagatagagaaatcaattttgggtagaaagaagttgtgaactaactacctaccaataagccacatgactgtgagaagcttttgtttccctcccatttctctatattaatggtgcttcctctctaaaccattcctctctctttctctctaccaccatttattctctccttaatcactgactcgactcgggtcgtgaccaggtctgttctcttctaacaattcgtaactttttttcttagatctgtcttgattccgattcgtgtttttgataccaaagtttcgatatttacgaggagggttgcgtaaaaatcggaactttttttctttctcaatcccagattcgttaatggagtaatgagatctgtttgttagtgattatcgaattagtgtaatgttgcctaatttcgaattcgacattgagataggaacaatttatagcttgtggatctgatcattgtctctcttttgtttgttgtgattctcagttttttctatctgagctatg

SEQ ID NO: 27517 - DNA, 3003 bp, Unknown
  misc_feature (1)..( 3003): 2750-1469P.txt file - cDNA_ID_2990516; gDNA_ID_1620536; Annot_ID_159873
ttataacgaccaatcaccatcgtccatcgataaaagcttatgcttagaatatgaaaaccagaacaaatttaataaacgtaagaaaagaagataataggagcaatgacgagattcttgttaggttcattgatagtctctcatgcatttttcaataagtcttaagtttcaagacgtcatggaacctttttcgtaacccacacgagtttggtttctattttagacaatttcgtatatatatatatttttttttcataataatatttggccaagatattaaatccattccaatactaaaaatatcaagaaatttcggataacaacaaaaatccaaattataatcctagtattggatttccgattgatgcccagtttagatgagaaccaataagaagaagtaattcaaattattgtatttatcctcacaatcgtgaaatcattatttaaaatggacgggccaatagatttccatcgatcatgataaagcgtttaattatttcaacttttatcctaaaaaaaaacaatagaaatattttatttcatcttatcctttctaaggtgggtggttttgaaatgttatcacacacacatcactgttctacgaaaataatatataatatatttattgagttttacaaatatgtatatctatataatatattgtttgtttattattatttacaattgtaacaaacaaaaaatatcttatcatctataatatataatttattaaattataattctatagtatcagtagctagacaagagaacaacattcgtgctatatgaaatcattagaaaatacacatagcattttgttcctaaaataattaaacatgtaatcaaaatttaaatagttgtttggatttatgttttcaaagtgaaaatagaccaattaacattcaaaagctggttgatgctatttttaacgtatacttaacattaaaatatttgttttagttttgccactctcgataattatccctgtcataggatgaggcccacctgttaggtacatgggcccactgggacccaagatttcttatctccgaacttaacgccgtttacacatttccttccaatatacacacaccgaactagatgccgtcaatccaacgccgtttatggtttatcctcccctagacgttaagattttgacggtttgtttttattatcctacaaaacataactgaaaaagtgtaaaacagagactcatttgacgttagattctgcaagtatctctaccgtccgattggagcaagtgatcagaaatattattactaatcaaaaattgatgaacatgattttgagggcaattttccttaagtaaaaaaatcataaagagacgataatgatgtacaaaattatctaaaactgagtataattatataagctatagattaaggtattaagaaaagaaaaaaaaaggtagatccacctgccacgtgacagaatgtcgtatagttatagtttacagattatctccactaacctaaatattaatttatatatatagaatccatgactatagtctatagttgaacttttagatttaatactatgaaaccaaactcaactcttttaaatacttgaaaatagataattttaaaattaatgagtaaagatatattcttggtaaaaaaattagtgtgtaattataacattccatataaaaaatcttagatttcttcaaagataagaactaggaaaatcaaagtaatttttgtaaattgtttactaaaactgaataagaaaatgaaagttgcatatatttttttcaagaatctgcaagtaaataaagtgtaactttaatgagatgtaattttggtttgacatggaatattctgattgggtagattcaggagtcatgtgatgatacatctatgccacgtggtaagatctgagggattacaagcaatgtaaaagcgtggcgaagaacctggtctaaaaagatgaaggtgtcgaccgataatagccggtgaagagaaagagtataaccggtaggaccggtggggaaaaggtcaatataggcttaaaaagggtttaagcaaaaaatgtggtcgtctttcttaagggtttttgtttttgtggcgtttcacagagagagaaagaaataggagattgtttttgcttgtggtgagagaagatcgcatcgtgtgggtagcgtttcaaacaagtaaaataataaaaagaataaaaagtttccgtcactttctcgaggaagaaggggttttggtgtgagtcctttctttgcgtttgtcttttcattttccgatctcgtaattgtcgtgttattcgccggaaaagttaaagattcagatttaaaggtgagagattttacagtcattttttttttagtcatcctgattctgtctttgaatttcataaaaccaaggagattttcgttaccttggtctgaaaatctctgggtaaatcccaattttacgtttttttaaaaaaaattcgtcgatttttatctttcatcgctttattcttcgatctgtaaaatccgatctgagatttagaacccttttgaacacccgtgatctggtggtcctttgatcttgagatcgaagtttttcgtccatacgattattttcttaaatttttttttatggtttagggttttcctgtggtgaaatatttggaacgacggtttgactctcaatttcagatctcaaagttgtttagggttttagggtggtttaagcttttttcaatgggctttgacccaaaaccttcaaaatcattcctttttttgcttcatgcattatttccagagacaaaacccttttattctgtttttttttttaaatttaaaaccattggctattttatctcgttttcttttgatttcaatgtctctttctaatttgatttctcaattttatctacaggttgggaattacattcacagaatttcgttgattggtgtgataataagccattgatcaacaatcttcttttgtggcaatcacataatcgtgttatgcattctgagaaatg

SEQ ID NO: 27518 - DNA, 3000 bp, Unknown
  misc_feature (1)..( 3000): 2750-1469P.txt file - cDNA_ID_2990520; gDNA_ID_2926264; Annot_ID_143282
tgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtttacatttttaccatcattttggttttgacataataacaacaactaagagatagaataaaatatggaaactagtggccggaagataaatataaatgttctggcaaactagcttttgtctggtgagtcttgtttttaaacttgtgtagcttaatttgttttcggttaatgggtacaaagttaaagcatagaaaagccagtcaactgattttaaaaaaaaagtccaccctaaaacgaccaaattgtcaaattagatcttgataacgttttcaccatattttatttgattttttttttctaccaaataaataagaagtgcagagctatctatttagaggtataatatctatgtttgttttaaggacgagttttcaattatactattacattaatcagtaaaaagtaatactatatatataagatacgttaacatcgtaaaatgtataatcaaacttacgtggaaggataaagtttggtcgagttttcattggtacgattagtaactgtttaaattcaaagggaagaatgattgtgtacgaagaaaattgacccaaaagaaagttgaattagaataatagtagtaagaatggaaatagacgcataaaaccaaaataggtatgagtacattcacatgtaattatgtgagtggtcaaagttcgttgatcgtgggttttaagacttagagtgcgtcttatgatcttatctaacaacaaacacttattttagtgaaagcggcttttgtcactttacacaccttttcttctcttccttagggttttacttcaactttcatctttgtaattatatatttattagttcctttttttgtcactttctccagaaatatacgttctagtgttttttacgcaggacatgtttcctctctatttatatatatatatatatatatatatatatatatatatatatatatagattcaattcaaaacacgcagtgtgtataatgtcattttattgcttaatatgattgtgcaattttataattgttgatatattgcctctttttcacgtactcaaacataaaaaacatgaagaacggatcactctctaattcccatgcaaaccatgcactggtatacattttacataacatcatctcattaaactattctactctcttattcttcgatttcataggtggtctcagattgcagcacgattgcctggtcggaccgataacgagatcaagaatttctggaactcaacaataaagaaaaggctaaagaagatgtccgatacctccaacttaatcaacaactcatcctcatcacccaacacagcaagcgattcctcttctaattccgcatcttctttggatattaaagacattataggaagcttcatgtccttacaagaacaaggcttcgtcaacccttccttgacccacatacaaaccaacaatccatttccaacgggaaacatgatcagccacccgtgcaatgacgattttaccccttatgtagatggtatctatggagtaaacgcaggggtacaaggggaactctacttcccacctttggaatgtgaagaaggtgattggtacaatgcaaatataaacaaccacttagacgagttgaacactaatggatccggaaacgcacctgagggtatgagaccagtggaagaattttgggaccttgaccagttgatgaacactgaggttccttcgttttacttcaacttcaaacaaagcatatgaatatttttacgtcatcttattcttttttctattgcggtttatactcaagattcttagccacacacacataaatgcaaatatatatacattgttagagagtattttgtatttcgaataatcttttcgtactagggcttgagccttgaggtgccatgtaatgattagtcaatgtaaaacatatatcctataataaataaataaaagaaataataagcacatacattctttaatataacaggggcaaacacttgaagaattttgtaatcaagtagcaatggagaagattgaactaattaaatgaaagtttttctgatgttatatctttggataaaactgaacattttgttttattgaatgtactttaaaacatttggtaactttcttagacattcacattagaaagtatcctcttacataaaagaatcatgtattcaatatttgatgtcacaccttactctaaacaaacaaatcaaaactatgaaccatataacactcaaagaaaaaaaaacgagaggccgcttaagggtttacactagatttaattccaagcgaagccatctcggcccatcttggacaatgtaatgaaagctactattctattgccagttaatctttcattggacgatccactagtaaacgcatagtttaagatctttcaaaaccaaaaaacaaagctaataaatcaatagaaaatttgttgagtgaaggattttgctttgtatgtttcgtcgatctaaaaagaccaaacccaaacccaaaatggcttttcgtaaatatttcagccaataggatgaggtgactgacccaccaaagacggagatctctatttctcacctcacgatctcatctcatcatcactctctctcactcttgtccgtatattccttttcttaatctcaccgtccgattccaatccaacggtcaacatttatccaactctctctttcctcttcttactcatttccttcttcacttccctctcctcttcacacctctctctcgccgacgacgctacaaccatg

SEQ ID NO: 27519 - DNA, 3000 bp, Unknown; identical to SEQ ID NO: 27518
  misc_feature (1)..( 3000): 2750-1469P.txt file - cDNA_ID_2990520; gDNA_ID_2926264; Annot_ID_204856

SEQ ID NO: 27520 - DNA, 3000 bp, Unknown; identical to SEQ ID NO: 9038
  misc_feature (1)..( 3000): 2750-1469P.txt file - cDNA_ID_2990544; gDNA_ID_1971974; Annot_ID_58699

SEQ ID NO: 27521 - DNA, 3003 bp, Unknown
  misc_feature (1)..( 3003): 2750-1469P.txt file - cDNA_ID_2990548; gDNA_ID_1620302; Annot_ID_152653
atgtgacaagagttaatcgtatcacaatgtctcaaatcgtgtaataaatagatcaattcagtgagatcagagtgtgttttttctttcgatatctccaatattttttagtttacctcatgaagaaataagacaaaataaaataacattaaggtgtcgtcatatgattggttcagataaatctgacgtggacatcattggttattaaaaatgattataaatctctttgtcttaatattttctcaccgtcgagaaaacaaaacacaagttgcagactttatccaaatttagggttttctctttttttcttacttagttatcatcagatcttcaaaaccccaaaatttgcaaatcaggtaataactttctccgtatgtatctcttcgatcaccgattgtctgtttctttgtttgcttttctcgatccgttattgaatttttgagttcgtcgttaaattttgattacatcaatttttcttttcgattcgattcagagagattgaattgcaaattatgtgccagatcttcgtgttctgtatctgattccggatcttggttattagttttttttttgttgttggaatgaattcaacaacgatgattttgatttggtcaattgattttttaatgctatagttttaaccttataggaatgtaattgaactggatcagctttacttgaattgtttggatctagattattcagacaacatctttttaactaaattgaaacatatttgtgtttgtgttcttgatgatcatgtgaatttggtagcataattttcttgttgagatgatttctgagatgggtttttgtagtttaattttcttactcgatgaaccatctcgtgcaccttgcaaaatcttttgttctatatctcattgttcgatatcaaactaatgaggttaacgttttttggtgagacgaccagttatgtaacatgttgttaactatcttcatgtttgaatcgattttgattggatgttttcatgttctatcatattctgcggttttgaatcttctgaattctaacgtgaggttatccttcttgtgcagatctcagcttcccggttagtactaccctcaaatcaactaagtttcatgtctgaacttgactcccaggttcccactgcctttggtatgtttctactctaccaaaacttgagattgtattagtcactgatcttcttctacttgttttagatacttgaacatgttatcatttgtaaatacatgttaatcaaagcatcattttttgtttgattatgctgtttatcttacatgggaatctgtttatctctctcaatttgctgttgcttgtttcagatccgtttgctgatgcgaatgttgaggactcaggtgccggaacaaaagaatacgttcatatccgtgtccagcagcgaaatggtaggaaaagcttgacaaccgtccagggcctgaagaaagagtacagctataccaagatacttaaggacctcaagaaagagttttgctgcaacggcactgtggttcaggattcagaactcggacaggtaggttttatcaaaacactctattgatccatgtagtggaaagtggatgataatatttctgtcgttagtgcctgcttgaacaaaccagaatgatttggcctcttatctgaacatttgagcttctctgttttagttttgtttatggtttgtgttgatttgtaggttatacagcttcaaggtgaccaacgtaagaacgtctccacattccttgtccaggtaaatatcaataactctacgagtctctttactgctaaaacatacaaactgtgtaagatgattgtctgatctcactgtttctctgtaatcacaggctggtttggtgaagaaggataacatcaagatccatggtttctaagctatctagtggatcatattattaataaaaccatatctttttctttcatctcttgttgcgaatttcgggtttgattcatcaaaatcgtcttcttcctagtgttcttcttctgtttggtattcgaattttaatggcttatgttcaccatacttcttcccctgttttcgtgttactctgtttcacatcttacttatcttataatatcagtttgttaagataattctgctctaacttgttataatttttctctacaatggttcatagttttaaaattatataaggaccaaccggaagtttatacggtcgatactttccaagtataccaaattgcaggttttagtttggaccacaaaaaagttcaatgatcaaaaaggctgatgtatcttctcactagtaataataattcataagcacacaaataatgataaatgaactgtctctgtcactagtaaagtccaaatgccgtctctatcgtacaaagatatttcaccttcttgttgttcgtgtcaccacacactcactgcaactggctacagatgttcccagataaaagcttcgagatatttttttatacatttattttgatccatatcacaatattaattgcaaagttttttcccttttcttcaagaaatagagcaatccgattcagtcaattctttgaagttataacagtaatcaattcgccattaattttatacatttaatcaatgtataatataagtatttttctttcataaatgggggaaaaaaatagagatagtttttgaccaaaaaaaaaataaaaaaaaatagacatagtcattggagatggttttactaaatttgggcttgttcaagagaagtgtcttttcttcattcaatcagaaccgtgaagaaaggagatcgttactttccattgatggctaaaaattaaaataatcacgataaatattaataatacaaaaaacaattaaaataacaaaaaaagatcaaaaattctctaacccttcattccttatctctgacgtggccatcaatcttcagattttcttcttcttctaatttaaatactcaacaaccactcttcacttcaccatcagcatcactaaactcgaaccctaaagaaaaacaaaaatg

SEQ ID NO: 27522 - DNA, 292 bp, Unknown; identical to SEQ ID NO: 41
  misc_feature (1)..( 292): 2750-1469P.txt file - cDNA_ID_2990552; gDNA_ID_1526; Annot_ID_145143

SEQ ID NO: 27523 - DNA, 3000 bp, Unknown; identical to SEQ ID NO: 4654
  misc_feature (1)..( 3000): 2750-1469P.txt file - cDNA_ID_2990556; gDNA_ID_1620720; Annot_ID_49184

SEQ ID NO: 27524 - DNA, 3000 bp, Unknown; identical to SEQ ID NO: 4654
  misc_feature (1)..( 3000): 2750-1469P.txt file - cDNA_ID_2990556; gDNA_ID_1620720; Annot_ID_165789

SEQ ID NO: 27525 - DNA, 3000 bp, Unknown; identical to SEQ ID NO: 4654
  misc_feature (1)..( 3000): 2750-1469P.txt file - cDNA_ID_2990556; gDNA_ID_2926214; Annot_ID_142127

SEQ ID NO: 27526 - DNA, 3000 bp, Unknown; identical to SEQ ID NO: 4654
  misc_feature (1)..( 3000): 2750-1469P.txt file - cDNA_ID_2990556; gDNA_ID_2926214; Annot_ID_202842

SEQ ID NO: 27527 - DNA, 3003 bp, Unknown
  misc_feature (1)..( 3003): 2750-1469P.txt file - cDNA_ID_2990560; gDNA_ID_1620350; Annot_ID_154284
attcggataatttaggtgttattaagatttgtttttaaagatgaggttaatacagtttcaaactttcaatgtaatagttcaattaaccaaatagaaaaatatacaaacttaatgtaacaaaacgtagtacgttttgagattttttaagctaacgcattagatgtttagaaattaataatatgtgtatacaatagttgtggaattaatctctcaatttcaaatctcttacatatattaattgtaaacatattattttaaagaaaccttattcttacttattataaacgaaattgtcatgacgttatcctataggagaaattttttaactagtttaaataactaccaattcttactagaatattaggaattagtctggactacatccggttttatgttaaaaattgatgtttttgaaatagtttactaagtctttttatttgtttttacgttttttactatgcatagaaaaacgtcatgtgatgtattcttaacattttaatagtataaacttaaatataatattaaattttcacctttatctatctatgtttggtttttttcattgtaatttttttttctttctaatttgtacagattgacaagcctcaatgaacattttttattagtaagagattgtgaaaatcacataaaatactttcaaagtaacaaccacatgcactttcaaccttcatggttttgaactcacacaaaccatcaaaattacgattttgttactttaaaacttcaaatgacttttgtgttcgtggatcaacataaatcagaaaaatttcatcaacacaagtatttgttttccgttataaattaagatgtggttttaataagtaatttttgttttaataaaaaattaattttatttatttatttattagtaatatattttaaaattatggaaaattgaaaaattcagtattatgataaccaattatatattataatagttatggaaaattcaaatttaaaaatttaaaaattattactttctctttggtaatcgatcgctaacaataatattgtatgaagataaccaatcatatattacgtctaatgaatctatatgtgtttattatcttttttgtatcccctaaaataaaccttgaaatacctaagagattttattattttcaatatgcaagggaacatctgctaaaaaggagagacgaccgtgatctttctggtaatttatttgttggtttaaatgtgaaacaatatttttagaacttttattgtttctctttaagactatataactaacatgtcttgtgagcctatatgcaaaaaagtacacaaatgataccttagatatagaacataaaaatactccgacttaaaaataaacaaacaaagaaacttgattatctttgttttttttggagttgtaggctttgatatataacttcatctttactatcactatcatttttatccttttttggcttagtcaacaagaattagatataaaaatccgaaagtaatataatgagggatttaatgtaccttttcaaacatttttgttttttaatttttgttgagataaaatttattgtttaacaaaaactttaatttacaataataaatcaagagtgtgaaaagtttggtcaaaattataatggcgattgctaatttctttcatgaagattcactgttgaaagagatgtcttgtaattgtatttcttcactgaactaacaagataataatattattacaagagatcagcatctttagtttaagtatataacaaaatcataatattaagacttgtaactaaattaacgagattctaacacttgaactcaatggattttaatttttgcaatatgaattattttgaaattataagacatatagcatatatttagatgttatcttacgattttttgtagccaaaaaataagcaatagatagttggaaaaaagctcatataattctttgagtatttgcaattgagagattcattctccaactatcttgtgtgcacattaattctctaatttggtgtccaatcaacaaaaactagacttaaaaaattcaacgttagacaataaaattgaacgttaagtacttcgattacaaatagaataaatccaaagaattcctaaatctttttcctaaattgaaacacaattgaatcctaggcgattttttctcaaaataaagatctataaagttcaaatttgcatagtcttcatcgattttatagtgtgtaaatttataaactgagtaccaaagattcgtagggcgtgcgtattgtagaatgtgtaagcttccaaatcgaaagtccaagttaaatacgaaatagtagaaaccgaaggtgaagagaaagatagtggaatctgatgattatgatgctagtgttaaaagagataattgcctagttatcgtcttttttttttttttaggaaagacttgagaactttaggttttgtttttgtttctaatcaaatcacttaacgtcctaattaattatgcgttgatgtattttaaattttaaatttgttaattcaacaataaatggggatgtgtctttcatcaagtggttaagtccatttgaatccgtttttcctactaaagttgaattctattaaatcacgttactttgcatagtagaaattaattataaatcgaccttctcaaagtaaatatgtcaaaagaaaaaagaattcaacaataagtttgagaattaatatatacacatgttagttatggaattaatctttgaatccgaacataataacaattatgtctccctaaaaattgaaaaattcgggacgaacggtacgggcctaactgggctctaatagacgggccgggccgtttgtacatctatttaccgtttagtttatagcattttctactgtataaagtaaacggcccaaattacaacccggattcaaacccgtacccgatccgagttacaattgccgcctcactgatctctttcttcggccaaatttctgaattctctaatctctctgcaaccaatg

SEQ ID NO: 27528 - DNA, 3003 bp, Unknown
  misc_feature (1)..( 3003): 2750-1469P.txt file - cDNA_ID_2990564; gDNA_ID_2926270; Annot_ID_143404
tctaagaaaagagtaataaatatctttgcacatatactagaaaccaagattgaagtagtagatatttttaaatttataaactccaaatactaacactaactaattttatactgattttaatatctttgcacatatactagaaaccaagattgaagttgcccacaaaatttagtttgtgagaggcccaaggagatgagagaaaatgcgattatcttaaagtgctagtttcacaaagagccatggcaaaggagggcttagggacttgggacttatgaattgagatagttctaacttgtaaggctactatatctgcctaaactgattataggttttaggtatgtatgatcaacctgtaggctgtagcctgtggaccagccccgtcctatcccgcctgctgatcagtttttccattttgcaacttcgaaaaccagtctggcccttttgtacccaaaccccaccacatctggtctagtaaactgtaaacccaatgaatccgtcattttcctatgtagtttctagattaaccaagcactgtccccatcgttcatataccaaaaaccaggatagatcttgaacactcaaaccagagagccgggttcaaactgggcagcttgttcgtcactggcccatcacacgattcacaccatccctgcctgtgaaatttcaaagacgaataatctctctacgtgaagataagagccttgttgagtcatagccaagaaggcacaagagactagacaatagacggttcattcatgaatcagtgaaacgatacagaagaataaatatttcatttctcacacattctatagggttattctggatcttagtttttttccagtacatgcaacagaacgactcaacttcacaagcaatattaatcacaagagaaaagaatgcatcttatcatgctgggagtgcgaaactaggttgcttccactgtggcggatccatcaccaggcagggatctgatttctcaaagtcagcaacctgtaaacaaatcaatcatatgaatgaaacaatcttccatacagagaaaaaaaaaacgcacacgagtagcaggcatgaagaagacatataaaagtaccttgttcccacactgagggcaatggtgctgtttgttccagaggcaatccattgaagggcagagaaagcagaaaccaagcataaacggcatcatgcaagcaacaacagcagctacaccaggtttcgatctgtttcacatccataaaaaaaaatatatatcacaaacaaagaagatgtaaaccacaggttgttacaatgaatattttcacataaaaccacaggttatcacaaaggaatagtacagtctcatgctcttaaaattgtttcggtagaatgaaaaatgtaagccctaaacatgaatgccgagaaacgagaaaacgtaaagcagactaacttcattaaaaccaatcaccgccagtatcaaaatagaagagatactgaagtgaagcaccatctaaataactccactactaaggaaaagatgttgttaccaacagaaagagtcacaaagcaggtagctttatctttgcagcttaagtatatttgttgagaaagcttaacaataacaggctggatcaatggagttctttcagccttccttttaagtgatttaagttttataacagcttgttcatatagaagtatcaaacattctatagctaatgaaacacaccaatcaaaatgaacaagtttgagaatcctgaaaccaaaaatccaatactcaaaaccttaaaccactggcaatgattagaggcgctaatttttctactatattgcttccaagtatgagatcaattgacatggatccgaaattgccgattgcacatttcctcgatgatttcttgtaatcgagtcatagaacgattcgcgaacaataaactctaaaatcgtataagtgaatatacctgagattggtgagaccagtgttgccgcaataaaggcaattgaaaggagcaggagtgtctcgataaatcgtttgctgaatcggagcacccaacggatcaccatagatagcattcggcggcacaattccggcctgatacggattctgccccgcgtaatatggaactccgatcaccgttgttccctctttcgccatctcctttgtttttagtttttacggtcaaactcaacgatttcgaagataaagcaaatcaatcacaacgagagaaacagacgaagctgattcgaagagtatttatttaattccctttccgctatgaaaattcccagggaaattacgcggaagacgatggagattcaaggaaagttccaaatctctgacgattacgcgtgtgtacttaatttgagattaatcgcaattttgatttcaacgattctttgattctttctttcctctagaagatagagactccacacttaatgggccttttgtttataaacttaaatacttaatacagatattgggctcaaaaggcctaataattgtcttagacctgttcgttctagctttcgtctaaattgcaaggttcgtttttaaaagtgaagtttgagtttgacggtaacaaacaagcgatggactacaaaagaagaacgtgttggactacaaaagaagaacgtgttgtttaggcctctttgccgacatagcagagagtccatgtcacaatcaccttatttattatcttcttcattactgtaattacaagaagattcagcaaaatgtaatcattgaatgacacagagacttttctaaaatcttgtatttatcaagaacattctaaaaccattatgtgttcttatcttattggttaaggattaaactaaatgtcaaaattcagcctaaaatagtccaactcttaatcccaaaggtaacatcatcaaaaccgcgttttatatatgtataatccaatcttataaattaaaaaaccaagttcaacacaatccatcacatccatttcaatagaagacgaagaacgtttcagaatcatcaaccaaattcagaaaatttcagccatg

SEQ ID NO: 27529 - DNA, 3003 bp, Unknown; identical to SEQ ID NO: 27528
  misc_feature (1)..( 3003): 2750-1469P.txt file - cDNA_ID_2990564; gDNA_ID_2926270; Annot_ID_205089

SEQ ID NO: 27530 - DNA, 3003 bp, Unknown
  misc_feature (1)..( 3003): 2750-1469P.txt file - cDNA_ID_2990568; gDNA_ID_2926227; Annot_ID_142558
cctgcaaatcacttgacaaatccttcacgttgtcttctgacagcttcttctcctgcaaaaatgaagcttcgacttttaacgaataagatcacaaggaatggccaacaagaaaaaaataaaactaaaatagggttggcaccttctcgagtttatcataagatttcaaggcatctctcctaatgttcctcagtgcaacctataagaatccaaatacgaaaaaagaagggctgaaataaaggaacatgaagttttagcacatccttatgcaccctaaaagtaacaaacttttgtggaaaatcccaaatacttttaagtcacactataggcaaacactactactgaccttcccttcttcagactgtttagcaacaacctttgatagttcctgcagtggtacaattaaaaggtaatacggcagtttagaaaatgcacattgcaaaaaaaatcaactgacagagattatatgccaggaagagatacctttcttctgtcagatgtgaggggaggcaaggacagtcgaataacatctccatcgttattaggggtcacaccaagatcagaattcacaatggctttctctatagccttcaagctgaaagcattggaatgtatcatgaaccgagcaagagaaagcagacatgaaaactcttgtacagaaaaccattagcgcaccattggtcatgtacctggatttgtcatatggttgcagcaaaagagaacttccatccggagtactgatttgggctatgcttttcaaacttactggacttccatagtattccacctgagaacccaaaagatcaaaacatcaacaagttatacatatgaaaccatatttggtagctgtatatcttaatacctcaatcttgtcaagcatcgctgcattggatctcccagtccttatggagttgaaactcgtccgaagcgtttcaatagtcttctccatctttgatttctggattgcacaaaccaaaaaacaagaatcacatccaaatcgtttccactaaacagtaaccaaaaaagatataaagaacgtacaacatcagtctcaatagcagacttctctgcttctatttcttcaatagtagcagaccttatcaccaatctgtggaattttccaaacaaagaacatccggattagagacattcagcaaaccctaaaactcccaaatcatgagtggaacctgcctcttctgtagagagcgcttgacaacggggccaccggagagattgacgccggcaccgagcggaagcttgtctgtcttgaacgaacacgcaattaagcgtgtagagggagatatcgccgaagagattatcctcaaacacgaatctatccaagggtattaaagcaacaacgatttggagccaaatggattatagaggacagtgaagaaacaaaattcgaacctgggagagagaggagaggcttggagtagttggctctgaatcgaagaaccggtgtcgtgggagcagtggaagagaaagaagccgccatggcagtagccgtagaagtgaagtgactagactagaaaagacctttcgttggttcgtctacgaaaattgaaagggagggagacgaagcagaccgaattgttcgggataagaaggaaagcttgctctgtttggatggacagctaactataatcccttcagatatatcttttctgtgggccttaatgggccgtaatatcccatttgctatttacatggtagcccatattgaaatgggtttgagccaacaaaatttgtattgggtcgaagaaggtacggtgatcaatggtctgatttgtaccagaagaaaagtaaaactaaaaggtttaaattctaacatatttatgtcatggtccaaatcaaagggtaaattgtcaaagggtattcaaaaatatatattaaatgaaatggtgcattgatatcatcattcataaactatttatatacttttgccggttcgtcgtcgattccacgtccttcatttatgatggataggagatatataaagaagagttaattagcattaaataaaaagatactagtagattagtaagaagaggcaacaatgtgattagcgggagccgagccggtaaggcagccgaggttcgcgcttactccttgaccttcatactgacatgcctactcacacgtgcgagaacagtcctaccaccccatcaatgtttttttgtttagtaaaattctgattatactttgattttttttcctgtcaagtatactttgatttatgttcttttaattcgtgaattacttatatttatgtgtctagcaatagtttaaggcttttaaaaatagattaattatacatgtataatatacaagtttgggaaaaaaaataagaaaactatctcgtgtcgcattttttgtttagtagaacatataattttttttatcaagcaacaaatattagctgcccaaacaaaagaaaaaaatatgtcaaaaaaaaaggattattcacatcggctaattaaaaaataaaaattgacttgacgagatttagttatttgtgagataataatttgttaccaaaaattatagtatgccctttttcaatttgtgttaattatatttgtaattttcttcagagaaattacaccatttaaaagaagaagaaaaaacaaatactaatatcattgtaaaatatgtaaacgatgggaaataaatagaaaaagaaaacaaaacagtgcatcgtcgtcagtgggagtatataactaccaccacccactcaccattccggaattatctctgaatcactcataaaccctttcttcttccttgttcaaatccactcactcttggagagagacgactcaaacgcatagtctctcctctgtatttactcgttatcgtcactgtgagagagagagagagagcgcgcgcattcccccaattaaagcctctctgctccaaaccgtgatatactctttacgttgtttgtttttgcctttatccttccctagttgtgtataattttgttcttttcttatggagatg

SEQ ID NO: 27531 - DNA, 3003 bp, Unknown; identical to SEQ ID NO: 27530
  misc_feature (1)..( 3003): 2750-1469P.txt file - cDNA_ID_2990568; gDNA_ID_2926227; Annot_ID_203538

SEQ ID NO: 27532 - DNA, 3003 bp, Unknown
  misc_feature (1)..( 3003): 2750-1469P.txt file - cDNA_ID_2990578; gDNA_ID_1620424; Annot_ID_156665
acttaactacgtacgtacgttttagtaaaatacatgttttggttacataccaacgtatgaagtacgtcccacaatacgaaggcatgtggaaggagtgaacttgagattcttcaccagacacgactctattccatcaaatacgggcattgcaaatacctgtttacatcattatactacttatctctaccagtcttgcgaagtttattattcaaagagaatagttggcgttcaagaaaaaactggatttaccataatattggaatgctagaaatcagcttattcaaactaaataagaggttgtaaacgtgaggtgccagacccttgttgagagtgggattataggccaaatgcatcgaaaaccatctctactgtgatctctaaacatttgaccggaaaatgttcaggagtgacgatacaagtttaaaaacaaactgttgatatatacaagggtaactcatatttgaatttgattagattgattaaattattaaaaagagacgtacctataatgccttttttttgccaaaactttagttataataatgttctgaatttgtttttccctttaaagacattgaaatagcagtcttcaagaaaaggaatatccgtgtcgcatatttaagataacttatcatcattgtaaaaacaactttaattagatatgtatccaaataattgccgacaaattagaagaaaacaaaaggaacacgaaggacttgctttcatacactaactggtgtcactagtcgtcgaagactaacgctgtcgtaagaaaatcagttccacgtgttccgtacgctggatccgccaactgtttagatttttatttttcacgttattatataaagtcaaactctaattagagaacatgaaaccaaacttattataagaaagaaaaaaaaaacagaaacaagaacggtggaagagacaaagatgtgtagttccgattctcttcagcttcacaatgtcttcgtctatggtagctttcaagatcccgacgtcatcaacgtcatgcttgatcgtactcctgagatagtctccgcaacactcccgggcttgtacgtacctttctctgtttcttcttcgattgagttatttttctgtatagacttaagatttaatggccggttttggttttgttcatcagtcaaaggtttaggcttaaaggacgtttgtatccatgtattgttccttctgagaaaggagaagttcatggcaaggtttgattcttagatgattctttggttttaatttgtgtatgaaatatgggattttagggttttgatttgggaaatttggtgaattggtttgtgtaggtactaatgggagtaacaagtgatgagcttgagaatttagatgcggttgagggaaatgaatatgagagagtgaccgtcgggattgttagggaggtaaaagtttaaaggttgatgattataaattttggaacatgttggatgattataaattctgattttgcacatgcaggacaattcggagaagatggcagtgaaaacatatatgtggatcaacaaggctgatcctgatatgtttggagaatggaatttcgaggtttgatgatttaaacaatgtatttttagcttttgtgaactcattatgactggaaaaatggtacattgtttcgattcgcttcttaggaatggaaacggttgcacaagaagaaattcatagagactttcaagaaaatcatggaatgtaagaagaaacctcagggacagggaaatgatgatattagccatgtcctacgcgaagatcaataggataagactccatcgtcttggatggacttgtgtttgagtatgttctatatataaccacctttgttaaattatcaacaacaaaaaaccttcgtttttaaaaatctaaaataaataaaacgtagagagtgttgtattgatgtaagatttttgtttttgtataaatttaaaatttatttaacaaaaaaacggttttacaataaatacatcgttactgaaacaagtataaactgaataaaagagctaacgacaacaagtgctaaaccaatatcgtagtccgccttcgtagataggtgaacttgaagtaactaaaataaactaaaatacttaaccgattccgcatattcttatcgaccattttggcaagagagagggctggaatggatgactcgccatgccttcttccatttctctctttctaaagagctgaaacacatatctgaaaacaaacatatgaatttgcgtcaaggccgaatttgtagatagatcaaaatatcatgtggattatattattatatatatgttatacttgcaagtatttagagatttttgcatcttacttagcttgtgtgtgtttggtctatttgaagtatttgcagaaattctatcccacaattttgtttgtccgcctctatccaaaactgatatgcgttcaattattctgataaaaatttagatacatacgcaattaatcatgagtatttaaatccttaaaggttccaccatctaaatgactaaaaccaattagtaatcaataccaattgggttagtgggttttgggaaaatttaaagttttgtactcaagttggtgtgtctaattatttattatttactttatgaattagcataattaagcaaagaacaaagaatattttggtcaaatatataaaaagattaacatccatctgaaaaatcttttacctatagtttttgcaacttgaatatttacctcaatagataaaaactagagttatttttttttttttttgtcggcaaaaaactagagttatttatcaaagccaagttagcaaaataatctactatgatgacaaaaatttgtaactaaagaacataattccacgtcgttcaccgtttcgtgttcctacgtgttattcttttttttggtcacgttataaaacctcaaaaagctctagaggatcagagaaaataacataaccaatcccaagaagaaaaaaaaaacagagtagagattgataaaaaaaaaatg

SEQ ID NO: 27533 - DNA, 3003 bp, Unknown
  misc_feature (1)..( 3003): 2750-1469P.txt file - cDNA_ID_2990585; gDNA_ID_2926088; Annot_ID_196511
cgtaccatatatagtttttcacattttcttgggtaattttttttttgtaacggcttaggtaaaaaaattacatcatcttgctgttgtagcggtaattaaggataaatatatatttttattggactggatataggtaataggtccatgaattttctctaatgaggctagatatcatgattaattttaaaaccagcatttagctttctaatttttttgttcggatcctatcagtcgatgaaaatataacgtgatgtgttgaaattaggatgagctagcattgtgaaatataatccctaactacgaatatttgtattagtatagctctctttaactatgaatattagagcagttttgtggttgactgcagtaataaagatttattgacagagaagctcggatctaaatctacatgaccttcgtcgttatcttctctttctttgtggagctatattattttcttgttgttcttcatagttaatctgaacataagggaatacattaattaggatatatgataataaaattaaaacaaccacccgtacaagattttccttgacggccgtaagatccggaactagaaagtcaaactctgttgcagttcaaattccgtgtactttactcgccgcgcgcgcgtgacaaaaaaataactatgtgagtgggaaaggaataaactaatgaagaagaagagaaagcaaaagaaactcgaacgcggagaaattgttgttgtcgtcgcagttaacgggttttattttctctattgtcttaaattttcttgctcgttccattttcactttaattgctccacgcatctcaaatcaatgacaaaaaaaaaaaatgtaccagtgtgaatgtgtcataagatctctttaccaaacaaaaaaaatgtgtcataagatctaaaacattatacggatctaaataacatacaaaattcagatcgatgcatgcgcagatgccttgtaagcgtgttggttatattttgaggagtataactttggatatgaaaaatgttaactaaacttaaaaccgaaaaaaaatatgttaaactctcttcttcttttttttttttgacaaaatgttaaactctcttattcacaagttttctacaccagttcaatttgttttttttattcaataaaaaactacttcatcggggtatgtgttatcaagtatttcattgtagttgttaattggtctatgtgaaaatatataaatttgaaatctaattaacataatcacgacaaaataaatatgcttttaaaataaagaaaaataaatatgattgttagttatttacattttttaataccggccagtagtatatgctgcggctagctctttgccatatatgatacgtgccggtgcatctttgttttgcttgactactaattttatagttctgtgtttattcataactcgaatatttgtctctatataacagatgatagaaagcatggttttattcaaatgtaatcgattgcgttttactttaatgatgctttacatacacgatatctccctttttcgacacattatctcttcgattagaacaattattgtgtatgtttgcgtgttttgatgagtatcttatagtactacttatttgaaattaataacttatacaaacctttaaccaaacacattttttgttttatcaatattaataaagatttatagttccccaattccataaatatgaatacgacacatcaacgaaaattatgaaaaacagccatatatagtttgcaatgtcgaatctcgatatctccgatggtggtcacagctattgataaacaataattgaacaaatcatgatcatacttaataatataaatggccatttaataagctgttagaagttctatcaattaaatagctagatatttaaattaagcaatttagtaaattttccacaataaaacaagacgaagtttatgtaaagtcttaaacatgtatagttttaggtagagaatcgaagacaattttttttttttttcaaaagtttgcatgtgttcagtggttgagaacttgagataacgattggtttatctaacgaacacgctctttcatatcttacaattaacgtttcaatcagacaaaggaaaagttaaatagatgtgtagtaaaaaaaaaacatattttgtttgtagtctttgtcttgtaaaagtcttagaatttgtggtggctaaacttaacccgtgacactttgcaagtattgttgggccatttactacaacgtgcagcaaaacgcgtgaaaaatcacgtagcattaaaacaaagagccagacaatctggagattattatgaagattttttttttatctcgtaccgatttcagccaaaccaaaaaatcggattccataaaaccaatcagaaaaaggagatgtggcatttgaatttgttgcaaatgttttcactcaatatttattgaaaaagcaaaactccatattaaatcatactctaacatttttttttcctactatgaatgctactacaaatatggtggaaaactagttatttgttttctctagaaacttacactttattcgtctaaatttgcttgcaatagaactatactaatgaacattcaaatcacaaatgaccttttttactacaatcctaaaaaaatcttaaggtattcaattatttaaatgaacaataagaaaaagacacaaacacggtgggacccaaaaaggtctctcaaggtaggtcccacgagaataccctccattgctgagtgctttaaaaacagctgcaaagcatctacgttttagcatccgaacaaaaaaaaaaacaagttttcttctttttacactcaagaatataaattccctgttctccagatcttttctcaagaaaatttaaagctttaacttaagaaagcttgaacctttctcttccaaccacatcttccttctttttatcctctagctcaacttagaaagaatagaataaagtggcaaaaccgaaagtgaaccaacttgtagtaaattaatagttatg

SEQ ID NO: 27534 - DNA, 3003 bp, Unknown; identical to SEQ ID NO: 20828
  misc_feature (1)..( 3003): 2750-1469P.txt file - cDNA_ID_2990593; gDNA_ID_1620814; Annot_ID_169184

SEQ ID NO: 27535 - DNA, 3003 bp, Unknown
  misc_feature (1)..( 3003): 2750-1469P.txt file - cDNA_ID_2990596; gDNA_ID_1620771; Annot_ID_167527
atgaatgacaactcgaacgtaaaattacatcttttgcttttgtcaagtgtttacatcagtaatatccccaatttcaagcttatttttttttttcaattttaaaactaaaaaggttccaaattttttttatcgatgagtcatatttcatttgaacattccaaaagtaaagaaaagagttgaaaactttcctcagcctattacaattgcctttagctgttaatgagttttagagattcgattagttttaaccaacagttcctgaataattggattttactctcttgttgagtttaattattccaatatttcttcatggtgctgttttgctattgctggtgataaacagttgatctaccgacgatttgcattcgacggtggtttcttcaccagaaatcgatatctccgatggcgaaggatgacgatgggaatcttttttggctcatcttacacgtgtattattacgtgtctttggatgatctttcttgatgcaatcttcttctgtaaacggtgtattattgggctcttcttgagcttgcttttgttcgcaatctgtttatgtgtgttgggctgtaattggccttgtagcaaacggtttattgaataaagtccactattgagaaaaaaaaaaaaaaaaactgaaaagggttgtttttaggcattttttgtcggagaaaaatctgggaagaagcttcgtcctttgcgtgacagggaatctctccgttggggttttgtggctgcctacgatttctgcaagcaaaaccacagaactcaatctaattaattagccgagtcgactcaatccgagtttctacagccgcacgagggaatcatgaatcggctgagaggccgaggtacaccgattctgggttccgcactcgtgcctcagctgaagaaaaaagccctaaattcattggtcgccgtccaggattcatatctatccaccaaggtgatcgaagaatttcaattcataccggtttctgaagaattgggattagtaaatgttttttgcatcaggatttttgttaaaatgtcaatctataatctgcttataatgggtttcgtttaatctcttaggacttgttcgagaggcacagggtcgtgtttacagttggaacttctatagcatctgttgctacggcttggattggtatgttacaattccatattttttgcttactttatcttcaattagagaatctttacctcttaccacgtattttgatgtttaagtttctgaattggattgctttgaaaggcgagcaatggctattagtgaagtgattcagattttgggtgttgattggcttcaattcatgagtgtttcattgggatagctttagctctcaggcttgatctctaggggtgaaatccattctgtgataaatttgaggcctttttccggatcagactatagattacggtttagttgatttgatctgccataagtttccaagtgtttggagatcatcttggtcagaattctgtgatgatgttcaataactaatctgtccaaaacttccaataactgaagtttagtactttgagatctctacatgatattctaggtcttttgttattctgctgggacataaaacaagttagaaactgaatttcttgtgtgatactagtgaccgttggaagaggtatctcattggtcttttgtttatgtttgtactgagtcaaatgagttttatgaccgtgttctaccgaatggatgaatgattgtgcaggttactcattacgacattacaatgaaactagaattaatcagaggctggagtccattgagaatgcggttagtgtgtccctcatttgccaaagtttattgcacatagtattgcatatttgctttaaatttagctgctttgcatagttggattcatatagctgctcttcttgcaaatgacttggtgcttcctcttatgatgtctagttattgatcctctatcatgaacttacagcgtagttgtctgaatttagtcctctttccgttaataatatagatttttttgctaatacttacgtggttgactattttacactttaaaatattcagtgttttgtttttgtaccttaatgatccttagttgctctattgtctcagtctgtcacttgaaatgtttgtttttttggtcatgccagatgaaaaacacccaagagttagaacgaggagaactgaagaagctcgttgatccagtcggttccaggttcactacaacaattgccacagcgggaaccactttgatcctcgggtttgtttccggaaagactgttataggttgacaagttagatactgtgtgtcgggtttctcattaatagtttccgtctgtttttcttcaggtatgggttgggttggcgaggcgggatatggtatgcaaataggaagtttagaagggagcaaatgagattggccgggcagttaaaaccgagagaatggaagttactagggaggataaaacctcgagcttggccaacaacaaagtttctcagacgaccattcccaagacagaacaaaacaacagaaaatgctttgaaggcaccagaatgtggaggttgaaaaattgaagaacaatctaaagaagtagctgatcggaacataaaagtgcacatgggttttgtcttgaagccaaaggctcttctgtctttttattcctttatgaggaaattgagataacctaattcgaaaatcaaatagatttgtgttataaattgactctagtagtgtggactatgaaatgtgattcagctaatctttatatcgagatcaaaatttaaggattcctctgttttcgcacataaaaaagaaaaagaaaaaggattcctctgtttatgaacaagataaccaaaaaacatggccaagtagatgagaggagagtgtgctgacgtgtgacaatatcattggtgcgtacacgtaagtccacgtagacaatgtttttagttcgtgtcctaaagagtcacttttttgtgttttggtggagaagaaagagagggaagaaactatg

SEQ ID NO: 27536 - DNA, 3003 bp, Unknown
  misc_feature (1)..( 3003): 2750-1469P.txt file - cDNA_ID_2990616; gDNA_ID_1620304; Annot_ID_152771
aaaaacccagaaattaaaaatcagaaaagcttactcttaagttgttcttcttgttggtagaagcagatcgatcgacattagcgagacgatactcgtgcataatccaattcgttttaatccctttcggagcttttcctgcgtagaagacgagtgctttcttaatccctaacgtcttcggttttccgatcggtttatcagctccagtcgctttccaataaccggttccagctgcccggtttggtctcgacccgtttgggtatttccggtctctatgcgagaagaagtaccattctttctcaccgtacaacgccatttctggaaacaaaaattcgaattctcttcaaaatctcaaagtcaattcacaaaaccatatgtcaatcttgtcgtggactgaagttttacctggaagctcccatggattgaatttgtacaagtcaatctctgcgataaccggaacgttaatcggttctgacgcacatctccggcaaagatagaacttgacaagctcttcgtccgtcggatgaaatcggaatcccgccggcaaattcaactccgccttcatttttggaaaagtaccttgttgttttcttgtggataagattcgattttgagtttttataaaccttcgaatcggaggatctttgtggtttatctcaaagattgaaatcgaggagaagagagcaaagtccatggagcttttataaacgaaggggaggttcatgaaccacacgtgtgtagttttctttcggacacgtgtgataaaaaccaacctttttctttttcaacgttgaccgcgcagccagctgaggtttacacgtggcttggactaattggatgatcgacatacagagtatgtgatgatgtcattgcttccgtcagccgcacgaaccttttcgtggttgtaatctggtacttcacggtgtagcagcttgtgcacgatgttctctggctgatatttatattgtgacttgtaagtggactggtcagagtattactgtgagcttctccgcagcggatttcttctctgttcatgtaattgcatacgtcattgagaatagatgacttcatcttagtcacacgccggcttatatgtatacgtaaagtctgaaagatgcgataatcgaccagtttcgtggaccaaattttccacataaacgacagttactatttaaaatgaaatgtattatagtttgcttattcttttccctaatattttataaaatgttgtttagtaacaagtactaagaccatcttcattggtaatctttaagagtttctaagcacaaatccttatgaaaaaagtttaaaaataattcaaaaatgtgaaattaagcaaggtatgcaccttagcttaggtattctttggtttctaagaaacttatatgtggcagtttttcattgactggagaagaatacaaaacaaaacataaaatctttcacattttttttatatcttctgaagataaatttgaaaataaatctaattgcttttggtttcttttaattgaatagatagcaaaaatattatctgagtcaaatttaaatttaatcgttattccaattttttatttgtctttttatatgtttttatgtcatatatgtttatgatttaagaatttttaataattattatgctttatcaaatcgaaatacttatgatttttcattttaaaactaactttttttctttaaagaaacccacttaaggattccaccattggacaataaaaatagtaaagactcaacaaaatctctaaacttcaaaataatcaaaatttattcttaaaaaaattaaaggattccacattaggactccaccaatgggggtgctctaatgaatgtaagtaaactgatcttatatgttataatttatattggggtatgtttgacaactgtgacaattagaaaaatgggctttttgagaagaaaaagaatgtaaaactcaatggaagatataaaaatggctcccaaaatcataaaacatacgaaaaatatttatgtgtgtttagaaacatatatcatgtttaataaccaaaaaagaagaagaagaagatatttataaactagaaaagaaaaggtaatgcttagctagagcatcaagattgtaaaagcccatatggggcttaactataacttcccttttaaaggcccattttatctttacgtgaaggctgtgttgggtccaagtcttgtcttccaagttccagttgcaatgtcgtatacgcaaaacctcaacacctaggtttcaactttttcccaaattttgcttagacaagtgtatatgcaaaatgaagaactttaatcgaataacttttcttgtcaataatttttttttttttttttgctttaaggttttaattaacctatttaaaatacaatttgatatgttgaaatttaaaacatatattgtaaaaataaatttacaagaaatctttacaaaacaagattggaccattttgttgttttgaaaaatattcaacttgctcatttttagcattgacttgaacttattcaacataagtatcacttaatcactttactaattcaactgatcaaaacttcttttttggtgggatattcaactgatcaaaacagtaaaggttgattattagtttgccttagaagttgaagatcatatagatgctagtcaaattagaaggggcattttggtaattcagttgtagaatcgtaagacaaaggtgaaaagcataatgctattttcaggattatataacacatcaacagaggatccaaacttttcccaattattgcaagtcaatcgatttgtttatctatataaagctcccaaatctcaaatctcaaatctcaaattttttattaaacgcctacatatattactcacacttgttttcagatcataaagttttttcttggatttatatataatgcactaatacatacacacccacatgcttacacacatgttcgaactgtaatcagtaaaagaaacatcagagaggaagagaaggagaagaaaagatg

SEQ ID NO: 27537 - DNA, 3003 bp, Unknown
  misc_feature (1)..( 3003): 2750-1469P.txt file - cDNA_ID_2990620; gDNA_ID_1620414; Annot_ID_156378
gactgatcaactgctaagtaaagaaagcgtcacagggtgtttctagctagtcaaagacgatcccgacttgacatgttttagagattcttgggaattttcggagtttcttgacgatttcatcttttgctgaacaatactgcaaacgtagagctagacgtagagtgagtttcttcagggttgtggaattctctaggaagtactttactaacttcatccttgcaacatatactaagatgctgcttttgatatcgacaaactctagtgacgatagcaaacacttcggtacagatgaaaaattgatatgatagttcccattcaaaagcatcctcttagagttactattagattcctgaggataacaaagagagagacatataataaactcagtaaaaaatgataagcaaaactatatagctcgatagggttaaccaaaagcattaccatgatgagtgatttcaagttcgggcagctctcgagaaaggttggtaaaaattgcaaatcagatactccaagagtaacactcaagcgggacatgtaagaaaatttaggcaggtgagggagcggtattaacgccaagtatcggtacatgagctggaaacaaacagaaaagaatgtgattagtgatagaaacatgtccaagatctctgcattgacatataagataggtgtataccatgaaagctggtgaatgtattgtcatttccataacacttaaaatccctggaagaaatctgtcgatgctacttctcattgatgtaacgcttgtttcatcaaaatgccataaaccaaagaggatagaaagatctaacttgtcattagaacccaaattgtttactatgaagcttttcgatacattatcgttaatcctcaaagagcatagtagaggagcatcaatcacaactcccgaaagagcaacctcatggaggaaagaagagactcgttttaaactgaacctctttagtgactgagagtgcacccgaaagacttttctatccatcccataaatgataaccgttaagtcttccaagacagggcagcaagagataagtttcttgaaagtggattcattgggatacatattatcttctaaatgcatagtcttcatacaagggaaagagacaaacttggcatcgtatcttccttcaatctccgactaaaccctttggaacaatcctgtttcgatttctttctaccaatcatggtgttgatcattctctacgtagcgaaattgaaaaaataaatttcagagaaacaatcaaataaactatcaaacgaagacttgaagaagaagagatctcaccgtgattttggttcatagaggtcaatgaaggttactctttttttttaggggactatctccacaaccacgtagttttttctatgatagttaaggaattaacggcgtcgtttttgtgtagcttccctggtctcaactattgatagaaaacgatgtcgttttaatttgcaatcaatttgaaatttgtttttcttatcgtattcatttatttcgatagtctcttgggaatatgttattttactgtaaactttctagagtaaagatgagattgagagatctaaataaactttttaaaggggttttagatcttctgctcttataccatgacaagatatgaatatcgaatgaattggttgattattgatggacccttaggtctgtatttatacaagttaagaatcggtaaacctaaaccaaaaggaaatctaataaaagacaataatacatagtggaaagaagaaacccttactaaagtgagtctctttagtgattgagagtgcacctgaaagacttttctatccatcccataaatgataaccgttaaatcttccaagacagggcagcaagagataagttccttaaaagtggcttcattgggatacacgttatcttctaaatgcatagtcttcatacaagggaaagagaagatcctgcctttatccaaggacacctcaaagagtcttaaggaaaccagtgcctcacatttataaagattaaaatgaatcttatgaaactgaggcagaaactgaacatctagatgttggatcttacgcttagctgcagcatcaatccatgacttgagataaaagccatcttcttcattttcactaatagttaacttgagcttgtttatgcatagaaccctattggaatcgaaatacctatcacaaaaactcacaaaggtattgaaatcagagaaatctcgggaatccaattccaaactaggaaccaaaagccagagacttctccatcttgtggataaaacgcttgtcttaacaacatcctttgtaggaagataattaagtatttgacataacaaagattcatagaattggcttattctgtcttccttcaacctctgattcaacccttttgaacaagcctgttttgatttctttctcctcaccatgtctaattttttctctagataactttatctgcataactaaaattggaaaacacaagtttcagagagacagtttggttttgaattagatattcattcaagttcgacttaacctaacgtcccaatcaaaattctcagtctagtaatgtaaaagatttcaaatcaactaaggcttaaaacatacatggtgaccaaaagctataaaaagattcaggcttttggacctgtttctgatgggtaagaacaaaacgatatgtagaagaagaagaagaagaagaacttacggtgacttaggtaatacgaaagaggtcaatgaaggtttcttacatttttttttagaggaccagtacaatcataatgacgccgtttctagtaaataaacgccgtggtttcactgctctacgtaattggagtattgaaaaccacgtcgttttgatcagcggactagtctctcaagctattctaagaaacgaggtcgttttgattcgcggttggtctttctctctctctaaagcagaaaattcgtagaatcggagagatttgagaagagaacgaaggaagaagaagaagaggaacgatg

SEQ ID NO: 27538 - DNA, 3003 bp, Unknown
  misc_feature (1)..( 3003): 2750-1469P.txt file - cDNA_ID_2990640; gDNA_ID_1620647; Annot_ID_163278
tcaacgcagatcaagttttgcaatatgaaaaaaaaattataatgtttgtgtaaatgttttttgttatattaatgaaatttcactatttctaacatattaatactaatgtatactgaatcatcttttcaagatgtaaaaaaacatataaatttaacaactgttttgaataatattgacaatcatttttgtagaatgctgagtggaagattagtatgtcattcatttaattacacttaaatatacatggataattaattaggataagttttcttatcaggcgttttcgtgggacaagtacataattaggttaatttcttatgggattctactctctttttttaaaaaaaaaatctagacatttccaaatgtcgatcgaaaacattataaccgaccacctgtataactttccgtcgatgtcccccgtatgtacaaaacttaacaggtcaccttatccgtgtacgtggccggatctcattgcgtttgttagatttctgtgatgacgtggtgttttcctttacactaggaaacttcaatttggcattggaatgtaacatatggctaaagtaactttatctgcttaacatatttttcaaatatctaaaactatttctagaccgaattttagatatgtgactaagaagatttcttgatttacatcaaccaaaacaagagcaccatgtgctgtttcttatatggatataacagttcgaaataagttatcgtcttcatacatccctagaaccccaacgactggactaaaaccctcaacttctaaaataagacttattgtagaataataccaaattgtgaaaaaaaaaacaaatataaattattgactatagtttgaagtaagtcgtaattttttccgcaaggtaaattcattcaaagttaaaatgtggagagtgagagaaagagagtcgcgtggctattgggtaatgagaaacgattggacccatttggtatcattcggaagtgatatgtggcagagggcaatcatacgttttcgtcatagcgttagattttcttacagtttcttagagattatttcgattgtttgtgtcaaacgagtttagtatgttactgctattgaacagtagtattttctcatgtatcgatatgaatacgtttactctttttctttttttcacacaatcagatgaatatagggatgaatatacgtagttttgtctttgtcatatactagattatattcccaccagtcattttcctatgtatttaacaagacaagacgtagaaaaatgagaattttagtacttgagttaacatatttaaagattatattcccatcagtcattgaacatatgtgtacatatatatacgaggagaatctataacttagtaaggagggaaatatgagattttatttctatagagaaaagaaaggataaaacctctctctgccaacactggccaccgtctccaaagtccatcccagttaatttttattttttggaatcttcttatgttattactctttcttttcttatgacaacatgtcaacatgtgacctgtcgtcttctactttcttttcttcagcttttctccttttaagcagaatattcaatctatcttcaaattcatatctgagttttgtactataaaagaaaagcagacattaaaaaagatttgaatataaaacaaatgtattggagtggtaaagcacatcttcatcaaacatttttaaggagcatcaatctaattggtcgatggaaatggaagtaaaggaatagaagattgtttgtgttccatgatgatgtatatatatgcctaattaatgttactgttagttacctttggataacaaagatatttaaagcggtttaatgcttattaacggttgatggatgttaccttttctttttgacatcacggtagatgttacctttcataggtgttgaatagacagattggggacgttaattagtaatgatgtaattagttagagctaaatagtgctaataaatatatgtaagaaattgttcggaaagtaactaaaaaaagttcaattcatgcaagtagacacttcaaatgtgataaatgtataagtatgatgttaagcatgtgacccttgagagtcgattagggcactgtacaagattgacccaaatagttacaaactacaagtgaactctcttccattacatatctacgtgtattgaggggaccattatcgtacgtatacacgtatatatgttttgccctaaattcccaattttaattcagcatgggggacggactcattcaatagcatcgtctttcactttccttcttcggtttaaaatctcattttagtttctgatccaaaaaaaaatgtttgatcaaagatcaaaaacttagatagaaacaaactgtttttttttcttaaatcaagaaagtctaaaaaactaagatacaaaaagggactcgcagcggcagagagataagtatcttacgggccagcagataatttctatgttacgtccctttcatccccattgcatattgcatatgaagacaacggatattaactaaaatcttccaaaattacggtataatgaataataatacacttctgtctcatatagtattctattatattgttcgaaaatgttcttatttacatatctatttatattgttaattgattgcggctattactgtggatattcatcgtaactattttaatcaatacaaatcatgcaaaatagtgaatgacttagaaaagttgaaaccacatatgattgagtttagggggaaaagtataaaagaaagcatgactagtatgttactatgtagtaagcttcaaacatatatttaagaaaatactatatatagatacatatgatataacataacattaaaatatatggtgaaacattttttcttaatatcctaagcttcaaacatatacccaagtagagaagagttggagtattcattctttggttaaacatagacctaatacatagctcatatggacaatttttcgacaaaacaaaaatg

SEQ ID NO: 27539 - DNA, 3003 bp, Unknown
  misc_feature (1)..( 3003): 2750-1469P.txt file - cDNA_ID_2990640; gDNA_ID_1620647; Annot_ID_163279
tatccgtgtacgtggccggatctcattgcgtttgttagatttctgtgatgacgtggtgttttcctttacactaggaaacttcaatttggcattggaatgtaacatatggctaaagtaactttatctgcttaacatatttttcaaatatctaaaactatttctagaccgaattttagatatgtgactaagaagatttcttgatttacatcaaccaaaacaagagcaccatgtgctgtttcttatatggatataacagttcgaaataagttatcgtcttcatacatccctagaaccccaacgactggactaaaaccctcaacttctaaaataagacttattgtagaataataccaaattgtgaaaaaaaaaacaaatataaattattgactatagtttgaagtaagtcgtaattttttccgcaaggtaaattcattcaaagttaaaatgtggagagtgagagaaagagagtcgcgtggctattgggtaatgagaaacgattggacccatttggtatcattcggaagtgatatgtggcagagggcaatcatacgttttcgtcatagcgttagattttcttacagtttcttagagattatttcgattgtttgtgtcaaacgagtttagtatgttactgctattgaacagtagtattttctcatgtatcgatatgaatacgtttactctttttctttttttcacacaatcagatgaatatagggatgaatatacgtagttttgtctttgtcatatactagattatattcccaccagtcattttcctatgtatttaacaagacaagacgtagaaaaatgagaattttagtacttgagttaacatatttaaagattatattcccatcagtcattgaacatatgtgtacatatatatacgaggagaatctataacttagtaaggagggaaatatgagattttatttctatagagaaaagaaaggataaaacctctctctgccaacactggccaccgtctccaaagtccatcccagttaatttttattttttggaatcttcttatgttattactctttcttttcttatgacaacatgtcaacatgtgacctgtcgtcttctactttcttttcttcagcttttctccttttaagcagaatattcaatctatcttcaaattcatatctgagttttgtactataaaagaaaagcagacattaaaaaagatttgaatataaaacaaatgtattggagtggtaaagcacatcttcatcaaacatttttaaggagcatcaatctaattggtcgatggaaatggaagtaaaggaatagaagattgtttgtgttccatgatgatgtatatatatgcctaattaatgttactgttagttacctttggataacaaagatatttaaagcggtttaatgcttattaacggttgatggatgttaccttttctttttgacatcacggtagatgttacctttcataggtgttgaatagacagattggggacgttaattagtaatgatgtaattagttagagctaaatagtgctaataaatatatgtaagaaattgttcggaaagtaactaaaaaaagttcaattcatgcaagtagacacttcaaatgtgataaatgtataagtatgatgttaagcatgtgacccttgagagtcgattagggcactgtacaagattgacccaaatagttacaaactacaagtgaactctcttccattacatatctacgtgtattgaggggaccattatcgtacgtatacacgtatatatgttttgccctaaattcccaattttaattcagcatgggggacggactcattcaatagcatcgtctttcactttccttcttcggtttaaaatctcattttagtttctgatccaaaaaaaaatgtttgatcaaagatcaaaaacttagatagaaacaaactgtttttttttcttaaatcaagaaagtctaaaaaactaagatacaaaaagggactcgcagcggcagagagataagtatcttacgggccagcagataatttctatgttacgtccctttcatccccattgcatattgcatatgaagacaacggatattaactaaaatcttccaaaattacggtataatgaataataatacacttctgtctcatatagtattctattatattgttcgaaaatgttcttatttacatatctatttatattgttaattgattgcggctattactgtggatattcatcgtaactattttaatcaatacaaatcatgcaaaatagtgaatgacttagaaaagttgaaaccacatatgattgagtttagggggaaaagtataaaagaaagcatgactagtatgttactatgtagtaagcttcaaacatatatttaagaaaatactatatatagatacatatgatataacataacattaaaatatatggtgaaacattttttcttaatatcctaagcttcaaacatatacccaagtagagaagagttggagtattcattctttggttaaacatagacctaatacatagctcatatggacaatttttcgacaaaacaaaaatgatagcaaatgggctaaaatggtttcatatcgaaaagcccaaaccattaagccaaaacgacgtcgtacgatatgacagcggcgattcctataaccaccaccagaggttaaaaagtctctctctttagctatcttttttgtgttaccggttcaaatggccgccgtcgcagattccgttgagaacaacggttccataaacctccctgagaatgaaaaccttataccggcgggattcagtgccgccgcattgcttgacgaaaactctggcgctttccctgaattgaatcagcccgatagcttagctgctgctgagactaccttccccgatacgaacgattccgcggaggagaggtggccaggttggcctggtgattgcgtgtttcgtatgatcgttccggtgactaaagtcggagctattattggacgcaaaggtgactttataaagaagatg

SEQ ID NO: 27540 - DNA, 3003 bp, Unknown; identical to SEQ ID NO: 27539
  misc_feature (1)..( 3003): 2750-1469P.txt file - cDNA_ID_2990640; gDNA_ID_2926188; Annot_ID_200795

SEQ ID NO: 27541 - DNA, 3003 bp, Unknown
  misc_feature (1)..( 3003): 2750-1469P.txt file - cDNA_ID_2990644; gDNA_ID_2684121; Annot_ID_190980
ttgataattacagctaattggaaggctctgttgtttaacttacctcggggaagtttgcgagtttggccgggttaggccgtcccatggcaagaatgtaagattttttgccagctgcagatatgagtgcttgcatatggtgaatcatatgaaggtaaccagctgcatatattgccaggtgacattagacatttaatgaacttatcaatcttgacatcacaaaatcaatcttgacaacacaaatgcagaagaataggaacttaccaacaccaagagtccccaccaaaatacctataatattcgcatccttagctttttccaccaagtaatatctgcaacacataactctgaatgaggacttgaaatgtaattcaacagagataataaagaagatcgaaatgattgacaaagtttcatattgtgatgtataatgtctgcttgaaaaaagtgattataccgtcgcttaagtatccttctttgttgataaaattccgtcaccaaagaatcttcttcagcatcatatctgactaacatcaacaaacgaacataaacaagaagataagctactcatgccttagtcaacccattggatatttgtttaagaaaaatggatcaagaaatttccatggatagagccatatacctatgtcacaaccattgaaggtcagtactacattggcaaaagctgaactgtcagaacctatccagaaaagtaaatagtcctcgattttgcttccttctggcaagtcccaagttagccctcctagtctatagctcctagatgaggataagctatcactagaatcactttcgctatatggtctcggatgctccatggattctctaggatctttggatggactaatgaatgaacacaagacattggctacagataattgagaatcagtcttcgataatcctaattcttctcggatttgtggaattacatgcgcgtattctagaccataaagaatctgaaaacaaagcaaagattgagaaaacagaacatgttcatcaatacctataccataaagataaacttatgaaaacaaagcaaagatagagcgataagcctcacataccatgataggcttatcgctctttgacgcataatctatcaaatgcttaacacagctggagacgtttatcgaagctttcccaaaaacgaagaatgctggaagaactgatgtcctgtgaaaacatagaacctcacaataagacattgtttcaacaagggaatttaaagcaattacatagatgaagaaaagggtttatgactcacgggcttagacatgtttgaccgtaatgaacaacacattcagaatcaatatgcaaagctccaacttcatcaatacagcaactaccataagttgtgtcagccattacaaagaacctgacttctctgtcagtaagcaaacgagttttgctcttaagagcactcacgaccttagtcgaatcttttaacaactcatccgggaactatgaaagaaaaaaactaagctttatcatcaaatattcattgaagtaacaatttgaagctaagaaacaaaatcaaacttcttcattcagaaactggagaaaaggtttggtacctgtaaagcaattctggtgaagcttttgctaataatgaactccgccgtacggttaatctcgtactttgattcaaattccaactccatagattaatcacacgaaattatcaacctttccggccgaataactaaaatcgtcgtattcgtcgacttggatttgcggctgaagaaaaacaaaccagacgtagaagaatgatgcttgatgaaacggcgtcgtttctaagtatagttctcatcactggttttccttatttatcaaaccggtttaagatcctaccaaaaaaaatcaaaactcaaaccggtttttaagtatttattttagcggttatgatgaaacgacatcgtgttgattccttaaaagtgcctgaaacatgaagtgagctcagagtgattcaactgatggatttacagaagataacaaagacgagagaagctccaaaaaccctaagagccatttttcacagttacaacttacaacgcaatgaaagctgaatcaacgaagttactttcagaaaaaataacaacagtgtcccttttttttgaattgaatttaagggaagattcgagcttgagttaacgccagaaatccgatcagtggcaaactacaacagtttcatctaaatcaatcaaactataaccaagtcgaagctcaaaagaacaaacactatgagcgcttgtaagaagcagaggataaaccatagagaagagagatcagatgaaatccacatcgcaaagcttgcaattaacgatgacgttcgacaaagaaattttaaaaaaattaacctttttagtttccgattgcattcaaggatctgggttttgtcgcgacgtcgcacagagaacgatggacgtcgagcactatgtttccgtattgattaaaaccggttcaagtatatatttatcggtctatatttgcaaataaatcacacccacaccggccatcgctggtttccttatttattaaacctggttttcatcggataagacgaaacgacatcgttttaatccaccgccgtcaaaaacaatttcttcggtcaattatacctctaagcttcgaagctccgacttcttcggtctgtttcttattaaacacacaaacaagaaaacgcaaaactaatcctctctcgaattagggtttcgtcaaggtattacattatttcacacccttatcatcatcttctgatttctggtaatcttcttttgattagatcttcctatcgattggttcagtcctttcttattttcgaattcttgattggtttaccgtggttgctacgatttaaacctttaacatacctaaaagaacgtttttgtttttgctttttgttgttattgaagtttttttttttttttattgttgttgatgaagatcctggagttgatgtattgagagaagccattgagataagagatg

SEQ ID NO: 27542 - DNA, 2667 bp, Unknown; identical to SEQ ID NO: 4452
  misc_feature (1)..( 2667): 2750-1469P.txt file - cDNA_ID_2990652; gDNA_ID_1620706; Annot_ID_165284

SEQ ID NO: 27543 - DNA, 3000 bp, Unknown
  misc_feature (1)..( 3000): 2750-1469P.txt file - cDNA_ID_2990663; gDNA_ID_2926237; Annot_ID_142782
agtacttccattgttttttaaaaacgtattcttttatgtaatttgggcaccaaagataacccaaaatcacaaactagtctatggtatgttttttttttaccaaaataaaactaatctatggtttataattatttatctttttacgtcgtttaaaaaacttcataaatgtcaggtatctcataaattttctaatgaaaacataacagtaatgcgttagttcgaaatccagataacttacaagtcgatatcacatggctgcaaacgcatcagtggccaatcaaaacgaacttctgtgcagtcagtgtgaggtggcttatatctattggctactgatgactgctgatctatcttctttgtctttgtggtgcttccatttgttttgctttctgtcatcgacttttccgacatgatccactattcgttttagtctttaacaagggacactgataaacaatatttttttactcaagggttatccaacaaaacaagttacgagatcatccagtgagatctcataactgaagattggagcagtatataccaaaactccaaccccctactgtgcaatgatcaataataaatagttagaatcgaatatttttgtcatgttttctggttaagactttaattttcacattggcacatgccgacatcccgatggctagtgcagtgcatataaatgaagatgtggcctgtagggtcggttaaatgttttggggcatacaactatacaagtgaatgttgtagtttaatgcatataaatgagattacgtcgtgctgaatttggttacggcgccgaaatgcatacgcatgcagttttcatattacccttagccacattgttcaattgtttcctttttagaccgtcactgatttgcaaattttcctctaatttatgtggacgtacaataaagtggaggacttaaattatttcttcaaccaattctgctaaaactctacgtacctttactagaatatattataattagtatgcagattttagggctgcagtagaatttttttcatatcactttcatatttgctgcaaaaaaataccaatcagaatttagatttttgtttttgtaaatttttttgctttgataaatcacgtgacaattttttttttatataaaaaaaacagttttacaacctcaacctatcgacccataatgcatattatggattagtaagatccactgggtgggaggaatcaagctcaacgttgcaagctcaaaaagtgaaagaattgtatagatgatgagacgtatatgaagtgaaaatatatgtacggtcaataatatatatataagtttattgttttgatatatatatagaaacttaaaaaataaacaacaacaacatctgcaatcttttatgtagtgggaaatttgaatttcattaaactgcaccaaaatctgtatttaaatgcaggtttttttttttgttggtgttggcattgcttatttaaaatagtctaatacaaaacgtgagaaattaaataaatgtctctcgacaattggcctcgagatttaacgtcgacctcatctagatgcttttatttttctgtggttataaattgatagggttttaagtatctatccattagatctccccgtttgtcgtttatatatatacattgttattcaaaacattgcgtttgtgttttcttattaaaactttatgtttaggctatatatgcatattaatgcacactaattgaattgattagtatatagtatatattttcttgaaaattataaactcagtaatctgggttgaattagtatttagcaaacaatctatatatacatttttgcagccattttaacaaataaatcctagagttggacttatttacaacccaatgccattagcattaattgttttccaaaataattaattttactttaaatacttaatttaaattgtcaatcacattatcaatcaacaaacaaacttcacattaatcccttaaaattagcataaacgtatttgttaacaatattttaaaacaaaattttttgtttaaataaatattattcttactaaacgttttttgtttaaataaataaattctgtatttgaacttatttacaatgtcatgctattgacattaattatttagaaataaaaatatttaattaacgatttaaatcttctaaatctttgcttttagagttattatgtcattacctaaaaggcaaaaaatatatatttttttaaatattattatttatatatttaaactttataaaacattattaatatttaaacttataaaaagtttaatatatcaaaaaatttaacatcattatataatatatagtttaaaaaatctcaaaaaaaattccgtcatattttgtgattcaaaattttaaaaatgaacatatattaaccaattggcgaaaaatgtgtgggttcaacatcccgcatcgactaaaatatttagacaatgattcataaataagatcaacattaataaaataaatagttttttttgcaggatgggttttgcgggacgagtttggcaggacgttacttaataacaattgtaaactataaaataaaaatattttatagatagatacaatttacaaatttttatatatactaactttaaaaaataaattgtccccgcggtgtaccgcgggttaaaatctagttgttttcattttatgagccaatatttttcattaatatatagtcatgtaaaaaacagacaatttttttatttatttttttggcatggatgagatttgatctctggctatatcaagtaagatgatttttcaactgttgtaaaaacgtgtaccactacaaattgttaatttcgcatattattttataagtaaaaaaaaaaaaaaaaaaaaaacctatgcatgccctctgtagctttctcttctctatttatatgacttgctcattactcctagactcatcctcaacctcccgtcctcccccttcatctcttagagccttttaaaagtaaccaacgccatg

SEQ ID NO: 27544 - DNA, 3000 bp, Unknown; identical to SEQ ID NO: 27543
  misc_feature (1)..( 3000): 2750-1469P.txt file - cDNA_ID_2990663; gDNA_ID_2926237; Annot_ID_203917

SEQ ID NO: 27545 - DNA, 3000 bp, Unknown; identical to SEQ ID NO: 11038
  misc_feature (1)..( 3000): 2750-1469P.txt file - cDNA_ID_2990667; gDNA_ID_2214471; Annot_ID_133102

SEQ ID NO: 27546 - DNA, 3003 bp, Unknown
  misc_feature (1)..( 3003): 2750-1469P.txt file - cDNA_ID_2990667; gDNA_ID_2214470; Annot_ID_182999
tttttccttctatcatactttttcttctttaattattttttttttttattgggtatcttattgagatacttcaaatggagatgctctaataattaatgggaatgtgtttctaattaaaaagataacatctttctttctatatttttgtcgtcatataacacacctcaactcttttaagtactcgtgttgaattttgttttttgaaaagacaaaactccttataatcaacgtaattattaataacaaggagaaaaaaagtccaaagaaaaaaaaaagaaagctttttgggaacataaacaccatcgaaggagggtgggaggtgttttatgttcatgggtggagcttcttggccaacctgaccccattcatcatatcattacccactttcttctcctaaattattctctcttatctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataacatatgggaaacattagcagcagcggtggtgaaggtagacgccgtcgacggcgaaaccatacggcggctccaccaccacctcctcctcctccttcttcttctcttcctccaccacctctacctacagaaatccaagctaatcccatcgttttcgctgccgttactccctatcctaatcctaatcctaatccggtttaccagtaccctgcttcttactaccaccatcctcccccgggagccatgcctcttccgccgtacgaccaccacctccaacatcatccaccgcatccttaccacaaccactcttgggctcccgtggcgatggccagatacccttatgctggtcacatgatggctcaaccgactccttacgttgaacaccagaaagccgtcacgattcgtaacgacgttaatctcaagaaggagtctcttaggcttgaacccgacccggataatccgggtcgctttctcgtctcctttacgtttgatgcaaccgtctccggaaggtagatttcactttctccctttcgttgatttcgtgatccatttgagcagataacacgtgaattttgttgtgttcttcctcgtgactatgtaatttggatcttcttattgcaatttgatcaaatcttcttcatgtgtaattgaattaagcttatgttattatgttggacttgtgaaaaataggattagtgtcattttctttgctaaagaatccgaagattgcaaactcacagcgacaaaggaagatatactgccacctatcactctagatttcgagaaaggacttggtcagaagtttaaacaatcatctggttctggtatagacttttcggtctttgaggacgttgagctgttcaaagcggccgcagacacagagatctatccattagcggttaaggcagaagcagctccctcaggtggtgagaatgaagaagaagaaaggtcggggtcgaagaatgcgcagattactcaagcggtttatgagaaggataaaggagagattaagattagagtggtgaagcagatactatgggttaatggaacgagatatgagttgcaggagatttatgggattgggaatacagttgagggggatgatgattcagctgatgatgctaatgatcctggtaaagaatgtgttatatgtttgtctgaaccacgagacaccactgttcttccatgtcgacatatggtaagtgaaagctgatgatttactactattatgtgatgatggacatatatatagatgttaaaaattgtttgggtttggtggtgcagtgtatgtgtagcggatgtgctaaggtattgaggtttcagacaaatcgatgccccatttgcaggcaacctgttgaaaggcttttggagataaaagttcacggtaacaacggaagcgggaataacaccggacagggagaaacagttgaacaagagtagctaaacacggccgagtatggattgaaatgccatcgaaatattagtagtatatgcatgtttgatccttgtatgttaacaacaaaatgtgtgattgtcaattcataatatagagattacgaaatcatttggagtcataatgacacaatacttgaaacattcttcattagatacaacaacaaagtaggcagtttcttacttagctagttgctcaaccggaagttgcagtggcaggtgaagccattttagttgcaataagacagaaacttaaacatggaaaacacgagatatagtagcggcaacatgacattcaattatatagctgaccccttcgtttcttatttaaaaggggcaatctccaacgttttgtggtcaaatgggcctgcatttctttttatccgcctctactattgggccctaagcccgagttttccggtttcgtaaacaataggttcatcatacttgtgtaatttcaatgttttggaaaattcggttcacagcttcgttaaaacatcaatcatctcatatctgtgactcgtagtttggttaaaaaatgatcccaaaaaagagagagacagatccaaaaaatcatctcatatctgtgtctctctctttgtttaaatttaaaatgcttgccgtagacaaaacatacaaatacgaggctgtaataaacaagtatttaatataataataaggacaaataaacggaccaaatttaggccgagaaaatgggacattgtgatataatctcaaaaagaattgaaatttgtatgatcgatcagatatctcaatttcaggaacccagaaagagggacttgtcttttacctccaaagggttcctgccgtttcttttctacaatttttctcctgctaattatcaaatttttcttctgattttcattgtttgttagagattcttcttctcctctgcttttctattctctgggagctcgatg

SEQ ID NO: 27547 - DNA, 3000 bp, Unknown; identical to SEQ ID NO: 11008
  misc_feature (1)..( 3000): 2750-1469P.txt file - cDNA_ID_2990667; gDNA_ID_2214471; Annot_ID_183042

SEQ ID NO: 27548 - DNA, 3000 bp, Unknown; identical to SEQ ID NO: 2450
  misc_feature (1)..( 3000): 2750-1469P.txt file - cDNA_ID_2990671; gDNA_ID_1620538; Annot_ID_159936

SEQ ID NO: 27549 - DNA, 3000 bp, Unknown; identical to SEQ ID NO: 14225
  misc_feature (1)..( 3000): 2750-1469P.txt file - cDNA_ID_2990679; gDNA_ID_2214712; Annot_ID_136982

SEQ ID NO: 27550 - DNA, 3000 bp, Unknown; identical to SEQ ID NO: 14225
  misc_feature (1)..( 3000): 2750-1469P.txt file - cDNA_ID_2990679; gDNA_ID_2214712; Annot_ID_189919

SEQ ID NO: 27551 - DNA, 3003 bp, Unknown
  misc_feature (1)..( 3003): 2750-1469P.txt file - cDNA_ID_2990683; gDNA_ID_1620354; Annot_ID_154404
gacactgtgaaaatcagatgtccagtagtaattagagattatcctcgcgcttaccaggcaccaagaaacttccataacaaaaacaaatgcaaaaaaatgtatacctctcttctagggacgttatttgctctttgacaactgaaagaatgatcgcctcatctgacttcgcctgcgatgaagcttgctttttttcactcactgcaacacacaagggtaatttcagtaagaaaatgactcgggaaaatgaggcgatgtcttcaggatcatatagcttgtttaccaaagaaaaaatgctttaaagttagaggtgcaaacttaggatgtctcaattagttcatgacttcatgtagacattaacacaggcaaaatgaatttgtacaagataaaaaacgcttttatcctcaccttctactttttcttgaagcctggattcacctccaagatatgaacgttcatccgtttctaagtttagacgttgacggtctgcaaatttctctagcaagcggccgattaggttatgtgcaaccaagcttgtctcatcagaaatttcttggattgctaggtactggtttttatttcttcttcgtggcttctgctcaccatgatcatcagactttatgttttcaacagaaaacaatgaccgagagctaaactgattatctacttccatctcaatatccctctcaaccttgactcgggttttgctcatagctatgtcatgtctatcactgataactattgatttattggacgtgggagtgacatagagagatctaggatagactcttgtaatactctctggcaggtctcttacaaccaccctattgacagaagagctgaaatcatgctggtttgtttcatgtgtagaatcagtcgggtccaaaaccaagcattctgcaccactttcttcatgatccgaatcagaggactccattgcatcgtcttgagtgtctttgacttcaagctttatgtttcggcatctactctcttctttattacctaatttctcgttatcaaataaattacaattctcatcatcatcatcatcatcatcatcatcatcatcattatcatcactgtcttctagatcctccatataagcatcaccgaagtcctgatcgagttcataatttggaatacattggcaaaatatttgcttcacttgagcactcacatttaatatacactctgtctcctcctcaattgcttcccttggacataccttatgctctacattccccgtcctgctgttgaccaatgaaagagcttccattaaagactttggaatggtgtccagatcactgcactcaaacagatattcaatcaacgtttttctgaccgctgatcttaagctgtcattagaaacttcagcttctgggtctaaacaaagatgcaatcttttcagctcacgaaacctaaccttacggagtaaccatactgccttcactatctcgttctgcaggttctttgtttctggtgagaaccgaaaaaaatctgtggcagcagcagttttgtagccaggacttagcttaagtgataaatctactactgacaacgctttagccaattgctcctgcagtttatcccctgcagaaagttctgagagcatcttctcgctagcttgcctcacttggttaatcagatcacttcgacgctgaccacgtctactatttttcaattgaggtatcattcttgaacctttaagtttccttttcattgcacgtagggtctgagtagacaaactatctagctcattaagtaccttcattgcagcatcacgatgggaatgaagagtaggtgttctccccaaattcatcctgcaatcttcccggaaatttgcgggatcactaagaacttgatggagctgattaataatctcttctttaccaataccttctttattctttccgaagtctctcctgaccgaatctctgataatctctttcattttcaatcgagtcttgtcaaaggaagtagagcctcctgtgagtatcattgcaataagataaagacctttattcgtcaaagaatcaagctttctaacaagttcaagatcgcagaactttaactccttctgttgaacatcattgcatactacttgttgattcttgcaaaatccaaatgcctcttctacacgcgactttatcgtctcgtagaatatctagaaacacaaaagagatctcattgaagaaaactctcaacatttatctaaagagaacgtaagtaagagagacatacatcatcttccctaagcaaagattcagggacgaatctgtttcacaacgaaaacaaagaagaagagttcatagtcatataatcaatcagctaaaccaaatggaaactaagtaatgaactcactcagtctttcccggagtatggtccttggtggagtcagacatatcacaacccaaaagccacctacaaggtttgaaagtcacagacaaaacaaaagtctgaaactttttttggagaaatattaaaggttgaaactttcacaaagccctaataagcagagagattgattcgaactcaaagcaatcgtttcctatatctaagttacaattatagtccaaattcacacacacacccatataaaaccaaaaggagagaagtggaagaagaagaaaccttcttttgagacgaatttgctcatcttgatccttaatctgtgaaagtatcgaaccaaaatcagtcttgaagaaaactgaattattatccattgccatcttcttcaaggaattggaatcgactctcctttgaattgatatcgattttggtctgtttagtttgtcttgttcacttgttctcgtaacttaaaccgggttcgaagaatttttattaaatttttgagtaaaccggcttattaggtcaatacaaaaaagcccaatggacttttaagtttatggcccaaaatataacaaacgtatccgttctacttctgaaactaacctaaaacgcagagtgtgttgaagacgacggagacggcgacggcgagaagcaatg

SEQ ID NO: 27552 - DNA, 3000 bp, Unknown; identical to SEQ ID NO: 4621
  misc_feature (1)..( 3000): 2750-1469P.txt file - cDNA_ID_2990691; gDNA_ID_1620718; Annot_ID_165717

SEQ ID NO: 27553 - DNA, 3000 bp, Unknown; identical to SEQ ID NO: 4621
  misc_feature (1)..( 3000): 2750-1469P.txt file - cDNA_ID_2990691; gDNA_ID_2926153; Annot_ID_198235

SEQ ID NO: 27554 - DNA, 3000 bp, Unknown; identical to SEQ ID NO: 12803
  misc_feature (1)..( 3000): 2750-1469P.txt file - cDNA_ID_2990697; gDNA_ID_2214573; Annot_ID_186240

SEQ ID NO: 27555 - DNA, 3000 bp, Unknown
  misc_feature (1)..( 3000): 2750-1469P.txt file - cDNA_ID_2990708; gDNA_ID_2926258; Annot_ID_143168
ggctctgcaatgtcagatcaatgccattaaagttcttactacgtttcttgagcgttgtgagaaaaaagatatgaagtttggaggttgaagattgaacaaacaatttagaattctgaaaatcagaagaaaaaaaaaaacaatttggaattctctctgttttttcatttattttcaccttatattttttttttttatatattgctgtttagttcgggttcataatttagttcttaaaaaaaaaacaatcttatgtgtttttattccaaaatattacgagaaatgaaaattttatctccacaatttctcctttgatatctcaaattcatataagtaatataagtatataactttcggtgctccagccattagatttgataaaacacatgccaataaaatgaaaataattgacatttacaccaaaaaatgaaaatgaaaatggtataaaatttaacatttaatttacatcaaataaagaagtgaaaaataattatttttttctttatctttatatttagtcaccaataatattgtcagaaaaaacatataaactcatgaaacaaggaagccaaaaaaagaactcatcgaacaaagaataaacgaacaataataactctgcaagcgataatagcagacttgggtctgatagagcgcattaccaataaggttcaaaaaaaacatatataaaactcatgaaacaaggaagacaaaatagaactcaccgaacaagaataataataactctgcaagcaacgatttgggcctgatggagcttaactactaatggaccttaaggcccatataacagagatcactgaaaatgatgcagccaagtggacttgctttaaacacgtgggtattcaggaccgcccaatttctcaacgccatttgttgtcactcactctgtaaagtataaaccctaaaaatcgaatctttccgattagccgatccctccaccggaaaatcggaaggtaaacctcaatagaattctcttactatttttttgttattcgtcataccagatttttccgattaacgaaatgtcattatcatcatcatgatgattgatgtgtgagattgctgggaaaaagtcagagtgactgattcttctctaaagcatcaaactttacattttgttgagttattcgtgttattgagtcttaattctgtgttgaattttctctagtagaagcgtaaatggcggatgttgaagatcgtgcggcgaaggggatctctgactacgatcaaggtggtgtaaagacgacggaactggaaaggaagattgaggatatggagaacaagaatcaggagctcacgagagagaatcgtgaattgaaggagaggttagagaggcttacgggagaaattgaagagatgaaagacgtagaagcggagatgaatcagagattcggagagatggagaaagagatcgaggagtacgaggaagagaagaaggctttggaagctatttctactagagctgtggagcttgaaactgaggtgtcgaatcttcatgacgatctgatcacttccttgaacggagtggataagacggcggaagaagtggcggagctgaagaaagcgttggcggagatagtggagaagctggaggggtgtgagaaggaagctgagggtttaaggaaagatagagctgaggttgagaagagggttagggatttggaaaggaagattggggttttggaagtgagggaaatggaggagaagagtaagaaacttagatcagaagaggaaatgagggagatagatgatgagaaaaagagagagattgaggaattgcagaagacagtcattgttttgaatctggaattggtgaagaatgtagaagaattgaagaaatggaagtctaagaagaagctcacggaggaagctttgagtgaaactcaaaaacgagagaaggagctggagttgaagaaggacgagttactgaagaaggttgaggaaggtaacaagacggtttttgctttgaatgagagaaccatgaagcctagtaatggagtcagagacacaaatggtggtgaccaaaagggttccttggaagctgagtatcagtggccagtggttgctgctggatcagttggagctgctggtttggttgcagcgacctttttcgtctgctattctaagctaaggtgattttgatgaatatgttagtgaaagaataactgatgaccaagttcttaagattgatatctgggatggaattatataggttggctacaaatttgttttgggtttggatttgagtttgtgatgtttgttggttgttggctatcatacttttgttgatgagatcagcatttggtaactgttctttatcacttctactctgtcttaagattgatttcaggaatggatttacacaggtttgccacaaatttctttgggtttggatttgagtttgttatgtttgttggtagtttggctagcatggttttgtgaatgggaacagataaaaacttcaccttataatatgccacaaaatgcatttcggaaccgttcgtcatcacttcttcttgtcttctatttactggattttaagagaaacatgattcaaacagaattgcttggccagtatagttctttatcctaagtccacgagtactaactttacattagaaccgttttaaaattgcttcttggaagagcatatcaagggaccgtttttggattcagatacttcaaaatctgcaacacgcatagtggatggagatgccatgaaatgaatgtgttgaaaggtgaccattttaagacaagagggacacatgagcaaaacatacaatttgacttgtcaatttgttaaggttaatttgactagtgtccgtttatatttttggaaatcaaagcgtgtggaaggaaaagagtcatcatatttttctaaaacagctccaagaaatctggaaattctcgataaacaacttacaactacattttagggtcaataaaagtaaaacaacaatatttattataaagaaggctgagatg

SEQ ID NO: 27556 - DNA, 3000 bp, Unknown
  misc_feature (1)..( 3000): 2750-1469P.txt file - cDNA_ID_2990708; gDNA_ID_2926258; Annot_ID_204635
ggaaatgaaaaggtaggttccataaaagatgtcacgtggctcccatgcgagatggaaaatcatgtggatcttcttctgtgcaactgcaactagttaagtagatcatcatggtaccagtaccaccaccacttcactatctacaactgtatctctctattaattcattcctctccctattataaagagagagagagagagagagagagagagagagagagagagagagagagagagagagagagagagagagagtgtatcataatgtgtgtggaagtaagaaagagaggcacatgcgagctaatattaagatagatggagaaactcatgtgagcacatgtgctttccttttctcttttccttttttacggagcttttgtggctcccatctcctctgctcccatgcacctgtcgcaggtgattcctctcctcccttcttctaacgtgcgagagagagagagtatgtgggattagctctttaatttgtgattagtaatataccattcttaactagatttaagtcaagctgagctcaagtttgaaacttgaaatgttaattatgtaacctaatatgataatcaaatcaatatataagttacaagttaagattgattgttttcttaatctcacattctaaggtccatgcatcatcttatatcttcaacacattttttaaaaaatcgcctgatccaaaaaaaatatggattatataagagaatggtcaagctaactctaatacatattttcattcatttttggtttgaaatctggatgaagagcatgtattgcatttgtcgtatgcatgcataattaagttgtaagatacaaataactagcttatctttatggtgaaatattgattcaaacacatcattaatgtttccgaaaagaatacaaaacaaagacccacaagtcaaagtctgggttaagttttaaacacatgtcgataactctattattactaaactaagcatgttacaaatttgttaatgacacgcatattttcaattatgtattaaacttttgtgatgtatagtgttttaaaagacaaataaagatacaatctatctatctgtcaggacctcagggagatccacttgagtaaagtgacgtctccactaaaccacacaacatagcgcgtgacaatcacgatccaaaatctctcttaataaataaaccaacaaaacaaacactccaacacataattcgaaacactcaagaacaaaaaaagaaaagaaaatcacaactggacccagctttgatggcataccggcattacccaatttccaaaattatagccaaaccccaaacctaaatcgcacaaccaaaacatagtactaaactaaagtcttaaccaaacgcactaagattcagctcataatcaaatcattaaaggcaaacaagagtaaaccaaagtaaaacgaaccggaatgactttaaccggtcctacttcaatctactaattcacatcactcatataaatacacacaggtctctttactccttttcttccaacacatcttctctccctccgtcaatggagaaaaccctagccacttcccataccaaacgctcttctcctccgtctccatcctccgccgtgaacacaagctccactggtttcaaccgcagaaccagacagagattgtccgatgcaacggcgagtgtaagcgagaccgacgtagaagatgaagatgaagatgaagaaggagtggaggagaagatcgaggcgcttcagacaatagttcccggaggaacggaacttggtgtcgacgcgctgttcgaagagacagctagttacattttggctctgcaatgtcagatcaatgccattaaagttcttactacgtttcttgagcgttgtgagaaaaaagatatgaagtttggaggttgaagattgaacaaacaatttagaattctgaaaatcagaagaaaaaaaaaaacaatttggaattctctctgttttttcatttattttcaccttatattttttttttttatatattgctgtttagttcgggttcataatttagttcttaaaaaaaaaacaatcttatgtgtttttattccaaaatattacgagaaatgaaaattttatctccacaatttctcctttgatatctcaaattcatataagtaatataagtatataactttcggtgctccagccattagatttgataaaacacatgccaataaaatgaaaataattgacatttacaccaaaaaatgaaaatgaaaatggtataaaatttaacatttaatttacatcaaataaagaagtgaaaaataattatttttttctttatctttatatttagtcaccaataatattgtcagaaaaaacatataaactcatgaaacaaggaagccaaaaaaagaactcatcgaacaaagaataaacgaacaataataactctgcaagcgataatagcagacttgggtctgatagagcgcattaccaataaggttcaaaaaaaacatatataaaactcatgaaacaaggaagacaaaatagaactcaccgaacaagaataataataactctgcaagcaacgatttgggcctgatggagcttaactactaatggaccttaaggcccatataacagagatcactgaaaatgatgcagccaagtggacttgctttaaacacgtgggtattcaggaccgcccaatttctcaacgccatttgttgtcactcactctgtaaagtataaaccctaaaaatcgaatctttccgattagccgatccctccaccggaaaatcggaaggtaaacctcaatagaattctcttactatttttttgttattcgtcataccagatttttccgattaacgaaatgtcattatcatcatcatgatgattgatgtgtgagattgctgggaaaaagtcagagtgactgattcttctctaaagcatcaaactttacattttgttgagttattcgtgttattgagtcttaattctgtgttgaattttctctagtagaagcgtaaatg

SEQ ID NO: 27557 - DNA, 792 bp, Unknown; identical to SEQ ID NO: 13552
  misc_feature (1)..( 792): 2750-1469P.txt file - cDNA_ID_2990712; gDNA_ID_2214636; Annot_ID_188141

SEQ ID NO: 27558 - DNA, 3 bp, Unknown
  misc_feature (1)..( 3): 2750-1469P.txt file - cDNA_ID_2990735; gDNA_ID_1592230; Annot_ID_152137
gga

SEQ ID NO: 27559 - DNA, 3003 bp, Unknown
  misc_feature (1)..( 3003): 2750-1469P.txt file - cDNA_ID_2990735; gDNA_ID_2926241; Annot_ID_142895
actagagaggatacttcaacagtaatcagatgtgttaatgagttattgatgtttcactttgagtaatgttccaaagtttaggtcatataatatagatttgatttgactgaatcataaatcaagcttgtatcatgattttatgatctagtaaaagtagggccacaagaaaggtagtagtagaaagatgtaccaataaaagttaaataaatagaacgcgtaattgtgggacccttcttaaacatgtgtttgattatgacacatctaccatgtgatttcaaatatccctctgaaatcacctgtttttaatcaattttgaaacttgtagatttacaacttacaagacataacaaatatatacgcacatcaaaaacaaaagttaaatatcaaattttcttactatatagctgatcttatttcctatttcctatttaaatatcaaatttcctatttcgtatttttaattcaatgaaaatcgagtgtgttggaatatgcttttttcacacaaactaaatttcaagcaatattcacactctcttcacccattgatctttgcagggaagaacacctttttgttttgtttttgtaacaaatattggtgatataataatttcataattttctagaaaacagaaaaaaaatagagtacaaagagatagaacactagaagtatataaagatgcaataatctcgataagctagcgatacagctttactattgcatgttcagaaatgtaagagacttgtgtcgcaccacgaaatatagtttttagggtttccgacttttgatattctggagcacattcgattgatcagagcgtaaacatgttttaaggtctaaattttgatttacaaggtataattacgctagataggtagagatcgagtaagaaaaacactaatttagaaacagattactgaacagtgatatgcggcataaaaaacttattatcaatttaaagcatgacaaggaaattttttctcaaaaccattattcttatcgaaatctatagactatagtataatatatagatgcttaaaaaagatataacgtatcaagagattctataactataaaaaaatctcgctttgatcgttagcaaaatcagaaatctctaattacgctttcaacctacgtggtggtgcaaaatcatcatgaggaataggtgctggactacgtcttggaatttttggagtcgggctccaagaaccataatccccgtgaaatacttcttcccaaattacatctccctttgctgaatcttgcttcaccgtaaaactttctccggccacgaaagcaaccacaatgaggataagaagaaaccttacatggttcatacgaagcgccatgactcgtggttgattcaactagggctttgtatcttctctagaatatttaaacgtttttttgttaatgtgtgtagtcattgaagttcaactagtagggacttttgatcttctctagagtaattataagtttttttttggtataatgcgtgtattcgaaaaaagaagtagaatatatatatatatatatatatatatatatatatatatatattcgtgtggacatcataaatgcctaaatgataatagttgatttcgagttttattttcgttacttccaatcaaattctccttgcaccatatttatttttttactgtgagaacatatataagtatatattggaattacgtatccgagaggtttttgcatatttcgtttatttattttcgatatccacactactgtattattaaaaatttgaaaaattcaactagggcttttcatcttctctagaattattcgtttatttatgtcgatgtccacactattattaaaataaaacgagaggatatggttggatcatccaagtttcgtttatgactctttgttcatttacaaacgtttagttttccacttaagttttgaaaagagttaatttccaatatattcggcacagtttttcaagtgtattcatctgttttttttttttttggttggctatatggtccaaattttgatttgcaatatgagattgcacagagagaacaatctttcattatgattaattattgtacaagtaacaaacaccaatctccaatatactttggctctttagcacattgttatgctagaagttagcggaaatctatatgttgttaaacgcagcgtttaaattgaacagtgtaatttaccttgaaattttaagactacatgctgtttagaatttcagatgaaaacatcttgatgttttagaaatccacgtgggaatagcgtaaaatcttatccaacgaacttattttggttttgttgtatttgtgcaagtcgtcacgctaatcgaaaaaagaaaagaaaaaaagaagccgtcatgatcggccatttctcggccgagtctgagtctgactctgcgtccgtgtcaccattatcagatcgagcctgtcttatctcgttgcgattccctatgcaaaaatcttcttcttttttttattcccccatttatctctgatctcttctctcttctcaagtaaacctccctgcttcacgtctcttcttttcttgtcgattttccccagataatcaggtaaataaggctactttcttatttgatctggtggtctttgtgttgaaatctctgggttttctctgttgatttcaaagttctctctttttttttttgtttactgggtgctgtgaaaaatgatcttgtcaaagtctcctcttttcatcgaattgaaactctaattagaaaaaagatcataacttttattaaaaaaatgagtttgctttgcttaattttgcgaattgcttcatagattcattgattagcctatttggggtaacaaaaaaaagctgacacggtttcagattccaaaaatagatcatgactctgtttcttctctgcagaggttttaataaatatatgcttcttctcatgagttctcgttttttttgtcaccttcgcagttgaaaacacacccaaattcatcttcgaatcaataatg

SEQ ID NO: 27560 - DNA, 3003 bp, Unknown; identical to SEQ ID NO: 27559
  misc_feature (1)..( 3003): 2750-1469P.txt file - cDNA_ID_2990735; gDNA_ID_2926241; Annot_ID_204095

SEQ ID NO: 27561 - DNA, 3003 bp, Unknown
  misc_feature (1)..( 3003): 2750-1469P.txt file - cDNA_ID_2990739; gDNA_ID_1621125; Annot_ID_172241
gtagacatcgtttttgcttttaagaaaattgtaaaaggtcaaagattacataaatagatagtccgttacgttacatttttaaaattacgtgttttcctagttcctactatcggaccattctttgtgtaatcgtttgacacattttcaagtttatagaaattaaagtcatttatattcaaaaacagattagtcttttattttataagatgtaaaagaaaaaattggaaagatttagaaagaattagtatcttgaatattatggactagttatttttttttcttcaaaaggatgaaaacaaaaaattacgatcaactcatagtcatagtggttcaatagttaaattttctttttgtgattttaaacatcgttgagtactttaaaaacttttcaacatttcctatttgtaaattggaaaattatatatattcttaagtttcaatgtttttcccaaactgactactttaccttacgtttatatgatgatcagaagttcagaactactattcgaatattattttaaaaatatttaagaaaattatagcagaaatatgtgtgataatttattagttaactaaacacatatcaagagttagtttattttgaaacaattaataataaatctaataattcatttagctttaaacagtaaattattttggaaatcaaatctatatttaacgtagacaactcatagcaatttattaagaaatcaatccaaattaaagatttttttaattttaaactgaaacatattgtttttgtaataaaaagtaaacaaaaacggacattaatttagcaaatcagagagagattactcttgaatactcggttaggaaatcccaaacctagctccgaacccccaagaaacaagatttagctccaaaccacaatgactatataaacaccacatcaccatctcatattttattcacagagaaaacaaaaacaaacgagagacaaaactcaatccaaaacaaaacaaaagccaagttttttgtagtaagtaaaaaatccaaattatgggaatcatagttccagttttgacccttgtcttcctcttgtttgctaaagtgagccatggtgcctccaatcctagggtgattctagttggtggatctgtgggatcatggaaggttcctgattctcctaacaacactctcaatcactgggccgagaacaaccgtttcaaagtcggcgacttcatcggtactcgatatatatctctctctatctctttacttctgatatatttatatgctttgattctcttgtgatcatatgttcataaaaatttatatgcatggttgaatatttgatatatatttgttgtgcatgtgaaatagtgtggaagtacgacatgaaagtagattcggtactacaagtgacaaaagaagattacgagagctgtaacacagcaaatcccttgaagcaatacaatgatggaaacactaaggttgcgcttgacaaatctggcccttacttcttcattagtggtgctcctggtaactgcgctaaaggcgaaaagattacccttgttgttttggctgaacgcaaatccggtggtggcagcagcagcggtgacgctcctaaggtttctcctgttagtcctacggctcaaactccagctccagctcccggtccagctgcagcccataacgctgcggtggggttgaaggttgcaagcggttggttcttgaccgcagtcgtggttggtttggctatggcttagagcttagaggggtttggtcgagagaatgtagtttttattgagttcactttttagcaagatttagttttatttttccagattgttgacgtttcttttgttcccttagtttttcattataaaagatctctctttctgttttttgttatgtgtttgggatattatattcactcttaaagcttataatctatagtttgttcttgccattttgaatctaaaatttcaaaacctcaacaaggcaactacttgccgaccatcgatgaactgatcggattaatcaaccaaagtttaacaattttcattttttctatgagatatgttgactcaataattaatacaaagagattcagtcgactctatcttaatggtaataggattcatttgtagaaactaaatatatttatttaccaaaatgaccattgtgaaagtggtaattaaaaaacaaaactatatatggtgtccaagagattcttctatctctaaaataaaagagaatatatatgctacgttatggaaactacattttgaaatctgccttgcatgtactgattgatattctaagattgttcttgattttgttggtaacgccattgtgcgtggtaataaataagacgaggccaagtggataatgtgctaatctaattccattacttacacatatagtacatctttgacttttaagtaatctatcgttactaattaataattatgataattaaattacccgtttcacttatatcatggcaacgtttctgaagaaaactatactacacatttacgctaacagccgtataggagattaaattctaagaattgtacgttcaaagtctgaattaattcagagaattttgtttttgttttcaaaatttaaaagttggtatatattgatgaaattagttcaatgtagaagaaaacagtggtgaatggattttgcgatgaaaggaaaaaatggatttagtgattaatttaattcaacgtataaaaatgcttaagtttgataatgggtcactaaaagaccattagttcaaatgggccattgttcaacgacttcaaaggccttgtacaatagtttgctggcttcacttacaaaaacggcatgcaatctacgtcacaaactagaaaatgcaatccgccgctttttcaaagtaaaacgacacacagttgatgtttagaaagtgaaaacagtagagcagggaacccctgagagataagcctgaagatgacacaaattacatgagcaaatcccacgcatgtttttgctccagattccgccatg

SEQ ID NO: 27562 - DNA, 3000 bp, Unknown
  misc_feature (1)..( 3000): 2750-1469P.txt file - cDNA_ID_2990739; gDNA_ID_2926198; Annot_ID_141371
cgagaacaaccgtttcaaagtcggcgacttcatcggtactcgatatatatctctctctatctctttacttctgatatatttatatgctttgattctcttgtgatcatatgttcataaaaatttatatgcatggttgaatatttgatatatatttgttgtgcatgtgaaatagtgtggaagtacgacatgaaagtagattcggtactacaagtgacaaaagaagattacgagagctgtaacacagcaaatcccttgaagcaatacaatgatggaaacactaaggttgcgcttgacaaatctggcccttacttcttcattagtggtgctcctggtaactgcgctaaaggcgaaaagattacccttgttgttttggctgaacgcaaatccggtggtggcagcagcagcggtgacgctcctaaggtttctcctgttagtcctacggctcaaactccagctccagctcccggtccagctgcagcccataacgctgcggtggggttgaaggttgcaagcggttggttcttgaccgcagtcgtggttggtttggctatggcttagagcttagaggggtttggtcgagagaatgtagtttttattgagttcactttttagcaagatttagttttatttttccagattgttgacgtttcttttgttcccttagtttttcattataaaagatctctctttctgttttttgttatgtgtttgggatattatattcactcttaaagcttataatctatagtttgttcttgccattttgaatctaaaatttcaaaacctcaacaaggcaactacttgccgaccatcgatgaactgatcggattaatcaaccaaagtttaacaattttcattttttctatgagatatgttgactcaataattaatacaaagagattcagtcgactctatcttaatggtaataggattcatttgtagaaactaaatatatttatttaccaaaatgaccattgtgaaagtggtaattaaaaaacaaaactatatatggtgtccaagagattcttctatctctaaaataaaagagaatatatatgctacgttatggaaactacattttgaaatctgccttgcatgtactgattgatattctaagattgttcttgattttgttggtaacgccattgtgcgtggtaataaataagacgaggccaagtggataatgtgctaatctaattccattacttacacatatagtacatctttgacttttaagtaatctatcgttactaattaataattatgataattaaattacccgtttcacttatatcatggcaacgtttctgaagaaaactatactacacatttacgctaacagccgtataggagattaaattctaagaattgtacgttcaaagtctgaattaattcagagaattttgtttttgttttcaaaatttaaaagttggtatatattgatgaaattagttcaatgtagaagaaaacagtggtgaatggattttgcgatgaaaggaaaaaatggatttagtgattaatttaattcaacgtataaaaatgcttaagtttgataatgggtcactaaaagaccattagttcaaatgggccattgttcaacgacttcaaaggccttgtacaatagtttgctggcttcacttacaaaaacggcatgcaatctacgtcacaaactagaaaatgcaatccgccgctttttcaaagtaaaacgacacacagttgatgtttagaaagtgaaaacagtagagcagggaacccctgagagataagcctgaagatgacacaaattacatgagcaaatcccacgcatgtttttgctccagattccgccatggatgtcgcttctgctcggagcatctcttcacatccttcatgtaattgcaagtttcggattgtagcttattttgtcaataaagtaacttcaatatcttcgggataactttttcttaattatgttcgcagattatggaaaaccgatttgttcatcacaatcatcgttgattcgggtaaattttcgttttatttggatttttttactctttattgattgattcgcctttcgtttctgagaaaatgatggaacgtaatctgcaatggaagcttaattagaatttttacttggtgatgttaagtgaagtatcaagcttttagttattttcattaaacatattctggctctgttgagattttgatgtggatttggatagttggacatagttgaacaatgaacatgaagctctcttctaattgttcttattctatgaaatcattggagatgcagatttcgagggataaagtttgttgctttggtcgcatttctaatggcatgacgagctttactacttcccttcatggtaaggcaatcaaactatagttttaattgtcccttgatgcggttttgttgctggtcggggcgttacaatatcatttcaatcattccttgctatatataaagacttgtaattttatataggatctactcattttgtttttgagatctgatcgagttacttatccatatatctatttcgacgtgagatactgagatgaatcttttaaatccttacttgcttcgctttccatgtttcttctttagctgtcccgagtgaaaaatttatgggcgaaacaagacgtactggcattcaatggtctaaccgctctttaagacatgatccttacagatttcttgataagaaatcacctagatcaagtcaattggcaagagatatcactgtgagagcagatctttcaggagctgcaacccctgactcttcttttcctgaaccaggttttttttggctaaacctttgtgaacaaatttcatctgttttggtagattacaacctacatcgttctttttgtttgttagtttctgtctctatacacaatcctttcttgttctttcaactttgaagtgcagagattaagttgagctcaagactcagagggatattcttttgtgttgttgctggcatttcggctacttttctcattgtcctgatg

SEQ ID NO: 27563 - DNA, 3003 bp, Unknown
  misc_feature (1)..( 3003): 2750-1469P.txt file - cDNA_ID_2990750; gDNA_ID_2214471; Annot_ID_183022
aaactacaaagctactaaccatagttcagaccaacaaaaaatgaagttccttactctgatctgtatcgggttctccttcgtcgacactagaagtcacacccactgaaactacagtcttcctgtcctcgttatccttatcaacttcctccctcgttgaatctatagagactctctcagaatcctggtcttccgattctataatcccaccttcctggttgttaatcaagatggcagtttctgcagatattcgtggctgttcatccttacattctgaatcagcattagaatcaacggatatactggattcctggttgttaaacaagatggcagtttctgcagatgtttgttcatccttacattctgaatcagcattagaatcaacggatattctggatccttcggttgttttcacttcttctattgttatttgggttgtagaagattcaaaactatcaacaagagtatctattgattcaatagtaacttcatcttcacttctatcattttccataatggtgcgaagtggaaactcaccttcttttagattccgatcctcaaaagtaggacctggttcctcagacttcacattctcactagttttggtcagctctgactgctccagacagctcccaagaagatctctttcagcatcatgagaatctttttcggcattatcacgagaatgggaatccaaatcattacgctcatcattaatggcatctactttatcagatgcaatattagcagtatcagatgactcctccactttgtcgatatattcagtatcccacggagtctctgatgaagcaaactcagtattaccttcacaaaactcagtcccatcaccaggggccaaatgaaactgaggagtatttaaccgtaaattctcagcctcctgctcagcaactgacacaggggctgttagtatatgtccatcaatactgaccaaaaccacttcagaatctgagccttgagaatccccataactttccacatttagattgtcaaatcgagcacttccatattctgaggttggcgaaggaggatcatcctgaaaatcataaaacctcctattacaatcagactctgtcctctcaagccgactcaaagggtcgaaaccctctcgtaattctccagtaccagagtccgataaactgtgctcaagtcgataagtaacaccgttattctgattaccattgttattctcagacccggaaatcaaattgttggtgtcattagctgcaggatcaacttccctgatgaaatatgcttcaccagaattatcaagatacatgtgaaaatcagcttcggttccattaacagaaatcctgacaaacttctcagcgcctttgagaacaccttggaacttaccaaacctaacataccaaggcgtgctacggaaagaaccatcttgttgttgaacaacgatgacatcaatagcaccaccaaagggatgaaatggtgtcgctacagagtaaaccccttgagaaatcaaactcccaactcttccaaccaaactcatttcatcaaatctttgagaaagtcttcaacttttactgtcctaatcatatacaaaaatctagaaactagagaaagtttagtttcttagacaggttaattccagcctacaggtgaaacaaaacaacccaacaacaagccaaaattagagaacaataacatgtgagagactaaaaacaaaaaactcataaggaggaaaatcaaatcaatcagatacaaaaaaaaaccattcgtaatgttccgattacacaagtatccaaccattttcccaatttcaagcatgcaactttaacagtttctgaactaacacaacccaaagaagaaaaatcaaacagctttcaaattgttggaaagatacaacgagatacgatgatagcccacgaaccaaacatttaaaaatctcagagtcggaaaatcgaaatcaacttacacagattaggaactctgagcggagaatccgagaaaaatcaaaacacggcggaagaaacgacgaatcagtaatcgagattactattgaaaatgaaatggattttaatgaattgtatcctatactaagaatttcattgaaatttctctctcgggggataaaaaaaaaatattgggttgataaaaagattctcggaatttttaatgaaagtcaaaaaggatttgtctttgcttcgacgattgtattttaccgctaccggtgggagagatttataagaaagaggaaaaagatggttgttttggataaccagaacaaattaaatccgccatgaacttaagagactgtaattgcttatataagatgatgagatgactctgtgaagggaggagggagaattacgagaagggtctctcttcgacttttgtcgtaattattgcttctctaagagggtacttttggtatttccatattaaaacctgcgaaagaatatgcttgattttacacaaaagaaaacaaatatgctgaattaatatatttttgaccacaaaaattaagtttccaccttttttttgtttaaatctactttttaaaacaacgtttaaatctattatttttttcacttcttgatgataaatgagaaaatagttttataaaaaattgaaatatagtcttggtaaagacataagtgaaattaatctattaaataaatgttcataaaatagagaaaaagaaaatgggatagtcgtggactcgtgggaatattagtgatccacacaatagcatatctggtatattctttgtctatacgcaaaatcaatttgtttatttagttagccaatttattgtgttcaatctctttataaaaatgtaaaaatttgaaaataagcatcgttcacaagtgtcctatgttgctacgttctcacctaactcgttttcttctaagtcaaatcattttccattaatgttaccgattcacgttggtcgctccgataaatttaatacgctaagccctttttcgcatataaaaatataacagcacagtcatattttaatatatg

SEQ ID NO: 27564 - DNA, 3003 bp, Unknown
  misc_feature (1)..( 3003): 2750-1469P.txt file - cDNA_ID_2990754; gDNA_ID_2214528; Annot_ID_184837
gctcatcattgcgccagcgttgtcaaattccccgcaatagttgggagctgaaaatactgtaacaagttgtctttctgcaaagaactcatacccatcttcaacaacctataaacagagccaatacactcaaattaaggttgcacagttttcataataaactaaatggcagatataactcaagttaaaacctggtgggcacgacagataaggtccatgtcatgtttctccaagaactctgcgactttgtcagctccaaaagtgtatgaaacaccacgatcattcatgccccagcctacgtctccactaggatccgaccatagtaaatcacataccaaaccagactccggaatatccatcggccgtgcaatatttctaatctggtccaaacttttcagctctggggaaatcccaccatgcatacatagtattctgtcatcaattaaggcggccacaggaagacagttaaagcaatcggtgaatattttccagagtctgacattgaacctgcgtttgcactcatcatagaaaccgtaaatacgattaatggaagcagattcatgattccctctcaacaagaagaagttctcagggtacttgattttgtaagctagaagaagacatattgtttccaagctttgcttgccacggtcaacataatcacccaagaacaaataattagcttcgggagggaaccctccatactcaaaaagcctcaatagatctgaatactgcccatgaatatcacctataaagtaaaagacaaaatataaccattacatctaagaaaacatggcatatcagatactactagtcaacgttaaacttttgcaggaaatgttttatcagacccaatcaaaacacataacttgactagtcaacattaagataaaatgaatcaaacctcatagaaccagtcaaaactcctaagcctatctaagacttttagtaataaaaattcaaactttatactacccattagcttgatttcattgttctgaactcaaaagacaatcaaaatctcacattttttcttcagtcacttagatatgtacatagctttaagaattcaactcattactactgaacaaagcttgatactttatctaaacatgcactaaattcgcttctaaaaatcaatcaaaactaaaaccccaatccaaaaaagcactctttctaaactaaagggaacaaaaatctgaccgcagatcttgatgggagcttccaattcaagcagattgggctgttgaagaaatatttctttggagacagcacaaagctgacgaatttcaccttcactgagatgaacttgcttccccgatccaggtctcgtgttccgaaactcaaccaaacgacgaataatatcgtcgagaactgcaggttccatcgctcgcttctgctcttgctcttgcgccggcttctccgccatctccgatctaaacgaggtagaaaacgaacggagattttcaagcgtgaagcttgcgtttcgagccgcgaggaggagagacccgaagactggtgtgtgctctgagattagtcaatattgattggttcattttttatttatttaatttatttacgagacctgagtgaaatcaacctaatgggtatgtacacgttttattgggcctgtaaatgggctatctttctagaagattcctttatacaaatttccaaacggtagaaaactagttcttctagcctctctacgcgatcagtaataacgattggcgatagtaatatagtattcactattcagtagtaatgatgggggatagtgatcaacaatatgttttgttgtttgtttagcagtcatcggtaatgatcagtgaccaattataacaatcaaatgttactatgttagtatgatattcgttttccgtaattaagtggtagattagatcaatcttaattcttaaattcttaattagcgactaataaattaaaacgccaaaaagtttgaattagcaaattagttactgaaaacttagtgttgccatcaaaaactacaaaacaacaatctatttgttaccatgaaactacaaaacaaccaagatttagtgtttgatcggtaatacctaatctaatataatcaccatctggttgatgtgtcaaattaacatgcatatgcgtgtatgcaaataccattcttttgttaaaaatcaccaattcacattcttaattacatgctaagtgctaactaataactatgtagtttgataaaacaagttaatatatcaacaacatttttatcaaaagaaaaaaataaactatatcaacatggacaaattacatcacctaacggtcctaacctaatttaaaataatattgatgtatgtttataattgatttctataatgaaagaaaacaaaaagacgaaaaaaacaacatgctaaagatcaaagaacattagttgaatcaatccttattttgaacaaagaatagtcagtccattttgttcacctgaaacgcaaacgccacctttgtatggtaatacaatcatacaaatctcatacacaccaaaagaaacacaaaatcaccaaaacaaaatctttatatttatttcttttttccttgattctccttattaaagaaaaaagattattcttcttcacccgtcacaagccacaacgacttattttagattcccatacaaaaaagaaaattccacatctataaaacatctcctcccatatttgctggatcatccttaattgcctgtgttcatgtcttcatatctctaaccataagataaaactcaagatttctgaagaggacagctctggaattcatatacgttttgcctctccatctgattctcaggtttgtttcttgtcttaaaagaaacacaaaatgggtttatttgaatcttttaatcataaaaatacttaaagaaagaggatcaaatgttgatttagatctctaatgaaagtttgtgtaacgtataaacagcttatggaattggagcaaatctgcattttgaaacccgatgatgaggaagaaatg

SEQ ID NO: 27565 - DNA, 3003 bp, Unknown
  misc_feature (1)..( 3003): 2750-1469P.txt file - cDNA_ID_2990777; gDNA_ID_2214580; Annot_ID_186462
ggaaaaagttatgtatggagaaattgcagcagagcgattgtgttccatgtcagcagaggaacttgcttcaaaggaactagctgagtggcgacaagcaaaagcagaagagatggctcagatggttgttctgcaggacactgaggtggatatcagaagcctagtaaggaaaacacacaaaggagagttccaagtggaagttgaaccaatggatagtggttctgtagaggtctctgttggaatgagttcgattaactggtctcgaacaaagaattttaagaagaaaaccccttccatcacgaaaactcttggagtcaagaatgaattgaacagctctaatgagagcactgggccaataaacggagtcacaatagatgatgagatgcaggctgccactggatctcttcctccaattgtctctcttgatgaattcatgtcatccatagattctgaatctccgtctggctttttgtcttcagatactgagaaaaaaccttctgtttcagataataatgatgtagaggaggttttagtttcatcacccaaagaaagtgctaatattgatctttgtacatcaccagttaaggctgaggcattgtcaccacttacggctaaggcatcatcacctgttaacgctgaggatgctgacatagtatcgtcaaagcctagttctgatttgaaatccaaaactacatctgttttcatacctgatggtgaacgtttatgggaaggtgtgctccagctgagtccttctactgtgagctctgtcatcggcattctaagaaggtttgtaataaattgtttcatgagtggtagcaaacctatctcagtattttttttttattccacatttccaaatttaggtttgcatatatgaatagctttctttatttagtctacatgttactacttatctatactattctagtgcttatcagctctataaaatgtttttttaatgaatatggcttcgctgttattgataccatgtttaccaacctgatttttacgcttcacagtggcgaaaagactactacaaaagagtggcctattttgctcgagattaagggtagagtcagattagatgcatttgagaagtttgttcgagagctcccaaattccaggagtcgtgctgtaatggtatttgtctacacgtttacctctatcattaatgtacatgttttatatacgcattctgtgtttgagcccctgcaaaagctattaactgtgacgtttaaccaagcttaagtagaagcatttaggaaagaagaggagagattaacggccaatactgatttgtgaatgattgagaaaaatacattacatctgtgaatcacaatggagatagatggacttacaaaaatattttcaccagaacaattgcatagcttatgtttcttgaataggcctccatattccaataaaactaagacctgtttgttctcgattctatatgtatgtgatgaactcgtttatccatcatggtacttctgaaaccttgctttcgtgttacaggttatgtgtttcgtctgcaaagaagagtgctcaaagacagaacaagagaacatttccgaggtatgagcgttggtagttaaccaagattctgtgtatccaaataaacgaaaagatgattaaaaaaacttgagatttatttgaatattaatgatttatttgatcaaaactgaacgcgaatctgtacaaactgaaaacccaaaccgaatttaaattgaaacactcctaaatatctgtagaatgtctaacttggtaacgaaatttgggcatttggttttgttactatacaggtggtggattcatacgctaaagatgggagggtgggttatgcagaaccagcttcaggagttgagctatacctatgcccaacccgtgggagaactgtcgagattctaaacaagattgttccgagaaaccaactcgatttcttgaaatctataaatgatgatggtcttataggtgttgttgtatggagaagacacacaatttaaaaaatcaccactatctaacaactctcacaagaaccaccgtgaaaagggttcttcgttaaccacatataatacttctcgttacagtaacatgctacaggtcaacaatgacgatggtgatgatgtgccaccggggtttggcccaatgaccatggctcgggatgaagatgatgacttgcctgaatttaactatttttccagtggggatgttgtcgtgaaccggacaagccggtctgtatctgtaagagagcttattcaaaaatatggaaaatctgaacctttgaggaaccaaagttataatgataatgacaatgatatactaccagagtggcagcctcaatctaactggactcttggggttactcatgtaaatggtggctcgatggttagaccatgtagtgagtggtggtctcatcaggatggcagaggaggatattaattgttttttgtttcaccttagcaattttgtgtttgttatgcattttctgttgcaggcaacactgctttccaaattttgtgattttctctcaacagtcaccgatatttggcactttattagtaagatgggcttgcgcagcccgctaatatattgctcctttctgtaacaaaaagtacaaaagtaacaaaatccactcctatcgattatactataaaacagaagtgcagagaaaatttcagtcatgatattttttgaccagctcgattcagaaatttggaaagactagcttttttttctctcgggtttcactttttaaaggtcgtgaaaatttgggaatcactgatcaattttgttaatatgatttcctgatttagggtttctctgcatgcctctagaatcagcaagtgtaaagcaattaccatggtgactccgaagcagatcgatttctcttcctgtggtggtggtgataactccgacgataccctctcccatcgagaatctccacggaatccttcctcaaagcgtgctgctgcttccttcgcagcagaagcaggcgaagagactatg

SEQ ID NO: 27566 - DNA, 3000 bp, Unknown
  misc_feature (1)..( 3000): 2750-1469P.txt file - cDNA_ID_2990781; gDNA_ID_2926225; Annot_ID_142514
caacaatacaatgtttgatatatctagtgtgacttttggtagggtagatcatatatatatggttcaaaaaggacatgatcctgattttttctttcttgaaaacatctcaaaacgttgtgaacctaacataatttgatattactggtttggactagaccccactagttcatgtaaaatatggagcatatgatatttgaagggctttctacagctgtattaagaaactatggttgttagaaaacataaataccaaagtttaacatatataacaagaaacaaaaataccaaatacagatagtgtgtgatatgagaaagattttgagttactaagaaatgtctttctttatttgtcaattagaaataatatagtatgtaatttactaatacatggttatttttatgatgacagcaaattaaagaaagaaagcaaaataattatatggtagtatgacataatgtaaaaagcaaaagtagaccacaggaagaaaaaggacaaaaattattattgctctgtagggattatttatatttggtatttaaaccaactgtaattttcattttttttcttgtagattctgacaccataataagtatataatgtcgacataactgggactttgagatagagaaaaaccattatacgtataaaacatatataacccccttattcaacgttagctaaaaacatttatctagcaacatcaacaacataaataatttactctcgagaaaaaaaaaacaagaactgagcatatgataatgaattcacacttcacattccacagataactctaaaatctttgacatgttcttacaaacagtccacggaatttacctaagttaatcttcaaacatctatggaatttgactgattaatattataattctatcatatatatttataaaatatatacataatacacagatgaaagtgacactaaggatccttcgaccaaaaaaaatcactgtgacgtatagggtgagtacaaaaggattaaaggagaatgatattttcacaagaagaaattttttaagttttgataggtaatagtatttcatctgaaatactttattgtaactttacacaaaactaagaaggtactctatattttacaaaaattcgatgtacatttaaataaatgtaaatcttgtgaaaattttgtagttggaaatttacattctaaaatataatagcggatcagtcgcatattttttaaaatcattttaattaatgaacttagtgtagattagctgaaaaaacaagtacatgttagtggtaaatgaattaactgattaatcaacatatttagagcaaaaatacaaaaacatttaacactattttcataattttatcgagcaccataatcttgtaaacaacacactttaaaaataaaaaaaaacatttgaaagcattgataaaaaattgtaaacattcggattcaaatgatgaatatatatatatatatatttttccaatagtcgattatagttttcactaaatgttttcatacattcaaattagaaaagccagaaaatgggtttaattaatatattggtgttctccgatcgatctaaattattaaaatatattttgacggtttacaaaacaaaaataatgtgtactttttatattaatcttttttgtcgatcgatattaatcgcttttgtcgtgaagtttatataacgaaaaactttactttctaaattacaataactatttgcggcgaatcgattttaaaactgtgagattaatgaaacgatcgcgaatcttttttttgtcagaacgatcgtaaatcactaaaataataattttattttattttattgatctactaaaatttgacgtgtactcttaatctatataagttttttgtcgtgtcgtttattagaagattacaaattaaattataataattaattataatgatcgactttttaaatgtttaattaatgaaacgatcgtaaaaaaaactttgtcaaatcggtcgtaaatataacgaaacaacgaagctttctaaaaaaataataatcaaaattaatcaaatacatgtaaaaaaatatagaaaatttctaaattattactcttcacaattcattcatataaacaacatacctaataatatattcttaagtaaagaaaaaaaaagtgtaccgaataaattaactaaaacagccaaatctgccaaacaaaagagtaaagaatttcgtcagagaagtgctatcatttttattctgccacacttcctccgccatttatacaaataaaaatctcctaccattttaaaatcctttataaaatatattttcttataactttaatgcaaattaaatatttcgaagaaaggtaaattgtttttttctactacacttacacatttcagagagaacttaaaacgtgaatccgatagatagagagagactgagaagctcactgcttcgctgattttgaggagagagagagagaagagtacctcacaagacttgcacagatatatacgtaagacttctcattgtctgctttcttctccttctccttctccttccttcttcttcaacttttacctcagaagcaagaacaagtcctgaagaacccaggtctctctttttttccctctgaatttcttctactttgaatcttctttgtaatagcctgagaaatttcccagatttcagcttccaatcgatttatataatttttcagctcttgttgtttttttcgttgttaagtaatctgtctggactggtctgctctggtctggtctgatgatcttccgatgatcctttcctttgtattgacgatttctttgatctttccctttcggattttccttatctaggttccaaagattgttgctttccttattaaaaaatcaaagctttgtttttttatattctcacattgtgaattactatactcttgttttatgctatggaccttggatcattgcttaagctaacattttgctttttgttttttgagggcacagatcatcaatcatg

SEQ ID NO: 27567 - DNA, 3000 bp, Unknown; identical to SEQ ID NO: 27566
  misc_feature (1)..( 3000): 2750-1469P.txt file - cDNA_ID_2990781; gDNA_ID_2926225; Annot_ID_203463

SEQ ID NO: 27568 - DNA, 3003 bp, Unknown
  misc_feature (1)..( 3003): 2750-1469P.txt file - cDNA_ID_2990785; gDNA_ID_1620315; Annot_ID_153156
acttgattttacgcggcacaaatatatattttgcgtgggaggcactaagatgaataatttgatcgttaacattgcgagtgcttctcatgtttctttgtgtatatgttagtatctttctcgttttattttattttaagatcgatcttcctgtttatatgcatcattataattaaagttaataagatttgatttaataatagtagtcattactctttttatattattttctcactaagccattcattcgattgtagaattctgctggtttcaatgaagctttgaaatccatatataatatatgtagaactagaagtgatgaaatatagaaattgtcttctttcgttttttttataaaaaatcttacaatttggcgtgtaagattctctttattttatattttacacatatactcgtcaaacaaaatgatacattttgtttgagaaattcatcataatgaattatttatatatttattatatagtatatatccttccctaggtgggatccaaatcatatatgtatgttccttatagtactttcactcaatattataatggtctatgagttttgtaacgaaagtagtgacgagcacaatgtaaattattggtggtttttcatacatagtctaacgtcaccttaaacgcttaaatctgaaaattctgtctaagagccaatccctctaaaacgaggaacggaattggttttagcaagatccattgtcgatgaagtcctgcaccaagaaaaaaaaaaacaggttatagatcagttaaatatatagagttaaatgatcacttatacttttagcaaaatgttttacgtcatgtatgattttgattaaaggaaactactaatcaccccatagaactctattttatgtaaattgtaaagcgtcaaatattgtttgtgtttggacccgatcctacaaagattcgaacactttgataggtaaggccaccttcaatacgtattaacctaacgttggataccgtgaagacgttatttgatacgaaaaacacttgataagtggtcaatagataacctaatttgtaaaataaatgagcaagatatccttttttttggccttgatactaagttttttttattttttttttattttgttgaaatcgacgtgttggtaaacgtcttgattagtggatgcaaatctttgttctgttgagtgttgaccacttgacaagcacttgttagtttaaaacttactaacacactcattgtttttttcgggtttctgttgtatttatggtttttgagattactataaatagacaaaagaaaaaataaattcaaatagagaaactagtggttgacaaaaataaaaaataatagtagagaaactagtgaaaaataataactaatgtaaactctaaacgtaaacacaaaaacaaaaacaattaatgtaaatgaagacttgtaaccaatatatctttcttttattttggttcaacttcaataaacaagatgtaaccaatacatctaatatcaaaaacagtagggatatcaaaagcaaacgaaacaatcaggatcatgtaaagcatttcaacaagatgtttactgtagtgtgcttgatttgatgtctgaaaacaaaatcgcattttgtttttttaggatcatgtatgtcaacatacgttgagaaggacgtcaaattggctattcattttaagcaagagacactgatatataaatataaatcaatgtatatatgcaacatcaatttattatcaaaacatattccaattaatatgtaggttggaatgatataaaccatgggagtgaacggaattgagattaaatatagcggaagtctagagcccgacggaattccaattgagatttatccccaacaaagcatgggagtgaacggaatctaatattgacgagtgtttctaattcaacgctatataatatgatatcaaactaatcatatttcttataaatatagtatttaatatattatgataaatttccatggtgacttttcaatgttctgagacatgccttaattaattaccatttaccaactctatatacaatacgttatctcgtaatatgaattaacgataatattagaaattatatgaattaagtttttgaggtccgaatagaagagaagtaggagagataagagatcctttgaggcttgtccacatcttgtatacttcgtagccgcaatatggactgttcatggttcgggaagggttatgataacctaattccaggaggctcatataacataccgttcatgatcttataataatgaacgatataactgaaaaaaagttttatgcatattacatgttttattaacattcgcaaatatatggttatccaagtcgtggatcatgccatgtgggtaaaggcttttagtttggaatggttagcacaattatttatgaatgtatgtatttgcagtaatcatgtataacatgttgatttttttttattattttttttgccatattataaaatgttgattatgcaaatagatacttcaaaatatagataaaatactctgtttatcacctgattatatagattatctataatgttagatgcatgcttatattaactgataaataaatcgagatacatcaaaacataacttataagatatatataaaaaaatttgtactgataaataaaacaatcaagttttaaccatctacagtcttaccatttctttatacgtctaaactaagtataaaatttgaatataattatgtgtgtagagaatctagagatcgatgaattgctaatcttaatttgaagttattgcattataaacgagatccaccacttattattcataacgtatatgaatcgaatcattgatagataaataatttcagccaagaattgaccccacgagtgccaataaataacgacccttagcgagggttaaagccacaacacaaaatttgttcaaagtctaaaaaagattattattacttatcttctcccctgaaataacctcatagtgtcgatatg

SEQ ID NO: 27569 - DNA, 3003 bp, Unknown
  misc_feature (1)..( 3003): 2750-1469P.txt file - cDNA_ID_2990797; gDNA_ID_1620834; Annot_ID_57928
tgattttaaaatataaattagcaccaaaataattaatttaaaaaaaaaatatagcgactgtttataacgacaatcaaacgaacaacacatcgacaattattagcgattgtcgctgtaattggtcgttgaatctagcgacagacaaacgaacaatgtatgttgtcgattgttgctgtcgctggatccagcgacagagaaacgaacagggcatatgccttcgaaaatatctcatgttagggttaggccatgcaaatatattggacacttattttattttaatatgtggtctgaacttatttctttttgaacaaaaacaagaatattgttgtttaaaatttccatgaaatgattaagcaatacatatacaccacagaaaacaaactcagcttcttcttagctaagcaggcttaaggggcggctggacttatctataataaaaatttgagtatctaaacgaataaattggagatattcttttagtgttatcctaattatagttataaaacaattataaccttagaaagtttcttggaaatttaatggtaatttcattaccgtaaatagtttttctttcttcttcacgttttttttttttttttgttaaacttcttttctttctctataaaaactaaaaagcaaacttctcctttttggtacacttgccaaatgctctcaagctcaaattagcccaataaagagagaaaaacaaaacaataaaaatattaaaaatcatgaacacgatctttaaaaaattatcctgttttaagaaaaaggttaaatctttacgaatattcgaatccaggtcactctcttcttcgtcttcttcctcattcactcctcaaaagttcgacgtttttctaagcttcagaggcaaagatactcgcaagaacttcgtcagttttctctacaaggcgctagtatcaaaagggattcgaactttcaaagacgacgaggaattggagagaggccgtccgattccgccggagcttcgccaagcaatcaaagggtcgagaatcgccgtggtcgtggtctctgtaacttaccctgcctcgtcctggtgtctcgaagaactcagggagattctgaaacttgagaagctgggtttgctcactgtaatacccattttctatgagattaatccttcagacgtgaggagacagagcggagtagtctcaaaacagttcaagaagcatgagaagagacagagcagagaaagagtcaaatcgtggagggaagcgttgaccaaattggctagtctctccggcgagtgttcaaagaattggtataaatctctgaaactttcttaaagattgatgaatcgggtcgatagtttcagattgaaatctgttgaatagtttctcaaagtttcgattttttctctgtttctcaaatttaaggtctttgtctctgtttctgttttagggaagatctgtcgaatcgtttctcaaagtttcgatttttatctctgtttctcaaagttaggatcattgtttctgtttctcaaagttagggtcttcgtctctgtttctcaaaattaggatcattgtctctgtttctcaaagttagggtcttcgtctctgtttctcaaggttaggtctttttgtctctgtttctcaaggttaggtctttttgtctctgtttctcaaggttaggatcattgtctctgtttcttaaggttagggtctttgtgtctctgtttctcaagcttaggatctttgtctctgtttctgtttcagggaagatgactcgaagctggtcgatggaattactgagaagatatcaacaaagttgttctcggaaaaaccaaggaatgataatatcctaattggtatcgaccaacacatgggggaattgtatccactatttaacctgaattcgaatgaagatgttcaagtcattgggatttggggaagaggaagtaatggtagatcagcactagcaagccacgtttaccaaaacatcaaacatcactttgaagctcattgttttctcgaagacgtgagacggatttcgctacatttccgtgactctcatttacaagatgagcttctttcaaatatgcaaggagaaggtttgacaacaaagaactgtcataggtgtcttaagactatcaaagcaaggctaaggaacaagaaggttcttcttgtggcgaacgatgtagacaaacttgaacaatttgatgcacttgctgaagaatttagctggtttggtcctggaagcagaatcatcataaccacacaagatagacaattgcttatttcatcagtagtgaggagtgtctacgaagttaagctcttgagatgttacgcagttcgtgagctctttaggtcaaatgccttcaaagaaagagaaagagacgatcctgttgggttcgaccagtctacatatcgagccatgtatatatcaggtcatgtgtttttgaccttgagatatattttcactttgttgtgtgatagaggtcaacttagagaaaggataaatgcaatagtacatagtctttagattcattaatccttttagatacaaggtgttgtatttaggtcgaataagttggttagattcaggaatattaacttaatgtgtttgtttgttctatagtgaatgttacgccatttttttacatatggatgtgccacttgtgtatggatttgtgtactatccatttggtaaactattttattcttaagacggttcacaacaaattcatttaaacttgtaattgttttataaattacctatatcaatctcgtccgtcagttgacttagttgtaaccaccagaaaagtaagatgataatttatgtttatccatgttcattttcttattttggcggctcatcttctctttctgagtagtttagtgaaacagaagctgacaaacaaaaaatgaaaatgccaggaaacacacactagagcagaagactcctagttcaacttctcttgtgttaatgtgcctataaatatcctttgagatattcatagagtatcagaaataaaaaaaaatg

SEQ ID NO: 27570 - DNA, 3003 bp, Unknown; identical to SEQ ID NO: 27569
  misc_feature (1)..( 3003): 2750-1469P.txt file - cDNA_ID_2990797; gDNA_ID_1620834; Annot_ID_169790

SEQ ID NO: 27571 - DNA, 3000 bp, Unknown
  misc_feature (1)..( 3000): 2750-1469P.txt file - cDNA_ID_2990805; gDNA_ID_2926259; Annot_ID_143204
gcagagttgaatgatttccaggttcgctttctctgctagacactgattattgcattcctaatccttctataaatatgatgctgcaaatttggttaacaggtaaattgttttggtgccccacttgaccctgttgaacttatgggagttaagaaagtggtacaagaaaggcaaccagatggagtaactgaccttggtcttacacttccgggtttcctttttcttttctctctattcatcgagagaggtcgccctgagacagcatgggctatcctacggaaatgtggttacaatgattctttagaactccatgctgagttactacccgttccagctaagcagtctcctgatcaggtgtgtgttgttttagatagtgtacttaactacgacaatatctctaaattgttatgttattaaaggatatgagaaactggctggttgcttttaaataatgtttgcactctattcctgtatttcacttgcagagcatcgagctaacaaacgaagctatggactttctgagtggaatcttccagttatatgaccttgataatgtgtgtatgatcgtttcttcaattatccaacaatgattctgttgttctctatcacctaaaagcttatttcaccttcaaggagcagtagtagttctctaatgctcttcgttttgctactatttaggatggagcgttacagccagctgagctagatgatttatttcaaacagctccagataggtaatttgctggtgattttttttttttttaattcattgctattctttcctctgtaatcagtggttatcatctgttcttccaatgattgtttagtgagttaaccttctttcttttgaattttcttgccaatttcttcaatgctcttgtacatgaatacgtttattatttccggaatatgtttctttacacgtacaatctgctttacgatttcagtccttggcttgaggatccttataaagaagctgcagagaaaacgccaggcggaagtttgacaatcaatgggtttctgtctgaggtttgtattcttgatgttatgttgacgctgaattagaatcaagctttcattgtcatcatgatcttatcaaattcaatattttttaccattgttaattttgctctgttatatgtgttgatgcagtgggctctaatgacacttctagatcctcgaaaaagtttggcaaacctgacatatatcggttatggtcacgacccagcttcaacattttctgttactaggaaaagatcagtggatcgtaagaaacagcgaacagaaaggaatgtgtttcagtgctttgtatttggccctaaaaaatctggaaagtctgcactcctcgattctttcttaggaaggtatgctagttttaacatttcgaagtatccatattctgtgtcatcttcagtgctttgattgtttctgtggtctactcgtgttatattttataatctgtgtttcaactccaggaaattttcaaacagctataaggcaacaatgggtgaacgatatgcagcaaatgtcattgatcagcctggggttagtagcaaaagtctgaactcttatgttctttgtcacatgtggatatggtttatgtggttttttttgttttgttttcctaattgttggacgcatttttcagggttctaagaaaaccctcatattgcgggaaataccagaggacagagttaaaaagtttctgacaaacaaggaatcgttggcagcatgtgatgttgctgtggttgtctatgacaggttagctcagaaattatttgcacctggtatgtgtggataataagatgacagacttagcaagaaaaaatgatgttttccagttcggacgtatactcatggagaaaggcgagggaaatactgatggaggtagcaaggaggggagaagagagaggttacgggaccccttgtcttctggttgcggccaaagatgatttggatccatatccaatgtcagtgcaggagtctgatagggtaaatgcatcacttaagcctaatatgatttgatgagatgctgctcttggtatgattgatgattctattatcggatgacaacaggtttgcatggaattggggatagacatccctgtgtcattaagcatgaaacttggggagccaaatagtctcttctcaagaatcgtgagtacagcagagaaccctcacatgagcattccagagacagagtcaggaagaagaagcaggaatatccgccaactcgtgaatagctcacttctatttgtctcaggttctttcttcttcttcacaagatctatgcatttccttttttcttgagcaaaaccattaaatcatccaaagctttactattaaattgcagtgggtacagctgttgggtttgccggattagcagcttaccgtgcttattccgcaaggaagaatgcttgaagctttttgcccccaaaaaaaacttagtaataaaacacttgatgtttttctttagcgattcatctgctttgtatagaataaaggtaaccctcgttgatggcttcaaatctccgctccgtcacacctgaattttggagtttttagatacaattattatgtgtgtgggttggatttttttctcatcttcgaggaatctttcttattctttgtttctttttttcattgatgatataccattttatcaagaaaaaaaaaatcatatttctttcctttttttgggatcaaccacagatctttatgaagaagacacaaataggattagatgtagacaaatccaaatcttcatgagaattaaattaaacgacggggaaaaaacagactcatgtattagcataaatgggcccattttaataaatttgggccaatctagaaaatggtagtgaaacgaagatcacataaataaaaggcgaccgttggatgttgttatcttgtacaagagccttacaaaattcttctggttctctgaggatcaaaccaccacaagtcagaacagagtgaggtaatcattaccaacaaaaaatg

SEQ ID NO: 27572 - DNA, 3000 bp, Unknown; identical to SEQ ID NO: 27571
  misc_feature (1)..( 3000): 2750-1469P.txt file - cDNA_ID_2990805; gDNA_ID_2926259; Annot_ID_204684

SEQ ID NO: 27573 - DNA, 3003 bp, Unknown
  misc_feature (1)..( 3003): 2750-1469P.txt file - cDNA_ID_2990809; gDNA_ID_1620530; Annot_ID_159707
tgccgaaccggcgccggtttaagaaactctccggtagttacaacgccggaagggaagagatcttcttccaccagaaaacattacgattctgctatcaaaggcattgagactctccaagtctccgacgaaaggtttcaccaccactgatacatcatccatccatcgcttagcaaagttgtcgtatttgttcagagctttttatttgctttcgactctatattggagaaacgagaaaatttgctgatttttttttgtttgctttggttttttctaatttttattcatctggttcttttactgcggagggaaattaaattcagtgtttggaattggaacatcgtatatatagttttttagtaatactgaaaatgtcttcttcagtagaaattgttcatgttattttcgttcactgcatagtgatggaatgaaaaaacggggtcaaattaatagaagaagtaatataaagggggcaaaatgcaatacacatgaagtattaagattttatccattacttcacacatgacgcccttcgtctttttccttattctttctcctctcagaagagtttacttgttctggaaccctaaatctcgaatctggtaactcggatccgataaatcgttccagagatctgttacttctctattcaaggatctgttatcggtgcgaggatctacggattcttctgttcgcgcataatcggtgagtcttaagaatcttcagcttttcgtttgattttgatttatcgtaagatctgatcggtccttagtgtaatcactttatttttcccctgttaagttcacgcgtaacctaagaacttgaatttgatctgtaagctagatttaaccttggttttgtgtattgagttcgttctcggtggaaattggcttatggtgatttatggatgtgacattttggaagtgtttacaaagacgtatttagaaatgcatttggcgatttgctcgatgttgatctgttgttttctcgaacttagctctataagttttgtaattgtaggaaatggcagataacaattcaccacctggctctgtagaacagaaagcagatcaaattgttgaagctaatccattggtgaaggatgatacttcgctggaaaccatagttcgaaggttccaggattcaatgtcagaggcaaagactcataagttctgggagactcaacctgttgggcagtttaaggatattggggatacgagtttgcctgaaggtccgattgagcctgcaactccattatctgaggttaagcaagagccgtacaaccttccttctgtttacgagtggacgacatgtgatatgaactctgatgatatgtgttcagaggtatacaaccttctcaagaacaactatgttgaggatgatgagaatatgttcaggttcaattactccaaggagtttctaaggtgggcactacgtccaccgggttattaccagagctggcatattggagttcgagccaagacttcgaagaaactcgttgctttcatcagcggcgtgccagcaagaatcagggtgcgtgatgaggttgttaaaatggcagagatcaatttcttgtgtgttcacaagaagctcaggtctaagaggctcgctcctgtcatgatcaaggaggtgactagaagggttcacttggagaacatatggcaagcagcttatactgcaggagttatccttcctacaccaatcaccacctgtcaatactggcacaggtcattgaacccgaagaagctaattgatgttgggttttcaaggcttggtgcgagaatgacaatgagcagaaccatcaaactctacaagttaccagatgcaccgatcactcctggattcaggaaaatggaaccacgcgatgtccctgctgttacacggttgcttaggaactacctcagccagtttggagtcgcgactgactttgatgagaatgatgtcgagcattggctactcccaagagaagatgtcgtggacagttacctagtagaaagccctgaaactcacgatgtcactgacttctgcagcttctacactctcccttcaaccatcctcggtaacccgaactacactacattgaaagctgcgtattcttactacaatgtggccacacagacctcgtttcttcagctgatgaatgatgcgctaattgtctcaaagcaaaagggtttcgatgtgttcaacgcgttggatgtgatgcacaatgagagtttcttgaaagaactgaagtttgggccaggagatggacaacttcattactatctctacaattaccgtttgaaaagtgccttgaagccagcggaactcgggcttgttctcttataagctcaacaacttgatttgatggtatcaacaaacttgaaatttgtctctctttttttttcttcagtctgaactacttctcccatggtttactgaaactgagtttaattattttggcaatgcaattttggattttgcttttagtttcacttgtgttctctgagagagttgaccctgagaagtaaagtcaacactagacgtgtgcgagtttcaatggactgcatttttaggtccaagaagtagctacggcccatctatcgtagaagttgttttttgtactaaagcctgttatagccgaactaggtcgctacgtttcctaacttgtcgtttattaggctacttttaaatcgcacgcaccaatccagttcttacacgcgttttcacaaaaaggaccttacatgggttgttcccccaataagaaaattacacgttgcagaatcgaagcagtggtctatccttgttatcgtcctctcgtctttatggctcttccaagtcattttgagaaattttcgattttgagatttttttccaaatattacaaaaggaaataattagattcctctttctgcttgctataccttgatagaacaatataacaatggtgtaagtcttctcgctgtattcgaaattatttggaggaggaaaatggagtgtgttggggctaggaatttcgcagcaatg

SEQ ID NO: 27574 - DNA, 3003 bp, Unknown
  misc_feature (1)..( 3003): 2750-1469P.txt file - cDNA_ID_2990822; gDNA_ID_2926298; Annot_ID_205579
tgtcctgaaatcaagatatgcattttagaaacagaaaatcaagtcccacaattatcaatcagccatctctacaaagaaagcagaacacgttctctcgaccaaattgagtatatgataaccttagagacggcaaacaaatctacagcaatgactaacctctcttccagggtggaaaggaatgtcagggccaccagtaacttcaacggccacaacaccagcaagctgaatgatcaatttcacaccacaaggatatctagagttagaatccaaaccttacagttatcaccgttaaccaaatagtgctttttaaaatttaaaaccatgtacctgatggaaatcagcaaaagagatggtagggaattgctccctgatggggtccaacaacctaagagcaatgtggataccactgttggctccatgagcttgctcagcgtcaaacctcattgttccgaatggacctccagtccttgattgacaatcgaaagttccagcagagtgccatctgcagtttagccagacagatcagccatgagaaagttcataatcctacatacttcaaaaccacaagcaaatatggttagttacttacgcgagtcggaccatgatgggtgcacagttcttctcagcgatcaaacctctgagcttcctcctgcacttctcaacagccttcttgtaatcttcgctcacggttgggtagttcttcgtcatcttagctaagctctggaacaaatacacagatatatatacatgagcctcactactaaataaacgcacagatcaaatccaaaactcacgaaatccaactatacataacaagctgagaatcataaacaacaacagcctctaaaacagcttcatacgagtggaaaaaaaaaaaacctaaatcaagcaggagtgagctacagaagccaaatctctcaaaaactttcacagattcgtaagattagcctagaaactcagcaatatcgaaccacagaacagaaacgagagagctgacgataataacgccgatcgcagcaacgaatcgtggatctactacgaaaaacacatcattaagcacagatcaagccaagcataacaatgatccgatcgagtcaagatgaaaatggaagcagcaacgacggatcagagagggagagagagagtttccgtcataccttgtttcgaggaaggataataaaatctggagaaatgcgagtggctggcacgagtaagacacgagtactactttttatgagagcgttgaggagaagaaatgcgaaatatatagagtcatgaatgagaacgttctggtagatctgtagatgccgttagatgacggatatcgtgtggtcaaatttgccaatataattgacgatcatgattaaacgcacggctttaaaatggacgttcggatcttagggttggtggtatatagatgggaaaagaataatccttcaatattattaggaaataattggcaatatgcaattggaggatacatgcttcgtgtggagggcccactaactttggggaaattatcaaaaagggcgttgatgttgaattttcttcagtaaattgacgaaattaggcatcagaggacttttattgcgaacacgttgggcagtggtatttccgtgatttcatctgtcgcaggtgtgaacgcgtctcacgcagacgaagatcccaattggactaaggatatgataaagtcacagcagcagtgttattaggtttctcacccatcgctccttgattggtgggtcataaaccaatgcggtttagacctagcaatgcacggtttggttaattgtccacatttattaagtctgcgattcggaattttgaatcggttattagaataggtaacaacgaatgtcctctgtttcatggggaacaaattttcatgcccacctacttttgcttggcttgtcgaaagattcgagaaccggtgttgtttgataggaatctactcgacggaagtcgtgttttctctctactcatgttattaacgcaagccagaaaagaagataagccagttactgcagcaaaacaagtgagccgtatataatatagttcaatgacaagtctgagttagttagtagtaacagacgtctgctgtgctggtccttcccaagtgtatgtatctgttttcttgattcctcaattctattgtgtggcctacttttcttcttctttaatatctcatgaaattcttgtgttactactgatttctgcagacatggtcttatactcttatagggtagttgtttttggttaaggtttggatcataattgcggagaatgcaaaagcaatgtgagagccttttcatgagagaatttgcattgtttcttagtattttgactcataaaatgctgaagctaatttgaaatattcagtgatatgtttttgtggttcctgagccttatatcttagcttcagctacatctacataattatcaggtttgatcaccttctctgatccttaatatgtaagaagatataagatgggagaattggatcgataatgcaggtttgtgagatagtgaaaatgagttcagaggtgttttactttcacacaggttctgtttacttagcacacaagagagagttttgacattgaaatgagacttgagaataatctcgcttttgtatgtttaccactttgctttttacttactattggttcctagggacctattgatccacaatgagatagctttttctatagtatacttctcttttgtttcttttgaatttttctttaatgatgcagaagtcaagttttaaccttgtaataataattctcattcaaatttcgaagttcaacggatcaaataaaaaagtttgtcttcatttggcccaccaaaagcaaaaggtgccaccattttctctcctcttactcactgctttgcctttttaacggcaacaacagctacttgagaaacagtcttttaaaacttgcttccttttttaatcttaaaacctgtcttgatccgagttcttcttccaaagaagagatg

SEQ ID NO: 27575 - DNA, 3003 bp, Unknown
  misc_feature (1)..( 3003): 2750-1469P.txt file - cDNA_ID_2990828; gDNA_ID_2936587; Annot_ID_143889
acaatcgaatcatctaaaaaccagaattgtaccttcttatcgacggaggcggcggaagctgaagggaaaccctgaagagcttgcataccttcacgtctcttcttcatcaaactctcctcacgcttgcttttacggatctcaaccatgttgtcttctctcctccgtcgtccttcctccgcatccactgcaactttgtatcggttccggcgaacctccgtcttagcgttgggtctcagtgacatggctcttgctcgacaaagaaaatccgatgaaaagatataaacccgatcaatgaatgcacacaagcacacgcaaagactggtctgtgtattatatagatcctgccgagagcaaataaattataattataaaaaaaacctaaaaattgatttgggagtggaaaagtgataaagaaagagttaagaagcagaggcagcgagggacaagttgacaacagcgcatccaaagaatgaaagcacttttttatttatttttaatctttgttcttaatttatactgtaattgctaaaatattcacttatttacagttttgccactatttatttatgcaaacaggtgtccacaattaggttatttacataattagccccttactattgtgttctttgaggcaagctaatgtattcttctttatatctcaacaatttgaagatccttttgttttcatgacttacaagtggactgcgattatcttaatattaacgtatatagaccttggttactatataactttttgagttttgaatctacgtttgtgtttatacattttttcctttccaatgaaaagtcgttgtttgtcatatatggattagttatttctctctagcgagatatcctcagtcagattgtccactctttaaccgactacataccgatcatcgaagaccaacctatgaaagtaactgacgagatcataagtttgcttggccatgaaccagaccgcaatcaaggctaacaacgccggccagataaacggctcaatagctgggttggcgctacgggaaaatccaagcagaggtaacaaagacttcaagagcaagtaagggatgcagagtgtggctagaagtgtggttatgatcgaaccaatcacatcttgaagcagccacattgaaggaagcttattgattcccacgtttctgattctcttgaactttccccgccatgccttagtcgcgaaacagttgacaggaaacgagatttttgctcaggaggcaggacagtttctttgttatgaagtgatatcccaaggaaaaccacctgactatggctggaaacgagatttgacgcagagtgaggaaaattcctaagtaggcaaagggaattgacagcgtcatcatgtatccaagaatgacaggtgagttttcgaataaaccgccacctcctacaattgctattgcaatccagcgaaaagaaaacggcagaagaataaagaagaaagacacacatatgctgatggtaagagcctgtagataagataacaaacagaacctgttattcaaaacatgctccatatggtaattaagttacatagggtggacgaaggaagagaactagaagggacattagacttacatcaaaagatttgttatccagaaagaaaagcagccgtccaatggctccaagttcgtgaacagcaacaccaactagcctaggaggttccccgaagaagctttgcaatagagaataataccactcacaaacgatcttgttatatttccataaaacaagcacaaacccatctcctaagacattcttaatcaagatgtcagcctgaaacccagcaggatgtctcgcgataatgggctcgtgtatgggtatcctcatgaaaaacacaagatgaccgttgtataacaggccatttaagaaacatgcggacttggtagacattccataatctctcttgaacccaacaacaacttcttggcccaaaggatgtaaagaaaggcagtatgtgttcaagataaacgccatagcccaaggaacaaccattctcacgtaaggtgatgctctcattaacacaaacacgtattagaaactcgtgaactggaagtctctctggagcgtcctacaatgaaaacagagagcatttcatcaaacatttggtgtgcgagattcttcttaaacccatattacaagaaacagagaagaaatcgaaaatcccaacaccatgacacaaatataatccccaaaaacatcactcataacaaaatactagtaaataactttgatattctttctaaaatcgcagaaattgaagtttaatcgaaaacgaaattgtcacataacgctatagaacaagaacctcattctttagagaaaaagaggtttgtataataacctcgcactgcttgtatccgcggagattgagccagatatgaagacagtcttgatgaacattgatggagcctcgacacgcgcaccggataccataaggggtttcctggttcctccggtgatcggcaaatcctgcacaagtcttcttcttctttatcatcatcgtgtttgtctgtgtcttctaccagagtagcttgatcgtccatttttctgatgaaacagaaaggtttcttctctatctctcgtcttcttcacttccttgagtcaaagaaattccaaattttgaaaaaaatggtttgctgctttatttataccccaatttgtaaaaggccacgactctgggttcattcaatgggcttatatgatttagcaacgagatagattaattagaggcccatatatgatttattagggcacgttggtcatttaaagtccactataaattcaatcagaaattagggttttgtgttgcagacgccgtatttgtatcgcggaaagtaaacctagccgagcagatctacctctctctctcagtactcaggttagcttttcttatatctacggccgatctctggcttcatttccccctgttgtttcgttcgttattcaattgaatagtttgtattgtggtcttgtgtctcagagatg

SEQ ID NO: 27576 - DNA, 3003 bp, Unknown; identical to SEQ ID NO: 27151
  misc_feature (1)..( 3003): 2750-1469P.txt file - cDNA_ID_2990831; gDNA_ID_2684204; Annot_ID_191333

SEQ ID NO: 27577 - DNA, 3000 bp, Unknown; identical to SEQ ID NO: 4851
  misc_feature (1)..( 3000): 2750-1469P.txt file - cDNA_ID_2990835; gDNA_ID_1620736; Annot_ID_166275

SEQ ID NO: 27578 - DNA, 3000 bp, Unknown; identical to SEQ ID NO: 4851
  misc_feature (1)..( 3000): 2750-1469P.txt file - cDNA_ID_2990835; gDNA_ID_2926157; Annot_ID_198505

SEQ ID NO: 27579 - DNA, 3003 bp, Unknown
  misc_feature (1)..( 3003): 2750-1469P.txt file - cDNA_ID_2990839; gDNA_ID_2213667; Annot_ID_182140
aaatatatataaaaaggaaaaaaaattgtatcaaataatttaatagttttgttatgttaaattagataaaatgttatttattatgtattttttattgatatatatatatatatatatttagccaaataaattaatggtgtaatgatcacttgttatatctgttttttttaatagaacgtatttatcagttttttcgtagaccgtatcattccctcatccatctatcataattttacaatatttttcttatcagcaagtgtaatttgtaacatgaaaataaatgaatgaatatggcaaaatttattacaaaattaaaattattacgaatctcaatatataattacaagatacaacaaaaaagaaagaaaaaacaatgggcaaaaaacgatactagttttgccatttatgtcctcatctctcttagctgttatgcatcaatcggtgggtcatgcacctatacgttctctctctatctcactcaatatatatacacgaaccttcctcgttatttcctcccaagaacatctctcaaacattcctctcttcttcttccaatattttgatccccacacacactcacatcaacacatataaatctcctcgtaaaccctaaaccctagctagtttcaacaactctcttgttccaaccccaagaaaaaagttcaatttcgttagcaatggccaaagttgggaagctgacaaagcttaagtcggctatgaagaaatggccttctttcgccaagaaccaccaccactcaacctcctcagccgctgtttccgacgaactctcagaagacaacaatctccatgtggtttacgttggtcaaactcgaagaccttacatgcttagaccagacatcatctctcacccactctttcaagaactcgtggatcggtcttcttctagatccatcgaacaagatcgtgagattgttgtagcttgtgaagtcgttttgttcgagcacttgctgtggatgctcaagtctggtcaagaaggaggatccgttgaagaattggctgagttctatacttattgacatcgaccgattgattttatacatttatttcgtataatatataccttttttgttgttgtttgttgttgctgatttgtattttcattcgatgcggtgtgtgatcaaaacgtgatctcgtaaaccatgtcatttgcttccgtttttctgagcaattttatgatgatgatgagcatatgtagttttcttactttgttaagaccaaccaagaataaatttctactaacaacaatctttatatatattttccttcaaaatgtatttcagtacctatattaattgtaatatacataaaaaaagaatgcaatgatttcaagaaaacaaactaagttttctggtaggttttgtttctatatttattttattatggcggttttgtaaacttttgtttctattttcgtaacgtatctttctcatatgagtcatgagtctcatgacataataaagaaggcctttgatgatgttcgataaacaaaagttggttgaatatgatgagtccaattcatttattttgctttatataaacaaaatatgactagcaatgatttctatcatcgatattcatttttttttttttttgcgtatcatttgtatggtgtcagtttcaaatctatttttgtgtgtgtataaaatagaaaatacgtatgcaatttcttttaaggaaataataatggtcgctctcatgacgcgttggtgacctggtcccaatttcatgtccctactctcctttctagttgcagacattatatatttatcttttaatattcttgaactttcagccatacaaaataaattaaagcttacaggttaattagtcgatatactaataaatttgtagtttgttgtactaattggcattacttacaccaacatatgtgcattaatatacgtttatagacataaattggtagataaaataactgacattaattttccgaggtgggtacgaaaaggacgcgcagaataattattgaagataagtataattagtaagaccaaaataaattaatttcctacgtaggacgaagttctaatcattataatcaaagaaaagaagtttctttgctaagtttaattaagcttgttaattgattccgacacgctaatgattgacaagtcactcggtgtgtcttttcagcaaacttcatgggacttcttcttctacttctgtcttgttccttacattacatcaatcctatgatattatagtgtttatataaactcggttggtagctaaattgttatgggttgctgcttgttttaacgttgattatagaagaaattaataattacatttgattcgaactcaggttagttactagaagaaattgtaacgaccaaaagacagtgttgggccttagtgggccgtgcaaagagatgggagttatgaaacgacaccgtttagttttaacttagtgtcaaacactctaacctgaacagaaggtctcaacaataagagggggactagcaagaagactctcaagggaaggacaacttcatgaaagctcaggtgaagtgaaaccaaactcatcctttgtcttgacgatttgatttctcttgtttttgtttgtgcaattccctatggattcttctttggtcgttggtcttttttgtttttgtctgtgggtcgatgtgattttatcaattcttgtctttcaagtgtttgttgaaatgcctcaatgggaaaatgtaaggtttttcagggaatccattaatgggttctgctcaacccaaggattcaagtaaccctataacttcagctccgaatagggctgcagtaaaattgcttaagtctctcttcattgggttatgcgttgtgctagagtttccaaagagatgatctttcatttctcttttgcaacctcttgttatcaatctatgggatattaaggttattctccattttcattccggaaagaaattaaccagttagtgttgttcccattgatccagcaacttcagaactatg

SEQ ID NO: 27580 - DNA, 3000 bp, Unknown; identical to SEQ ID NO: 1800
  misc_feature (1)..( 3000): 2750-1469P.txt file - cDNA_ID_2990847; gDNA_ID_1620450; Annot_ID_157443

SEQ ID NO: 27581 - DNA, 3000 bp, Unknown; identical to SEQ ID NO: 9176
  misc_feature (1)..( 3000): 2750-1469P.txt file - cDNA_ID_2990851; gDNA_ID_1972017; Annot_ID_177968

SEQ ID NO: 27582 - DNA, 3003 bp, Unknown
  misc_feature (1)..( 3003): 2750-1469P.txt file - cDNA_ID_2990855; gDNA_ID_1972022; Annot_ID_178107
tcctgtagaaaatctgtggacaagaaaattaaagaagaaatgaaatcatcagattcactatacataactctagagaaagaatgtaatgaatatactacaacatgtattgtgtacatatagggttcactggtcttgacgttttcagcattttaaagaataaaacataaacacatgcatacaatgcagtgcttggttctgaagttttaggttactgaccaagttcctgggaaattgactttacgaattcataaactagccaatcaaatctgtattctggaaatatctgcgaagtggaagagaaaaaagaactctaagaaacaatagacggctgcatataatatgcagcctataactatatgaatcagagatgcacaaacagttcatgtaattgcatcattgatctcaactaacactccacagcaacacaggcttaggtcacaatcaccggcaaaactaatgaaattagaaagaagtaaaacaatgaagtcctcataatctaacaatgcatttcgcaaggcagcataaactactgcagcacactggaaatattatccgcaccagcagttccctgccagtacttttaataaaagacgaaactccaaatttaaagcctcaaatatttaatcaaaaaatcatatttccatcaaattcctagatcagttagatatatgatgtcacacgtctgtttcttcgtttcatattttatgaacagcttgtaagaaaacatattttgtttcaatctaacttcatgttctggtacagatataaagcaacaagaaaatgcaggcacctttgcgactgattttgaaaggaatgacattatcattgtatctaacatcatgttctgcttcaatccagggtattgcacctattttaacaccaaaaatgaaaacttggtgattcttgaagttgttgcagaaagaacataggaaattaaaacagttattgttatgaggagttaacctttactgctacttcctggtggttcttcaatacagcatgatgtacttgagcaatagatgctgccgcaattggttcctcatcaaaagataaatatctgacattttaactaatagcaatgtcaaaacctcttccaaaaacagacgtcaaaaaacaaatctgacatttaactctaaaagacttacatctctgtgagattttgacccaagttacttgtcagaacttgctttatttcttgaaagttacaaggaactgcctacaagataaacaaattaggaatagaacaaacaatccgaaaatgtttacagactcaactataacagtattcttaccttgtcctgcaacgaggaaagagccaacgagtactctttcggaacgagcttcaacgtagccacaaactgaccagctttcacatagaaacctttattactttcacacagtttaagaattcgtttagcagaccgtgaatgaacctacacaatcaaaacgaccaaatgttaccatatcacatagtactagtgaagtatactgcaaactttaaacaagcaatcgtatcactactctaataacttgccttcaccaatgacgaataagccgattagaatgtaattcaaactacaagaaaatcggcctaatgccattgataactacaattccatgaaaccaaaacttaaacacgaatgtaagatatgtaattgtacacctctgttaatctctgaagatactcatcggaatctgctggtaatctacgcaaagtatacttgtaatcagcgacagtgagagtgatctacaagtagagaataagagattcaatgaatgaattggaatgaggaaatggtgaaatcaatagagagataaggaagatacgaacggagtagatagcgcgagaagaacggacgacgccttctacagccgtcgctattttattggaaggtgagtctcggaagatggacacggcggtggcgctgccagtgacggcggttagagctaggccggcggtgactgtgaaagcaaagatcggagacttggatctcccgagaattttgaatttgcggagaatctccatttttgtggattctttgggtttcgtattatttttttcgtagtaacgaagaagaggacggagaagctacacattttctaacttacttgcaagtcgggtcggatcggattgatggacaatctaatgggccaggatccggttagactaatcgatgtgattttaatgggctaagtaagctgggcttggcaaatagccaaatataaaaggttaatttagtcaaaaaaatctctcaatttaaaattaactgacgtaaatcccccttcagtatcaatactgtaaaaattggatagacacagtaaaacgcagtgttttacagaatctcttttaatcgatttgacatcacacaaacttcagagaatctcattttgataaattaaagttttttttccactttgtgaattttaaagcctaggtaaattagtgcatatatgtaatttaagtgtacatactgtatctctctgcaacgaatacaaccttcttttttacccactaccacctgttttcgctaggcttgctggactcaaataatgtatttttatacggcaaaattattcattaaatttcaactttacgttatatacaacattttttacaaaaaattactaacatatatggaacctcaaacctcttaatgtagaaatattaataaatttttatttaaccattggactaaggagcttccacaatctactctaatctaataaagtgtatatctcatgggtatcaattttttttttcaataggtaagaaatcaaatcgttctacatatctttacgatcttgtgatattttacgagcgaatatcgtcgacataatataaaactcacaaaaaataaaataataatgatactccatataaaggaaaaagacagcaaatatgtagggtcaatataaacgcagcctcgtcgtctcttcatatattcgtctctttgtgttcttcttcctcctcagattctctttcactaaacagaaacaaagatg

SEQ ID NO: 27583 - DNA, 3000 bp, Unknown; identical to SEQ ID NO: 10969
  misc_feature (1)..( 3000): 2750-1469P.txt file - cDNA_ID_2990859; gDNA_ID_2214468; Annot_ID_182928

SEQ ID NO: 27584 - DNA, 3003 bp, Unknown
  misc_feature (1)..( 3003): 2750-1469P.txt file - cDNA_ID_2990859; gDNA_ID_1972067; Annot_ID_178391
cgaagtagagaaaagtcatatcagcatgcctataggggagaaaccacttactccatctgaagccatgccatctacatcatatatttctaatggtgacgcctctcagggtacttctaatgggtctctggaaactgaaagaaacaagtttgttgctttccccattgaagctgttcagcaaagtaatatggcctctgagccaacttcaaagttcatccaagggactgagaaatcgagtatttcttctggcaagccaacctcagaagagaaacgtatccctctggaagagcctaaaaaacctgctgctgtatttcccaatatctccttttcaccgcctgccacgggcttattaaatcaaaacagtggtgcatctgcagacatcaagttagaaaagactagcaggttggtggcatgatatttttcctctcagcttgataggcttttatatcactacttgtgcctaagtgagcctcatccatattggttatgattttttttttctggtttactcgcttccgactctctttcttgatgttacagcactgcgtttggagtatcagaggcttgggcaaagccaactgaatcaaagaaaacgttcagcaacagtgcttctggagctgagtcatctacctcagctgcaccaaccctcaatggtagtatattctcagctggagcaaacgctgtcactccacctccgagtaatggctctcttacttcaagcccttccttcccaccttctatttcaaatataccttctgataattctgtgggtgatatgccgtccactgttcaatcttttgctgctactcacaattcctctagtatatttggaaagttgcctaccagtaacgacagcaactcacaatcaacttcagcatctcccctctcttccacatcacctttcaagtttgggcaacctgcagctccgttttctgcgccagcagtgtctgaatctagcggtcagatctcaaaggagactgaagtaaaaaacgccacatttggaaatacaagcactttcaagtttggaggtatggcttcagcagaccagagcactggcatcgtttttggtgctaaatctgcggaaaataaaagcagacctggttttgtgtttgggagctcctccgttgttggtggcagcacattaaacccttctactgctgcagcttcagcacctgagagctctggaagtttaatatttggtgtgacatcgtcctcaacccctgggacagagaccagcaaaatttctgcgagttctgcagctactaatactggaaatagtgtatttggcacttcctcttttgcatttacaagctctggtagtagcatggttggtggtgtatctgcaagtactggaagcagtgtttttggattcaatgctgtttcatcagcttctgctactagctctcaatctcaggcctcaaatctttttggtgctggaaatgctcagacgggtaatactgggagcggaaccacaacatcaactcaaagcatcccctttcagtttggttcatctccatcagctccttcatttggtttgtctgggaactcttctcttgcatcaaacagttctccatttggattttctaagtcggaacctgctgtatttacttctgtgtcaactcctcaattgagttcgacaaactcctctgcaagctctagtagtacaatgagctctcccctatttgggacaagctggcaagctcccaactcttctccaaactctggtccagtcttcagttcctcgttcaccacatcttcaactcctaccaccttttcctttggaggatcttctgctgctactgtttcgagcactactactcccatttttggtgcatctaccaacaacaccccgtcaccttcacctatctttggtttcgggtcaacccctcctaccactccccagcagccggtatttggtaactcagggactccatcacagtctctgtttggtaactcaactcctgggtttgcatttggtgcacctaataatggaaatggtatcaacaataaccaacaagtgagcatggaagacagtatggcagaagacacagaccaagctaatagagcatctatggtagccccaatgtttggacaagcagcagtctcgatgcctcaaccaaactttgccttcggtggaggagcagcaacgcagcctccatcaatggcaaaccccttccagtttggaggccaaccaatggcaagcacgttacagaacgcatcacctttccaggcatcacagagtctagagttccaaggaggtgggagcttttcactaggcagcactggaggtggcgataagtcaggccgcagaatcttcaaagcaaagaaatccaccaggaagaaataagaaaaacacattgttcaagagtcattttatcagccttatggtctttttgttcgctatatactccgggaaccttggggattacgagcatatcgtcgtttaatgaaagaggtaaagtatgagaatgtgtatcgtttatgctcttgatcgtctctgtcattttagtatgagtcaggattttgggggtcaaattgttcagggttataaaagttgtaggaaagttttgtaattttcagaaagtactggtgtctgtaagagtaatatagctctgtgcctctgtctttcgcttctttttctttttgtccttataaaaaaacacactttattgtagctgtttgttaaactcttttctctcttcagttctggttttagtggtttaaattaataattgcctcattacaacttggtttacccaaatcaaatcgaaccaaaccaaaattgaataaatccaattcgatgatcttcaaggaagcttcttttagttgaccaattccattaaatccaatccaattcgatcaagtaaataaacaaattctcaatccttttattagagaagccttcttctccaaagtctcgatttctctttattcttccaaattcttttgtctctctgtatcatccaaaattcccagatttattcacggagttagaagaagaagatg

SEQ ID NO: 27585 - DNA, 3003 bp, Unknown; identical to SEQ ID NO: 26279
  misc_feature (1)..( 3003): 2750-1469P.txt file - cDNA_ID_2990871; gDNA_ID_2214553; Annot_ID_185632

SEQ ID NO: 27586 - DNA, 3003 bp, Unknown
  misc_feature (1)..( 3003): 2750-1469P.txt file - cDNA_ID_2990875; gDNA_ID_1620571; Annot_ID_160848
taattaccattacattaagagattttattgtctataggcttatgtataattaataaaaagagtataagaaaaagtggtaaacaaatacatcacatacaaagacagcaagcatactattactattatttaattatatatttgtatactgttattaattctaagttatctttcataaaataattttattataacttattttaagtaatttaatatttaaatcactacgatgtcaccaaatgaattattttaatttctttgtcactaatgctattttaattttctggtcaattatttttaagcccatttttacctttttaaccttctcactaattttgccactaaaagtttattattggctaatgtaacccattgaatatatattcttttgacaaaaaatattttaggtagtatggttttaaaatatgacttttagaagattataaatgttaaattctatttatttaactcttaaaaatcaattcattttctttagtgaaaaataaaggcatctttgaaatcaaaatcccaacattattactttaagaggggtattcaataattgattttaacagaatgaaatggaacgagaaaagttttattataatgattatttctctcccaatttgtgaattagaaaacttttgttttctatttaatataaattataaatattaaaaactccacaaatcctaaactcattgaactaaaaaaagccccaaatcctaactagatcagccaggtgaaatctactacatgccatggagcacatcatatacaagcttttgtcccaaaggagacatatattggcagaatctagagagtactttcaattcctaatcttttgaaaattttgccattctttcggcaagtttgtaatccgtgttgtacacctcgaactcaactcgtatatgaccttgaggttcctcggtctccatatcacccctctatggagtgcctattgttgtagtcgtccttctttatgaagagaacaatatgttttctaccctccttagtccttatccaccttggtctccggttttccaaccgagaaccccccctcattactcctaacctgttttattatctttcgcgtaagaagtaatgtatctcacatgccagtgaaaattgaggtttcgactcatcatcttctcgtttgtggcaatgtatctaatcgctagtgtttttgtcatgaggaatttgatattatttgtgttttaaaggtctttttgtgcctcattacccatgaatatgtattatcatggaaaatatcaatgacgaaagaacttggatcttcttcccattttaattgtgcacatactctaaaattttcatttgatatataatataacattgatattttctcatttatctgtattaagtcttgaagttaatctcttatggatatagagatgctacatcattacgcgattactaggtttctgtattattaaatagaggttgtctgttgtcttttccactatatagtttaacaaattggtgaattgaagcgtccaacatgttcacaaaaaccattggaggcctagtttgcttagcatttgtataagagggactttttaattggttagttatcatcactagactaaattagacggttggatcaaaggttgagtaattgacattacgattgtacctatttttgatgcattagtattatgttgcatcaccgatattatatttctagttgttggagttctatctagtgactacatcaaattgatgtacactcaatatctatctagtaccaccgtgcatatgtccctaatgatagagaagcgttcaaagttgtcagggaaacattttcactcttatagaagtctaactagttttaagtcgtgctagtctttcttccttatatttcatataaataggtcagtggtgcttgtcgttaaatatacaacattgtctgaaaatatattacctcctacatggacatttctagtatctcctacacaagtataatctcatatagttacaacacaactatttgagcaaatgtttactattttggattcatatagttcttaaaaccaacatgcataatattctttattaataaataaccttcaaataacacaactttaatttacagtcaattagaagtgttgatgattgatttttagagattagacattcaggtatcaaattcaaacacctctctaactgatccaaatgatcaaatttaagctaaaattgtagctactgatcagaaaaatagaagcaacatttgttgaatagaaaaaaatagaagcaacatctgttttaaaaaacacattgcttcaaaataataggaaagtacaaaatattagatttaactaaagatattttaaattaattaaaaaagatatttggattatatgataataaatccaataaaaaataataaaatccagaatacagaaaaaaattgcaagaggggaagcagaagaagaaagaacaaaaatcaggagttggcattttgaagacgaaactcatcatcatcttcttcctcagacaacaaaaaaagcttttcactttctctccacccttctctctctccttctgaaagtctctctctttgccgtcgttagcctcttcctacacttggggctgcgattcttccaatcctccgatttcaatttcatcctctcaatcatagtttgaaatcatcgagcttttacggtgctgttggtgtttgacgccgtaaaattcgatccttttttatacatttgatgttgattttatcgatagttttgtgagatcgattttttagggtttcgagtttggcgctgacttgagggtttgattggatgagaataaggggttatgggacttgagtcaattgggtttgtctccctaatcatcgcaaattcctgatttctcagctctttggaaggaattaggattcgttgatttcgagttttgtgttgtgttggttgatgagagagttgggtttggtcaattgaggggtttaggtgttgttttactgttttgattctgatcatg

SEQ ID NO: 27587 - DNA, 14 bp, Unknown
  misc_feature (1)..( 14): 2750-1469P.txt file - cDNA_ID_2990879; gDNA_ID_1563705; Annot_ID_148157
attgaaggcacatg

SEQ ID NO: 27588 - DNA, 3003 bp, Unknown; identical to SEQ ID NO: 22432
  misc_feature (1)..( 3003): 2750-1469P.txt file - cDNA_ID_2990883; gDNA_ID_1620748; Annot_ID_166721

SEQ ID NO: 27589 - DNA, 3003 bp, Unknown
  misc_feature (1)..( 3003): 2750-1469P.txt file - cDNA_ID_2990891; gDNA_ID_1620383; Annot_ID_155379
atcgaagatggtaacaccgttcagattacaaatagtttttggtggttcatatttagttgtaaatctcttattaacatgaagcattgcctctctttttttttttggtaaaagatgaacttgtgtttgagattttatgtaaataaagtatccaagtatattcatataaatcaccaacttttgattcaaagcataatgtgtgtgtatacagtttttattgtttcacatgtctaaaagcatgcctttccatagtttaatcataaagttttataagccagcaataagaatacttttggatcttgtgattcgtgtatcatatgattaccaaactcaagatgccaaaaaaggttggtaaacaagtattttattgatccaataatttgttatactaatacacatacgatttagttcaataattcctaaagaaaagtttttttgtttgtttttcatttggattgttaaagtattcaattctttatgtcgtacaacaagtaaatagaaagaaaaaaatagagtgcgagtttcactttcaataaatgcttgtgtgattatctttatttgtgtacatactagatctacatccaccgacaaaccagtgtcgaggaagcatatgcaactgtcctgcagatttaaagtctcatgtaattaaatgttgttcaatttgtttgttgtgtgattaccagtttgatgtatagttaaagttaccaagtaataaaatcatcaaacatacatatagtactaattttttgtttatcacataaacattttgttgactttttggtgttgtttgcaatagcatcttcttgataaattcctagtgaactcaaaattgacctacaccagttccatacaaatagaaagatactccaaaactagttgtggaagtggttgaatataattttatattccaaacttagaaaattcatgttaaattccgcaaaagagcttataacgtagtttatgcacgatatggttaaacttcctcagttgctatagagttaaaaaaaaacaaatattttgaaattggtaactagtacgtgaaattttttaatgcagactgaaagaacaaaataaaacttaaaatatgtttacaaaaaaatattctttcatgatttacgcaaaccaaaagttacatttaaggttaggaaagaaaaaatgacctaggaaattaaaacaatgaggttcgttgataaaggtcaagaatcaaagtttggtagccaaattaccagcaaacaaaaaaagattaagaccattaatccatcgcgtatactcattgtcttatgaatcttaaacaataatattatattatatacagtaggtccataatttatgtttctttacctactctatttaccaaaaacatacatagtttttatctgacttacacaagtgtactaatggccagacaagattgttacttgttcaagtaaaattgtgttaccagatattcaactttctatatatacatatagatttgacaactattcgactttctatatttaactgaaagagttgtatcactgaaatttggagtattgttccctgtaaataattcgatttgtttccaaaacgctatggaacaggccttgattttgatactctttcgtgctgacacttgaaacggcgtcgtatcaataatagaagaaaaccttactgtggaaataatcaaattgtgaatctccaccaacctcaatgggtcccattgccacccactaatctccccacgtacaccaactccccttcacgttttaatctcttaatatacttttattataagttaattaaatgatttcaaccttagtaatactaaccattaattattcatttctaatctccaatattttttttgaaaaacctttctgttcagatattttcgtcaattaatcaagatctcattcataaattaaaaaaaaaaacaaaattcaagctaaaaatacatacccaacaaaaattccttaaaaaaattacttatggggcatctggtaatttaattttcctataaaagatggcaatattaattcagtttttttttttaatttaccaatatgatactttaattatatttcttacttgttagctctactaatgcacacatacttatttctacgaatataagaaaaaaatactgaactcaaacaatagacaaaaaagaaataatcctacactcaagtgtgttgaaaaataacatcaaattcagagaaaatgcacatacaccaataatataaataaatagggatatttaaaataataaataaaattgcgaaaatatcgagcaccaccagatctacagaaatgacacagagcccaacgatgatgtatctcgtttattttcgctataaataaactcacacagcccactcttcttcctcgctctctctttcgccttctcttagcctaccctttttccttcctcctctccgattcttcctccgtcaggttcgtctccgactttctatgtcttccttacgtctctcttatttagctccctttccttccttctccacgttattattactacttcgcttttagtgtgattcgtttcattctcgtttttttatattcctcgatctgtttgctcatttgttgagatctattcgctatgtgagttcatttgactcagatctggatatttcgtgttgttcgatttatagatctggtttctggatctgtttacgatctatcgtcatctttcctttgaaaatgattggtgtttctgtgttcgtattcgtttagatctaaagtttttgatcgatgaatgtcgcatgtgtttttatctgaaagttttcgattacagtatcaagtggtggtagtagtagtagtagactcaaaaagctgcacaaactttttatacacgtgaattgtgattgctttacggttttcttggagtttgttaattaaatcatttaatattaagaagtttatgaattaagagaacgttattttatactatgattttgattttgatttggtttgtgtgttttaatgcagtaaaagaaaatcaaaatg

SEQ ID NO: 27590 - DNA, 3000 bp, Unknown; identical to SEQ ID NO: 14459
  misc_feature (1)..( 3000): 2750-1469P.txt file - cDNA_ID_2990899; gDNA_ID_2684120; Annot_ID_190932

SEQ ID NO: 27591 - DNA, 3000 bp, Unknown; identical to SEQ ID NO: 13917
  misc_feature (1)..( 3000): 2750-1469P.txt file - cDNA_ID_2990903; gDNA_ID_2214670; Annot_ID_189100

SEQ ID NO: 27592 - DNA, 3000 bp, Unknown; identical to SEQ ID NO: 10011
  misc_feature (1)..( 3000): 2750-1469P.txt file - cDNA_ID_2990908; gDNA_ID_2213359; Annot_ID_180730

SEQ ID NO: 27593 - DNA, 3003 bp, Unknown
  misc_feature (1)..( 3003): 2750-1469P.txt file - cDNA_ID_2990916; gDNA_ID_1620813; Annot_ID_169145
tacacggtacacataaaacagagcattaagcacaaaacgtgtatttgagtggtttctttagccacaagttttttttgttatttgcaggaagaaaagctttggattgggcgtcgagatatagaatcgcagtaggagcggctagagggatttcgtaccttcaccatgattgcattcctcacattatccatagagacatcaaatctagcaacatacttcttgatcacaacatggaagctagggtttctgatttcggtttagccactttgatggagccagacaagactcatgtttcgacttttgtggctggaacattcggatatttagctcctggttggtacacaactgatagattcaaatatataaaccaaaatttggattgcatttcgattttgttcatgtttgtttttgttataaacagagtatttcgatactggaaaagcgacaatgaaaggagatgtttacagtttcggagttgttctgttggagcttttaactggaagaaaaccaacagatgacgagtttttcgaagaaggaacaaagcttgttacttgggtataaagttatctatctattttccttgtataagttattaatcttgtttggtttcaagcgacgtcgttgtggtgtgtaattgtatacaggttaaaggagtggtaagagaccaaagagaagaggtggtgatagataaccgattaagaggatcatcggttcaagagaatgaagagatgaacgatgtgtttggtatagcgatgatgtgtcttgaacccgaaccagcaattagaccagccatgactgaggttgtcaaattgctcgaatacatcaaactttccacacgttcctctttttgatgtttctcttgtcaagaaaaataatcaaattcagttccaaaataaagttttgctgaagaaaaagatttcgagatctgcttctttgaaaagctaaattgtaatttaatactccatattagtatagtaaagattatttataattgatttgttttagtatggaataaaggattattacacacaaaaaagccttatatcaactattcttttttaagattctcgtacaaagtgggcattggatctttaatttttccctaatttacagctcagctcacgttttgatgtcttgttatttgatcccaaatgttctcactactacattaaaccttttgaagcaattagcaaccttttttttttgttacttagcaaaaccaaaccaaacattacgtttatataacgacacttttgctaaaacggttacttttcctagaagcaatttgctggattattcacctcaaaatcctaaaaacattaattagcattagatatctaaaaaaagtgaaatacaaatctttgtttctttttaaattgttttattttataaaattgattcacttgctcatcatttatatacaccaaagagtgtagaagagttctctcactcaaacaaaaatcaaacaatggctaaagcatggatctgcctttccttcctcatcttcctctaccttgtctcaggtatataaattaccagtttaccactaatcagccatcctagtttaattaatttaataatcctaattaacagtatcatcctcatgttctttccttttaacagaacgaaacttcatcaacgtcaacgcagaggtatttgcttagaccaactatcaaattgctatctgatttttttttcttactcaatgagtttttgttctaagttgttgttatagaccaagacttggtgtgtggctaaaccttcttccgatcaagtagcacttcaagataacataaacttcgcatgttctcatgttgattgtcgtgttcttttgagtggatgtccatgttactcccctagtaacctcatcaaccatgcatctatcgccatgaatctttattaccaagccaatggaagaaactattggaactgcaatttcaagaactccggactcattaccataactaatccgagtgagtttgctctttctctttaattatgctatcgaaaaacacttctctatctatatatagagagaagtggttttaaaggtaatttcatttttacctttaagtatctggttaattatattaaaggtaatttcattttttctatatgtgtaggctatggaaactgctactatgaataaacatgagcaagaaaggaaaaaaaaaaaccatatttcttacaagcaaacagaagaggaatgtgttttcttgttgttgcaatgtttatgagttataatttaaatttccaaagttcgcagattttgattaatcaaatttgataacataaaagcaaaaaagaaagtatccaacacttatcaaaatttgatcacaattattccatctcattttcagtaatgacccttattacgtactgaccgtaaacatagaacttaccgtaattaagcttttaaaattgaattcttcaccacatgaacatttggaaatatgtagaacaacgtaacgttttcttttcttttttctttggtgtcagaaactaacgcatttctaaagattttttttttttataaaggtaacgtatttcgatatactcgaatgttagtatgttaaaccattggataaatgacacgtggtgaaatcttagcctcaagattagataagcgtagactaatcaatcgtttccctcttctccttggtattgaacaaaaacacagtcgtcactttcgtgcctcccgaatgatctcatgtgggcttgtctcgtccacccaacaaactatagaaaaaaaactcgatcggctgatacttaatcacccacttgattttgtatttttgtacctttttttgttgtaatttttccatacacccaatttcccgtggaagaaaaggagtcagctttttcgtttgctttaaagcttgaatctttacatagttccagttactttctatagagcttcataatccctagttgcccaaaaggattctgggttttgtgagaatgatgacgtcatgtcggaatatagatttaggtacgatgatgatg

SEQ ID NO: 27594 - DNA, 3000 bp, Unknown; identical to SEQ ID NO: 10594
  misc_feature (1)..( 3000): 2750-1469P.txt file - cDNA_ID_2990920; gDNA_ID_2213664; Annot_ID_182018

SEQ ID NO: 27595 - DNA, 3000 bp, Unknown; identical to SEQ ID NO: 4034
  misc_feature (1)..( 3000): 2750-1469P.txt file - cDNA_ID_2990924; gDNA_ID_1620680; Annot_ID_164402

SEQ ID NO: 27596 - DNA, 3000 bp, Unknown
  misc_feature (1)..( 3000): 2750-1469P.txt file - cDNA_ID_2990940; gDNA_ID_2926240; Annot_ID_204062
tgtttaaatagaactccggaggattcattttctttggcagaatcggcccaaggcttagaagctgactggaggactgaagcaatggcacttgaatggtttagtcagaacttaagagagcataacaatccccaccctgcaaagttagaagaggaagagcctcaggttgatcacccactagaaaaacctggacaaaccaaatttcgacaaaccttgcgagacaataactcatataatcagaatcagaaagctggaaagcttaaaagagacgaggatacgcttgttattggcattgacagaagcatggttagtacttcaatggcttatttttctcttctctctctcacgcgttaatcatgagactcaatttgtgtttgattacagttgaggaaagtatctgaagggaacaggacacacgttggagctcgagtggacgagaatgattcactactagagatcatacggagcaaggtcaaatcaccatttcatcttttccttttcactttattcagttttctattatagaacatttaacttgaaaaaaactttagcagtcgttcaacctgagaccagcagatgcctcagggagaccaaactttcaagtagctgttcccaaaaccaacttgaaggtggctgcaattctagagaaagccaacactcttcgccaggtctctccctctctccttcttggttaaatttggacacttgatataataatctgttgcacaaagaaaaagatataataatcttggggatcgataaagtggttttgtgacatacatataaataggcaatggcgggaagtgacgacgagcacgattcagatagctggagcgagtgagtcgttgaatcaaatctgcaggtaacaaacatatagatcacactctgtatagaagaattctcacattgtatgtattctcacaagtaatgtttttattgctgtatttttgacacattgtaagtcactctgtttttttcccctttatatgtacacccaattttaccctcttttaaagggaatcaatccagttgatgtttcagcatatttgcatgtttgatcttttcacataaacaaatactttacataagtaaaagtaagtgttataggacttgtaatttacatcaagatacattttaaattcaaccttcatcagtgcatatgcacaaatcaacaagtatgataaatactgatagtagatgaaaaacgatgttggagagcaaagtatttttaaaagtcaagaaacgctaagtttttgttatgacttctctgatttgttcaaactttttgaaatttgaagtgtgaactggaatgctactagtcgtcgttggaatatttagccacgtagtgtatgtctgagtctccttgaacaatcgtttccaagttgaaaaaagaaaagaagtgataataaaaagtcaagtctaagagttgaattgtcatcaaagtacgattagtggaagtggtacggtatacgtgtaaacgatcctaggaatattccgtacgatatccggcctaacacggtcaagagtcataacgtctcgtgaattctgtacttttttgtgcctggtagagttgacacgtctcttactatgacgacgttctgtttcgcaaagggtagtttggtcatttcaaaaaaatagccgtagtttggagtcgtccaaatcccaccgtcgccggctatactcgttatcctaattatatacgctctctgttttctaattggtgaaaaaagctttgtttaaactctttttttttataggagttcaattgtagttgcgctggagatgagtcggattcaattttgaaaggattttggcattgaagtttctataaaactccttgtttgaacttggaaattcactaaatctgttgaccaaaaaaagattattagcaaatgttttaggtgtttggcatataacttttctctaactttaagactaatatttaatcatgacgtaacttgattcaaatttggatttacagctaaaagaaataacacatctcatgagtcctcctttttagctgatttctattgctgttgtagaaccccatgataactcaggtttcctcttacacgtctgtttcaatatcaattttgttttagactaaaccatcttcttctttctttcctttttctctttcctgtccacgttagtttccagaatttggtatttgtagtatgtgttgaaaaatggtttgttttggagaaacggccagaaatattctagaaattcacagccttgttttcttatttgatgataacacgtattataacgctataagacacatgtatgcgtgacagaaagattattaaatatgaaattgtgcgtactgatatatatcatgccccttataataaaacttataaagaattggatcgttacctagaatagttttaggttattataagtacggtcacacaccttggagtttgaaataatatttcccagtctacatttactgttttgtctttgctgcgcactctcgttgtccattcaataatatttttgttggtttgtcaacttgtccatacaataattattttatctgacttttaactccttttcttttcttttctttttcatatgtataattaagctaaaaaatataatcaaaaattaggtcgggacaaaagaaaaggcacttactggttttttacaattatgtggttgtgacataatacacacagaaaactaataaaacgtgaaaaagaaaagttttagatatggaatatatcattggcaatggagaatcactagttttttttaaaaaaagttgggagacaagaataagattacacatttgatgaaaaagaacatatatctcccgaatattttcttggtcggcttgtctaattttttttttttttttatttacatgatatcaagtatatgttttgtgaagacgtcaaaagagtatttgtaaagattagatggtgttggaaaataagtaaaataatttagccgattattaaaggttaagaatataataattaaagtagaatg

SEQ ID NO: 27597 - DNA, 3003 bp, Unknown
  misc_feature (1)..( 3003): 2750-1469P.txt file - cDNA_ID_2990944; gDNA_ID_1620477; Annot_ID_158196
aaaaacgaacaaaagtaagtaccaagctagaagcagaggaggctatagaggtaacggcgagagatggtccaccgcgagaggaggaaggagttagggttttggagcagacaccttgccggacgtgccatattccgaccttctccaacgccggagcaagcacatacttccccgtcgaatcgtaagctatgttcgaatctacagatgaaatcacaccgaaagaggtcgctgcatcgtatctttggtaagccttcaccattctccaaaagctttggttttgattttctcttcttcttcttcttctagcttttgatggcgggatttagggttttagagtggttaaggcagcagggttctaacatccaatgttacttttgataaattgcgatatagtcttaaaccttttgtctattcaatatttaacccctaactttatttcaatagatttgaagcccttactcttcggacccaaacttttgttttctcaatttgcaactatgttgtgtaatcattggtactaagaacgaaacagaacaaacaaaaagaaaaatggctcacgacatccatgaccaatattagtaattttttatcattttcttaaaaatcaatgtataataattgaatgattatcatctaaagaaaatcaagaacgtacactttttatcttattcatactctaggcttacctttttaacatccacattaattttttttattttttttgttaaagggcccatccacattaatttttcctagctaatttctttcaaaataaaaggatatatagaaatatttgtgtgtatatacattagttcatataagtgtctcttaagtttcaactccttaacatctagtgatttcaataatgctgattcactcactatgagcataaaaagagatatgttattacttttgagtttatcaacaaacatatggaaaaaataccaaaaaacaaacacacaacatatgatcagcattcaaatacataaataaaaataacaaaaaaaaagatcacaattataaaactttcgtatttaccattccacgaataaacacatgccattacattttaatgttttatgcatataaatagtataaaatcatatactatcatttcatctcggaagcatcatcctcactgtggtccgagggattcccaattccgtgacgtctactagggaacaccgtgaaaacagcaccggagataactccgatcaccggaggcaaaaccatgagaaagatcttcccagcggagccaaagccaggatagaaacaattcacggtgtttgcatccaacaaggaaataacactgaacacgataagagagaagaaagcgtgaacgaaatctccaactctaagccttttcgaagacaaatccactgaagatgaatctggccaaagacccttcacggtggcaactccataatgaacgtaaccgtctcttgttcggtaactatcggtgaagcaagtgaagcaacaagagaaggcacaaataacgatgagaactccggttaagtatttgttgatgaggaggcaatgtccattgttggttaggacagggtttaaaaattggaacaagaagacggttccggtcgggaggagcttgatgaggtctcctacgcctgaatatgtccggtctcttatggctttgaatgttttcgacatttttttgttcttcttttgtaaattatatttttagttgtcgtttatagtgttcttgaatgtgaattcataaaagtgttgtttgtcgagtgtttataggatgagagagagacattgcttctacgtaaaaacgggtttggtgttgcttatactctttagaaaaagttgggggaaaatttaattataacttttttatttgtttaggttaccctttttagtattttaggcttgtactagaaaacgtggcttggaggattagattcgttatgtttctctttgtattagatacatagaagtgtgaagtcatttttaatgctccattccatttgttgtcacacatatcgtcatacggtcgttgaaagatctggtagtccaaaacgtatcgagtgtgaaacaatatgtttggcaagtagaccggaacatgtataaatttatttatatatttgaatcttgttaaaaacatttttgtgtatttagagactacacataggaaactactgatttatacatatggtttactcgacttaatagtttgttaaaaccggttaagtttatgaacgttttgtagaacctgtgaatactctgtttttaaataaaaataaataacataacatttctaaagtagtatgatagtatcacagccgtttcatttgtgtgaatgtcgcgaaaatcaatatgctctcggagtttcattggttgtcacacactatagattcagttcattcaaccttagtgatcatcatgatttgacgctcgtcttaattcatcttgatacatcgaattataattcgtcatattacattcgtacacaagtcaggtccagatggggtggacagagatgcgctggcttttgggtcattgtcttttcaaaaaactttcaatatagatgacacgaaaagcccaagagcccaaattggagttgcaacggggccgtccgtacactaaaaatctttgttcacgtgactgatcattgttttgctcttgtcggattagtaatctaacgtaattcattgtttgatcaggacttgcatttgtccaaaacaaaaaaaaaaagtcaaaagaagctaaaagatactgtgaacggaaaaaatggcagctttttagtgctaattgccagagagattcacatgtacccattgttcagaactgtgttacatactaaatggttcaaaagagaggtgattcgagcaagagacatgtgacctagtgaaaaaagcaaaataaagagaatataaaattgtgtggcaagacatgagtggccattcttcagcctgttttgatatgtgtgacttcatttgtcttcagaatagttatgacaccattctctttcgtcatccacaaatg

SEQ ID NO: 27598 - DNA, 3003 bp, Unknown
  misc_feature (1)..( 3003): 2750-1469P.txt file - cDNA_ID_2990948; gDNA_ID_2936573; Annot_ID_194837
tcattatttctttttcttaacagaaattatatatgtataattgattctgataattatacaagaatttggagattcagtgtggtctcatagcataataatgtctttttgcaccattcctctatggtgcagcaaaaacaccacataacgtttattgtgaaaagttttaagacacgtcgtactacaatctcttccaatataagttagaagattacacgactcatctaaattatgtggtttttactccatattgactagagtgagagtgatgaccacaccattcaccatatcctactctctataggtttttgttagctatgagagaaatagtttcggtcactatggcaaatttaatcccgacatgaatgaattatgatgttttggtgaaggacatttttgagaacaactaattgagtcttcatagataatacatgatccgagtttggatattggatgcacgagtttttgatgtagtcacctttgttatcactcattcttactcaagtactaggtaatttgtttttagtttttagtattagttactagttagaccattttattttgtgtggattgtatattactatatttgtatgtatcatttttgtgcttactatatcaaagaattgccatgattaccgcaactatacgaaacctttatctacttctgacttagaaacactagttacaatttggaaagaacgcaaacttatttagaaaaatgcactcacgccgcctaactttgacatacagtaaaacctctataaattaataatatttggaccaataaaatttattaatttagagaggtattaatttatcgataaataaataaaattgtacaaattttgtaaattcttacaaaaattcgatataaaatatagtttttttccctataatcaatagtatttctaaaaccaattacaagtagaaagcaattattaagtttgaaaaacaatacaattttttcgatattgtaaaatattagaattgaacactacaaagaattaacaaaaattgaagaaaaacattactagactcatattttacatatgatatttataatatatattgataaatttatataattattaatttatactattgatggaccatataattatataagattttcaaaaatattattatcttattaatttatcgatttttatcaatttttacattggtcccaacttgctcagaatctgtgctcattcttatgcattctaaagaacttgctcagactctctgctcattacagcaaaacttctataaattaatacttgaaaaatttattaatttttcaagtattaatttatagaagttttgctgtatatgtttggcttatgatgtgtaatttgtttgaaattggagggaaatgatgggactctgagcacagggtcaaaagagaaactttagaatgcataagaatgatttaagtattatttctaaacttgagggttctttttgaaaattacaaataaacggcaagccaaccctaattcgagtcccatttctgtgatcttgacctcttcctttctcactcaatttctgagctaaagttagggttttgccgagatttatcgtccttctgttaaactcttcggagaaagatgaaatctttcctcctctctagacaagcgatccaccgtatttcactattatcttcaaaaaccccaactttctgcagaaacttctccgccattacatccaccatttctcactctgatcgtcatctaagaagctacgacgaacaaaccccattccaaaatgtcgaaatccctagacccatttcatcattcaatcgatatttccactttactcgcgagtcccgactcagtgaatccagtgccgccattgacgactcaaatgaccaagaggaagatgacgaagatggaacaacaaacgagttcctctcacgattcgtttggataatgcgtgggaaagtctcagaagcttacccagattgtgacaagaagatgattgatggtatgcttctgcttattgttgagaaagtcgtggaagaaatcgaaagaggtggattcaataaagttggatcagctccaccttcaccgtcatcggagtttagcgatgatctatgggctactatctgggaagttagtaatacagtgttgaaagatatggagaaagagaggaagaaggagaagatgaagcaatacgttcaatctcctgaagtgatggagatgtgtaggtttgctggagagattggtattcgtggtgatttgcttagagaacttagatttaaatgggcaagagagaaaatggacgacgctgagttttatgagagtttggaacagcaacgtgatttggataattcgattagggaatctgaaactgtggatggagaagtagaagaagaagggtttgttccttctgatgaagttgaatctaggagtatctcccttcctaaacgaaaggggaagttgaagtacaagatctacgggcttgagttgtcggatccgaaatgggttgaaatggctgataaaattcatgaagctgaggaagaggctgattggagagagcctaaacctgtaactggaaagtgcaaattggttatggagaagcttgagtctttgcaggagggagatgatccttcagggttgcttgctgaatgggctgagttattggagcctaaccgtgtggattggattgctttaattaatcagttgcgagaaggaaacactcatgcatacttaaaggttagactttagtttcaatcattaaaatgacttccgctagattgttcttctgaaattcataatcaaatcaaactttgatgcatatttgtttgttgtattggcctacttctatagtgttggttcttgactgatttccccaattgttcgatttaagcttttttgctaattggattgctatggaggtcatttgatggggtggaagttctgtggtttgatttcgttacttcttttaatgggattcttgttgttgttttatttgttactctaggtagtttgttcaatcaagatg

SEQ ID NO: 27599 - DNA, 3000 bp, Unknown; identical to SEQ ID NO: 1318
  misc_feature (1)..( 3000): 2750-1469P.txt file - cDNA_ID_2990960; gDNA_ID_1620386; Annot_ID_155456

SEQ ID NO: 27600 - DNA, 3003 bp, Unknown
  misc_feature (1)..( 3003): 2750-1469P.txt file - cDNA_ID_2990967; gDNA_ID_1620481; Annot_ID_158331
gttaccttagtattatgaaagtaaagaatgctgtgaaaaagattttcgtctgattcagaattgaaaatgtcaaggaatcaagactcctgtatgagatctgcagcaaactgttctgcagtgcatatatggctgcaggaagtcctgatgctgtcaaggatcccatcaacgtccactcttttgctaatcccttcaaactaccatttcttgccatgagaatcagagcacatatgacctataaaaaagaacatacagcagaagcatgaaacagtatttcataaatgcaaaattttcgaaagtagaaaggaaaaaaaaagatccagtaccttaacaatctcgcacgtcaaaacagatgaagttacaataacatcctttctgcaaaaacaataatgcggtaaagtgaccaaaccatgatagagacaatctattaactgtttaagaagaaacaaacaaatggactagtgaacacaagtctactagttctaaatatccatggcattttgccgcaaaattaggcaaagtgactcgatatcgagtactagataacgcgaaaggttacacggtaccctacaaaaccaagatgaacaactaaaacactatgatgaaaagctatattcaaggcatcaatgtagcaaactagtagattcaaattcatctctctaacactttagaaaatggcttagtttaacagtgaccatgtctttttccacaggaacaacgagaatacatcacaatcgtcgcatataacttcgaaattgtaagtttacaacactattctcaaccacaattcgcagaaagccaacaaaacagatgcccagaaatcgaactccatctctactcgctacataagactaattacaaccaaatctcgcaattcccgataaaagcgcacgaaatcagcgaatatgaacaaggctatcactaacatcagagatttaagaggcataggttgttgcaagagaccgtacctgatgcagcgtttggagatcagaggctgggctccgtactgaagtgtgagcaatatggaataaaacaaaaccttagggcccatactcgacggactctttgctccgttagccgtcgccatgaatctccggccgtcgagaatccagaaaatccgccttcgctttgttctgatcttttggtcgagaattggtttgtgctttgaagaacgctttttcactttttctacattggacgtcgttttctcaagagatgaactacaaaacgccgtcgtatttgtttgacaagtgtaaaaacaataatccttgctaagtaaacactttttgggaaattttgcaagaatttatccatattaaatttgtcaaatctagattacaaaaaaaaaaaaaaaatccccaccaaattttgtaattataaatgtaaaaatattatgaagtattgatagttactacaatctagtagacattaaaaaatcataacaccaaagttaaaacattttctctggcgatatgcatcccgggctattggtattgccgaaaatctacgacgtcggaacataaacgtggacccgtattgttcgcgatgttgcacggagctggaaacaaatgaccatacaatcttctcatgtcctcgggttgaaatgatatggagagctgcaggctttcaaacttcccaattatgtgacaatggaataccaccggaagagaagttgcgtatcatctttcaaatgcataatgattcaagggtggatcgagttacaagatttatgcccttttggttaatgtggagaatatggaagagcggaaacgacctagtctttaaccacacgcgaacaaaattccaaactacagtggagatggctctcaatgacaccaaggaatggttggacaatacaatgacaaacgagcagcaaaatgggaacaggaatgcagatccgtctcgtaataccaagtggtcgccgccgggaagagacaaattaaaatgcaactatgatgcatcgcaccatgaaagaaacacagtttcaggacttggttggatccttcggaactctcaaggtactgtgatcgagtgtggtatggggaaatttcaaggtcgtatgacgacggaggaggcagagtgttcaacacttatttgggctatacaagcttcctatggcttcgggcataagaaggttatttttgagggagataaccaaaccatcacccgaatgataaacacaaagtcatctaatccaaggctacaacactttctcgataccatccaaagttggataccaagttttgaatcgatagaattctctttcaaacatcgagaacagaacggatgtgcggatttcttagccaaacaagccatcaaagagaatacccaatggtctctgtttcattcttgtccttattttctgagtccatatgtaaacaacgattactcttaagttctaaataaagttataagttgaaaaaaaaaaaaaaaatcataagaaaatctacaagttatgttttctcaatcacatccacttcttaagaagacataacatgtaacatgttgatatgaaaccatgtgattagtggaaatgaaaagcagaatgtaaggaggttacaatgtcagaacatagcaaatcatatataacttgattgttcctttcttcaaagcaacaatggaattggaatatagcatccactaaaagccttcaaaccaatcatacgagataataatgcgatttcaaaactgatcaagccataaagatgaataatgagccatagttgcattcgttcaatccgtgatttcgtaacgcgaaaggccaaaacgttattaagttccaatccaaagtaattgacaaaaaaacaaatggacctcgtgacaatgatgatatgaatctctcccaatcacaaaaatgagtaacaaacaaacactaaaaagattagggttaaaaatcataaatagtcaaaatcaacggccgtgattgaaagccaccctataaattctaataatcagtttctgagtgaagccattgttatttgttttcgttgccactctaacacaatg

SEQ ID NO: 27601 - DNA, 3000 bp, Unknown
  misc_feature (1)..( 3000): 2750-1469P.txt file - cDNA_ID_2990971; gDNA_ID_2936570; Annot_ID_194749
tgggatattgaatctggacgcaataccctggtgaactttgaaactggacgcatccagacagacagagcgattcaattagatacaagcgatgatccagctctcgtatttgttccgtgcatgaagactgtgaaggtagtcaccaccttactattgtatcagcaaatctttccattccagtacttgcattatttgatgaattgttgctgcaactgtatataagggttttggcatgtggtcgggtagaacaacactgatgcttcgtggacactacgaaagcgtgaacacttgctgctttaattccaatgatcaggtataaactcaatcctcagaatcttcccgaatttcgcgagtgatttgagtttgtaagtttgcttgaacacacctctaaatccgaattacttgttatacttgctcataggaactatacacaagtggcgcagatagacaaataattgtgtggtcaccaggcggatccgtggaagatgaaatggttgagctaaattctagtactacttcaaattttcataatttagaggttaggcagtcttgttgtggatgtctctttaatcaagatttgtctatttgcaggcgcaaggtgaagtagctgaagataaagacaactggagcgactgagagaaaacaagacttctttctcaatctgtgaatttctatgtcttcacaattacttgaccgcagcttctgcagtgaaagatgtgttcccatcgcagccatagttaaatcggtatttagaaatttcttctggtctctctttcaagcgttttcagttattggatacattatatttgatcaatgtgtaaagtttcagaaacttagggaatagatggtggagatgtttcataggaatgttatatttggattgatcaagaaaagggttttactagattgcctctatgatcaaagaatagtctaataatgcaactatgcaagtatcgttcttaatacaaaatctttgcgtctcaagttggcattgtcattgaaagcctgtcgaaatgctctctaaagaaattttgcttaattggagtttcaatgccaaatccttctttgtttctatgaccataggaaaatttagctggattgattaagaattgggttttactttattgcctttgtgattaaggaataatgtagtgatacaagtaaggttcttagtactaaatccatgcttgttgagttggcattttcattgaaaggtatttctaaagaagtttccttaatcggtgttgcaatgccaaatcattggttgcctctatgatcatcggatcatatgactggattggtcaaacagaatggttttactttattggctctattatcatagaataatgtagtgatgcaagttaaggcttttaataccaaatcctcacttctcgagttgtggcatgttcattgaaaagcctgtggaaatgctatctaaagaaattttgttgatcagagtttcattgccccatagcgttttagtactgaaactataacaaaagtctaaaactggtatagatgatgatatgccgaaatgtataatccatgaaggttagtaatagttgctttgtctgtgtgaattcaattaacacatgacagattatgcctacttaagctggacaactgtggctaggctgcctcaagttgatttggtgatatgctgtgttctttaattatgggtccagtgtagttgatagcttttatgcctatgggtcatatgggtgttctaatgggtgttctatttaagaagtttgcgtgatcacagtttcaaattcaatgccccatagcgttttagttctgaaactattgtaccgatgatgaaccggggaattcaaaacacatgtctagaacttatatagatgagtaatccatgaaggtttagtaatagttgttttgcctttgtgaatctattaacacagtaataggttatgcctacttgagctattgctctggacaactttggctgcttcagtctcttggtcaagacatgctaatttgttaagtattaaaatgttattttaattacgggtccagtgtatatttgagagcatgtatgcctatgggtcataatgggtatagcgtcgtggaaacagtgtgaggacgtttatatagtcaaacgaggcaattgtgtacatagagattttgtatgattcttaagtaaaatgtgtcaaatgagcaccaaggaaattgcctttgtttgttacccttaatctcttattttgtaaaatccaaactttcgaagctcatttggttgaaaaatgatcaatgttacgttgaacaacattgaatctgagttcaaaatttgtttagttattgcaaacaatttgattcgaagttcaagttcattctaatcttgcacctttgggattatatcttgagcattataaaatgtcatataccaaaatccttacatgaagtatgatattctaagatgaagtcataagaagacacgcatttaagagagtatcatattacaagtagtgagctgccaagtgggcatcgtgttagttcaaaatttccgaaacgtaggatgttggataatcccaaaggtcaaacccccaaaacaaacaaagtcaatataacttaaacttaactataccatttccttatataaccttcgaaccataaatccaattcggaatattcgttgatagaaaacaatcaagattcaaaacctcaaatatttctcatcatcttttgtcgattattgcttggattttgtaaagacaagaataagttacttctaagtgttgtttacacacttttttggatgacgaaacaacccggaacaagttgaaaacgacgacgcgtagacatgaggctcgcttgattgaccattacgccgccagggtagacttttcgtgcccatatataataaacccttctctttcctttatcccacaacatcatccactccaaatatcacatattaccaaatctaatcgccgacatacattgaactcaaatccgctcagaatctccgacaatcagttccaatccatg

SEQ ID NO: 27602 - DNA, 3000 bp, Unknown; identical to SEQ ID NO: 954
  misc_feature (1)..( 3000): 2750-1469P.txt file - cDNA_ID_2990975; gDNA_ID_1620341; Annot_ID_153989

SEQ ID NO: 27603 - DNA, 3003 bp, Unknown
  misc_feature (1)..( 3003): 2750-1469P.txt file - cDNA_ID_2990982; gDNA_ID_2598; Annot_ID_145809
  misc_feature (38)..(38): n is a, c, g, or t
tctctcgccacgttctcatcaatctattcaccaaaagnaaaaccagaaaaaaaggattgaaaatcacataatcaacctttgatcttataagacaatgaaccagtactatgctcacaaaagtaagaattccagataaacaaagcagaagaacactccaacttgcaaaattacacacataaaaggaagtaatttgagagttagaagaagaaccttagggccacgctcgatgtacttcatagcaacaagttccttggagtttttgactctcatgagcctcgccactccaaaattcccagcaccgatgtctttaacaagctcgtacttgtccattttctcgtagcgaaatcaaacaacaagcctaatttccactacacaaagtcacaaacccagaaaatcaagggatgcgattcagaggtttttcgcgatggctaaaaaaggcacaaagtgatagaatgagattttgaaagcaaaagcgaaattgtcgatatccttttttcttatccgtgaagaaattccaaaagaagatatgattacgaattacaatgatgatgatgatgatgatgatgccgtaataatctccatcgttccttgctggcttcttctctcgaagtcacgatggctcttatttttttattatttaagtaatagtttacttattgaattatttttggttaatttaagaggtatattaataaatgcgggacctacaaattccaattctatcggttctttagtgactgagacgtcgctatatgtgaaaaggatattttagttgtcacagaattgcgtctatttcttattttttcatctttttgcaatttaccgattctacgagaacatcatttgtttattggatatgctttttttaaagaatcaagagaatacgaaaacaacttgtactcaagaatgtttactataattctctagtggatctttataagagctggagattagtttggattttatcttaaagtatccagttatcaaaaaatgagattgttaggactttttttacccgagagtatttagttacaaaaaagaaagttagtttaatattagataaactataattgcaactaacggtcagtagaaagctatataagttatataacgaatctgaatatgacttagttatcttgttggattgtctagatatgtttttgccttttacggaaagattcgatttggaacaacttctgaattaacctgaaaaacgtaattaaacattgacttgttggttgtttgtagaatggttggtttatactttccgaatgtggctatgtgaaatcacattttgattatatgtataaagttgagatataattttaaaatttgcaaaaaattattagttttgttaaaataataggagatgcaaactaaataaattctcttcttaactaaaaaagcaatagatttgttaacattgaatgatggatagatttgtgagttgtgactttgcttaagctaccccaacagataacggatatatcatatagatgttgagtaagaaagaaaaaaaaaacatttacgattgcattctcgtaatgggctttatgattttaaggcccaatagatgaagtaaggctaatgcacaactttaagaaacgtaattctaggaagtgtttatcgactgcgttgtaggtttcttgtgttcgtggcactatggattaggttttaatatggtttctaatttcgttgatttcagtggcataagtccagttgttgcttgtggcaaactgtttcatgtacaaaaacacttacatcattactaaattatgtcatgggtttggtttcgttaacaataagtcaatctccttgatgagttttatctatatgattatctatttgtctatttgcaacatgtagtagattgaactggggctgcaaaatatgctcttgcaattcctagttagatctagcttttgataatacgattatctaatttgtcatttcgatatgatagatagattgtttttaaaagagatctcaaccacttttctttaactaaaataaaaaatttagtcactttttattaaaaataactaaaaagttttaaacctatcaggacacttccatcaacagtatttaaaagagatatttattattaaaataatacaaagtggtgaaaagaagagagaagtgagaatcgtctctgttttcagaaactctgaaaaacgtttatggccacgtgtttttccagaaatgattgattttattctttttattaaaatttaatactttatctaaattcaattaaaataagcaatatttttttcatgagaaactcttttttgagaatcaaccgatgtagatggtctcatactctactctgttgattgtgtttaagtttctgaggatttttctactttccgacgttatgccaagaggctggtcttcactagaaaactacttccacccaattcaagcaagtatgacctcttctccccacaatttattcatgtactgaaaggccattagaagttgactgaattgtgaaggtggagattatgtattcacttgttgatttggtatacattctatgtaaggttcaattatttacgttatataattataatggagtaatttacagtaattgggttaaaatggtttgattcggtcaggttgatacggtttggaagttaaacccggcctagatatgatgttacaaccagtccacatcttttatgattttagtggaacaaacgaagagttatttagacgatacaaacaaggtccgaataagtgtgagctgtcccaagtaagaccacgtaatactcacctcaacaagatagtgttcttaaagtgtgtcaaacacaatcacacacacacaaatcataaaacacaaagacgataatccatcgatccacagaatagacgccacgtggtagataggattctcactaaaaagttctcaccttttaatctttctccacgccatttccacaagccataatcctcaaaaatctcaactttatctcccaaaacacaaaacaaaaaaaaatg

SEQ ID NO: 27604 - DNA, 3003 bp, Unknown
  misc_feature (1)..( 3003): 2750-1469P.txt file - cDNA_ID_2990986; gDNA_ID_1620517; Annot_ID_159337
ttccgaacaaagtccaagtttccaagttcgagtagtagaatctttcggttaaatttcttttgtttctttttctttcgttctttctttttcaatatgtaaaatttccattactaatgtgggggtttgactggtgtaactcttttcttcttcgaatgtaatataaatgcgttttaaatttgggaaaatatttttattaggattatgtaagaaaaataacatcttgcatggatgctgttaatgactatggtaatggaacaaaataacatttgcatagatgttaatggtacaaaagaagtttcaacgtaacaaagattggttacgaaaaaaaaaaaaaagtaacaaattggttaaaaaaagcaatagtatattgggctgagtatgaagccaaaaagcccaataggcttaaaaccgccataaacacgaaatagaatctaccaaacgcaacgctattttcgagtatgcgattgcaaacgcgataacgaacttgaaatcaaattttggaaagttaacaagatttttatcttcgttgtctccgtttaacgaactggcgaataacaaagagaggatgaattgttcaatcggaaactggaaacacactgttctctacttaaccctaatcgtatctcttctctacttcatcgaatccctaatctcacacaaattacacatcaactacaacaaaatccgcctgaaaagatctccgaatcttcctctacgattccgtgacgatggcacattcaaaatcctccaggtcatgatttgtttcatcctctatcatcataaattgtgcaattcgctgctcattgatatgattaatttgatatctaacaggtcgcggatatgcatttcggaatggggatgattactcgatgtagagatgtgttggattcagaattcgaatattgttctgatctcaacactactcggtttcttcgtaggatgattgaatctgagagacctgatttgattgctttcactggtaaaaattcatgaactaattgatatgttcagagaaggtttaaagactaaattgattctgtttgttgattatgaattaggggataatatatttggatcaagtactactgatgcagctgaatctcttcttgaagctattggtccagctattgaatatggaatcccatgggctgctgttttaggaaatcatgaccatgaatctactttgaaccgtttagaattgatgactttcctttctcttatggatttttctgtttctcaaatcaatccacttgttgaagatgaaactaaaggagatacaatgaggttaatcgatggatttgggaattaccgagtgagagtttacggtgctcctggttctgtgttggcgaatagtaccgtctttgatctcttcttttttgatagtggagatagagaaatagtacaaggtaaacgaacttatggatggatcaaggaatcacaacttcgttggcttcaagatacttctatacaggtaatgaggttaagcatctgtcaatatatttagtggaaacctcacatagattcattacctctaagtagactcactgactagtgactaaacagggtcatagccagaggattcatgttaatccgccagcgttagccttcttccacatcccaatattggaagttcgggaactgtggtacacgccctttatcggtcagtttcaggaaggagtggcatgctctattgttcagtctggagtcttacagacatttgtgtcaatgggaaatgtaaaagctgcgttcatgggacacgaccatgttaatgatttctgtggaactctaaaaggggtatggttttgttacggtggaggattcggataccatgcttatggacgaccaaattggcatagaagagcaagagtgatagaagctaagcttgggaaaggaagagacacatgggaaggaatcaaacttatcaagacttggaaacgtcttgacgacgaatacttgagcaaaatagacgaacaagtcttatgggaaacttccgactcatttctgaagtgaatctaaggacaaaacatataaggtattaatctcgttctttcataaatggccaccttttgatgttttgtgtgagaattttctgagtctctggaatctattgttgtgaaaaacgtttttctaatggtcatcacaatcacaaattcgttatacgatttaacgtcaatttcattaggacaaaaccctgtcgaaacatatgtgaaatgaaggaccgtattttcgttttgggatgcttttgaaatggtctcttcgttgctgtttcggtgtgttctctttgactatttggcattttttttttttttttttttttgctgctctttaattagctaatatgcaatcataagattctcgttacaaatatttccagcgtcaaatcatttcttatttttatctttatgctttttgtttgtatcattattttgccattttttcgcttttttatatttatgtagtcatatttctgaacttttcttttgtttttctttgggtctcggttctaaactttgattgttcactattctaatatttttcaggccaatttttttcagtgtcttcactgttttatattgacaagtgtgaaaatataataaagtttccttggtaatcagaaatccgttagactaatcaaaaagacctcgtgtcgaatatcatcataaattaataaaataatattctgctggagctggtcattttttttttttttttttaattaggaaatatctagatttttatattgaccaattagtcaattactgatttactctagatcttatttttatatatatctaagaatagacattataattattttcttgcagtaagatacaacggcggtgtcgtgtgtgtataactggaaaattacgttgttgtctcccgagactttggtttgtctcattccccattcgcgttcttatataaagctcacagttcgagagagacaagagaccaacgaaacgaactagagacagtttgattcgaaaatcttgtcggaaaatg

SEQ ID NO: 27605 - DNA, 146 bp, Unknown
  misc_feature (1)..( 146): 2750-1469P.txt file - cDNA_ID_2990986; gDNA_ID_1564508; Annot_ID_149573
ctggaaaattacgttgttgtctcccgagactttggtttgtctcattccccattcgcgttcttatataaagctcacagttcgagagagacaagagaccaacgaaacgaactagagacagtttgattcgaaaatcttgtcggaaaatg

SEQ ID NO: 27606 - DNA, 3000 bp, Unknown; identical to SEQ ID NO: 14932
  misc_feature (1)..( 3000): 2750-1469P.txt file - cDNA_ID_2990990; gDNA_ID_2684234; Annot_ID_192366

SEQ ID NO: 27607 - DNA, 3003 bp, Unknown
  misc_feature (1)..( 3003): 2750-1469P.txt file - cDNA_ID_2990998; gDNA_ID_1620547; Annot_ID_160194
gatttgagtgtttcttgaagcatagagatatactgcaacattatgtcatctaatgcaagtatcagctcgtctgcctctgaccctccagtaaagccaatacacctttcaactgcagcttcaagaagaacaacaacttggggaatagactcttccatcctacgcactgtttcactgagttcaattccttgagccccaacaccacgagtaacagcccctctcagatccaccactgcaatctcagaggataaaatagcacgttccatcttcccatacctaaagcatgatcaaaccttatgtcacaaacagccttgaagaaccacgacccaaaaaagtttcatcaaaaaaatgggacaatccataaatactagaaatggatacaagacatgggggaagagaagtacacaacatgaaaacttacttttgcttaaacgattcaaagggtgagtacacggccttcagcgtatctattaagatcctaagttcagattccgcaaacaggtgctgaatatttcttgcaaaggaaccagttacgttgtgcagttcaatcagagcctcaagatgcttggtctgaatattaatacccttgggcaagtctccagataatagatccatcacacctgttcaaggaaaacatcagaattgtcagtattctcctaaatacacaaaatacagatataagtcaattgaagataatcgtgcattgtctggaaaatttccagtgactaaatgaaaaatgtaacaaataagttgttgttcaaacttcctgcaagtctctcttgcatattgacagattcatgacatcggccactatgcacaaaaattacaaacttaacaagaacagccaaaaactttagctcatgtaaaggcagaaaaaagtgatactcttcttacatctatctacccaaacatgaggatggtagagtagaaccactaaagaagcaacgcaatcccaattcagctgggtaaaaagactagactaagaaggaaacctaataatcaaactgtactgacatcatatctaacctttggcgagtgcttttgtttcaggaacagcatctccagttgcaaggttaagacgagaaacaaaactagcccccagtactcccatggtctcaaccaacagctttgggacgagagtcatgtagtcatcagggaaggcaaccatacacctaaacaatcatgaaagcaaaaacgtacaacagtgattgatacttaaagctgcaatcacctaaagatctgacatactgtcactggaagggcccggaaaatatatacagtttactgtaaataaaagtaaaacatttaccatttccactcttgctcaagatagagtagcaactcgtcgtaaaagcttgtcagccaactggcaaatgatgtctgagatgatgtcgactgaaactcatcgccgctagacaacctttgactttcacttctctcattggcaagcttgtttgccctttgctttgtgtcaaaatcttcccagagttgtttaatcggctttagacggacttttgaatattgcaactccagagacttgaatctcccaatccggatgagaattactcgcaaatcttgggcgacatcaacctgccaaatttggggaaaggcttttcagtccaataatggcaacagagacattacaacctaaagtagttgggttctctagatatacaggttccaaccttgtgatatgttaatgcatcagtaagacgtggctgcaccatcgcctccagcctatcttccaatacctctagttgctttctcacattagcaaattctgcaacctgttgacaaaaattggactttaagtggtgacggaaaaagacttaaatcctcagagtactgaagctgacataaaactacctctccaacagcagacaggcaatttcgcatgctagcaagagtttctgcagcacgaggaagatcgccactagcaaatacatcctcaaccgtcgagcttaactgagttaaccctgcagcatcctgtacatataccaaaaagaagagaatcaattgcagatctacccccaagtgtccacataatggatcacaaaatcactatgaatactaacctgtagtgttttgtaggcagcctccattctctgtttgacattgtccactctagcaagcgcagctatacaatctgctgaagaaccctctgcctgcagagtaccgaattcgataagagcacaagtttcaggaatttgatataatctaattttcgagaagagatccaaacaaaatctcaggaatcagcacaaatgcgtaccttcttgagcttctggaggattccagcaacagaaccacgcagagacacagcatcatcacggagacgcaacacgtctcgtgtggcacgaggaacacggaggagagcaccaccgctctgctcttcaagagaagctccgatctcctcggaggcaatctgaagcttcatttccagatccacaagatgtttctcgagtgaatcctgtgggtgacgcgcctggcacgacgagttaacccatcgcttcgcatcgaacttctcatctgagaatggacctagatccagcatcatccttgatccgatcacccgatttaccttagattctcttcagcttcgacgatgatgatgttgaagagaagaagatcctctgatttcgcagatacactgaagaagaaactaaaccaaatcgatctaaaccgactttcaaattcgactttaaaaccaaaccaaagtaaacggaagataaatttacaaatctgggccccaaagtgatgggccgtcacggaaaaagttttcttctttctttttctttatttttctttattttacttggagaccacgcagttctagaaccatccttaagcgactctctagcctctagcagcttcttctactctctgttctatataaacctttctctaacagcttttttttcgttcaaagagtataaaaaatatctcatcgagcttgaaaataattaatcacttgctaattctaagcttcttctctttccaaaaatg

SEQ ID NO: 27608 - DNA, 3003 bp, Unknown
  misc_feature (1)..( 3003): 2750-1469P.txt file - cDNA_ID_2991006; gDNA_ID_1620355; Annot_ID_154471
cctgtccttgtggatttcggctctgtctgttctgccacaagaccatttgcgatggagatgggcgttgtccaggctgcaggaaaccctatgaacggaatatggtcaaggctgagactagtattcaaggtggtggtctaacaattcggttggctcgttcgtctagcatgttttgcaagttttaaaaggagaggtgcggttttctcaaccatgttgtcttttggaactcgagaacttaagctctgttttctatgtcatctatggttctaagtctgaaacactgtggtgatgatgtagaatgtgatgtgtgaatacataaaaggtggtacagaaaatgattcaaatacatttagatagtttcaataatgaatgctatgttctcttttctaattccatatgtttggtctgcatttattccttgtcaaacattattgaaggtttaagagttattttgttgctatggtgaatcctcttgacaagttactcatgaaccaaagcttgttttttagaatcaccattcaccagagatcaactctcattacttcaaattcttttaggaaacttctgattgtttatgattagctaacaaaatcatttattcacataaagtgaggcttcttaacaacttctattaagccagcttacaaatctcttgtaaggaaaaaagctatgacccctctaatgaatataatatataatatagcttttgctcatctctataccatttacattactactatatgaataaacccactgaattcaatcagcgaaaaaggccataggggttggaaaattgtataggtcattaagctggcgagaatcatcagtgtaggctcaagtgcattgagtcttgaagcttctgtatatgaaaaggctttttctaagatccagtcacggaatttgcatcggagagctcagatctttgcgcgtttgagctgcgagtgaacagggtagacattctctgtttctagctctctcttctgaatactctttgtgaaagacaaatcttcaaccttcattagagaatctcttaatctttttacatccgagagttttaccggcttcagtaagaaatcttcagccccttcttcaagacatctgaatgacaaaataataatcacaagaaaatcagtttgagtaaactccaatttcaataaagttgatgatagctttggatcaataagttttttttttgttgtatatgtagcaaacaatcataaaatggccagttcgtaattgagttggccattgtgtgtaacacaaatacatattcctttttattttatttggtctagaggtttcctaatattgtatgcaaagtgaaaaagcatgtgaggtggctttcacaataccctaccaaatattaggcaagcaagatcatgtacttattttattgtaatatcacatcaccagaaatagaatcaaatcccaaagtaaagattttgctggttagaaacatctttatacacaaaatcatcttgggacccattaaagatcaccaaatctcaacatttgtttaattatgcaatatccaccaccaaaaatggtttaaggaaattaacttttaaccatatgagcaggaactttactttgtgatctaatccctttttgttttatctaattctttttttgatcatctaagacaaagatattcaccaaatttactatagtttgacttaagattatgatgaagttttatacctatcaatacgaggcaaaatgttctcggaggacataattaccaccggtacttctctaaaagctgaggattcctgtggaaaatcacgtaaaaaaggattagataaacataaaactcaaattccattgactaattatatcattatatgtttgtttgcttactttgatcttcttcaagagttcatatccagtcataccgggcattgagtaatcagtcataattaaattaaccttcaaatcctgaagcacaaatcacgatttaacatattgcttgagagctacggcaaaattttgttttctcttggaaattgttttatacctcaaaaccgactgatttttcctcaacatccaaaccaaggtattggagagctcttgttgcactatcaacaacagtaactgaacaaccaaaacagagctttttactcagataacttgcccgaattcagagactgatttttcaaaatatgagtaataattacctttgcaagaagatactctgagcaaacgctcgatgaatttacgatcaacgtgactgtcgtcgacggcaagaacatgaagaggatccggtgatccaaactttgaagaatggttgagaatctccatcttcctcggtagcataacttcagccattgatcaacgaatgttggaggatttggaagaaaaaggaagagaaagatatgatgtgaaaccatggtggcagtggttgggccatttatataagtagaaagaaagaaagaaagaaataaaagagggaaaaaatatgaatgaaatcgagagattttgcatatctttaagattttgtcaatttgctttcaaaatctttattttatattttatataaataatagttcggtggatttttattattaaataagttaaaacaaaaaaccgaaataaagtcaaaccaatcggttcaagtttagtcaaaacgaagaacaaaccagaaaatttggaatgggatgcaagatttaaccgacccaaaccgatattcaataacttgtagaattctttttttatttttaaattatttgtgtgtgtttgtagttttttttggtaaaagtgtgtttgtagttgaattgtggaagttcacgcatttaacttctacacttcaatacttcatctacgtagaagttcactttgaggttttgacttaagctcaagacagaaaaatgtgaaatcaagaaatcataaactaatactaaaacattacacgcatccttaatctacaattagtaaaacctctttagattaccaccttttcattcaccaaaaatataacaaattaatactaaaggcccggcccatatg

SEQ ID NO: 27609 - DNA, 3000 bp, Unknown; identical to SEQ ID NO: 9684
  misc_feature (1)..( 3000): 2750-1469P.txt file - cDNA_ID_2991013; gDNA_ID_1972172; Annot_ID_179852

SEQ ID NO: 27610 - DNA, 1757 bp, Unknown; identical to SEQ ID NO: 3171
  misc_feature (1)..( 1757): 2750-1469P.txt file - cDNA_ID_2991013; gDNA_ID_1620629; Annot_ID_162599

SEQ ID NO: 27611 - DNA, 3000 bp, Unknown
  misc_feature (1)..( 3000): 2750-1469P.txt file - cDNA_ID_2991021; gDNA_ID_2926300; Annot_ID_205652
caaacacatctgcataaatcaccagaaagaaagaaaaagagaagtaaggaacatgaaaacaactaaccaaataacagattattctttttattttcttaccagggatgagtttgatccttgtgtattggatgctttcacgagatgggactttccctgagctgctgctgaacgtaaattgtcgatcttctcatctatatcatctgcaataaaataaaatttaactcaagtgtcgttagctcaattgataaagatattaggtgaagcttagaggtcgtcggttcgacgttaggacgaaactaatattacatgctgtactttcgggcctaagagggattatagaattcggtcatgaacctactagtattaaaagaataataataataaaaaaataaaaaaataaaaaataaaaaaataaaaagtaaagaggattgagaattggactcaaagcattctaggtcttgactgttttttttattctaggtcttgactgttgcttttttcgtttcagagatttaccgatcgttccttgatggtctaccatcaccgccagatctttgaacatctccattacttcactgatttgatgcttaacttcctgtatcccctgttcccttgcctctatccgtgcttcgtttaaggaaatttcgttgtcaagcaacacaatttcttgcctacaaatgaagaaagagagagttcaccagtatgaaggtggtagttatttaccgagatatgcggcatatatagaacttacttaccttctagattccatgaggacacgctgctcttgtgatctatcatagccaatgtctacctcactggtatataagaaaaaagaggcatcaaagtaaaatcaagtcaagataaaactatagtttaattggactcaaagtcaacaacttatgtgcttgaaccagtttgtttccaaccacacaagtatagcaatcatgtaacaaagaacatagtggttatctctactgatgaagtaaccgtaactaggtttttcataccttgaagaaaagctaccttttggatcaaaaggaatataagaagtttctctttcaactgtaatatgctgtgctttctgaaactctttcaacgctgcttcaaaatcctttgcaagtttagcatctgcaatcttcttactttgctgcatcagcaaataccaattcataaaagagaaccatcaatagtaaataaatttcacagaatgtgatgttttcatgaaaacaaatctcacatctttctaagttattcctattgagaaacacacacttacagcaacatctcgacgatgatcggtttcactagcttccctaagatttgcagaagtatcttttaccagttgaccaataagtaacattttcttgtgcctgatcaatcaatagataattacaccaacatagaatagcacttactttaggcattttgaagaaaaggcaaaaatctttctgtcgccatagttgggtattgcaaaatttatgtcgccatagttgggtattgcaaaattttgggttcaaatcggattcgggtcggatatttcggattcgaattacccgaaattccccaaaatcaatttttataaccaaatttatccaaactactcgaaaatacacaaaatatctaaatattttgaatatcttttactcaaatttactcaaaagtagattaaatacttaaaaatatttaaaacttcagaagccaacgtggcatctggttgactggaaatcaaaccctccggttgagttagaggaacctaatgctaatggtatcttaagatgacaacgaacaactggtttcatcggccacgtgactaaatgcaaaaccataaccctaaaattaatactcagcttcacgtcaattctataaacaccagtcttctgatcatcttcaaactttttgcgttcattaccctttagtaaaactagagtttggccttcaaacaatgctctgagaagcatcgtgttcttgcttccaaggtagaacaacggcatgggaacagctcctaaccgctgattcatgtagtaaacggttgcttcaaacctatcgtaatggattccgatactactcttcgagtttcggatggagagattcaaagagagactgtactggaggttattgttgctttcgagatcgaaatgtgtcagctcagcgtcgtagacttggaatttcacatcgttggatctaaccatgatccaagcaatgaatgacgcaaagcagatgagaaataacagtgatacacagaaatttatcagacaagtacaaggccaacataaatagtatccaaggctagatttgtctgtcatgttaagagaatgatttgtgaaaacgaagtaacaatcactagtaatttataaaaaaaattataacactcgttggcctctgcttttttcaagtgaaaaaaaaaatcaaacgaacggtttgatttagttaattaatcttatgttttgaaaaattattctcctagattataagtgttgatcttttatttaggttatgtttcattagtttccgtagttatctccttattagttccaacaatccatgtaaattttaactctggactatctttttaatgagactttcataagctttgttattagaatattagaaacatttaaataaatttaattattatgttaatttattatgtaaatttaaatttgagttaatttatagaaaaaatctgtgattattaataaatttaattattatgttattagtttatgattttctacatttttcttcacaaaataaagttgtatcatcaaaacaaagatattgtttgggaaactttacaaaattatgaaaaaacagacggcccatatatctactccgttaaagtgggccaacagacggcccacaatgacttcttcgaacaaggaaatagacggtgaggatcgcatcaccgttaaccagccaaaaggtcagtgactgacgaaaatggcgatcatgcgataatcgtgtagccgaagaagaagaagaagaagaagaaagaagatg

SEQ ID NO: 27612 - DNA, 3003 bp, Unknown
  misc_feature (1)..( 3003): 2750-1469P.txt file - cDNA_ID_2991029; gDNA_ID_2214672; Annot_ID_189132
tattacaaatgtgaaaactgaaaaaaagaaggaaatttgtattatcatttttagtttaatacttttaaaatcgaggtaaatattacaaatgtgaaagttcaaaaaaattatatgtattatagtattttgtttaacattttttaaaagttgagataaatattaaaaaaaaagtttaaaaggggaacttatatcgtcgtacattagtttaaatcttttaaatatcttttcttccgttttttattaaaaacatattgcaccgaatatttcaaatatgttaaaatacccgaatatgtttagtgagcttatcttcggaaaaaaacaaattggcccggtataatttacaccgtcatatgtaaaaccctaaaactatatgttacaaatctctataaatataggttgtcattcatgaaaaacaaacataacagtttattttatgcatattcgttatgatttatagttttgatttgtaccataaagttggttctttctatgatgcatcatctcatagatctttgcttattgttgatcgacgacctcttaaacgaggattatagcctttttatttgattcacccataaatattgaacctaatttgtggtatattttaagcaaatgaatatttttttaactttttagtttttttttaattactaattagtttaagttatattttgatctgataaaaagtatttgtgggtcttcccacgcgtcagacccaaaaagtattaaaggggtcagctgacccctctaaaattctatatttgcattgtagccctttaaaattattttgttttttccctttttaaattacaaattagtatgtaaaccttttaagttttatagtatttttcttctactttgtcttttgacactatttcttactttttttttttttttttgattcatccataaacattgaacctaatttctggtatttttttaaagagatgaagttttttttttaggtttttagttgtttttaattacttattattttaagttatattttgattctataagaagtatttatgggtccaccgcataggcagacccaaagaagattaacatttgcattataaccctttaaagtttatgatatcatttatattttaagttatattttaatcttcttaaaattacaaattcgtatgtaatccttttacgttttatcgtatttttcttctactttgtgttttgacactatttcttacatgtttttaaatttttttgtttgtttcacccataaacatttaacctaatttctggtattttttttaaagagatgaagatttttttttgagttttttagttgtttttaattacttattattttaaattatattttgattctgtaaaaagtatttatgggtccgccgcataggtagacccaaagaagattaaaggaggtcaattggtccccaaagttcaacatttgcattataaccctttaaagtcttttaaaatattattttatatttcttctattttgatcttcttgaaattacaaattcgtttgtaaatccttttttttttttttgggcatttgttaaccctttaaattacaaatttgtatgtaaaatccttaaatacttcaaaagatgatcaaagttaaagttattttaaaatttatttgcattatttcgttgaatgatgtggtagaattagtctttgatcttaaagatttggtcttgaagaatacacatatataatttgcaagtttatatgggattattttgtagatatatttatgtaaatataaaaaaatgttggaaacttattttttcctatgattccagtcggatgattgagtggttatggatagcgccaccaaaatatttcataactttgatgtttttatgagttacaattgatgtataaatcatttataataagtacgttatgtttcatcgtttgtaataaattaggcacacattaaattctctaagctatgtctaatattagtaaattacttttcgttttgaaaatcgtgaattagatgattgagttgttatggagatcgaaagtgttgagctattttggtgttttaagtgtaataatttatggataaaatgtttgtaataagtttggcaacttttaactatgtctaagattggtgattttactagcagtataaataagcgagatattatcataaaaaatcgctctagcggtttgcatagtataagcgagcttcatctggcttatttacctttgcaatatcctcttttgtttccgtacggggaggatggtttctggttagtgatggaaatcggatttgttgatacgagaggaaggaagagaaaaatggtcactatgagagagttttgatgaatagagacgatgcagattttatgctaaaatattcacaaaaagtgtgtgatgatgatataatttagttgctctagtttctaactttatttgttgaatattttgtgactatacgatctattgtattactgctccaacttagccaatttaaattcgtttgtactgattgccaagagaaggtattttagtattaaaaattttcatatgtgattagtaataatgtaatatcttcgtaaaaatactcttttcatattgatttctttaccattttgaatttcttgatttcattttaatatacgctaaaaaccgatttcggttttgtattactaatcaaacacgaaatacaaggcataaactaaacgtgaatattttgttacggagtcaacaacaaaattggagttaattcagttttgacgacttaccaaaaccaggattaaattgttcaatacgcaaacgtcattcttaaaactctcatactaaataaatagtgggcgtttttgtaaacccgaaaaagtagaggggttcttttccgaagtcttgtaatttcccagaccgtcgacgacaaaactctacacatgtccattaacgtctggatttcgattgtcaagaagttttgtaaaacgcaaactccgataatctttctctaatctccgatcgtgttttcttagtgagatg

SEQ ID NO: 27613 - DNA, 3003 bp, Unknown
  misc_feature (1)..( 3003): 2750-1469P.txt file - cDNA_ID_2991033; gDNA_ID_1620758; Annot_ID_167073
ctctgtttggttgtcgatagtcacacagtgcctgatcgtcggtcaatttgctaatccttgtgtgatttagagttggaatgatcatttggtgaaatctcgtggatcttttcttgttgaaagcttgttgacttgctcgtcatatatattcgacgatctatgggtactgtatctagttgataatgttcaaaggcttgatcgattttagccttgggatctgctaccgatgctttcaatttctgacgcttttctatgcgatcttttcgaattcgtttttctctccagtttttgccatgtcaattgattctcttagtaacactacttctttgtttgctctcttggattttttgtttcttctgaaatggaggcttgtgcattgattgttctatgtgtgtgatttcttatgcggtgttaagtcctttggatcttcgtataatgatgtttttaatctgctgacaaacgaatttatccctgcggcgttttagtttgctacatataaagttcttagctgtgaactgtttctcctgggtatctcattgcggtttgaattctgttttgctatcaggaaatgagtttcaacaaagttcccaacattcctggagctcctgctctctctgcccttcttaaggtcagcgttattggtgggctcggtgtctatgcccttactaatagtctctacaatgtcgatggaggacaccgtgctgtcatgttcaaccgattaactggtatcaaggaaaaggtttgtatttctcaaactaacaagatgtacttttatatctgaggctttgaattctaagaaagcgttacttttacttggatttgtgttttcaggtgtacccagaaggcacacattttatggtgccatggtttgaaaggccaatcatctatgacgttcgtgcacgaccttaccttgtagagagcaccactggtagtcatgatcttcagatggtgcgttttggtttcttcttcttttggcttcttttctgtgtgtgtttgtacaatatttagcccagggatttaattttaaatgatgttactgaatgtggtgctatatagatcatactagatattccttcttttgacgttatgttaagacccttcaatgcagcattaagagcatgttttagaaaattttgggtgtggtttgaggttatggagctgtagattaaatatcacttactcttttaggatattacacgatcaatgttgatccttatatgaactgtgtgagtgtatggataagtggaaaaacaagagacaagttacacttgctttcagtagacttaggtagagcaagaaagaacttagtctccattttctttcttaaaggagttgctgtgtttctgatatttttcttgggtgttgcacaggtgaaaattggattaagggttctcacacgtcccatgggtgaccgtttgcctcagatttaccgaacccttggcgagaactacagcgaaagggttcttccttccatcatccatgaaaccctaaaagcagtggtagctcagtacaatgcaagccagctcattacccagagagaagtacgtatctcaacattctttttctacaacttttctgctcttttgtttctaatggtggactctgtttactctctcctctaggctgtgagcagagagatacgcaagattctgacagagcgggcttctaactttgacattgctcttgatgatgtctccatcacgactctgacattcggcaaagagttcaccgcagctatcgaggcaaaacaagttgctgctcaggaagctgaacgggctaagttcattgtggagaaagccgaacaagacaggagaagtgcggttatccgtgcgcaggtatagcattggtgatcttgattgcaaatctaatgacatgagattagtggttttggcctgaagcattagctctttttgaatctttgtgcagggagaagctaaaagtgctcagcttatcggacaagcaattgcgaacaatcaggcattcatcactctgagaaagattgaagctgcgagagagattgcacagaccattgcacaatctgctaacaaggtttacctgagctccaacgatctgttgcttaaccttcaagaaatgaacttggagcctaagaagtaaaagagaaggaacgagtaagtttcttcatttcatattcatttcatttaaaagatctctccgccttggaagtaaaggatgggttggtgtttgaccaaatgaccctttctcgtgactgattctgaaaatagtctttaagaggacatattgagagagacgcagattggctttggtcagtattattcatcattttcaatgaaactttttgttgatattttcctgtgtttccccggacaattgatgaagttgaatttaaaactcaataatattcatatgatctgatctatgccaatagttctttttagtatatgttacatacgacatgcttatataaatatccgaatataagatccgtaccaatcctttcataaaacttaaatataaatatttcttgttagcttgctattcaaattttcttttttccactagttgccaaccttatctacctataaggatttgtattggagagcagagaaaataaaatattgcatacgtataataagattttgtatgagcagagcaacatggaccctttgtatttaatgacgtcttgccggcgccaccatgatagagacgtctttttctttctttcaccggtgaggagttttatgggggtgacgaaactccggcgaattttccggtgacgtcaaattttaaaattttgaccaagtaaactcttatttcaatatttgtatataaccgacggctgctttttatgatgtcatgtataattaaaattagctggaaacgagtgatgaccgttaaccaagataataaaatgttttgagcaataaataattccaaaaaaataaaagcgttgtggattaacaaaagacggaacgacttgctgtttcgtaaagttaaagggagacgtcatgtcgttttgtcaccatg

SEQ ID NO: 27614 - DNA, 3000 bp, Unknown; identical to SEQ ID NO: 3440
  misc_feature (1)..( 3000): 2750-1469P.txt file - cDNA_ID_2991037; gDNA_ID_1620646; Annot_ID_163247

SEQ ID NO: 27615 - DNA, 3000 bp, Unknown; identical to SEQ ID NO: 3440
  misc_feature (1)..( 3000): 2750-1469P.txt file - cDNA_ID_2991037; gDNA_ID_2926179; Annot_ID_200089

SEQ ID NO: 27616 - DNA, 3000 bp, Unknown; identical to SEQ ID NO: 2440
  misc_feature (1)..( 3000): 2750-1469P.txt file - cDNA_ID_2991041; gDNA_ID_1620536; Annot_ID_159886

SEQ ID NO: 27617 - DNA, 3000 bp, Unknown
  misc_feature (1)..( 3000): 2750-1469P.txt file - cDNA_ID_2991045; gDNA_ID_2936554; Annot_ID_194149
tagatgttgttcttttatatattctagaaaaattgtagttatatggcaaattgccaataaggctgagttatctttgatattttcaaactgaactgagacatgatcagatggtggcaatatataaaatgccaagtcaacacgcaaacagtttttatatatttattcatacctttcatattgatataaattgataaatattttggtatatgggtttggggcatttatctagtaatagaaagaaaattcatgtaaattagggataacccactttttgatctctcggttccatagtaatgaggttttgtaaccataagattcttgcaactccattaagaacatgagtttattctttacagaaaaaacataaatgttagtgtttataaaaaacgacacataaatcgtaggaaaattgttctatgtaactatattttgttagatgtctacttttcaggtataattctgctttcctaaatgtgtgaattgtggggttttttttgttttttttttttctttttgagcaaaggtgtgaattgtggtttattggatcattttaaacaaagtttcttccttggattaggatggatacacgctagtgacgaaagtggaaaagtcgttttgcttcctctataacttgtgttagtactaacatgttaatatacataatatatcgtattaaactgtatttctaataacttcttgctacatattcatatgaataatatgatatatcatacactaatttatttaagacgatacaggaaaaaactttaacatgttttatctatgtttattgatatcgatgaaacgaaatagttaattatccacaaatatgcacatgctttcatttcgccgagatcaatatcattattgtcacatttttaccaacgtcataaccaccgtcgccgcatttttctcgagtataaaattttgatgaaaatataattttttaaaatattgtaaatatcttttaacttcattaatatatattccttccatttcataatataaactattttataaacttttttgttttacaatataagttgttttcaatttttttatgtaaattatatattattttaatatttttaaaagaaaaacttattttagtgctatttttgtcaatctcccatatttatattatgcattatcttttatgattggctgaacttttaagagtatatattaatatgtggttttttagctaaaacaacttgtattgaattataggaagtataatttgtagttcttctactaataatattcacttaattcactttttgacaatatgttgtactgaaaaatctatagctaaagaagaaaatctaaatctacctttctagtctcttttgattaaaaatagaaaatcctaggatcgatatgaactttttttattgaaatagacaataatatctcggtatgttgtacaaagtaatctctaaagaaaagacaaataaaacaaccctgataatcatattaaatacgtacgattgactgtatggatgttacagtttccttatgttccatttttattgtctctaaattgagatcagagaaaaactataggttgaagaaagggtaaactgtgatcagtaaacgataagcatcattaataaagaagattatctctttgattagcaacacgatttcttattaaatccaacatgataactatataatatatgggtactgtcatcagctgacaaattatgatgttgcttttggtgaaggaaaaggtcataagaaaaattgatttaatattgtatttatagttttagctcgtacttttggagtgcaacttattcagagtgtttgggattatttgtacacaaatttatacatacatatatatatatatatatataggctaatactgtaatacatgatggccaaatttccataaagtgggaatgcatgatatgcatctatgcatgagataagtggtagctcttttatagcaatatacccttttcagttttcattatacatcatacatgttactgttgtacatgcaacgtaaagtaatagcttatactcaaaacaagatattaagataatcgttaactttatgtctggaatttaatagctcagaaatcacggtatagcccattcaaatgggtaaatagatatatatatatatatatggtgaataagattaagatgacatgcatcattagtcattacatattataatacatatgttaatctgagtttagtgaaagacctaatccaagtttcatagatgagagagacaccaataaactttttgtgcatggaaaagttcttgaaaaagatacaaataaactctcttttttgtgtgtgtgcaccagatacaaataaactttagatgtacctttaagcggatgataataaagtttgatcacatatgttagttaccatgcactacatttccttgttcacacgcactacaccagccaataaacttacctaatcattttccaatcatttaattacattgtaagagaaaaaagaagaagggtgtttgattgtttgaacaatgggtggacaaagacaaaaaaaaactaactagtgtatactaataatacctaaccccatctattcaaacaaaacgcaataaaattattataaattgtaaacaaagggtgtgatcatatgtaaccatcgccttatggacaaataattatctattaaaatagtaatcaatcgaggtccctctcttaaatgataaggatataaagcattattttaaaacaagtagagattaaattgacatatgctcgcacgtcctcattcatacacaacccctcttcttctccaccttctctccattttctctttctctcatatctctctgtctacttctactcctctttctccatctgcaactcatatatttccaaaaagtgatcaagatcaacaaaatatccgaatcttgatccgacctttctttcttagcttaacttcttgtaaatatatataactatagtctatactctatagagcatatatataaacatg

SEQ ID NO: 27618 - DNA, 3003 bp, Unknown
  misc_feature (1)..( 3003): 2750-1469P.txt file - cDNA_ID_2991053; gDNA_ID_1972132; Annot_ID_179099
ctatatagttttcagtcattcaatcattcattgctcaactaaagatccgttttttggtgaaatgaaaatctaaccacgagggtattttcggtatttctcactgtgaagtatctagtttcttacaagttaattaacgactatgtatataaaataagttgacattgtgagctttgatatttagggtcgttgctaaattagcttggttggtacttgtgcaagacgtgatcctcgtattttcggaatgacgaaaataccatttgatccctaaccacgtgcttgaaaatacagcaaaaatgtggctcggttacccttaatttgggatattatttaaatcttcgaggattcctatatctcaagttgcatttatttatttagaggatggattttttcgttgatgaccaatagtttctctgctgagatggcgaaatatcattggttgtgatgaagattattcaaatagaaagcgatgtagatctagttggtggatctgatctgtccacttttatattattttttccttggtcctgatgattcgtgctttgcttcgttgttatctaatcataatatcttccaccaagcctggatgtgacttcccacacctaaccggtcaccggcctgaaccggaattcaactatccatattatccaaaaatccctctttatttacttacattatatggtttctaatattttggatgtgaatgtgaattatttttaaaaataattttcacgtaatgtcattataatatagtttactttgtaaatcagatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcaggtacaatttatttgtttccatgtgggattcctttttttttttcttcatgtgttattactataaacatgctactttagtcaaattatatgaaatttcaaaatttctagaaaaggacaaaaaaatgtaaaatatttgttttaggatagacataaaaaaaaaaattaactagtaaaggtaaatgcagcaaaactctttagtggccatacatttttgttggtggccaattcttaccgaatatttttatcactggttttgcagtatagtcttccttcagacacttcaatgaactacatggataacttcatgcagcttccagaagattctgtaccctgcaaaatccgggccaaacgcggctgcgccacccatcctagaagcatcgctgagcgggtcagttataaacactttttaatttatttagcgatggataattaattcactaaatttagcaacaaatttgatcgtccctaatcatgtagaccctattctttttgccatcctcctatcttaacctatacaatatgtttatattataggagaggagaacgagaataagtgggaagctaaagaagctacaagatcttgtccccaacatggataaggttactttatatcaaatatatatagtatatatggtaacatcattttgaaaaagtgttcattacctcacacacttgttgctgattttcttagcaaacaagctattcagacatgctggatttagctgtacaacacatcaaaggccttcagcatcaacttcaggttcccttatcttactttttctgtttaggtcagctgaatccatttccagagttctctctagttcatgatccatattgatacataaacacattttcatatacaaacgcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttatgttttgagtgtcgcctattttgtaaggattatgctatgaattctgaaactaattcgagttatgatcataagcaaagcaagctagcatccattatatatatgactttctaatttgatctctcttttctttatacttcttcataaatagttcctgaattgaatattgaaattaaaggtacgctaatttttcttatttttaaaattgaagaaatggaccaaataccaaagttacttgaaccaatgaaaacattaataagcagaattcacgtaccaaagaccaaagtgaatctcgttgatcatataatgaattatgatatatttagtagtagttagaaacatgcaaatagatataggttgatatgaaaattggcataaaatgtatgaaccggaatactattagtagcattaactttcctattattaacaaaactagcgtgtatgcacgttacagagaaagatttattctttattagagatgaaatttctttagttatacatacactttggttttgtaagttaaaaaaatataactccctcctacgttaccaagaagtccaccaacgtggtggattttaaaataactaaccaaaaacacaaatcagggaaaagtcgtaaattaaaactgataatttggaggaaaatatagaaaaagaaaaaggtaacgacattaaagaaggtgcacttaatgcgcagtatgtcctcttgtgccagcttgttgcaccgtcttccgtctcctcctctttccctctctctctctctccaaaccagtcctacttctctctctagaaacctagggaagaagaagaagacggtgaagcgagcgatg

SEQ ID NO: 27619 - DNA, 3003 bp, Unknown
  misc_feature (1)..( 3003): 2750-1469P.txt file - cDNA_ID_2991065; gDNA_ID_2213635; Annot_ID_132147
atctgtatatggagaaaatgaaacctttagagttttgtctatctaatcacaagttcagagaaataggcttgtattttggaattgtacagaagataagctctcagtagcaaacaatccaaactttgatcagtcacattacttataaaacgatctttgtgtatggtaaaaaagattataagtttaaatcaacccgcagcttggaaatctccaaagtcatcatctggtgcatcttcaacccctccatctttggcttttaggtcttctttcttctcttcttcttcttcttctcgctttgtatctaaatcttgttgttcagacgatctttggaggctgaggcttggcggcagacttgacggggacttctgagcagttgtgacaggggaaagcggtcccggaggtggaggtggcaggatgattgaaggaatggtggtttctattgacttgcctttatcctccaacgagagattgcccagactcttctctaccgtttttgacttgctgtctttatcgcttctctgtttcaatcattttgatgtgaaaaacaaaaagaaaccttgtgggaaatgtatccagacaataactgtaaatcttacatttttgagttggagaacaatggtttctccttcctttaagctgtaatcaacggatgaagtgttctgatagtgttgttccatttcttctgctgttttcttcttgttcaaatacctttagcaaagagagagaaagagagggtggtcagattcaaacatgatttagtttttcgaaagaacacttagaaatctggaagtggaatgttacttcatatggtcatgtagtgctgcttggaaatcatatgcttctgttctttcccggaatccgagtccgataaaagcatgtcgaacacgaccatctgcattgcatcaaagaactaaactcaaataacaactacaagttaacatctctatatctatatggaaagtacgtacctatcttttcttcaacacggagaacaaaatatcttcaagacaaaacagattattttttgttagactagctgcacatcatgagaagagcaagttaagttatgtggtcaactttttgttacctgctactgtcgattactgcttctacaggatgaagttccccctctcttagaaatgcctgagcgtaaagttcccctgtggttttatctactagttttataatgcattcttctcctttgctcaccactttcaaagctccttcccatgcccatttgttcacgtcccactcatctgctctgcaaggataaaatttatacaaaaaaagtatcagctgatgtctatctccatcttccaatggattacttgatgcactttttcaagtatcttttaccaaagaagccaagttgagttgatacaaagcgaatgtaactagataatgaccatcttgatgcaaattaaggttaagctaccattcatagtcatacatacttcacgattggttcaataagattcgttccgagtttctgatcatttgctaagccgaagggtttatcgggaaaaggggttttgtaaaaatctcctaactacatatatcagaatgactgtttctatcataaaggtaagaaagaacctgtacgaagctgcggttttccttggaggtatctgcatacacaaacaaaaagacaatgaagaggttactttgcctagcatccccgtaaagtaacagacacagaagaaagcataaacgataaaataacattgatacatcaagctccaatgttgtccattacgaatgagaattttatagttaaacctaaataacaacagttcacaatgtctatgatttcatcaaggtagccaatttggaatctcatacatcctataacacaatgaccatgtaacaatttcacgagtatctcaaaagctagtatgatttcagagagaccccatcaagatatcacttagcatgatattggttaaaattaatgtactcttttatcacaagccttgaatctatcatacgaaatctccttgaaaagatttttcgctgatagttacatgtgcaatcgatcaccattgcaaatccaaacaaaatttcgagtgatcaagactcaacgtcaagttttcaacatatgcaaattaagacaacttcctcaataccattgcaagaaatctataacaccagattgaatttacgttataactaattatcagatccaaaacatctcctaaaatcaccaagtgaacttgcaaagaaaggatgtaacttgagcataaaagacacaaaactcatcaaaaattataaaatcacatctcatgataagccaagaaaagttaccaaataaacatagcattcaggcacttggaacagagcaatctctatagcttctctctcctcgttatcatcgacattcacaggatcagtggaagacttcttgtcttcctccatagtcgaagaagacgaagcttgatccatctcagaaacaaagaatttaacttggagaaaaacccagatgagactaatcgatcaaacaaacccgtaaatcttaaatgttaagtctttcccgaactgtgattacaacaatctcacgagtcgcgaagacgaagaaacgtagaggtttcgcgttaggtgtgtgtagtgtataccattacttcaatctgagctacttcaaaaccatcagatctaagctacctctgttaaatctgaaccgtctattacgttgactttgaaaccctgatatagactagacacctatgtatcctccaccgctgggaagtcaacattgaagcagttgatggaccaacaccaaccaatagaaagaacgtccacatttactttaatgggccttttaaactaataggcctaggcccattataaatacatggatttgttttattttatttttctcatatctgtctcttggtggtgatgagtaggtaaactgtgtgcgcttattaacttctctcacactgactctgcgaccctaatttgtgagctctcttctctttgcgcagtcaatttgctacaacttagaaaatg

SEQ ID NO: 27620 - DNA, 3003 bp, Unknown; identical to SEQ ID NO: 27619
  misc_feature (1)..( 3003): 2750-1469P.txt file - cDNA_ID_2991065; gDNA_ID_2213635; Annot_ID_181017

SEQ ID NO: 27621 - DNA, 3000 bp, Unknown; identical to SEQ ID NO: 8339
  misc_feature (1)..( 3000): 2750-1469P.txt file - cDNA_ID_2991072; gDNA_ID_2926195; Annot_ID_141242

SEQ ID NO: 27622 - DNA, 3000 bp, Unknown; identical to SEQ ID NO: 13909
  misc_feature (1)..( 3000): 2750-1469P.txt file - cDNA_ID_2991074; gDNA_ID_2214667; Annot_ID_189039

SEQ ID NO: 27623 - DNA, 3000 bp, Unknown; identical to SEQ ID NO: 14369
  misc_feature (1)..( 3000): 2750-1469P.txt file - cDNA_ID_2991077; gDNA_ID_2684112; Annot_ID_190665

SEQ ID NO: 27624 - DNA, 3000 bp, Unknown; identical to SEQ ID NO: 12961
  misc_feature (1)..( 3000): 2750-1469P.txt file - cDNA_ID_2991081; gDNA_ID_2214583; Annot_ID_186554

SEQ ID NO: 27625 - DNA, 3003 bp, Unknown
  misc_feature (1)..( 3003): 2750-1469P.txt file - cDNA_ID_2991085; gDNA_ID_1620771; Annot_ID_167550
tctgctttttctttacctttattactgttccccggcagcacaaaggagttatgatcacctcgtaaaggagaacaaccattacttgtgcgcaactctcttatatcttcagatggttggtatctcgatgcagcaacatgaacatgtccgttacgctgattcagatttaaaaccggatttttctctacacgaggcgcacatggatcagtggagatggatttccctttatccttctcaacaacagttctcctaaacaaagcattgcctacagaagcacgagggcgatgtccactctcagttcgtgtatcagaactttcccggttgtccccaatttcagggactggtctggctcttccgtgaagatgatgattacggtattcctctctttgatatcttaatggtgctactggagaatgtggccttctcttaacctctctatggtgtaccgatctatctggagtatcaggtatgattaccatgtcaatatcagaattctccatcctgaaacaattaaacaagaaagaaactgaagcaatgcacacatgatgttatatattagcaatagatttttctgattagagagatttaaattcgtgttttgagactttcgaaaacataaaccctaaattataacttaacacaatttccccaaaggttaagatcacaaaagtggcaatcaacaacaacaacgacaaagattgacatgccttaataatcatctaaaactgaggatcagactagtgaaaattcatgggcatttcagatacaccaaaatgagaacagatattcctctccagaaacaattatcgtagaggagaaatctatcacaaatacaaatacgaaaggacagaataaattacccgattgaatttgattcaaatgtgggaatcgaaaccctagttgttcgatgagaagcaactgcatcgaacaatctatctcctcttgctcgggtgcaacgattggacctcagattattccgggtcgggtaagggattactgggtcgggttctgggtccaatattaatgatgttggcttagacaattatattgggctaagatccaataataatgggccttttaaaaacagggcctctttttatttaaattggctttcacaatttaaaactgcaatcaaatgcttagtcaaagtttaaacagagaagttagacagaatcagaaacccaaaccaacaagacaaatagttcgtgaaagttttgattatagcaaaatccaaaacgtgcatttattcactagctctttttacaaatggttcctctattttttgccaactttactaatttaaaaaatggattttcaaaaatcaaaaaccaaaaccattctagatctacaaaaaaatcaaggccttaaagtgtcttgaattttgaattaagaacacttaatagttgaaacttatcgttgtcgcagatgattacaaaacgatcatgaatttagtcgtttttttccgctcctacgatacaaaaatgacatatagtatagctatgttttccaaattttaaaagtcaaactcttctaatttttaataattctaaatttctattcactttttaataacactaaatatagttcttatttcgacgcattacgtttcctagaaatatttaaaatttcagctgaaaataaacaaatgcaaactgatgttaacaatatgattacttaatattaggttgaaacttgaaattcatggcattgtttccatttcaacgataaatatacttttctaagtctaattattttaaatttaatacctaaaatttttcgaaatcaatatagtcacatagaacgctctcatcacgtaactttgacaaataagtataggacaacgtacttgttagggatttgtttaatagcaaaactatgaaaacaaaaacatagtacaataatcatttattgggataatcaagtcaccaattgcctcaaaaccaattattttggcggtttcttaatgatttattcgagaaaatatcctctctcttttttcctacattttggctttttctgcattcaatttttttaaaaaaaacattactcttcgttgggtatataaaacaacaattcaccaaactaattactactagtacttgttttgttttaaataatgctattttttttctgtgacttttattttcaaatctgactatttaataatttcatttactacaataattatatgaattatttattgtcgtaatattttttaacggttatcgtatctaaaatagttattcccagaatccatgtaagcttctcgaccggactttgaaccttccccattggacacagccaaaaggaaccgtgtccatcttcggttcctctccctctgaaaacttattcctttcttttcaacttcctagtcttcttacttcacatatcatctctctttgtttagatctcttcttcccacgattacaaaatcctgtccggtgggttttccccgatcggggtcggatctgattcctcggaagcaacgaatctcgaggcttctttttggttttggctttcggggaaaggctggaatcatttctctttacggagattaaacataaagttccttacttcagctgattagcttcattcgtgcttggtctgctccttcttgatctgggtttacaaacaaatttccttttttggcaaattatttctgtgtttggggtttcgaatttcgatctgctctcgggtgttttagtgattgaatttcgattcgtactgtcttatatctgttcaaagttgtcggctttactctaggcatttggggattttgcttgggttttgggttttatctccaatttttcagatttgtttactctaatcatatatcggagagttgcaattaggtttttatgaattggaggaaatttgcaatcttttgtgtttcccagttgagagggttttaggttttaagatgatggaacttgagttgtgtttctccttgtgaaagattgagtctttgtaaagcttttgtttgttatatccaacttctgagatatg

SEQ ID NO: 27626 - DNA, 3003 bp, Unknown
  misc_feature (1)..( 3003): 2750-1469P.txt file - cDNA_ID_2991120; gDNA_ID_2926274; Annot_ID_143521
ctttaatggcaatcgaaatcttcaattttttacgatacgattgattctatactgcagatgatttttccagttttggctcattccttgtcataaatctcgtcaaaattctttaccttgtcgtcttatttttttccattgataatgcttttctctcagaatgatggaggccaaaccaaaaaggaggattgttacagagaatggagatacaggtgaagatttagttcttgcaacattgattggaaacggtgatgatgtaggtcctctcgttaggcatgctttcgaaatggggaggcctgagcctctcgttcatcagctcaaaaatgtggcgaggaagaaggaagctgaaattgaggatctatgcaagactcactatgaagaatttattgttgcagttgatgagcttcgtggtgtgttagttgacgctgaagagcttaagagtgatcttgcaagtgacaatttccgtttgcaagaggttggtagtgccttattggttaaactggaagagcttctcgagtcttatgcagtcaagaagaatgtaaccgaagctattaaaatgtcgaagatctgcgttcaagcactggagttgtgtgttaaatgtaatagttacatatctgaaggacagttttaccatgccctgaaaaccatggatttgattgagaagagttacctgaagcttatcccacttaaggttctaaagttggttatagagagaagaattccagtgatcaagactcacattgagaaaaaagtgtgtagccaatttaatgaatggcttgttcacattaggagttcctctaaaaatattggacagactgctattggcctcaccgcttcagctcgccagagggaagaagaaatgctggaacgtcagaggagagcagaggaacagaatacaggtggtttgggagaattggcatacactttagatgttgaagactcggaacaagactctgtattgaagtttgatctgacacctctgtatcgagcttatcacatccacactattcttggagtcccagaacggttccgtgactattactatgagaataggctactacagctccaatcagatctgcagatcacttatacacagccatttgtggaatcataccaaacatttctagcccaggttgcaggatatttcattgtggaggatcgggtgattaggacagctggagatttcttgttggctgatcaagttgagacaatgtgggaaacagccatttccaaaattgtagccatattggagaaccaatttgccagaatggattcgcctactcatctgcttttggtgaaagattatgtaactctccttggcacaacccttagacagtacggttatgaagtgggtccagttcttgatgcccttgacaagagccgagataaataccacgagcttcttcttgaagagtgtcgaaagcaaattgtgactgctattacagaggacacttatcagcagatggtaatcaagaaggaagctgactatgaaaacaatgtcttgtcgtttaatcttcagacctcagacattatgccggctttcacttacattgcgcccttctcttctatggtgccagatgtttgccgcatcatcaggtcatacataaaaggatctgttgattacttgtcctatggagtgaacactaattttttcagtgttctgaggaagtacctcgacaaaatcttgattgatgtattgaacgaagttatcctcgagacgattagcaacaattcaattggtgtatctcaagctatgcagattgcagcaaacatatctttcctcgaaaaggccagtgattattttctccgacatgcagctcaactttgtggcatcccaagccgatcagttgagaggcctcaagctagtttagctgcaaaggttgtcctcaaaacatcaagagacgcagcctatcttgctttgttgaatgtggttaacaccaagttggacgagttcatgaagctcacagaaaatgttaactggactacagaggaaatgccacaagggccgcacgagtacataaacgaggttgttatatacctcgagactgttatgtcaacggcacaacagatcctcccaatggatgccttatacaaagttggagttggggctatcgaacatatctcaaactccatcgtctctacattcctcagcgatagcatcaagagattcaatgctaatgcagtctcggccattaaccacgatctgagagtgatagaaaactttgctgatgagagatatcactcaagcgggttaaatgagatctacaaagaaggaagctttagaagctatctggttgaagctaggcagttgataaacctgttgtcgagtagccaacccgagaacttcatgaacccggtgattagagagaggaactacaacactttggattacaagaaagtggctacgatctgcgagaagtttaaggattctgcagacgggatattcggaagcctggctaatagaaacacaaagctgacagccaagaagaaatcgatggacatgctcaagaagagactcaaggaatttaactgattctcaataaacactagtaggtcctgaccttcccactcacatcatcatcatcgtcatcattatcctttagctttactattcccttaatttgcttcttctggttaacctctaatcttgtttatgtctttcttcttcttttctctgtttttgttctatgatccaattcattaatcaatttcagttttgtcctaatcgacaaaattcatctttatggctcacaggctcaggattaatctttagtgtagaatgaattgataatctaagttaaagagcttctagcttttagattcaaattattgatgaaagttgcacaacaagcctggattgggaggatatttacgtattttctctatctgtgtggaccggagactccatttgtcttccaagtcaccttatccaaagtgtcaccaaaacctgaaaactttcaacctcaaaaaatccaaacttgagctttgtattccgacaaaaaaatg

SEQ ID NO: 27627 - DNA, 3003 bp, Unknown; identical to SEQ ID NO: 27626
  misc_feature (1)..( 3003): 2750-1469P.txt file - cDNA_ID_2991120; gDNA_ID_2926274; Annot_ID_205269

SEQ ID NO: 27628 - DNA, 3003 bp, Unknown
  misc_feature (1)..( 3003): 2750-1469P.txt file - cDNA_ID_2991125; gDNA_ID_2213619; Annot_ID_180908
caatctccattcgttgttggattgattgttattaatttcctctttggtctctccctaatttggatccttaatatatatatagacagaaaattgtttttttttgtgtgtgtgtgtagttgttgttccagagtagagaagaggaaaacagaaagtaaaacaaaaaccaaaaaggagttgactttggaaattggacagagagattttgttgagttattatataatgggattgaaaaatctcagatttaacaaacggacatttgcggtggtgggaaaggatattccttaagatccatgttccgatgccgaatttaatacaaacaagttaggtcacatcgtgcttccgtaatctatagcagactttcccattggtgtcaatctcgttgtttaaaaaaaaaagtaatattagaaaagattgaacgtaatctgaatattaagaaaaaggataaatatgaaaagatatgatgtaaatatgtaatcgatgcatactcttaattatgcaatgtaattctttttttgtgacattaatacattatatatcctttatcttataaaacacaagtcacttggcaaatcatgttttgacatgtggcaaatttatcaaaaacaaaatccacaatgtaaaacaaaaatgaatttttcgacaaaactcaaaataaaattaaatgtgaaaacagtgtacaaaattaaaacattatcgtcaattttcccacgatcactctcaaaagaaaataaaaatcaacccacatattctccatactcccacaatttctttttcttctattcaaactatgtaactcttttttttcaattaaaacattcaaactaactattgggaaacaaagacagatacgatctcaaacctatatatacaaatctcggtatcatctttctattgttgatattggtttttaaaagaaggttgagagtaaaatcatttaggagcgagaccttctttgtaacaagagtcttcaatctctaatcagttcatataaggcaatatggccagcgtatgttatatttcttttattttattgattgcgtttagatgagtatattaatgctttctgtttttgaattatcttttattatgtatgtttaatatctttttgcttcatagatcaaccactaaaaataaacaagcaaacttgatcgatagaggataaaacacaaacaaagtagaagacttgagcaagaaaaacaccaatggcaaagtagtaggaggttgaagacgaagtagaagtgtacaacattaagacataaatgatatcatctatgtattgagtcaacttcactctggtaacttttttttgtctatgactataatctatgtttgtattgagtctttgaataccatatgtaattttttattttatagcttttgtatgtattctagaaagcattgaagttggaagctaattctctatatttggaagactaataattttgtgatatcaacttcaattctccattatatatcaaattatcatctgaaaaaataaaatccacaaatacatgaaacgatatatttttccctacacgattatatactaatctatttataaaattaatttttcatgtataaatatcgataatatgtaacatatcataacatttaaattcaaaaaaagaatgtatcataacattaattttcggtgctatgcaccgggtataatactagttacaaataaagtataaaaggaattaaacttttatatagataattaacacaaacaaaatattagagacgatttcaaataaattatgaggatatagatgagaaaaatactatatagaataacaatagtaagaaattaaaaataaataaatcaatttgtacatataaattagaaagaaaaatatagataaataattaaacaatattaatagtatcacataggtcaattaaaattttatatacaatagttaaagagtattatatctcaaaactaagttttgatactgcgtagaacaaatcatgtttcaagcaaaaatgatcaaattcctatgatgctggaaatgcttgacgatccacatgagactggctatgtgcatgtatggagaaaaacgtgttgttcgacaacgcgtgcatgccttcttccacctaagtgacgacgcatcacaaaaagttatctagtagtgttaatagttcatgttccatctgccgaaattacacacaatataacgtattcgattatttgttatccaacaacttaaacgattcgaccaactcactcaaccttttgtcactagttccagtcatatatttcttataaatactcgttcactacatctgtacagatcgaaagaatctcttgatatattacaacacacccataattcataaagactagctcatatacctttgatatatgagatttgatctatatgtcgttctccttaactagatatcgctaattgggcttgcattcaacaagcaacatatatcgcttattacattcgacgatactcagcttctacatcttaagtctctctttttttctgagctcaccatcaagtataagaacacaattctacctcttatttgtctactcccaattttttgtttttggtttttcactattctgacatcttatcgtattatgattaacgttaagaatgtcgtctcgaaaatcacctacctagctattgtttcaagattcgactcccatgcgcgtcccatcaagaacaaaccatccagaagcatcaacctccaactattagagaataatgtcccattcgcccctcgctggtcaaatcgcttccatttgattcacataagtccaacaacaacgatgatctctggtgtactactaccaaaactcaaccttgagacagattctcaaaatactatatgttctattaactattttaacttgaatcaagttgataattgtagagagaaattttttgttcacttcttattaatttgtaaaacatttattttaaaacccattaccgttaagctttgatacaatgatacatgttattttctgattaaaaatg

SEQ ID NO: 27629 - DNA, 2661 bp, Unknown
  misc_feature (1)..( 2661): 2750-1469P.txt file - cDNA_ID_2991137; gDNA_ID_2926296; Annot_ID_143684
aaatacaaattgataaataagttttttttttagaggaccataccttttggaaagttcacaaaataccacaaataaagagttttttaaaagtaaaatttatttatggctgactttaaaaatacaatcacattgatggtcattatgatacattgtttctttagacattcaaataaaaataaaaatatattttttttatgaaattttgataatgaaaatgatatcagataattaaatgaaagatttttttactctaaattgtggcttgtaattagtataacatatatacatatgttttactgcatcatcatatgtttgcttcttagagacttgaatccaaaaaataaattctcaattaataactatattaatgtgataattaatttattttcatttaaaatattaggtattgcatattatattaataagctaagttatggtgtattgatgcttgtttgttttccaatcaaaaatatactttttgaacagttttcagttttcacacacacacacacacacataaaaagacattttaagtgatgatttattgtttacattgctaattgtattgataagataagttatggtcaattcactattcattatttacatgcatggatatatatgattttaaatgtgtaatatagaaaaattaatgtctttatgtatgttatttttatgaatgggaaatccttatatatcttatatatagtttaaaaatttagttgttgtaagtttttaaatttaatgaaaataaaacaaaagaaaaatagaaaaaaatatgtataatttaatattaaagaaaaccatttaaaaagtaggtaaaaaaactaaagctatactaatgtttattgttttaacaagcataactggtttttcttcaattattcgccttagaaaccgttttggggaaatcaaaagcaaaacatgaatctaatattgtttcaactacaaccgagtatgtaacgtaatccaccaataaagaatattaaataaattaacaaaatgatctaaattacaaataagttcatacacattatgacccaaacaatgatgttgtgaacatatattcgatatcgaatataaaagaacataattaagactaaaatgtgtaagaaatttaaaacaaaaaatgaaagaattgacctaaatcgtagggctttgaagactcatatcctgaacttattcatcacctagacaacctacttcttttttttacagccaactcttccccttcataccaacgcaatatcttactcatcatcgtgtaatatggtcatatattcactactcccaacactgcaacacatggtatctaataggctataagcagtttgaaaaccatgtggatgaaaaacctttcaaccacaaaataaaataaccaaaggtgatataaacatcaaatttaattgtaaatatacattcaaaatcaaaaataaaacaatttgtgtagtatgatgtgacataagtaaaatgtttactatttactatttataatagaagaaggtggagtaattaattttgtaaattaaacatgcttgtacacactaatttagagtaaatgcaattaccaaaattaaggatttaaagggttttagtcatttatatgcatcatagttgggtaatacaaaccaaattgaacaatagaaacgtccactaatttattattgataattaatagcataagtttcaactgagccaaaaagtaaaaagtaaaacggttattaaataaaagtattggacatcaatcttataatgtgtatgtttaaatgatgaattttgtagtcaaataagtttcgtatatctttatttttttcttttaattatattaagaaaataaagatctaaataataaaaaatgtatcaaaataatgaaaatatttttgcccaaaaaaataataatgaaaaatataattgtgtaaattgtctttgttaaagtcaatgcatttaaatttattaattgttataaataaatagattggactaaaatttaaaaagtgacaaatgtcgaaagaattattttgtaatcacacagctttatatattttattttttgctttaaataatattagcaaaataaatatctatataatgaaaaatgttttgcccaaaaactaagaataatgtatacgatgtaaattgtcttattaaaatcaatgcatttaaatttattaattgcgataataaatagattggactaaaaattttaaaatgacaaatgtcgaaagaatagaatgccaagtaaccatttatcagagataattttggagaaaccttactttattatataagataagattcacatatttagcaaaaagaaagaaagaagaaaaaagtaaacacaatacaagatattgagatatcatcatcacaaagaatccaattaaaaatcagtgtcacttattacaaaccacaagatcttcaactgccagatggcaccaccacagccactaccaatcttctattaggaccaaggaaatcttcgaaatctcgattaaactctctcaaccaatcagaattcactgacatgtacatttgataaccctctaacatgaacgccttctctgttataaaaccatattggtttcaccatctcatccataactcacactctctcttatctcctttcctttcattgtagttaacgaaaagattacgataatg

SEQ ID NO: 27630 - DNA, 2661 bp, Unknown; identical to SEQ ID NO: 27629
  misc_feature (1)..( 2661): 2750-1469P.txt file - cDNA_ID_2991137; gDNA_ID_2926296; Annot_ID_205567

SEQ ID NO: 27631 - DNA, 3003 bp, Unknown
  misc_feature (1)..( 3003): 2750-1469P.txt file - cDNA_ID_2991145; gDNA_ID_2096292; Annot_ID_195438
catcatatacatatgcagcaaaattctcacaaaaagaagtgtatgatcaatagaaggaattaatttacatggtaatgtatgatcatacaattatataaacaattatttaactgtttttaaacatttatacacaaagtacaatacattacggaatacataataataatatacttctttttgtttaaaatatgttgttaattattttgttattaatgtgttgttgaataattaagatatatataaagttttgtttgctgcgatatgataagtttccctttgaggggaaaatgttattcttcaaaaacaaaatgaatttatcgaccgttttttgttttttgctagcttatatgggaaaataagtaaataaccataaatgaattaataccctatgataatggcaaaggtaaagttgatatagtgctaatgtttctttttcttggtaaataatacattgacatatagtaagaatggttaacacataatgcaagatttgtagctgatatgtagattatctaacaaatcatataggaaaaagatgatatttagagagaagacgtacctgcatgttattgtacctattgaatgttttgctgcaaatagagcaagcaaattgcattggaccgacatgaatctgagccggacttggtatccaaaacctcttcccacatacttccacatcagaatcaattatctcctcatcaaacttcatcttcctcctcttcttcatcatcaccacaccatcttctattatctctctcttgatgggtttcttctgatgatcgaaagttatatcagagccatcctccgagctaccacggtggtatttaggaaatccgatttggagggtaaccacatcatccttattctcttctttgatatccgaggcttgactattattttccatgagcttgtttagaagaggcaagcattgaatagacgtgttgagtggttcttgtggttggtacaagaatagagatcgttccaacatgttcatctgactctggtggtgatttgatcttgatatagcatctcttgtcttcccacgatataacacagatttagaagaagtagtagaagattgaggtttaagccattcaataaagcttggggattcgaaacttaagcctttcgtctcataagaattcatctctcgctttctctcctctctttcactctccctctctctctctctctctacctccacacgaagaagggtaagactagtagtatgaaaagtttatatattaatatcaacctacctggtgtgtatcgtagccgttcgtcaaaataggttctctctttatttttctccaatacaaaatcttcttctttaaagttttgttttcttttcctcctaccccccaaaacgtatagtgcagaaatgtcgcacgtgtctgtctacgcgtttacatcaagaggaaaagagtgaaattttcttcacaaaaatgtggtgggtcttacttcacatagtgaaaaggaaacgcacaagcgcaaggcttttcaatgaaagagaatcctaagaatcatagtctttttttttttcttctttaccctcatttcctttcccattattaaaattttgtaacatcttaaaccaacaaatacgatatcctttcatcatattatagtcatgattgtcatttaagtgcatatagaccggcgaagacaaaattcatcattacatatcaaaacaacaattccaacatcattttagccgtctttttagggacaaatgataaaaaaaggtaaattgttataaaatcacgcgttcacttttattgacgttggatgatccaagtagcagattacacgatattgatgatacatacactgtttttcatacgcaagacttttctagctagtactctaatccatgatttgcactttatttaaagatatatgaaaatatttattagctttggaaatgagttcactgatattctttgatgcatgattgggttcacgggtctatagttgatatggcagcccacacacgtatatgtttgcaaatggtactatagaaaactgaatccaaaaagtgtgaaactactttggttgtatttcattcccgttttaaatctgtcgaagctatattcattcagaagtaataaagcttaacattaatccaaaaagcagtcgcattagacattcccatcctcacggtagcgttagaaagactggaatggagcacaacaagcagatgagatgacctacacgaaggagtacgttgacccaaaaactgtaatgaatttacgttaatttttgtgttatagacgaggttttaggacgttgtaagattttgaatacaaagaggtagtggagttttgacccattaagcacaagatttttcttagaaaacaaaaaggttaccgcaagtaagtcaatacctgaagaataaaatacttgaaagaaaaacctaagaagagtgagtattcattttaagacgaaaatagaagctgattcaatgtatgtgtcatgttgtggtggaccctaaaacaatattaaccgcgcaaaatttccgaatggtagtatagctaaccgttgaaccgtatgctactatgctttcattcactaaagaattatggtttacgtcccatgcggttcaaacacggtatatacatatctggtcatattttgtgaaaccgggtttgaacaactcaccaatacaatagtactacaattcaaattaaatttttctttttgtaattaaacttcattttggtataattaaagaaaaaaaatgtttccttttgttgaccgatacaatgactgtatattcaaaaaattacttttagacatccaaattatattttcatctatcaattacaatattatgaaaattatatatttacagatgctaaatcaaaaacggtacgtttcaccttaaaccctaaccctccgaatgagctagagagacaccagcccttctattaaaagttaaaacccttccctctttacttctccgatagctttttattttcctcgtttttgcgccgaccaatg

SEQ ID NO: 27632 - DNA, 1189 bp, Unknown; identical to SEQ ID NO: 8
  misc_feature (1)..( 1189): 2750-1469P.txt file - cDNA_ID_2991145; gDNA_ID_371; Annot_ID_144333

SEQ ID NO: 27633 - DNA, 3003 bp, Unknown
  misc_feature (1)..( 3003): 2750-1469P.txt file - cDNA_ID_2991164; gDNA_ID_1620617; Annot_ID_46915
gactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcaggtaatcagtttctgatgcatactgttgtgttttcataaagtactaatgagctgcatgatgattgttttattgctatgggctggtcaatctctataatctgaaataaatgttattatctgttttcgataatctaggtgggtttattaaataattgtggtggttctatccatatatgcttaatttgtcttacctttgtgctcttgttgtgtacctatacagtctgttgatggtcagcacattatccttcacactttgaatgtgaagtgccttctgcatcactatggaagctatgactttcttccaccaaggtaagattccaggtcgtttatgcatcacaattctcatttttcaaagactatggaataagttccaatgggatcttcttcgttatctaatcatttctgcatgtatttgggatgctgattcaaagtgtgatatatggcacttttcgttgattaatcaagaaccgttcgtataaagatccaactcttatttagtatgaaaatcagaacggacaatacattcaagtaaaaacggttcagtacaagatgttatcatctctagtttgttgttctaatagacttctgattttgatccattaaacggcagattgagtggaaagatactggaaatggaaaccattacccaatcagaagcgataaggagacgctaccgctttttaagtcatttttctttatcaactacacttcaggtatattttctctttgttgctcctatcttctgcatgtgttgctatatcttgacattttctcatgaggttatccttggtttggtaatcttttcagatatgtgagattgatatgaaggaatccttgcctcctgatgcatttgctccatttatacatgaaattaagaagcgtgagaagcagcggaaagaacgtgcttggaaggtattctcgttctaaccataaaacacaaccccacggtctacttcatctaatatctttcagattccaactcctattggctttgtttgctttgtgtcttattctcctatgtattcctttgtttaaggaaaaatcaggacttaagatcatatgatgttcatatttcaggatcgaaaaaataaaatcaaagctgaagtagctgcagctgcagagcttgtaccattgatggccagttttgggcagtcgtcttctagtgatgactttcccccattttccttggatgactttgaaggtaaacaagaggaatctctcgtctcgtaattggattttaggtttattgatctaataagaagcttttgttgtgtctctcttaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtaaccactgtttttagctctgcaaattctaaataggattctcggatgacctctaaacatggtttcaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtgtaaaactcaaacttgggctttgtttctttttgcaacccatgtgactgataatgaaggtgtctctcattactactagtctactatgccatttaggacaattattgagactcaatcatatgatcctcttgactcagagaactagaaaaaaaaagattggataaaatttcttccaagagtgattttcattctcacatgttacaacaaagcatgaaccttatcctttaaaaaatatcttcttccttttgttcaaacttttatcttctttgtcatagaaagtttggaccactgattttagtccgttggattatcaattattgacctcaataatatcaaaatttacttcaatgagaataagattacaattttttatttttttttgaacaccaacaaatctgcttcttctctggctataaataaagcataaactgttccaaaaacagaaccaaaaaatatctaaaatcactaaacctatcttcttaaccaaaagatcaatagattacaaaaatg

SEQ ID NO: 27634 - DNA, 3003 bp, Unknown; identical to SEQ ID NO: 27633
  misc_feature (1)..( 3003): 2750-1469P.txt file - cDNA_ID_2991164; gDNA_ID_1620617; Annot_ID_162083

SEQ ID NO: 27635 - DNA, 3003 bp, Unknown
  misc_feature (1)..( 3003): 2750-1469P.txt file - cDNA_ID_2991166; gDNA_ID_2926232; Annot_ID_142697
gggacttttgcatcataacatgactagtaagtacagcttcgacttctcggatggaggcaaagtcagaagattcaaagagattttggttggattctttgtgcaagtggtgatgctttacctgttgatgtagaagtgagaggtactgtctctgtttcctctgcttcttctttctttggaattagatcatttgtttggttgatgattggcttaggttatgataggttacggctatgtttgcagatattttgagactatcatttggtatgtggtaaacttcatgaacaactatgagtgtcttgatacaagaaaaactcttatctgtgatgattatagctcagggaatggcattttgggtctcacacatagaaactatagaagctgaagcaatagtgtagtgtgtgtgaatactgaaattgattgatgacatgtctgttcaatcgtttttaacagtaatcaggtgtataaaagagtcaaggtacattgaagatggagaagtagcaggacaccaagaatcatttgacatggcagcatgacccaataagcaagatcgttctcatcctttaccatgtcttgtgatctttgcttgtgttttgctatgtattgatgatttttgaacagactccaaaaatcctgtcttgtgtcagtttttaggtagatcatatggatggaccaatagtgcattcattacattttttttccaacatagctcttttgccacatatatggatctttgtgaatatctcttacgagttacgacctcttcaactgaatctcgctttctgatgcccaaaaatcagaaagttacaatgggtttgtgcacaaaactctactatagcgctatactgctattagttataccatactagatataataagtcaacgtcaatggtcagagaatcaatatccttagttgctctattaataagtatgtactaccagttccataagatcttcgacgaaccttacaaaatctggtatgtaatgtgaacttccttaaacatagttcaaatagaaaccaaattccataaatcaactaatacgttaaatgtgaatgcattttacatttttcctgggttacgttagccaacactactacaagagttgatcaacattataaaacctagattgaatagtcaaggcacgaaacttgtgcgtcttaccaaacaacattagtattaatttaaaatgtttgggaaaaacaaaagattcaagtattcaacctttgacatacacaaacaaaattgaatttatacgaaaaaaaaaaaacaatttcgtatgaaactcaatgaagaaagtttcattcaaaacataatgaagaaagtttcaaaatccacatctgatatgtgaagattgacgtatatttgatttgtggtttctatttctaatttgccatttcaataaaacgattggatatgcaaggataagtttgacttcaacatcttgcttcggtccggaccattttccatttctttttctcagaggtaaactagaatagttcttgaaagttatcataatataatagtaataataaaagtaaaagattgagacgttggcgggatgaaattcgtataaatagagatgtctataggtgaataacacaaacacatcttgttctttttgaagataaacggaaaaaaaaaatggttatacacaaatcaattaccccaatcgctctgatgttactattactactagcgatccatgcacatattcaagtcgttggttcaaccactgtaacctctgtctcactagccaatctgaaacatgaaacgtcttctgagatcaattttccagtttggcgtcgggagcttcgcggtggcggaggaggaggccgtggtggcggtggaggtcatggtggaggaggtggtgaggattttggtaacggatgtagaagcgatgttctacaaagtttcttgttcatggtttttataagttattggcttttagtgtaatataactgaatattgtatatagattttgattatgttttcagtgttactgtttgatttgctgtaatattggtttcactttttctttcatatccttttgtattgtgtattagggtttattctgtgtcttgcacggacgtttgtggattttattgttatatttgtcaatgcttatttaatatgtaaaattatgtaataaactaaaattatttatggtaaaccaaatagcttttttgtgtttagtagggattctagatctttctcaaagttttgaatttaaagatctcttggttcaaatccattgtggaaaggtttatgataaatgttggtaaagttatagccgtatgagaggctattgagagctattagccattaatcaaactaatgaaaatcaatttacaataaccaaaaactgaacaaatgatttttttttctaagttaacaaaaactaaaatgaaaaatatgtaacaaaatcttataatattccctgtcattccttagatattaatgaggaatcttatgacattccaaaaatgtatatttaataatctttataaatttaaaattattatttaaatcaaaaaatcaaagtggtgcagcggaagcgtgatgggcccataacccacaggtcacaggatcgaaacctgtctttgatataatcttttttttttggcagatatattttatacaaaaataaacaaccaaatgtaatgttaacttctacttgcatagccacacaaatataatttggtttgtatgtcattggtgatgtaaactgaaattgaagataatagaatctcataaccacacaaaaaatgaatgaacgcaaatcaaagcctctcaacacatctctttgcctcggtctctctctcgcccaattgcccatcaccagagcttaatcatatcttcttcagttactgccacgtgtcactctgaccgtgaacagcctttatctcttccaagtccacttgtgttcttgattattttgtcttcaccattctctctactcaaagctcttcttcttcgatcaaaaaacctcgagcttctaacaatg

SEQ ID NO: 27636 - DNA, 3003 bp, Unknown; identical to SEQ ID NO: 27635
  misc_feature (1)..( 3003): 2750-1469P.txt file - cDNA_ID_2991166; gDNA_ID_2926232; Annot_ID_203749

SEQ ID NO: 27637 - DNA, 3003 bp, Unknown
  misc_feature (1)..( 3003): 2750-1469P.txt file - cDNA_ID_2991177; gDNA_ID_2926222; Annot_ID_142462
ttcatcaaatccataaatcaaaacaaaatagataaatccaacacacaatcacaaaacaaactcaagcaacttgaacttgaattgtctttggtttctttggttccggaggaggaagtttctgaacagtaaccttcaacacaccgtcatgacaaacagcagagatcttgtccaaatctgcattttcaggcaactgaaacttcctcatgaacttacccattcttctctccatcctcacatacttcacaccttcgttttctttgttctctctctgcctctctccactcaccacaagcacattgtcgttctcgacctgaaccttgatctcatctcctttgattccaggcatgtccacgacgaatgcatatgcgttagggtgctcgatgacgtcagcaggtgtagcagccattgccttagcgtctcgcatgtaaactcgtgaagggttgttgcgggtcttctcgttgttgtggtcttcggggacttcaagcatgtcttcgaggattgagattattggaaaccttcctaaatccattgttagttgtgttgtgtttgctttcctgattctttgattcttggctttttgttttctttgatgagtttgatgtgagaaatgtggggacttaaataggagtggagatggatatttctagaggattgtcgagagagcgattgtcgcggtctttagaagttcttccgtattgttcgagaaacgtcttggtcgttctggtttttgtgaactctgtaactcaggtttgataaaatatgagccataactttacagaatttttaatatctatatgggcttttaaattaggaatatatcaaggcccattccatatgtgaaaatagttcatgattcataagattagtgttttagcaaattaaagaacaaattttgtgatttaaggaatccgaacaatattgctcattttaaagaatacattcaactggaaagtacatacaattgctgaagacttggattacaagtgtacaacatgcacctcaagatcagaagttcaaagtcttaatgatggaaacaagactaaattagtatatgctctggtttctggtcagaaaaattaatgaaagaccatatttattttagtgaccaaagaaaaatactatatatgtggtagcactaactcactgaataccactaaatcgtgtataacgacattaatataagctattaaagacggttacaaatctgcacaaaacttgatttgtcttaaaactcagttgatgttatttgcattcgcaaatgcaaatttcatttaaaaaataatgtagcagattgagatatcagacttcgtattatactacagatgtagtagctgaagattcagttacgttatccaacatgaaaaaagtacaaagagttgtttggattttaaaatcagaataacaaaattgtttcctttcatctaatacttaaaggataaaattgaatatgtaagagtttttgcagatataataacactgtgttactgatctcatacccataaattacttcaagggacataactccaaaaatatattttgctgactgcagagataagggtgaaatgcaaatgtggatttgatggccaatgtgctaaatagcaccaatgatattaggaaaggatgaacagtaataatttctgcaaaaacagaggaatgaccattcggtgtcttttttgttgtggtcctatttttgcctcataagcatggatggttcaagagagcaaaaacttcattgatttgaagattgaacacaaagacaaatatgaacagagaaaactatttttatttcattttacaacgaacaccaagaggtagttgcttatcgattacattcattaaaacacaaaaacacgatcacaaacaaactcaagcgacttgaacttgtatagtctttggtttctttggctcaggaggaggaagtttcggaatagtcactttcaacacaccgtcattacaagccgcagagatcttctccaaatctgcattatcaggtaactgaaacttcctcataaacttccccatcctcctctccatcctcacaaacttcacaccttcattctccttgttgtccctctgtcttttgccactcaccacaagcacgttctcgttctctatctggacctgaatctcatctcctttgattccaggcatgtccacggcgaaaacgtacgcatccgggtgctcgataacgtcagctggtgtagcagccattgcctttgcgtctcgcatgtaagctcttgaagggttgttacgagtcttctcggtttgttcttcaggggcttcaagcatgtcttcgaggattgaaaatattggaaaccttccaaactccaaatccattcttagctgttgtgttaactttcttgcttcttggctttttctttggtttgattgattttgattttgatgtaagaaagtattaaatagaagttgagttggatagttctagagcaatgtagagagagcgattgtttcggtgttatagaacttaaaagcgcttctctaacgttcgagaaacgtcttgatcgttggagaagtgtagatggatatttctagacgaatgtagagaaaagcgattgattcggtcaggcccaagaccaattcgttttcaggcccatatgtattctgttttggatttagtaaggatgttaaatttatccggtttggtacgatttcattcgaatttagtgtataaaattgattgaaccgcgtcaatacggttgaaacgcaaacgcagaggattcatgagtcatggcttttgtgaggtgaagtatcaatatcatctacctacctatatgatcatcggactaaagtgaaatgaagtcagcaatttcatcgtcactcttcttcaattcgaagaatcttttaaaccctaatcctctttctcgcttcatttctctcaaatctaacttcctccctaaattatctccgagatcgatcactagtcacaccttgaagctcccatcttcgtcaacctcagctttaagatccatttcctcttccatg

SEQ ID NO: 27638 - DNA, 3000 bp, Unknown; identical to SEQ ID NO: 14066
  misc_feature (1)..( 3000): 2750-1469P.txt file - cDNA_ID_2991191; gDNA_ID_2214695; Annot_ID_189516

SEQ ID NO: 27639 - DNA, 3000 bp, Unknown; identical to SEQ ID NO: 6961
  misc_feature (1)..( 3000): 2750-1469P.txt file - cDNA_ID_2991195; gDNA_ID_1621119; Annot_ID_56242

SEQ ID NO: 27640 - DNA, 3000 bp, Unknown
  misc_feature (1)..( 3000): 2750-1469P.txt file - cDNA_ID_2991209; gDNA_ID_2926261; Annot_ID_143223
tgttttccttttgggatatgggaagtgacttctccgacccttgcaaactaacaacggccattacacactaattacaagccaaaggtcctcactaagcaacctctcgtgtttatcataagacaccgctctatctcttattattttattcattgttttctaatttcagactgattaatcatacattagagaaagtttattaaaaccatctgatgtaaaaaatcacatttatctaaattaaataaatttgttatctagtatataactatttattgttttaacatttggataaattgtaagaaattagaatgtaaaataagacagaaaatggtcaactatgagcatctatcgccatcatgatatagtttcgtcgtttgcgttcccgacctaactcaaaacttcaccaaccccatttttaagcccctttctttgtttttatcctccgatcgatcaaaccaagaaaaaacactttcgtatttccctcgacgaaaaaaatggcaaccatttcgaatctcgctaatcttccccgcgccacctgcgtcgactccaaatcttcttcctcttcctccgtcttacctagatccttcgtcaatttccgcgctttgaatgcaaagctttcctcttctcagctttctcttcgttataaccaacgatcaataccttccctctcgtaagtctttatatccatttgatgcatgtcttttgtctctgtttctcgctcttggggttcaccaaaaattgaatctttttagctggaaacgtaccacgaatctcaaagtaacattttttataagatggattaggaaaagcaactgtatttcccctttttggttggtaaaagtctgatttttttgtttaatttgcagtgtgaggtgttcagtgtctggtggaaatggaactgctggaaagagaacgactcttcatgatctatatgagaaggaaggtcagagtccttggtatgataatctttgccgtccagtcacagatcttctcccgttgattgctcgtggtgttagaggtgttactagcaaccctgcggtaattttatcatctctctttgtgtgtttggttttgcttttgctctgtgtttgttcatttgtctttacttcttcactttttatacatttgcagatcttccaaaaagccatttccacttcaaatgcttataatgatcaattcaggtatctttttgtgattgtcttagacttgtggttgttaacaacatgctattaaaactttagagttcttctttatatgaaaagttgtctgatatgttaatggtatacctgacatgcactattaggacacttgtggaatcgggaaaggacattgaaagtgcgtattgggaacttgtggtgaaggatattcaggatgcctgcaaactttttgagccaatctatgaccagacagaaggtgcggatggctatgtctctgttgaagtttcacctaggcttgctgatgatacccaaggaactgttgaagctgctaaatatcttagcaaggttgtcaaccgtcgtaatgtctacattaagattcctgctactgctccatgcattccttccatcagggatgtcattgcagctggaataagtgtcaatgtcacggtaagttatcctagtatgtttcattattcaagtttcttattgcaagttttaaagaacttcaaaataaaataagtcataatacttcaaattcatgtattgtgtgatgatgtgctagatcactggatttcttgggcgttttaaacctgaaactagattagttcaagggtgttccaaggatgcactgatgttaccttttctaaatcgtttctcatatgttctgttctgtttcagcttatattctcaatcgccagatatgaagcagtgatcgatgcatatttggatggcctcgaggcgtctggacttgatgacctctcaagagttaccagtgttgcttccttctttgtcagtcgggtggatactctcatggacaagatgcttgagcaaattggtacccctgaagccttagatctccgtgggaaggtaaagctctattcatcgctgagatcttacaccagccactgtgagtagagtattagcttatgacacatgatatgtttactcttgcaggcggctgtggctcaagctgcattagcatacaagctataccagcagaaattctctggcccaagatgggaagctctggtaaagaaaggtgccaagaaacagagacttctctgggcatcaacaagtgtaaagaacccagcttactctgacaccttatatgtcgctcctctcatcggacctgacactgtaagtcatctttttgtttgtgttgaagtcaataggctgtattaacgctttggaagtatattcatagtttttgtgggtgtgatttaggtatcaaccatgccggatcaagccctggaagcattcgcagatcatggaatagtgaagaggacaatagatgcgaatgtgtcagaagcagaagggatttacagtgcactagagaagctgggaatagactggaacaaagtaggagaacagttggaagacgaaggagtagattccttcaagaagagtttcgagagtctgctcggtacactgcaagacaaggccaacactctcaaactagccagccattgaggaaatgagtcatcattatgtttttggttacgctaaaataaaaagaagaacctttggcttttgttcttcaatccttatgcatgctttctaaagtggttatgatggattttgcttgatgttccacattatgggttattctattttctttgttcttgtaagatgatgcttcagaagagtttgttactttttaccgtatttgtaatttacattttcactgaaaacaattggcgagtaaaaaagtgtccttgtcttcttctttgttcggattatatgaacaattgttcctagaagcctctctacataaaaagctgagactttatctctcatctctctttagacgtacaaaaaaatcagttttttaagtttcactctaatg

SEQ ID NO: 27641 - DNA, 3000 bp, Unknown; identical to SEQ ID NO: 27640
  misc_feature (1)..( 3000): 2750-1469P.txt file - cDNA_ID_2991209; gDNA_ID_2926261; Annot_ID_204741

SEQ ID NO: 27642 - DNA, 3003 bp, Unknown; identical to SEQ ID NO: 26065
  misc_feature (1)..( 3003): 2750-1469P.txt file - cDNA_ID_2991219; gDNA_ID_2214590; Annot_ID_186767

SEQ ID NO: 27643 - DNA, 3003 bp, Unknown
  misc_feature (1)..( 3003): 2750-1469P.txt file - cDNA_ID_2991235; gDNA_ID_2213650; Annot_ID_181593
tcgctgcctatggcgtgaatagtggtttaagtgctggtcttggtgttggtattggtggtggtcctggaggaggatctggttacggaggtggaagcggtgaaggcggtggagctggtgggcatggcgagggacatattggtgggggcggaggtggtggacatggtggtggtgctggcggaggaggaggtggtggccctggaggaggctacggaggtggaagcggtgaaggtggtggagctggatacggaggcggagaagctggtgggcatggcggaggtggaggaggcggagcaggcggcggtggaggtggtggtggtggtgcacatggtggaggatacggtggtggacaaggtgctggtgctggaggaggatatggaggtggaggtgccgggggacatggaggtggtggaggcggtggaaatggtgggggtggaggaggaggttctggcgaaggaggagctcatggtggtggttacggagcaggaggtggagctggagagggatacggtggtggtgctggagctggtggacatggtggtggaggaggaggcggtggtggttccggaggtggaggaggaggaggtggaggttatgctgctgcttctggatacggtcacggtgggggtgctggtggtggagaaggaagcggtggctatgtaccatgaaaaattatctatatggagtgtaacggcaattgagtgaagtgtcatatctcgtaagggactatatagtttcacgatttatatgtggcaataaatagagtaatccttcgtataataagccgtagaaaggcggctattgttgaagtttttaaattgtaccacgaccaatattgttgtaagctactactacgtgtgtatcaagtttttataaatggaaatcatagttgttcctacgcgtgacgtagaatctatattaaataaattttacggagtatgcaaagtaaggtacatgagtgaattaggacacatacaactttgatttggtacatgacaacaagtgacaatatgaagaacattaaaaacatcaataatgcccaaaggtttaattgacattaatttaattgggccgaacttaattttccaatagtttcaacctctataataaacactcttaatattatttacactaaaaggcccaaaggttatagaaaattagagccgacccataaaaccgataataaaggatcagatccgacccgataaaggtaagcagtgtagcgtcgcatcatacactccttcggttcccgacgaatcgctgcttttttctctctctctctccgtcgctgaaaaatgtcggcaagacctgaaggaagtccgccggaggttacgctcgagacctccatgggtcctttcaccgtcgaggtttctctctctcactttttcgcttatcggatcaacgataacacattccggccatgacattcatatatagagcttacacgaacttgagatctagatttcattctctataattctacattccaattgtatttttctcgaatcgagcttaaactttaggattttagaacggggttttagggtttacaatgttttgatctgtgtgtcaatttttactcagatgtattacaaacactccccgagaacttgccggaacttccttgagctatcccggagaggttactatgacaacgttctgtttcacagaatcgtcaaggtatgttttctgtgtgtttcagtctacttttcgttgtacttaagatcatcattgtgatgaagttttaaggaaattgttttgctttgctattgatctgtttcaggatttcattgtgcaaggtggggatcctacaggaactggaagaggtggtgaatccatttatgggtacgttatcatcgtttttctttaatcaatgctagctttgcttgttgattctttgtcagtaatcaaatttgaatatggggacacaagcaagctctgatgtagttagttttggtgggggatagaagcaagctctgatgtagttagttttgaagtgataatattcaaagctctgatgaagtaagcttcattatggactaggctctgtgactagaagtctcaagttaattgacactactcaagttgctttattcattgtccattccattcttgttttgtttaggtccagtcatgtgttccagaggcttgatcttaatcttagcatttgtcttattttattttattttttgccttgctccttttcctagttcgaagtttgaggatgagataaacaaagagttgaagcacacaggagccggaattttatcaatggcgaacgctggtcctaatacaaatgggagtcaatttttcatcaccttagccccacaaccgtccttggatggtaaacacagaatacactcttttaatagcttacaatgttttgagatcattttccatgtttactaagagaacttgcattgactgttgtgttcttcttttcacatctctatgcaacttctaggaaaacacacaatatttggtagagtgtgccgaggcatggaggtgatcaagaggctcggtagtgtccaaaccgataacaccgacaggtaaagttgattattcatttggaatcaacaagaattaaccaccgagtgaaaaaacccaactaatcgaaggaatctcttttctattctcaatttccaggccgatccatgaagtgaagattctaaggaccaaagtgatcgattgattggggcagaggagtttttgtcaaggagaagaagaagcatttagtaaaccgtttatgacatgaagaactataactctgtgtactgatcccttgatactattgtagactggtttttgtctaagtcttgactctactttgatggaaaaaaatgattgaaatacgttaaatcactctctatttctttttgtaatttgcctcgttcatatcaattcaacggcttaaaaaagaacacgtcatcaagattttcatgtttcaactcatatcctctaaaaagctatctctcactatgtgaaggacgcgacagtaggaaaatg

SEQ ID NO: 27644 - DNA, 3003 bp, Unknown
  misc_feature (1)..( 3003): 2750-1469P.txt file - cDNA_ID_2991239; gDNA_ID_2214608; Annot_ID_135709
atctttttttttttgcaacatcacaaccatccattaattattttagttacttaataagaacttctcatctgaatgcatatattattggagaatgaaagaaaccaacgtaaatattttcattaattaatagtatgtaagtatatgtatgtaaaaaatgtgtagaaaaaaggaaaaaagcaagcaagtgtaaggcatcgaccacccgaccacccttataatctagtgtaaggttgccaattgagctaaaagagtaacaataaccaatagttactaaatagttgttcataatcagtgtggggcacgtgccccaccctcttatacactagatccgcccctgaacctaacagtcactgacttagaagtacgaagcttacatgtacacttgtgaatggagactttccgatctcattgcataaatgacagtgatgttctggttttataataaatcaagtattcaaccgaatagacaagaggaaatacaacaatgccattatctctaacatttctcgtcaaaaaacttgtcacccggggttgttttccggaagaccatttaactcttaagtcttaagtggtcgcgcaaaagagacggtacaaaaagaaatgtaacaatagagcattgtatatgacatatttagagtaatttaagtgtttgtatgtatatgttctctacaatgttagagaaatattctcagatctaatgcaaccctagcatcattatcatcaacttcatgacatgcaactttttctttaaaaaatgtagtcgtccacggtttctcaagacattgtacactttaacaaatcattttttgcagagtggtcatgtaccttttgagaaaatgtacttgagctacaagcctacaacacatcgttaatgaatttttcagtgagttctttagaaagtcccatgactgtatcaacacctcccaccacggaatcaataaaaggtgaaataaggggatgctcaagcatcaaacctccagcaaccttgaaagttattgcatcatcaataagatcatcgatgacatgttctggtatctcatggaaataaacctctgctttgtcccatcctattcttccaactccagttttcaagtttctcacaaaaacagattgcacaacgccaccgtgtgaccccgaatagcctttgataaactcgcgagcttcttctttactagttggttattctctaataacacctttgtacacaacaacagtatctgcagtaatcaatagagttggttgagaatcttgtgtaaactggttttcacctcctaatttcaatataatctcatttgcttttgcttcagcaatagtcacaaccaaatcttcaggcttctctttcctaatagctttctcatcaatatctgcagttacaatagtgaaatcatatcccatttcagccagaatctgctttctcgccatcgactgagaacctagaatcagcttatatccgttctccatcgccttctttgccattctcgtgttgtactgtaagcggaaagagtaaagaagaaaaatcaacaaacaaaaagaagattgaacaaagaatgttgccatcttgtaacttcaaaattttgtatagcgtacattatccaacaacaagatgtcacatactataattatattgtcatcataatatagaatgctaattaatcaatagagaacaatagattactcttatctgtcagcagaacaatatcatttctaataaccattaactgtctgtaattaatggtattctgtttctcctattagctattacaccaaacctggcacacagtggacaagtcctctccatggtagtctaagagaaagattataaaccttgaggccataaacaaagaaagtagaaaattttccatgggctatcagataaattactagcaaaagcttccactaaaaccatcacacttggctaaaagctaaaatgttaacgtttgacacatctacagattttgataagtgtagtcctaaattgttcgttgatttcatacgtataaacacaatagaagaaacacgtttcttccagaagaagtaagaaaactctaaatatgcaaactacacaaggaacagaacaatcagaaaagcaaaaacaaaatgcatttacagtgaagaaattaatatgtgaagattccattagacgcgtcaatggacaaacagttcatgatgctaattgtacatatatatgatatatcaatgatccaataaaaactgctgaggcaaaactctaggaacagagaattagggttttgagattcagcagattcaaactcaccaaaagagattccttaattataggtaaacatacgattttcgaatgtagaagaagattgatacgagggaatgaagctggaacgagagctggagagaaaacaacagatggctgtaattttgcctcctcaagtttcctggtgttcggcctcgtttgccgattagtttggtttggcccatttctttatttcggttatcatctgtatttgggccttagcctttgtttttgtattcattaaaaatcaaaacgaataataagtctaatattaaaaaaggttattattattttagatatcataataatttaatacataatcacaaacaaatattattttataatataacacgtaaatacaaaaatttgttaaaaatgagttctctgcaatatcgggttcttaacccagtataattagtaatacaaatatgaaaataaggaatataaaatgatcttttaaaatcatatggcgaattggctattgaagacttttcaccaaataatacaacaaaaacttcgagactcataaaataagtgatccaactaagtcgtcgatgactataagcttttaagtctctcgctagactgtccacagatttcttcatcttctttgtctcttagcctttctatattatccaccatatctttaaatttcttttataatttgctgtatagcctatataaatgcataaccatgagtgacactaataagcaaaataagagggaatattaagatg

SEQ ID NO: 27645 - DNA, 3003 bp, Unknown; identical to SEQ ID NO: 27644
  misc_feature (1)..( 3003): 2750-1469P.txt file - cDNA_ID_2991239; gDNA_ID_2214608; Annot_ID_187287

SEQ ID NO: 27646 - DNA, 3003 bp, Unknown
  misc_feature (1)..( 3003): 2750-1469P.txt file - cDNA_ID_2991244; gDNA_ID_1620844; Annot_ID_50918
gataaccatgtttcttgtaacaagtgtcttcaacatgaccagggcgactacagtaagtacaaactggcctctcctttttctgataggtgtctccattaagaacagattgtgaagactgattggagactgcaaacactgatgaagtcattcctggagtagtagaaatccttgcagaacgttgaatttcatcctgatcaatcatgttgaatacctcagacaaagaaggcaaagttttcttcatgagaatctgacttctaacagcatcataacaatcattgagtcccataagaaaatcaatgactctattagtctctctttcaatcagaagatcttctacagtccgtggaatagcctgaagactcgtcaattcttcccaaagagtttgtttacgagtatgatacgatgacaaatccagattgccttgacgaagagagtgaatctgttgacgcagcttgtaaagtcgagggaggctagatttgtgaaatcgagtatagagatctttccagattgcagcggctgtgggaaaatacaagatgcttgtatagatctccttcgatacactattcagaagccaagacttaaccatactgttacaacgacgccagattttgcaataaggatcatcatcatcaggttttggaatagatccatccacaaatccaagcttattcttagcttcaatgctagtagtcatggctataatccaggtaccatagctgtttccatctaacagttctggagctaagactaaaccaggatgatcggagctaacaagatgataaggactgtgactattatcaggagaatccgatacctcaaagtgacgcgatgagctgtattgagctggttgatgaatcgcagcatgaatcgaggatcctggagctcttgctgatgaaccagaagactgctcatgaatcttcgatgaagcaatgacaagtagatccggtgaactactccgacgaacactctttccatttcgtttacccatggagaatcgaaacagctaacaaatgagactggatcgcaaaggaaacgaagagaaaacgtgtagaagttcaagagaagaaaaaaaatgagaagatgaacaaactccggtgagattccagtgaaatcaaatcggaaaagtttgttacgagactgagatcgagatattttgctctgataccatattagtaaaacaatctcattctcattaattagcaaaagagtacaattgggggtttatatacaaactgatattggcctaaaccataagcctctaaaccaaaattaagattggtttatagaataccaacctgtacagactctatatgaaatctatactaaccaaactaagcttatatacaacaatctaagctatatacattaatagacgaaatttttaaacaaaacccaggattcgaacatcaaataacccatccccaacgcaacaaatattatcaaccaacttttcatttcatcaatgacactgtgaatcatataaaagagatatgatgtcggtgttgaagataacttctttattgtaagattattttgatcgaataagctgcctcaaatcttctaatttcgacaactctttatctgtgaggacactatgaacacgtttgtaaaaatccatcacttggtctctagctaccaccattttctttcttcgcatagggctggggaataatgagttcttacagtgaaaacataagtggtgaccggacgcattgaacctaacatcgtagaaaacattgaggaaatttttgtaacataataaaaagagacatgtggaaagagaaaacaaaaataaaacaaaatattgagaagaaaccaagaaaggaggaatttctttagtagagagatctaccgagattataaagaaattgaggagtagaagagatgtcagcgagctaaagtgacatcagaggaaagactttgaagtggttcctcaatactagaggtatataagaaaaagaaaaagaggcagatccaaaatgttggttttgaaagttttatagatttttaagattttgtttttgttttcatttttcaagagctaattgtcataccattaccaatcaagttttaaaatgttggttttccaagaaaatacttttgctataatctttttttttgtcatcagatattatttaggattcaacgaaccaattttgaagaaaattgttaacaaaagcgaatttttcatgccaaatagttttttattcaaaattttagacttttagttatcttataagcaagcgttataatttatttatttttttaaagaaaattttgagaaaaacaattgcgaaaaaatgtcaggagatcttcaaatgttcaaaaatacaaaaaaaaaaaaaaaaaaaaaaaaattagtgtggggtaaaataatacgtttaaattttattgacttttcatttcaatagtcaacttttagtgacttcttatttcagtcgctaactttttgttgatgttgccaaaatagtcattaaattgacccgagatcacaaattgcgggtaacggaactttgttaaaatttctgttaaatccacaagtgactggattaaaaaaaaaaagtgcaactggcctaatatgagcccaataaaaaatatctcaaaagttttatgggcttattacagatgggcttagtcagagcactatcttacccaaacaattaaaaaaacaatttacaatatgttttcgttttctacttttttcggttattttgggcaaatgatatctacagctcaacaaatcaaaaaaattcaaaaatatttcaatttattatttctcgatttttttcacaactgtattttaattgtatttttagtagaaatacttatttttccaaaaatatttgtttgtgttgatgtatatataaaaaatctgcatcagtgttttgtctacattttctcttccattagtttcgttatctttttattttctctatctatctggatattattttttcacttggggatttggagaaacctctcctctctctatctatagccatg

SEQ ID NO: 27647 - DNA, 3000 bp, Unknown; identical to SEQ ID NO: 5213
  misc_feature (1)..( 3000): 2750-1469P.txt file - cDNA_ID_2991244; gDNA_ID_1620773; Annot_ID_50210

SEQ ID NO: 27648 - DNA, 3003 bp, Unknown; identical to SEQ ID NO: 27646
  misc_feature (1)..( 3003): 2750-1469P.txt file - cDNA_ID_2991244; gDNA_ID_1620844; Annot_ID_170140

SEQ ID NO: 27649 - DNA, 3000 bp, Unknown; identical to SEQ ID NO: 5213
  misc_feature (1)..( 3000): 2750-1469P.txt file - cDNA_ID_2991244; gDNA_ID_1620773; Annot_ID_167572

SEQ ID NO: 27650 - DNA, 3000 bp, Unknown; identical to SEQ ID NO: 5213
  misc_feature (1)..( 3000): 2750-1469P.txt file - cDNA_ID_2991244; gDNA_ID_2926216; Annot_ID_142218

SEQ ID NO: 27651 - DNA, 3000 bp, Unknown; identical to SEQ ID NO: 5213
  misc_feature (1)..( 3000): 2750-1469P.txt file - cDNA_ID_2991244; gDNA_ID_2926216; Annot_ID_202984

SEQ ID NO: 27652 - DNA, 3000 bp, Unknown
  misc_feature (1)..( 3000): 2750-1469P.txt file - cDNA_ID_2991253; gDNA_ID_2684112; Annot_ID_190673
tcacagatcgattaagagaagaaggtacaggattgttgaaaactttaagatgagttctacaagaaagtgttggaaactgatctgagccgttagatttaggtttctcctgaatgttgatgattccttctttctcataacaggctgatatgccgcttagttggagaagtctcgttgcagttggtaatctttgttggcttagccgtgatctagacggtggaggaggaaccattggtgtaggagtttcgagccggtgagaattctcgttgagcggcttcaagtgacttggtttcgatgattttcggctttgtgagagtgtaaaaggcgagtctaggctacgcgccgccgtctctgatgagcgattctcatctccgtctgccatttttaactgacgtctaagtctctgagcagaaacagagcgttgaatctggtggtgttgaaggtggtgctgctttggagaattacaagtcaaagagtggagatctccggcggaggaagaggatgaagtaaccggagacatgaatctggaacttacttctctaactcttggccgccgcgttgaaggcggaggagccggtgttgatggctgaatttgcttaggtccgctggttttcgcctccataactttttcgaaatagtcggagattcaagtggccacgaggattcgtcacggtcttcaagagattataattggatttttgaatttaagccaacactcggagaagaagatacgttacggtttttttttttttgagaaaatgagccgttggcttttggtcacaatctctttgtctctgtaacgccacattaattttgttttttcatagttattaaattaattaatttgtcaattagtgtaatagaaaaccaagctcttaagaaacttgttatagtacattgaacacgttctttgaagacaatgaacaggaatttcaaagagtttgtagagatgaaattgttgcaactggttactatatttatgttttatgtgtcgggtgaagatttcgaaggcaatgaaaaggctgtttgttgaacgattttgaagatctcagtttttttttttgtttttttttgtttttgaagaagactaatttgttttttttttattggtttggttttgttgcgtgatgtgataatgtgactgagaagagtaacaaacaattctgtagatttcagaacacaatgatcaaataactgagaaaacatttcatagggttacaatatcacaagaaaaaacgaaaaaataacataattatgaaataaaaaaataactatatgtctatagcgatgtgacattattggggtcctctccatttttattgcgggtatataaaatccaaaaccaaagctagatagatgcgacaataacaattcctaacattacggaagttgtgattaccattgaaagaccgaactccatattgtctatctttttttctcttgtgtcttttgaacaagcttcttccgttcttcgtatatatacaagtcgtaatttccttatctccgcaacttggcaatgaatgtgaacacaagttaaaaagttaacttaacaaaaaaatcaaaagcaaaaaagaatatttaacataacagtaacatagcaaataaatcctttaaacgtgtggtagccgcaaatcatttagagaatatgtgcaagaaaccaagcccgacccataaataaattttggtaaggcaagctaaatatgaggcggtttaatatagtctaattgtctcattctggaaattctcaaaaaatctcaagttcaaaatgaacaatctaatgaaaacttttttaaaggttggatcaattgattctggtgggagtgataatcttatttgacgtgtggcgcaaggcaataaggtccagaagttagtctaagtcttggtattgagcgagtatttaccataagcaacaaaaaaataacattgaagttcaagtcaacaaaaaaaagttcttagtgcttagatccgattactatattttatgttttatgtgtcggatgaagttttttaggcaaaggctctcaagtttgatagttttttttatgaagatctttgtttgttcgggttgtttgtgaagaagaacaagggtttggttaatttatgttgaaccacgagagtctaatttgtttgcttgattggtttggttttgttgcgtgatgtgaatatgtgcatgattgagaggagtaacaaaaaaatctatagaattcagaacacaatgatgataaaatataactattacttaggatatcattaaatatgaaagaaacaaaaccaaaaatctgaaagaaactaacaaaaggaaaaaattcaaataattgtgaaatggcaaatcaacttagatgcctctgacatcaacaaactgggcgtcctctcgtgctttcttgttggccttgtaaacaaaaagaccaaccaagaaaactaccacaaccataatgcctaaaactacggccaatgcgattatcattggaagagtgaacatcatcttattattcaccacaccaaaacttgttctttctcttttttctttttctttcttgtgtcattttaccaaggttttctactagtatatatacaattcataatttccttatctccacaacttggcaatcaaagcgaacataagtaaaaagttaacttaacaaaaacttcaaaagcaaaaaagaaaattaacataagaataagatataggcaccgccaatcgtttagagaatatttacaagaaaccaagcccgacccattaagaaattttggtaaggcccattaattaacgaaacactatacggggggttttaacataaataatatagttttaattgtctcattttgcaaattctcaaaaatctatcaagggtttgccgtacaaaggtatcggaggagagagtaaagggtaaacaaaagagagactggtttacttcttcttcgtgtgcgagtagctttttcctgcgattctcatcgagttttggttagtgctttgttatcaaggtgaaaatcgatttgaagatg

SEQ ID NO: 27653 - DNA, 3003 bp, Unknown
  misc_feature (1)..( 3003): 2750-1469P.txt file - cDNA_ID_2991265; gDNA_ID_1972049; Annot_ID_178331
tacttcgcagtagcaggctgaagcattatataagaaagagacttagaaaaagctcaaaatcgtgtaaaacaaagagaactttcgtatcgatgacaaatgtatacctgagaaccaatcttgaacccatcaacgttattcgctgcaagcaaatcaaaaaaggattagagaggaagataagtaattatcagaaataagcaagaactgtaatggttaggagtaagagcatacaatgtaactgcaagcgagaatcagcttcccaactcggtttctctggattaacattgtccgtatgagcaacaaatgtagaagtgaagtaattgataccgacaaaatcataagaacccttcagtttctccttctgctcgggcgtaaaagatggtaatcgactaccaacaacatctttcatggcctgagggtaatctccatgtgttattggctccatatgcctgtaaacagcaagtatccacactcaaaacactaagcttaataagtttgctcaaacaatatttcttaaagactactcaccagcctagagtgaaatccatagctctcttcactatctcctctgaaggactcgaggtggatttcttatcataaggctcaaaccacattggactttgaacaattccgatctttccacctgtgcactgtttgttttaaatccatggattagctcaactgaaattcgagtccaaatctgttgtgattatcctaacattcttacctttccacatttcctgaattcttccacagcttcggcatgagccaacagcagattgtgactaacagtgtaaacttcatggccactcttgcctgcaacacatttctcattgacatatttagaacatcttcctggtgctttctctccagtctcgtatccaccacgactaaattcataaggttcgtttatagtaacccaatgcttcactctatcaccatatttattgaaagcaaactgtgcaaaatcacggaaatcctccctatatatgagtttcagaacatattaagtaactgcaaaaagataggagacataactgagataacatagatcaatatttggcttagaggacttacaaaatacggtcactcaagaaaccgccgtattcatcttcaagagcctgaggtacatcccattgaaacaatgtgacaagaggcgttacacctgcaaaactcaatcaagattgccattttagccacaaggttaaaggaaaaaaaaaaggagatttcatatgaaataaagatgtgggggaatgtgtaacaaccatttgcaatgagctcgttgataagatcattgtagaatttaactcctgtttcactcactcccttgtcttttttcccatctgattgttttcaacaacaaaatgttgttagaaagtgcatctcataataaactgcaaaagaatcattaaccaaagaatagatctttgtcttacggggaaatattcttgaccaagatatagagaacctaaaggcatccatattcagttttttcaatagttgaacatcttcctgcaacattttcaaaaagttagattagatcaacatcttcagtgggaaggattgctcgtagaacaatatataccttgtaatgatgatagaaatcaactccgagcctgccgtcaagattgttgttgctttctgcagattcaaataacatgctcatgagttaataatcacaggacgagatcgaattctaaactcataacaatggctcagttttataatcttctgacctgaatgttgtttaagagtgaatgagtcccaaatgctggaacctcggcctccttcttctgctgcaccttcatgctatacaaacaaatgaaccaaattagaaacgtttggcagtagaagaggactatcaataagtcaatcatgaaacttgaagcatcatcaacagaattcaaaagtgaatgtgaaaaagaaactacccttaggcattaaaactagagacttgaaaatgaccaatgactgccttgaattggaaaaagctttaaacttttccctttcaagctatttggtttggctaaagataccaaatttgatttctttaaactagatttgagattaaagactttcttaatcgtacttacaaagctgctagagctgatattagagtaaatccggcaacgaaatattaaaactcgccggacaaaaagaatccagtcaacggcgattcaacaatgtttggacttataaatcccaaattcgatatacctggaaagcagaagttgtagcaccgaacaagaaaccatcaggaaagcttccacgaccaaacgtggaactcgccggacacacagctccaccgtagacggtgatcggagaaactatcacgacgagaaataaacccaaaaagagaatcgctttgagtgccatttttcaagtaagttttttttatgcttaacgtggttgtcgtgttccattatttataagagtcgagatcacaaagaagaagaatttaaaagatagttgtttttgagatccaatacttcgtctcgaagattaaagcaaggtgagagcgacgtgtgtgttaaaataaactatctttgatattgtacatttaattttcgatagcttagccttgtcttgtcgacgacgatggtagtagtagaagaaacaacgttaaggttccttcttaccacggtaaaaaataaataacaacaaccaataattgtaattctataacttaatttttgaaaaacagtttttaatttgaaacaacataattttaccttttatacggactaatatatacctacgacaaaaaaaggactaaatttatagctaatttttttgttttttttttcaatttatattagttagttggaccgacatgaaatatttatttaccttcaattaaagaataataaaacaaaattatctcagcaaaattaattgaatttttttagctgacacgtcaccatctttatgtttttttaattcatttatttccatttggataaaacagaaacctaatcccttaaacctcgccggcgacggaaaatg

SEQ ID NO: 27654 - DNA, 3003 bp, Unknown
  misc_feature (1)..( 3003): 2750-1469P.txt file - cDNA_ID_2991273; gDNA_ID_2936564; Annot_ID_194577
tcattgaatttgtaagtaacatttgcggttatgtgggaaatatgtgaatttaaatatacaaaaaaaagtagataagaaaactagagatcacaaagaatatataagaatctattacactttcttgtccaatatggtatatggaagttgggcttaaaaaattaactcttttttagtaaaataaatatttttaaaacagtattttaatacattaaaatttataaattatattaaatataggcatgggtcaattaagaaatatgcaaataaacaaccaacacagaaaccaaaccctaattccccattccctgtcttctttattcttttaggcgaatttcaattgcgtccaagcaaagcaccacctcttaccccgttgatttattcgtcgatttgcctttcggtgaaattcgcaatcggatctactccatttgattattaaccaagtcatgattttgagtcaaacaatggttgctgaagctgagatcagggttcttgacgttaagtgccatatctccgctcctaaagatcagaagaattttcagatcgacgaagttcgtgtttctgagtctgtccgtgctgagatttcgggttccgctgaaacgcctcgattcggatcggtatgtgtttttggtttcttgttctaaaaatcgctcatttttattaattgggtttcttagaaatttcccttagaaattagatcatgtggattcttctttctcgtaattgagtttgttggtttagattaggagttataatttgattttgagattagaccgttgcttgaaattctgataatgatccgattctgcatcagggcttatattagttttgggtttctttttgttctctattgcataataatgttgaatcctacataccctcttcgattaggttcgtgtagacaatggaaaatgataagattagtgttgtgctttggaaagtttatacctttgcatgaagaattagtttaggtgttcatgaatcaattttacattgttagcggaacgactctgatgctctgttctggctgttctgtttctttaattgtgccaagttcaggaatcttaaacaaaccttcttatgtacatttgttgtaacagggcatgagttgtgtaactactaccattggagaatccgccagtgactttatcccaactatacgttcagggagctttgctgacattcgaagtcgagaaaccatggaggatgaacacatttgcatagatgatttgtcagctcaccttggatcctacaacttctcggtaccaagtgctttttatggtgtgtttgatggtcatggtgggcctgaggcagcaattttcatgaaggagaacttgactagattgtttttccaagatgctgtgtttccagagatgccctccattgtggacgcgtttttcttagaagaactggagaattctcaccgaaaggcttttgctttggctgatcttgccatggctgatgaaaccattgtcagtggttcatgcgggacaaccgctttgaccgctctcataatcggacgacatcttcttgttgctaatgctggagattgtcgtgcagtgctatgtaggagaggagtggctgttgatatgtctttcgatcacagatcaacatatgagccagaaagaaggcggattgaagatttaggaggatactttgaggatggatacctcaacggagtcctagctgtcacgcgtgccattggagattgggaactgaagaatcctttcactgactcctcttcaccactgatttcagacccagagattggacagatcattctaacagaggacgacgagttcttgattttggcatgtgatggtatatgggatgtgttgtcaagccagaatgcagtgagtaatgtaaggcaaggattgaggaggcatggtgacccgagacaatgtgcgatggaactaggaaaagaagcagcgaggcttcagtcatcagataatatgacggttatagtgatctgcttctcctcagttccgtcttcacctaaacaaccgcaaagaagaagattaagattctgtgtttctgacgaagcccgagctcggttacaagcaatgcttgcaggcgagtgaaagcagtgtttttggcagtatgtacaaacaacagggatcgggtgttaccgatcaaaccattatttctctaatttgagattcgattcgatgagataaaataagagacgtagagagtgatagagagttaaggtcttgtttgtaatgtggtttctcatttttgattgatctgtttttttggtttgtttcagagagagatagagagaaaaaccagcctgaagttttggtaggattattgaaactgattaagaggatttcatttttgttcttgaggattagtgatgttgtacccattattgattgttttaaggaattttaattttaactattttgaatctagattttggaggttggtttaagaatctctctcccatatatgtggaattcagagagtttctttctgactgtgaaaggttttggaggtttatctcaaaagcctcaaatcctgtccttacttgcttctcatcatctctatctttatctctttatcttcttctcctccaacaatcttcatgtccatatatttctgatgagtatattttttgataatttttacaatacagtatttttcattacatatacataaatattttttggtgtatttctttacatatgaattagaagtctagaacttataaaagtaattcaaatgttgacaagaaaataataataaatcaagtgtgcattaaggtaactttgtaatcaatttcaaatatttagtgtacataattgagattagaaattcaagtattcattcatataaatgatttatttacttatctatatttttggtcaattaaggaaatattaaaatatttgtgattaaaaagagaaaaagggttctaagagagcctctcctctttacatttgccggctctgttcatctctacaaggagccaagtctctctttctctctaaaacaacaatg

SEQ ID NO: 27655 - DNA, 3003 bp, Unknown
  misc_feature (1)..( 3003): 2750-1469P.txt file - cDNA_ID_2991281; gDNA_ID_2926080; Annot_ID_196351
ccgtaattttcccttctgaaaccaacgatcctacacatcttcgtaaccttgctgcaaggtgttcatcactggtaatgcatcgcatgataaaacttttgtaccatgatgttccatttcttgttttcgctttataattttccaactgtttttcaggcacgagtccgggttttgtcgttgatagtgaagcttttttcgatttctcgacttgtagcttcagaagttaagaaatcggggcttcttgatttactggaggcagaaatgaagggtacaaaagacactcttgtgatcttaaatgttctggaactctactatgaggttggcctctgatgtctgatattattattcaatctgtttcctttgttgccctcttttgaaaggaaaagatagaattatattgaataattgtgtatgaacgctgaagttaatggaagtggagcacagttcagagttcgtgccacaaacatcacttattcagctgttgtgttctatcatcaggtacaaactgttgaaccttacccttaactattaagcttgcatcagctcatccttcagttttttttctctgggtcttatgttttgtatagtggtacatcgacgggaccctatgaaaagttaagagcaatgatgataagtggcagactactctcaaaggaaaatatctacaaagtcgtggaagaagctagtaagattttcattgtttttagcctttattggttaggaaatgagattgttttgttttctttctatgtgctttcacaacagggagtttttagggactatgttatgttaggaccagttgttccctgtctcaaagcctctgtttgttgtgcccataaaacgagtgacgaagttgaaaagttaactacgaattgctttgtttctgaatgtaatctaaggaagagaaaatagctttaataataatagacttaaatttgtaggctgtactgtagctggcaataaacaactttcaacttgtcctgaatacaggtgtgaaggcgttaatttcagctattgatgggagtctggagtcagttgagatgaatgatactgatgcacaggaagctgccattgatgcacttggtcagatgggatcaagtaagtgggtcacttttctttgaaactttgtttgttgcagtcgtcttctaaaagagatagctagagaggccatacatttagaattatgaattataagagcatccgacaagatattcgtttcccatgcaatgatcttgtaacttatatggatatttttacaataatcttagcaacgaagggagcggatcttgtcctttcaacttcacctccagctgcaagacatgttgtagcttctgcctttgatcgtaatgcacatggaaaacagttggttagtgtgtttttgcttctcatcaattgaaattctgccgattatatgctcttactacatttttgaagatccaatttttccagttttaggatttctaattctaactattgagggttgaaattttgcttcattagtagagacattcatgaaattatatgattgtttcgtaaatggcatgtgcaggctgcactgcatgcactggcaaacatcgcaggtgaaacacgacctaagagcaacagaatagttgatggaaaagctgaagaaagccttagatgtttgatatacgacgctgcagcacagagcacaaaactaaccccatccgtaagttcgtttcctcttttacttattcttctctcagaagtgtgcagattacatatttttgtttgatccgtagcatgagctaatttaagcatgtcgcacaaattgcagggtttattcctctcagttcttcaacaaagctcagagattcgtcttgcggtaaacctttaactcagcatctgatctatcatatcttctccccctttgtttctctagttggaaatttcaaaatgacacactacatttcattcaaaattaagaaatctcttttgtccttctacacaaaactcggatacatgtcactcatttgatctcacataagaccttcacgcattgcctagaggtaactatgttttttgcttatagtatattgtttacaatgttgtttgcagggttatcgaacgttaacagcattagtggctcggccatggtgcctggtggaaatcttggccaaagaagagataataaacatagttacggatgcaaccactgaaactgcaaaaataggtaaaccaagtaacattcctcgcatcacccacactccagccattgtattggcttcttcctccctcaacctctttgatctacgagtctaaatctcattttttttttactcagcaatggaagcaaggtataactgctgcaaagcaattcacgaagcgttcttgtgtagtaactttgttgatgaccctcgtcgtctaaaaaccggtgacaaggttccatacttttcctctgcgctctttaagatggaagtttcgaaaaggcttttctttgatgttgtacttttacttgctgatgacatgtttgacatttgttgcagttgcaagaagctgttcgaagtggaccatatatgtcgaagaagcacagaggcgcacgaccagaagtaatgacaggcgaaggattttaaagacaactaaagaaaaaaagttaaaacttctttgttaaccaaagttttttatatcttctctggctgttcgataagtaaactttagttctttctataaacaacgaaggctaggagtaaacgttttggcggttgaaatttgtgttctttaatttttagtgttgaacttaatcaaagaaaaaaaggaataacgagtttggtccgtttctcatcgtttgccattagcccacgcgggagatccaaaacactgggctaaactggagttaagacgataaaccaagggtaatatagtaattgcgtttccagacatcatctcttcctttatggataacactggttcgaaatggagccattactctttactaacagagggagaaagagcagagaagagagaagaggaagcttgtagaaatcgatg

SEQ ID NO: 27656 - DNA, 3000 bp, Unknown; identical to SEQ ID NO: 13103
  misc_feature (1)..( 3000): 2750-1469P.txt file - cDNA_ID_2991287; gDNA_ID_2214598; Annot_ID_186956

SEQ ID NO: 27657 - DNA, 3003 bp, Unknown
  misc_feature (1)..( 3003): 2750-1469P.txt file - cDNA_ID_2991329; gDNA_ID_1620511; Annot_ID_159118
aaataaggtctgatggttatagttgcacgtaacaattagcagaagaaaaataataaaaaatgtttctcacagagtaagtttttcttgccttgtattgatagttcttcgatacatatctgctagaatggttggtataagatccgtaattcttctttttattgaactacaatacatcttgatttctattaagagttctttgataaatttttcaatttcgcagcaaaggatcatttgggatattttctgtgagaagcatctacctgaattagttgatttcataatggcctcatgtcctgaaagacctggcgatacatctgaaggtgcattcgtaagagttggcagccatcgtggaacaaagccgggaatcctattgcgcatttgtgaattgctgtgctcttgcgttcagctggatccatccaggacaaagtaacctttatgatgattatcacattatttctgttttagtgtatcactacagtagccatctaatattcttgtgcatttacttctcttgtctgctacgtgcagttttctccataacagtgtgatagaaaaggttttgcttctcactcgaagaaaggaaaaaaccctagtggctgcagctgttcgatttgtccgcactctcctctctgtccatgtaagtaaagtagtcttcgatcagcattttttcttataggctcatctgtgcattctctcttgagaatgaattagacaattgattctataatggctagaaaatgttctcggatgacaataagtctttaggtaagttatgcaatttctaaaatattgttctatttcagaatgataatgtccagagttacattgttgagaacaacacgctgaaaccgattatcgaagtttttgttgctaatcgtcatcgggacaacctgatgactgctgctgtgttggagcttcttgagcacatacgcaaggttcctattatttcatccttttcttcactgtttctttggggtgttcctctgtacataatacatattactgttttgtgtgcaggaatatgcagtgttggtcaaatacgtaggtgatacattttgggaccagctagctccatttgagaacctgcgttccatcaaggatttgaaaacgaaatatgagaaggtatcattcttcgatctaacttctactttgaaaagttttcctaaactattctttgtttaacaatgtgtcaatgttgtcttagggaccaaagagcaccactgatgatgaatctgatatgagacaagatgggcgtgctctggatgaaaaaaagccagcttctgcttccagtacacagatggaagaagctgatccccataattccaatgccacagctgcaagttctgcttctagcacacagatggaagatgctgagccctataatcctgatgtcacagctgcaagttctacttgtagcacacagatggaagtagctgagccctataatcctggtgtcaccgctgcaagttctacttctagcacacagatggaagaagctgatccctataatcctgatgtcacagctgcaagttctacttctatcacaccgatggaagtagctgagccctataatcctgatgtcacagctgcaagttctacttctatcacaccgatggaagtagctgagccctataatcctggtgtcacagctgcaagttctgtttctccgaggtatttgtttctggtttctctcgatagaaattcattagaagcaacaaatatagttaatagatttgctttctgttttctattaatcatatagcaagaggtctggaggtttggttgattatgaggatgacgaagatgagctagagaagagtaaaagacagaagctcagttcaacaagtgaaggaaataagaacaccccagaacaaggtggtgaagctaaggaacctggagaactctaaggagctaatgacgatagcaatagtttagatgaagaaattgacagcaagcagatgtaaagagatgttgagattaacattcttgacaatagataggatttttgaagaatagaagaaactgtgtatagagggttaaaatgatgcttttgaagacaactcgatgatccgtgtaaatgactatgcaattgcattttgtaaatgaatcttgtgtgaaaatgaaattacaatttcttaaagagagacttggaggatttcatcatacacccgaggatttaagataatttcaggcaggtgtttctgtgtatatatatcagatttttttgaaacaggtaatgggttgtttttgtttgtagatgtcttgataatttccgtttctcttgatgtccacatttaccatttacctctaattgatatcatcaactcaagcgtttttacaaacaccaaaaagcgcctatttgcatcatacagtataattaaataattcaaagttcaaacgatgaaatttcacacatattcatattatttaattcaatttgatatatcttcatagagaaacaatttgtaattttaggaaaaaaaggaaataaaaaaggagtgaaggacttgagagaaaataagaaaagagtttgtgaataatcttttgtctttctctttcgtcttcctcgctctaacgccgccttctcacactctcaaattggctcatccattccaagcacgctccttcgatcttcctcttggtacgctcgtttctaattgtaagttttcttcaactcctattccaacgtttgtgtagatcttgtattcgagcaattagatcgataaaccctagtttctccgtggatattctagcaacttcccctagatttctccgtatataatcgtaaggatttagaaatcgaattatattgtgatgtttagttaacgaaaacccagtttattgaatcgtctccatcaagtagaatccctaatcttagatcccctgcttagggtttcgaaatttgtctattttgttcagctttatactgattctatttgtccaattttgaagatttgattctaagtctctagtatattctttgttatgcaatgcagaaacatg

SEQ ID NO: 27658 - DNA, 3003 bp, Unknown
  misc_feature (1)..( 3003): 2750-1469P.txt file - cDNA_ID_2991329; gDNA_ID_1620511; Annot_ID_159119
ctattaatcatatagcaagaggtctggaggtttggttgattatgaggatgacgaagatgagctagagaagagtaaaagacagaagctcagttcaacaagtgaaggaaataagaacaccccagaacaaggtggtgaagctaaggaacctggagaactctaaggagctaatgacgatagcaatagtttagatgaagaaattgacagcaagcagatgtaaagagatgttgagattaacattcttgacaatagataggatttttgaagaatagaagaaactgtgtatagagggttaaaatgatgcttttgaagacaactcgatgatccgtgtaaatgactatgcaattgcattttgtaaatgaatcttgtgtgaaaatgaaattacaatttcttaaagagagacttggaggatttcatcatacacccgaggatttaagataatttcaggcaggtgtttctgtgtatatatatcagatttttttgaaacaggtaatgggttgtttttgtttgtagatgtcttgataatttccgtttctcttgatgtccacatttaccatttacctctaattgatatcatcaactcaagcgtttttacaaacaccaaaaagcgcctatttgcatcatacagtataattaaataattcaaagttcaaacgatgaaatttcacacatattcatattatttaattcaatttgatatatcttcatagagaaacaatttgtaattttaggaaaaaaaggaaataaaaaaggagtgaaggacttgagagaaaataagaaaagagtttgtgaataatcttttgtctttctctttcgtcttcctcgctctaacgccgccttctcacactctcaaattggctcatccattccaagcacgctccttcgatcttcctcttggtacgctcgtttctaattgtaagttttcttcaactcctattccaacgtttgtgtagatcttgtattcgagcaattagatcgataaaccctagtttctccgtggatattctagcaacttcccctagatttctccgtatataatcgtaaggatttagaaatcgaattatattgtgatgtttagttaacgaaaacccagtttattgaatcgtctccatcaagtagaatccctaatcttagatcccctgcttagggtttcgaaatttgtctattttgttcagctttatactgattctatttgtccaattttgaagatttgattctaagtctctagtatattctttgttatgcaatgcagaaacatgtctaattcaaaggacgagaaatcacaagatgcagctgatagaatcaaggctgcaacactcactgctgctaaaggtctaagccgtacacaagcggagagagcagcggctgcagcagcgagaaacgttaacgcttatggccagaaagaagaaggtccgagtagatggcaggagaaaagagaattaaagaggcagatgtatttgatgagtactgagaaagctgtcaggcttggtgaaaggaaagataaaacaatgtcagcttcagccgtgggaagcagtgcttcggcggcttcacagtgtcagaaatgtttccaagctgggcattggacttatgagtgtaagaatgaaagggtttatatctcgaggccttcgagaactcagcagcttaagaatcctaaactgagaacgaagccttctgttgatgatcttgatggtagtgatgatgatgatgaagaagaaaggcctgatgcaactaatgggaaagcagaagttgagaagcgatctaagaagagtaagcgaaagcataggtcaaagtctgattctgaaagtgatagtgaagcctctgtgtttgaaacagatagtgatggctcatctggagagagtagttcagaatacagttcatcgtcggactcagaggacgaaaggaggaggagaagaaaggccaagaagagcaagaagaagcaaaagcagaggaaagaaaggcgaagaaggtacagctcttcttcatcggagtcatctgagtcagaatcagcttcggactcagattctgatgaagatagaagcagaagaaagaagaagagcaagaggcacagcaacaagcgtcgttgaattggttttaggaaatcgataagtggatgaaaattttcatgccttagaatcattttaagcttcttaaaggaaactcactgctatgttacttctttttcttcaagttcgattttttctttttgtcagccatttatggctttatgttgtaacaaactgataaatctttagaatctcctcaagttttcatagctcaatagctccttggagaatgttgtaaacctaaacgaaatacctttgtgttgttatgatagagagattttagtgactgttggttatagcatgcatatattcgaaggatggaggaggttttttggcattcaatggaaattatctatgtactagatactctgtaacaaaaaaataataaccacatcaatccaatactaattggaaagtaatcagttcaaacaaaattaaaatcatcccctgaaacatacaaatatgtgtaataaagtcaagggcttcttttgtaaatatccgtaatttatcttccagaaatagttgcattaattatctctgtgactctgtccccagtctccttcctcacagactgatccctctctctcccaaagttgcattaagttttaaactagtacaaagtctaagcttggagcttccactttgtgttctccttgaaaagtttttaccttttttcaatctctgttgttgatacacctgtaaagctcatattgcacacaaagtgttcgataaaatgcctagccgaaacaaaaattgcatataactggtttgtttctcactctctatccctcaacttcttgaattttttttcgtaggaattctctagaggtgttatttaggaacataacggtttaatcgtctccatttcgttggtactttaatcataacagttttggttttgtgatcttcatttatagcttctgagaaaacaagtgaaagtatg

SEQ ID NO: 27659 - DNA, 3000 bp, Unknown
  misc_feature (1)..( 3000): 2750-1469P.txt file - cDNA_ID_2991352; gDNA_ID_2926242; Annot_ID_142908
agtttgctccgtactcaatcgagtggcagtttaataatgtaatcagcagttatgcatggttatgatgaatgggagttattccttgtgtaggtttttctttgtcagagccgggatgatgggatggctgcttatcaatctctctattctggcaaaaagtgtgcaggatggttccttgagtcagtcgatgattctttaccagatcttctgtgcggtaaatttggtttttacttacaaatcttgcttcttgaagttatgatcatctgtgttttgttagttttgattagttttataattgcagttatatatattggactactttgttcatgaagaatacatgacctctacgtaagttcatggcgtgttaaggaaacacatttgtcttaccaaaaaatgaccatttgcattattacatctactttgattttactcttttcaggtgggacataattgcagagagactaggcttcatgctagtgtttggagatctcctgtggattcctttcacttttagcattcaggcatgtaactgtgagcctgaacacaaacaagatattaatttatcttattgacagtatcttcttggcatgttacagttattctcggaaacaatattgttctagaatgcttgatcactctgtgactgaattgtcttctctctggtacagggctggtggcttttgcacaacaaagtagaactaacagttcctgcgattgtagtcaattgccttgtcttcttgatagggtaagttctgagacattgggttattttccattcttacatatctacactaagaaacccactatttcttctttggcaggtacatggtttttcgaggagctaacaaacaaaaacatatctttaagaagaacccaaaaacaccaatatggggcaagcctccagtggtagttggtggaaagttactggtttcaggctattggtatgttatatttatcttctcttgtttctttgcttggtttcgccatctctgtgtttgattgttcatcatgctgggaataaagagttgaaagttccgcaatgacacatttccgataacttaggtgctgttttgtatatatgacaggggaattgcaaggcactgtaattaccttggcgacttgatgcttgctctgtccttcagtttgccatgtggaataaggtaacttcttctgcttgagttcatcttacagctaccaaaagtcatgtagaaactaataccaatatcaaaacgttcgaagttgatttggctgacttaaagatattgatctctaaccatcatttgaaaagtctaaagctttcaagttcatttcccaaagctgtttttatgatattttgtcttgtgtattctcagttctccggttccatatttctacccgatataccttctgatactattgatatggagagaacgaagagacgaggttcgatgtgcagagaagtacaaggagatatgggcagagtatcttagacttgtcccctggagaatacttccttatgtttattagatgtgccaagagccaagtcatgaatcctttcagattcatcctcttgtgtcttattttttcataatcttgttttattttagcaatgctcgagtgaaactttgtagtacacgtttgagaataacttcagtccttattattattttagcattgatatcagcattttcggattttattttttgggttgtttaaaaaccagagattttacaaaagacatttgtttgatgtaaaatgtcatgataaagtaatattgtacttatgtaaaactgagaaaaatactaatagaggaacagagtggtgttgataaatgataatgctgatggatatgtttataggagaaaatggaaaattatcacaaaaatagaaattgacgattacgaagtttctagatgtaccatcttaatcgacttggagacaatttaaatggaccatacacatccgtgtttctatttacatgtcaatatacatatattctttgtctttttagtatatttccttcttttcccctattttctttttaaatattgtatgttctatatcagtttctttcttaagatattatggcatatcgtaacagttgtttccatttataatcatattttatttttagtatgtcatagagttttttaaaatttatttatttgtcaacgaggttttattaaaaaattatatacacatattaaaaaaatgttgaaaatacgtgtaaaaatctcataatttgttataataataagatgtttcattttataatcacttgaacctaaaagataagaaacaataaaaccattgaagatcctaaaagacacctttaaaacttcaaaatgtatacaacaacaatagcaacaaaaaagttctagactacatacatactgtgtcggtagaaagcaaaagactttgatagtttttgattattcatgcgtttgaagagtcgcagctgttttccggttatatgtctctatctaaatctaagatcttaattttctatgttcggagatatcaaagtcgcactttttctgtgaatctagaaacacataacatttccaataagaatattctattgagattcgtagtcaactattaagtgtttattacgattaaaaaactactataatcaatgattaatgtaatttattatcttacgatctcaattatacaattcgtctgacggtttgggccgtcgtaaggccgaagtcatgcttttccttaaataacactacgagttaccaaattacccctcagctaatttgctgagaatccacgctattaaggggtagaattaagattagccaacattgccaattagagatccaacggctgaaaaagctatttcttggggaacatgcaaagatctgacccttaattaatattttcaccaaccaatagactctcatccgcagctataaaaccaacccttttcctctactggtccaccactcgtctgccttcttccgcatctcttttcatttctctctgatttctcgatctctccgtccaactatg

SEQ ID NO: 27660 - DNA, 3000 bp, Unknown; identical to SEQ ID NO: 27659
  misc_feature (1)..( 3000): 2750-1469P.txt file - cDNA_ID_2991352; gDNA_ID_2926242; Annot_ID_204122

SEQ ID NO: 27661 - DNA, 3000 bp, Unknown; identical to SEQ ID NO: 8340
  misc_feature (1)..( 3000): 2750-1469P.txt file - cDNA_ID_2991356; gDNA_ID_1971748; Annot_ID_175229

SEQ ID NO: 27662 - DNA, 3000 bp, Unknown; identical to SEQ ID NO: 8340
  misc_feature (1)..( 3000): 2750-1469P.txt file - cDNA_ID_2991356; gDNA_ID_2926195; Annot_ID_141238

SEQ ID NO: 27663 - DNA, 3000 bp, Unknown; identical to SEQ ID NO: 8340
  misc_feature (1)..( 3000): 2750-1469P.txt file - cDNA_ID_2991356; gDNA_ID_2926195; Annot_ID_201383

SEQ ID NO: 27664 - DNA, 3003 bp, Unknown
  misc_feature (1)..( 3003): 2750-1469P.txt file - cDNA_ID_2991367; gDNA_ID_1621142; Annot_ID_56670
aagtaattgcataaaacaactacttgagacttcattttgttttaccttcctgttcaaactgcttcttcagctcctctgctggtaacagtgtttgagaggaatcaaacatctacataagaatatgttatcatatatctggtttcaaagagcagatataacggtaagcccttcaagttagacggtggcttactaggggaaaagggacacacttgctaccgggtatatgaccactcggtaaacccttccaaggttctggagcaataccgtcaaatctgtgaaacagagtaaattctatatcagatcctatgagcggaatcaacttaaaaccattagcatattatagtgaaattacaatccagaacaagcaataattttggcatgatacctagcctttgaacgcgcatcgatgtgctgataagtcttatcctcgatgttttccttcacctgtcaattatccagttagctcccctagtttactagcaactatgtataaacttcatttaagaaacggtaacctgatcaagtgccaatacaagatgtggccggaacttcgtctgaaaagttattgggctaatctgtgcaaatggcaaagatgtgaataaaccatatgtagcaggtaaaccaactaaatatgcaattttcagatacatcagattggcaaaaacttttcgatgaatgaatcaacttactgtttgtccttgatagatcttctctatagcctcagttgctgcactggctttcaaaatggcatcatttgaaacactggattcaacgtcatagcctgaagcacgccatttcggcaagcctccatcaagtacccatactttgtcatgtccaaagactctaaacatcctgttttaacaaaaggaggactcatcgatttgataataccagagaaaacatattgaggaatgataaaaaggctaatggacatgagattcataactcaccaccatacacgagctgcactaaagagccccattccatcatacacaaccactccatcgttgttctcgattccaagagcagaacaaccagcagcaaaagcttcctcagatggtagcatgtgtcgtaactgcacatgtaattcaaataatatacaatactttttggttgttgcgcatacagacacatagaagctcacagccagaaggcttgccaaagctattaatgggaatctctgaacagaaaagagtccagatttttgcgtcaaagaaacaacaatatgttcaaatgactgcaatgaagaatagttactgataatatttcatttatacatataagcgatggcagtgtaaactgtaaagtcaataagttagaaataaacaacacaataacatcttctcaagaaaaaagacagtgattctcacatttgtttttcgatctgctattccattcaaatcaaagaagagagcacctggaatatgagcaacctgtagacgaggacaacatacaagtcaatcaacattcagtcgtgtagtgaccctgatgaaaagtttcatagcgctcattcagaacaaaggcttatagcttatttacgtagttatttacaaaagtgtaaatcttctcacttgatactcttggattggatttctttgctcatgtgccatgtaccatgaggcatccaaaacctgaccatgaaacaaacaagttacataagaatcatggcagaaaaaggctacaatctcaacaagtgcaaactataagcattctgagacgaaaataaacacagcaagaacgtcaggttacctttatatcagcatctccaagattagagtggagccaatcaacagacacaacaggttcattggtagatatgggtgcgtaattagcttttgcctcagatccagaagaagccatgactcgaccaaagtgagtagatttagaagctggataggcagagcgtaactgtgagctgaatgctctcttctgcaagtaatcatttacaatctcggaattacaaaacagaagatataaaaaaatcgaaactttgaacacaattcagtagagtgaattatacaagagaaagttaaactcagatttgaatcatgtgactcagatattatcggatatctacacacagctaactataactcccaatgtgaaacctttctaaactcgaaagcccactactagtagtacccaaattatacaaacaatttaaacagtaactagaagtgaatatctaagctcagagaaggtcgaaatcgaattaagaaacaacttaaattcaaaaaggttgcgcaattacgagtcttgtgatgaggaacagcagatagagagggattaatctggcagtgaccagaaaccaataaagttgttgagaaaagtgtcgaagccaaatcacctcaaaataccatgtacagaacaaattgctgagttaaagccgccaaattttgctacttccagattctctgagctcgcaactttttcaagcttcttcgttctcaacgatgctgcttctgccacctagatgattaatagattatcactgatcactagtgatcaggataagtgacgcgactaacgcatgtttaattatataaaattcacgtttgccttctctttgatataattcgcgttcgcgttctctttattaaaaatcgcgtttctgataaaacgcagtcgtttggttttacttcccttttcttcttccagaaaagaattcgtaaaatctcacttcaaccttctcttctctgcaagaaacctaaaagcctatttatttcacctctctctctctctctctgcaactaatcacttgttcgatctcgaagctgaagctaaaggtaagctattctcttcacagcgctagttcttttccgaagattcgtgtcgatctcaaaaatcccattctatcaaattgtttttaagactctaatgatttaaccaaaccaaaacctgaatcgtttgatcccggtgacgttgaaaccctgaattccggggaaattgatcctactcgtttgtgttgttcacagctttcgctaatttgcttaaggagctatg

SEQ ID NO: 27665 - DNA, 678 bp, Unknown
  misc_feature (1)..( 678): 2750-1469P.txt file - cDNA_ID_2991371; gDNA_ID_2926272; Annot_ID_143436
cttgaagcgcaaattgatgcgttggatagaaaaattgatcatcctcataaataaaaattatatgaatgagatctatatgtatatagttaattttgcttaagattaacaactttaaaatgtatatatttagtaattttatgatcatttcaaaggcattgtgtatttgaaattcattagtattattttgtagttagtgagagatccctataattatgtcaacgaaataaatagattgaaaaaacagatttgccttgcattcctaacgacctccacatgttggttagaaccttctagaatcagaaacagtagctagggtgttgacgtgtcacctaactagataccgtcactaataaaaatatcaccgcaccgtcaccgaaaacttatatccaatctctcaccttcgtggaagattttaaaacctgtactcgctgcgtaatttctttcttttgctttaaatcctttttctttttttctcttttatctttttttcttttccacggttgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatg

SEQ ID NO: 27666 - DNA, 678 bp, Unknown; identical to SEQ ID NO: 27665
  misc_feature (1)..( 678): 2750-1469P.txt file - cDNA_ID_2991371; gDNA_ID_2926272; Annot_ID_205154

SEQ ID NO: 27667 - DNA, 3003 bp, Unknown
  misc_feature (1)..( 3003): 2750-1469P.txt file - cDNA_ID_2991377; gDNA_ID_2926236; Annot_ID_203876
tttccaacaaaaaggactttttccttctccgcacactcctatgcaagtgatgcacaaagccgagagaaaataccaagtggggacaattgcagatgaagaacaagcaaaacaaaggcagttaaagagcatcctgaacaagttgaccccacaaaactttgagaaactgtttgagcaagttaaaagtgtcaacattgacaacgctgttacactttctggtgtcatttcacagatatttgacaaagccttgatggagccaacattctgtgagatgtatgcagatttctgttttcatctctctggggcgttacctgattttaatgagaatggtgaaaagattaccttcaaaagattgcttctcaataaatgtcaggaagaattcgagaggggggagaaagaagaggaggaagccagtagagttgccgaagaaggtcaagtagaacaaaccgaggaggaaagggaagagaaaagacttcaggtgcgaaggagaatgcttggtaacatcagacttattggtgagttatacaagaaaaggatgttgactgagaaaatcatgcacgcatgcatccagaagttgctcgggtataatcaagatccacatgaagagaatattgaagctctgtgtaaactaatgagtacgataggagttatgatcgatcacaacaaagctaagttccagatggatggatattttgagaaaatgaaaatgctatcatgcaaacaagaattgtcttctagggtgaggttcatgttgatcaatgccatcgatctgagaaagaacaaatggcaggagagaatgaaggtcgaagggccgaaaaaaattgaggaagtgcacagagatgctgcacaagaacgccaaactcaagcgaataggctttcacgtggaccctcaatgaattcgtcaggaagaagggggcatatggagtttagtagtcctaggggaggaggaggaatgctatcacctccagctgcccaaatgggtagttaccatggaccacctcaaggtcgtggctttagtaatcaggacattcgatttgatgacaggccatcttatgagcctaggatggttccaatgccgcaaaggtcagtatgtgaggagcctattaccttgggtccgcaaggtggtcttggtcagggaatgtctattagaaggcctgcagtagcatcaaacacttatcagtctgatgctactcaggccggtggtggagattctaggcgaccggccggtggtttgaatggttttggctcacatagacctgcaagtcctgttactcacggacggtcaagtcctcaagagcggggaacagcttatgttcatagggaatttgcaagtctgtcgcgtgcttctgatctgtcaccagaagtttcgtccgctaggcaagtactacaagggccatcagctacagtaaacagtcctcgagaaaatgctttgtctgaagaacagttagagaatctgtcattgtccgcaattaaggaatattacaggtactatatctctcctttcttgctggtcatttgtttcattcttcgcaaagtcatcagatactgccacatttaggaaattattctgtgggaacctgtgtaggtataattggatcaaattacagttcattcgtttacagttagagcgtttgtttacaacgacagatcatctgataaagtgtatatttcttgaagtatgtaaattagaatttgctccaaacaaaacggcttaaaaatacatatgagagactttgttctttgactttaatagaatctctaatacaggggtaaactctgttttttttactgactgtgcgttttatgtatgatgttagtttctattcgtttaccctctttattattgataagcactctggtgcgttccaatgtgttcttgtgcagtgcccgagatgagaatgagattggtatgtgcatgaaagatatgaattcaccagcttaccacccaacaatgatttctctctgggtaactgattcgtttgagagaaaagacaaagaaagggatctcttagcaaagctccttgtgaacctcgtgaaatctgctgacaacgccttaaacgaagtccagctagtgaaagggtaagtaaacaaagcccataaatcttgaagccctagtctaatcaaacgtctgttgcttaaatcttttactgctttttttttcacaggtttgaatcggttttgaaaaccctggaggatgcagtaaatgatgctccaaaagcagcagagtttcttggtagaatatttgggaaaagtgtgacagagaaagtagtgacattgacagagattggtcggttaatccaggaaggaggagaagaaccaggaagtctgatagagtttggattaggcggcgatgttcttgggagtgttttggagatgataaaaacagaagctggagaagaaacgttggttgagattcgccggagctcaggtctgaggattgaaaatttcaaacctcatgcacctaaccggtctaagatattagagaaatttacttaggaaaaaaaaatggaaccatcttttgggttcctttcttcttctctttttttgtttctctcttaaaagtcttttctcttttcaagtgcttcaaacaaaactaatttgttataaagggagtttctctattttattatatagcaaaaaacttccaaaatttctcatttctgtgtttaaccttttcgtacatcagttttaaagcacagagagctcaatgttcttccaatatcgttattaataaattttgattaaattcaatcaaatcggagttatattaccacatgaggttaaagggccatattaaaaagtctgcacttcatatgagcaacaaggcttttatgtctttatggttgatttgatggcccatatatgatagttcaaaggcccatattaaaaaatgccctaacatgattcgattcgtatataaagacgcttaatgtgacaagcgaacttgctcattagggtttctcatctacgacggcgtggtgttcctccttcctgctctgaaaaatg

SEQ ID NO: 27668 - DNA, 3000 bp, Unknown; identical to SEQ ID NO: 14849
  misc_feature (1)..( 3000): 2750-1469P.txt file - cDNA_ID_2991381; gDNA_ID_2684229; Annot_ID_192175

SEQ ID NO: 27669 - DNA, 3000 bp, Unknown; identical to SEQ ID NO: 11280
  misc_feature (1)..( 3000): 2750-1469P.txt file - cDNA_ID_2991385; gDNA_ID_2214487; Annot_ID_183539

SEQ ID NO: 27670 - DNA, 80 bp, Unknown; identical to SEQ ID NO: 3346
  misc_feature (1)..( 80): 2750-1469P.txt file - cDNA_ID_2991393; gDNA_ID_1620642; Annot_ID_47504

SEQ ID NO: 27671 - DNA, 2814 bp, Unknown; identical to SEQ ID NO: 3347
  misc_feature (1)..( 2814): 2750-1469P.txt file - cDNA_ID_2991393; gDNA_ID_1620642; Annot_ID_47505

SEQ ID NO: 27672 - DNA, 3003 bp, Unknown
  misc_feature (1)..( 3003): 2750-1469P.txt file - cDNA_ID_2991393; gDNA_ID_1971821; Annot_ID_176173
ccgtagatggttgtatccgcatttctcccttccttgcgggcgaggtgccttgctgcggccatagcatggacacacgggatcttgtctatatcaaaacatttgcatgaacaacttttcattttcaaatccaccagaaaacttaccgagttgagatcaatcacgttgtattcttggttgtaactgttaagctcaaacacagttaatttggctgcaacttgacatctaatgtgcaatatgttctccacagtaggcacaacttgtgctgtgattggacaagaacctgaagcttgcctatgctcgttgaaccattcagaaaacttagaaatcatcacatcaatcattggtaacaagtggtattttctcgcttttttaaacacaccattaatggactccgcagaattactagtgtcaatgttatacttgtctcctttaaaatggcacctcgaccatttctcaaaccctactttcacaagaaagtcagcagctttaggccataaacttgtaaaatgaccaaactctttctcgaactcactctcagtatatgcatgagcacaatccctgaacttgacagcagctccatccttgtcaattgtcacacgatctctcatgttttgacacaaatgccatatacaagctgcatgaagcgcattcgggtacaccgtcttgacagccttctttatgctttgatgcctatcactaataaagaccaatccgggaacatccgaatatacagttttcagcttttctaagaaccaaatccaacttacatccttctcgctatcaatgattccaaacgcaagtggataatgatgatgattaggatcttgtgctgttgcaataaccaacatcccaccatacacagttttaagatgagttgcatccacaactatcactttccgcattgccctaaaaccttcaatgcaagcgcctaatgcaatgaagaggtacttgaactttttctctccttccaactccacataagttactgtccctggatttaccttctctaacatgtaaagataagaaaataacatcgtgtagcttctttccggagtccctcgcacatcactaacatgtagcattttgcctcttaaggcagtggagtatgaacaatgcaccccaagtcttcctcttacaatcgacataatgttttttggagttggggtctctaaatttccgggataatcacaatgtaaaaccgatgctattaatcttggtgtgcctcgctgtatactgttgcttgtagtctcaacactccgagagcatgtatgcatctttctatgcactctaacactccaaaaatgagattttttagttctcgcaactcttagataccaagtacaccctttagaagcttggcggcatcgtagcataagtctcaacgggtctgacttaatagtatagactccaaaaacttctttctttgcagctctgttaaccaattcccacacagcctcccttgaacaaaattcttgaccaatttcaatacccgtaccatcatcccattctataacctgcggagtaacttctacacttcgtggaatatcgtgaatatcatcataatcaatcctatcatcctcatcttgttcctcaacagaattcaccggcctttccatcggcctttcgatagccacgatctccgtacctactacattctcacaatcattcacatcattatcatatccatcatgcaccatctcacatacttcatttaaaacatcatcctctattacatttacaccaactgaacttcgacgctccggtacagaaatttcctctctcctctcaactcctataccatttaattcctccacatgcaaaacaggaatccgactctcttcatcagattctgttaaaaatatgaagacatcctcatcatttacaatatatgtctctctcctaactttagacagattgtaactcagtttcaacttgacagaagcttcatcaatcgcaaccttcttcatgatcttgtcaactaacatcgaatagctaatcttctccaaactactcgtcttaaacgatataacatatagtgaatttttaccaatccactcattcacttcagaatagtatcctccaaagtcaaaatgtaccttagtgtggatcttcttcttcatcgctcctgaaaatacaaccagttcaactccaatcaaacattttaatagttataccacatgtactcttatcatacgttgaaatcaatctctcgtcgcactcgtctctactgaacctaattcgttacctttcaattgatttccaatgttaatacatacctattcgttaaactaattggttaatctaaactttgcaaacacaaaccccccaaatctttaatatgaaatctcggaattcaaattcaactcacattcaacctacattcctttgctcatcacctcaaataacgtttcggcaacctctaatcgattactctttactttgcaaaccaatcatcaaactatcaaattgaatcgagctgggaattatatagaattcaaaatcccaatctaaaatcacaatgcaccaatgtcaaaggaaatatgagaagaaactgacctaattcgtggcttttacgccggatttcaagtcggcggcatgaggaaatcgatggtggccgacgaagaagatgaacgtcgaccaaagaagaagaacacgacgacgaagaggagaatctccgaactcgattttctttatttagcttttgaatttctttttcatttttttaatcaactcattaagggtacaactggtatatcacattttcggtggcattcagattaacttatggcagtccagatcagttttttcaaaaaagtggcataagtgataaaagtccccccctgcggtttggtttcttgtccgctccaaaacttgtgagggcattttagtcattacaacatgggaactggatttttaaactggtgaattcgttagcgtttatgtgaataatcatccatcatcaggaaagatccgaagaaaagcgacgccgttttaaaggagatg

SEQ ID NO: 27673 - DNA, 3003 bp, Unknown
  misc_feature (1)..( 3003): 2750-1469P.txt file - cDNA_ID_2991393; gDNA_ID_1971821; Annot_ID_176174
tatgaagacatcctcatcatttacaatatatgtctctctcctaactttagacagattgtaactcagtttcaacttgacagaagcttcatcaatcgcaaccttcttcatgatcttgtcaactaacatcgaatagctaatcttctccaaactactcgtcttaaacgatataacatatagtgaatttttaccaatccactcattcacttcagaatagtatcctccaaagtcaaaatgtaccttagtgtggatcttcttcttcatcgctcctgaaaatacaaccagttcaactccaatcaaacattttaatagttataccacatgtactcttatcatacgttgaaatcaatctctcgtcgcactcgtctctactgaacctaattcgttacctttcaattgatttccaatgttaatacatacctattcgttaaactaattggttaatctaaactttgcaaacacaaaccccccaaatctttaatatgaaatctcggaattcaaattcaactcacattcaacctacattcctttgctcatcacctcaaataacgtttcggcaacctctaatcgattactctttactttgcaaaccaatcatcaaactatcaaattgaatcgagctgggaattatatagaattcaaaatcccaatctaaaatcacaatgcaccaatgtcaaaggaaatatgagaagaaactgacctaattcgtggcttttacgccggatttcaagtcggcggcatgaggaaatcgatggtggccgacgaagaagatgaacgtcgaccaaagaagaagaacacgacgacgaagaggagaatctccgaactcgattttctttatttagcttttgaatttctttttcatttttttaatcaactcattaagggtacaactggtatatcacattttcggtggcattcagattaacttatggcagtccagatcagttttttcaaaaaagtggcataagtgataaaagtccccccctgcggtttggtttcttgtccgctccaaaacttgtgagggcattttagtcattacaacatgggaactggatttttaaactggtgaattcgttagcgtttatgtgaataatcatccatcatcaggaaagatccgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggtgagattatgattgttactgattgtgttagttatttcattgtttgatgcacaaatatgagaaacctctgaatgaaaaatgcttggtttgcttgaaatttggaagagttagtgtaatcaagtggctagaccttatcatttagtgtaatctatgagtttctaaatgtgtgttggcttcttggttcatatacaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatcaatg

SEQ ID NO: 27674 - DNA, 80 bp, Unknown; identical to SEQ ID NO: 3346
  misc_feature (1)..( 80): 2750-1469P.txt file - cDNA_ID_2991393; gDNA_ID_1620642; Annot_ID_163051

SEQ ID NO: 27675 - DNA, 1939 bp, Unknown; identical to SEQ ID NO: 3362
  misc_feature (1)..( 1939): 2750-1469P.txt file - cDNA_ID_2991393; gDNA_ID_1620642; Annot_ID_163052

SEQ ID NO: 27676 - DNA, 3003 bp, Unknown; identical to SEQ ID NO: 27672
  misc_feature (1)..( 3003): 2750-1469P.txt file - cDNA_ID_2991393; gDNA_ID_2926195; Annot_ID_141214

SEQ ID NO: 27677 - DNA, 3003 bp, Unknown
  misc_feature (1)..( 3003): 2750-1469P.txt file - cDNA_ID_2991393; gDNA_ID_2926195; Annot_ID_141215
ttaagggtacaactggtatatcacattttcggtggcattcagattaacttatggcagtccagatcagttttttcaaaaaagtggcataagtgataaaagtccccccctgcggtttggtttcttgtccgctccaaaacttgtgagggcattttagtcattacaacatgggaactggatttttaaactggtgaattcgttagcgtttatgtgaataatcatccatcatcaggaaagatccgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggtgagattatgattgttactgattgtgttagttatttcattgtttgatgcacaaatatgagaaacctctgaatgaaaaatgcttggtttgcttgaaatttggaagagttagtgtaatcaagtggctagaccttatcatttagtgtaatctatgagtttctaaatgtgtgttggcttcttggttcatatacaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatcaatggcggcaaaaacttttgaaattcgtttgctcattgatctcacaacttttttttgcgctttgtttctctcatcgatctcagttttatgtgtttatctctccttggcagagtccatggttgagcatcttgatcatcccgacttcccctgaattcgcctactttgtcaaaaatgtgttgtgtgtgtgtgtgtgttgttcctctctctctgcctccctcgtatgaaaatggtaacatttacaattggaaagtcggtgttagcctttagctattagctgaagagctagttttcttgttgcccaggccattctttaccctatttttcatctgaagtaacaatgaaacaaaatctatatatactcgagttttgctttctaggatctgtatttcttaattgtttctatattttgatcaattttgaacttttcatatcaagttatcaacatgtgtagtagcaacccttcaataatgagaccatggaataaaagcctatcctatatgtcatccagtttttgctaagataaattattttcagttacccaaattacataatcaaaactgatatcataaacaacaaaaatagcacacacaaaaatcataactgaatctgattcttccagaaatgtgaactgttgtttactataaaaagaagaaaaccagaaccacaatacatttgactccatgaatcagtcatactagtccaacatactaaatataaaacttaaggggcaatattgaaaattagacaaaagttgatagaccaaaagataaattaataacagttaccagtatctatcgccaagtctcccctagggttttttttctctgaaacggacatcgagaaattccaggagtgagttttgacaatcggagagaaatg

SEQ ID NO: 27678 - DNA, 3003 bp, Unknown; identical to SEQ ID NO: 27672
  misc_feature (1)..( 3003): 2750-1469P.txt file - cDNA_ID_2991393; gDNA_ID_2926195; Annot_ID_201355

SEQ ID NO: 27679 - DNA, 3003 bp, Unknown; identical to SEQ ID NO: 27677
  misc_feature (1)..( 3003): 2750-1469P.txt file - cDNA_ID_2991393; gDNA_ID_2926195; Annot_ID_201356

SEQ ID NO: 27680 - DNA, 3000 bp, Unknown; identical to SEQ ID NO: 2411
  misc_feature (1)..( 3000): 2750-1469P.txt file - cDNA_ID_2991397; gDNA_ID_1620531; Annot_ID_159737

SEQ ID NO: 27681 - DNA, 3000 bp, Unknown; identical to SEQ ID NO: 11661
  misc_feature (1)..( 3000): 2750-1469P.txt file - cDNA_ID_2991401; gDNA_ID_2214508; Annot_ID_133793

SEQ ID NO: 27682 - DNA, 3000 bp, Unknown; identical to SEQ ID NO: 11661
  misc_feature (1)..( 3000): 2750-1469P.txt file - cDNA_ID_2991401; gDNA_ID_2214508; Annot_ID_184179

SEQ ID NO: 27683 - DNA, 3000 bp, Unknown; identical to SEQ ID NO: 10380
  misc_feature (1)..( 3000): 2750-1469P.txt file - cDNA_ID_2991409; gDNA_ID_2213646; Annot_ID_132381

SEQ ID NO: 27684 - DNA, 3000 bp, Unknown; identical to SEQ ID NO: 10380
  misc_feature (1)..( 3000): 2750-1469P.txt file - cDNA_ID_2991409; gDNA_ID_2213646; Annot_ID_181439

SEQ ID NO: 27685 - DNA, 3000 bp, Unknown; identical to SEQ ID NO: 1427
  misc_feature (1)..( 3000): 2750-1469P.txt file - cDNA_ID_2991424; gDNA_ID_1620400; Annot_ID_155918

SEQ ID NO: 27686 - DNA, 19 bp, Unknown
  misc_feature (1)..( 19): 2750-1469P.txt file - cDNA_ID_2991447; gDNA_ID_2926237; Annot_ID_142768
gaattcgtgattttagatg

SEQ ID NO: 27687 - DNA, 3000 bp, Unknown; identical to SEQ ID NO: 2765
  misc_feature (1)..( 3000): 2750-1469P.txt file - cDNA_ID_2991451; gDNA_ID_1620589; Annot_ID_161380

SEQ ID NO: 27688 - DNA, 3000 bp, Unknown
  misc_feature (1)..( 3000): 2750-1469P.txt file - cDNA_ID_2991455; gDNA_ID_2936587; Annot_ID_143883
taacaccaccggagcttgaaggaggaggaggagagtaataataagatccaccgccaccggagcttgatggcggaggaggaggaggagagtaagaagatgggacaggattacatggattgtcgcaagaggaacacattgtgcaagaaacagtttcgtcctttgaagtcactaaaagaggcagtgacattaagagaataagaagacctgacaaattagagaatctgattgcttccattgtcagaaatttgttgtctgacaaatgagctagagatttggactaaagtcaagtgataaggaagagagaagatgaaagaagaaaagagagagagaagaagcacattcagaggctagaataaaagtgttcctctctttattgacgaatttaagatttttaaattattaaattgtttattgaaaaataattatttgttttcgttattattaaagatttaaaggttatgcacaatttgttttgtccaaaaaaaaaaaaagttatgcacatttgccatatatattcgtatacttagacagtatcttgaaaatgttactttcaatatctgtaaatttactttcagatataattctttagttttgttggaaaatttgatcgcatgaaataattcatcagctaacaaatgaaataacaaatttacaggcactaaaaagtaaagaacacacggagccaacacgtttgacttctagccgaaggtttgtgtaataaaagcaccgaaaaaacgcggtaaatgtcaaatggtaatgtgttcaacctaaagtttgagatcatcattcctttttatatatgaagtcgtatagatgacttttaatataatctttttaatttaattttagatatgattttgtacaatcgtaatgcacgtcgcatacaaaagatgagccgctcgaaatgtcattttttgcattgttttatttcacgctcttcttcatcaaaatggatatatataatacggatatacctgaggcttgagagaactagctgtacgatttttggaactaagtaaaaaatcgtgtaatacaatgtttgttgctagacccgtttgtttttgttaggtgaggaagagtgtacacgtggcacttaaagattggtgagcaaagagaagacacgtggatatgagaaagctgatgtcatgtcattatctcttgtggtctagagtacgagctatctagagataagatttttgcgttatttcgttgacacaaaagcagtaaaactgttaacctaactgccaagtaagataattttgatcgtattcaagcgttagcaacacatccattattcttattttcgatcaagtcagcgaaattgttacatttttagaagaataagtcagtgattacattgcaacttaggtttatttacagtactgttgtaactgaggtttttccgacgacaacacacattatgcttcaacatcgtttgtaatcactgttaacaacattttcgccacatatttcggtcccaaacaacttttataaaaaaaaatgtgtctaactctcttatatatgtcgctaacgtcggagtttcaaacaaggccgacatactgtatgttattattctttcaaaataatttttcattagtcgttatgtcttatttgttctatcaaacgaggtagacatataaaacagatttgggcttcgtttaaaacagtttagcaaattcagtgatgaaagaatgagaacactgtaaatcgatgctgtggttaagactccgtttgcaatattatatatcgatcgatgcaaataatctgtcattcgtcctttgttcgagtatgtgtgtatatacatagttgcattgatgcaaaaggaccagtctcatcatcatgaaacaaaataccattgcattgaataaatcgtctttcaaatatgcataagtgatagagacaaaaagaaaaaaaatgttgtctgtgattgattacattaatgcacccaatgtgaatgaaagtggggtgaagtaagttgcactatgaaaatgaaagaaagagaagatcaaacaaaatcacaagggaaaaaggaaagaaagctctatatttgttggttgccaaatattaattggattcttccttgtttgttgataaaagatattaaattcataccacaactttattcccttccctcacatgcaacttcttttctttacttttgtttcttattacaaattgagatgactcatgtcgctctcgagcttttatttgtaataaaaagaataattcgtacgttaatctgtcgaatcatttgttacaataatacaacgttcttaagctaattattctccttcaatcaaacaattatcaaccaaactattagacataatgctgatcatgacttacgaaattatcaacttgaaatgaattgactataagtagacaggctcatatcctaagtatagataacgattgtatcaactatcaaccataccaatttagggtcataccggtttaggtttggagtggactagtgtttgttggttttttgatactccattttagtattttactaaccttttaattcaagggacaaatcaactttaagattcctaaaattgttgaaaaaaataaaaaagattcctaaaattaattagaaataaatgcgggcagtttcaattctcaggcaggaacggacttgtggtagaccaacgttacacgtgtgaagcatagcaacgaaaccacttcctctgttcggtccaatcgaaaccaaaccgcgtgaaacgactgaaaatcaaaggtgcaaaactataaataaacataaaactcgagggtataacaggtagaaacaaaacgttgtcttcttgtgtccttgtccgaagttgtagttcggtaacaagtctttcgcttccatttcttcttcccaccttttctctctctctctctctctctctctctctctctctctctctctctctctctaccgtccttctagggtttctttgatcacattcaaatttgtcgcctttaatctcaatcctgtaagaatcagaggatatg

SEQ ID NO: 27689 - DNA, 3000 bp, Unknown; identical to SEQ ID NO: 6487
  misc_feature (1)..( 3000): 2750-1469P.txt file - cDNA_ID_2991458; gDNA_ID_1621095; Annot_ID_170933

SEQ ID NO: 27690 - DNA, 3000 bp, Unknown; identical to SEQ ID NO: 6487
  misc_feature (1)..( 3000): 2750-1469P.txt file - cDNA_ID_2991458; gDNA_ID_2926162; Annot_ID_198860

SEQ ID NO: 27691 - DNA, 988 bp, Unknown; identical to SEQ ID NO: 229
  misc_feature (1)..( 988): 2750-1469P.txt file - cDNA_ID_2991466; gDNA_ID_33017; Annot_ID_146960

SEQ ID NO: 27692 - DNA, 3003 bp, Unknown
  misc_feature (1)..( 3003): 2750-1469P.txt file - cDNA_ID_2991470; gDNA_ID_2214611; Annot_ID_135746
tccctccagttacagtgctctcttttccactatcgccatgattgctcaaacgtgaattgaatgatctgatccataatctaaaaaattgagctttcatcagtaaccgaagcaatggcacggaggtctggaaattgcatgagatgtctagtgatattctcggtggtttcagcattattagtgtgtggacctgctctttactggaaattgaataagggtttcgttggatctgctcgtagcaccaactccatttgtcctccttgtgtctgcgattttcctcctcctttgtctctcctccagattgctcccggtactgttgttacatctgggttttcaatttgattcataaaataggagactttataaatctggaaatgcttagatcgtgcttggaacaatcttgtggtttctgtgatggatctttctatcaaagctacggcttttaaattgtatacataagaagagtctcaatttctaatgaagtttcattcttttgcagggcttgcaaacctctctattacaggttagatctcgttcccaagctttgaaactctgtatgtattgtttcttcagtttctctagtatctctactgatttagtatgaatgagaatgcctatctgatgatttctcactgagaacccttactgaatcgtttgaaaacctaggaatttgtgaatcagtaaccaatgggtgcaactatatctcttaaagttagactttatttgggtttcttgatcagacataggagcctaagattctcttatctgttgccaattgcattaggaatacttttaacaaatagtttttttagttatctgttgagaagatgttcctcttttagtccatggaaaagtagaatatgatatatctgttgacttgtgttatgtatcaggttgtggcagcgatgatccagagctcaaagaggagatggagaagccgtttgtggatcttctcacagaagagctgaagcttcaagaagcagtggcagacgagcatagtcgtcatatgaatgttacacttgccgaagctaaaagagttgcttcacagtaccaaaaggaggctgagaagtgtaacgctgccactgaaatttgcgaatcagctagagagagagctcaagcattgttgctcaaagagcggaagatcacttttttgtgggagcgcagagctcggcaattaggttgggaaggtgagtaagtaattcactgtttagtgacttcttcacagtctactctgacgagtttctcaatggaagcaaactagattttctcttccgtatacaactcgtgagaacatgggaatcgcttaattcgcaaggcaatgtttttgtctcacatgttctctatatatgtagttcttttttgttttgctcttggctctagacactgctaaagaaagggttggccttgtattgacttttttcttcagatatatatttgtcagtcacactggacaaagtcaccgacttctgtattttattgttcatgtttattggcaaacgcaaccatcattttctcaccaggcaaaagcaaaatatataattatgatcttattgaacttggatattgtgttttttgagatgtgcatctgattgagacagcaagcctgatttgatttgtaagaggatttgttttgcagctaatgttggatgcatctgtgattatggtttaagcataagtgtgggtcaagagtcactaacaaagacttttgagatgtttaactaacactagaatttgtgaagagggacaagagcagaggaagagacaaaattagagaaaagtcaagaaagggttgacataatgcagcatatgatctctccaggtattacacagcaccaactttcaatactcattcatgcacaaaaacagctgcttttttctgtttatttgatttgtttatttttactagtgtcagccattaataatactctctttctctcgttgcattattctaatgctcacatggacagattccttaaaggtttttattaacactttagatctaccattaaagaacagatctcggttcagtgacttctgcaaaccgtctagacccatgtgggttgtccaaactctatagcttgaggctatttgttctatattcaacttattatgtggttatgtttcttttatgttcttctctgaagcttcctttgtggacttctgctgtttttttcctaactttggaatagtttttgtttatctctggacacagagatcgcaaattcttttttcttaaatggaaggttccatgaacaagcgaggatacgaatgcagtcaagaggatactgacaagctgccagaatcaaagagacaaaaagtgcctgctttagcaaggtaacttccttaaggattttctgtcattttctagttcaaagtagctcaatggttaaacatcacaactattgaggaagaacatgctttgttgtaagattcatggaggagaatgtgttccatttgaaactaagattctttactctttctgagtgagatttgttctttgttgagaggttcttttgtaagctctcaaattttagtttttatgtttccagacctcttgattatcttgcaagtttgttgattttctcatatgaaacaaactttttctagtgttattgtggaagctgtcaaagtagatagtctgcagaggctttgctcgtctttggagccgttgtttcgcagaattgtgagtttctattctacccctgatctagccacgtaatgctattatagtaaattgtgagatgcttgtggaggtgtttactgggtatggtgtggacaaacacacaggttagcgaagaagtggaacgagccttatcaaggttgggaaacgcaaagttaacctcgaggtatttgctccattataccttttcctcttgaaatggctctatgatctttgtagcgcttagtttctgattaacccaacataaaatctccaggtcaccagaaccaaagaggatccaagaccgcaatggaagaaacctgcaacttcactttaggacgcgaatg

SEQ ID NO: 27693 - DNA, 3003 bp, Unknown
  misc_feature (1)..( 3003): 2750-1469P.txt file - cDNA_ID_2991470; gDNA_ID_2214611; Annot_ID_187364
aatattcagccagagattggttaagtggagcatttgtttatacagccatggttaattatccaactgcagctaatttcatggcgccactgcctggttatcccgtagagcaggtgagatattcattcgttaaagtgtgtcatcgagtattttctttttcccgaccgtcattttctcttgcatcagatgtgcaagatcatcgacgggttccctcgaggatccagtaatcttgaccgtgcctttgctgctgcaagcttatactacaactattcgggatcagaaaaatgcttcgagatggaacaacaaactgatgatcatggacttgatggttggcaatatcaggtaaactcatttagaccgtcatttagatatttgaacatattctaatagatttgacgatttgcagtcgctagagcaagaaatggttttatgttatgaaacttaaaacttataaatgacacaaaatgattattgaatggaaacaggcgtgtacagagatggtgatgccaatgagctgctcgaaccagagcatgctccctccgtacgaaaatgactctgaggcattccaagaacaatgcatgactagatacggagtcaagcctcgaccccattggatcaccacagaatttggtggaatggtcagtttttttcttcccctccattggatcagtttcttcggctgtaagattcaatatcctgctctttggtcatcttttgcagaggatagagacagtactgaagagatttggaagcaacatcatattctccaatggaatgcaggacccttggagccgtggagggtaagtggtactacacagtactattcggttttggttcttaaacagatggattattttcatcaaattttcagggttctgaagaacatttcaagtagcatcgttgcgcttgtgaccaagaaaggtaaacacttctgttatgtttatgaatgttggggaaagttagacagagatagatttgagtgaaaaatcgaaacctaacattgttttgtgtggaacaggagctcaccatgcagatctcagggctgctacaaaagatgacccagagtggctgaaagagcagaggaggcaagaggttgccattatagagaaatggatcagtgagtattacagagatttaagagaagagcaatagaggagccaaacaaaagtttattgcactaaaaatcaacaaataaagaaactaggtgtttttgattcggttcgtgtaacaaagtaaaagcttcaccaggaatttgtattccctcaaacaaaataatctgatgtttgtttctctatggagtgaattctgtaactaatatctgattatatcgtggcattcatgaaaatgttatggaacaaagagggtatcatcgcaaatagtcaaaaatgtcacgcgtatttaaaccctaattagacaccgagaacataagtaacgtacgacacattcttcatgaaacaaatgcgaattcaattagattcctattcttcttcttcgctctcttggtccaaatctgttgtcgaggtaggagagttacaagtcccgaaagtgtatcccttctgtgtcaacttgacggagaccatcatgaataaaggttcttgtggcaagtcagatttttgacttcttatcccgtttggcttggacaatctgatcagctatatgttcggacaagacatgatcgtggaattggcttaggagaagttgatagacgtagtttggttcgaagtttctgaagtctagaaagattagtgggtcgggacctcgagaaggattctggtaagatccgagactcgtgacgctaccatccctgtcgtttatgataaattcctcgaagtctctgtctcgactgatcattaccgagtttaagaaacctgacgatgatggagtacgagaccaagcggttacatgaacatcgagtttcattaattcagtatccattgtcgaatttttattcgacaaaatcagagagaaaatatgattcgtggagaattaaagtgtaatgttatgtttttataagcatagatctgattataatttgttctaacttctaacgcgtttatggaatttccttttttgtctccattttttttcttttttcgttcttattttctttttgtttaaattgtttaatattatttgcgggtttacgatgtgtttatagataagatattttataaaacaaagaaaaaaagaaaatctttctaaaaactgtaattaatatttgctataatacaataaaaagtaaagtttggtagtggatcatgctgaaatttaaccttgaaataactaagttaatgaaatttgatcattttataaaaagttaaactaaattttaggatttaagtgttttttcgaaagttcataattttttcgttcaaaatttaaaagttttttttttttttggttcagactatgaatgatcatttgatcgataacttgttttttattgggttttgttggatttctcatagtaatttcattgttcctccttgtctttgcgattgtcctctttgacttcatggtactgaaatcttttttggatctttctattttttggaaattgcttggatagctcccgatcgtttatctttcaatcaaactacggtttcatttttctaagcccaaataatctcgatttccgaaatttcatttcacaaggcttcaaactaactccgaaagatgtggaaaaatttagtgaatacgaaaagatgtgggacgcttcataaataaagatgtgcggcaattttgtaattacgcaaagatgtaggcaattacgtaactacccaaagatgtgaggggatttcgtaaataggggaaaggtatgggataatgtcgtaattaccaaacgatgtgggggtgatagagttactagtgccaatcttggaatagatagtctccctccagttacagtgctctcttttccactatcgccatgattgctcaaacgtgaattgaatgatctgatccataatctaaaaaattgagctttcatcagtaaccgaagcaatg

SEQ ID NO: 27694 - DNA, 3003 bp, Unknown
  misc_feature (1)..( 3003): 2750-1469P.txt file - cDNA_ID_2991474; gDNA_ID_2214701; Annot_ID_136875
aggaggagcagaattctgttgcgcttctcattcatatgttatataatgatgacccagaagagatgtttaaggtgcattgagctcttgcacattcagattcattaatgtgtgtcatatctttatgctgactttaggctttctagttattggcttacattaatatttttaatgtttaatggcatttattcccagttgcctttattctttgtttgtaattttcaactgagacatagattatacttatccccaggagtcatcatttccttcaaaattctattaaggttttggctttcagtgtttgaagctgtttaattgaatttcagatagtcaatgtcctgaagaagcatttcctgacaggagggccaaagcgcttaaaattcaccattcctccccttgttgtttctactctaaaggtttgatttcttaagcgaagttattctttaaagcccctcataatttatgttgagcttaatttgcgatgacatggtttggttgtttctatttatgtgccataccgcatagaagagtatctgatatagtttgttaattttgttcttcttcaaattctgtaatttttgttgtctgttttgtttaaattgtagctaatcaggcgattgccagtggaaggagacaatccttttggaaaagaggcttccgttactgctactaaaatattccaatttctaaatcaggtaagtttcataacttttcactgccttgtgtgttcagatctgtttttaggtagaacaatgtgtctcagagctacattacttttttaaaacttagccaaagttagttcatacaagctgattgacaacgttgaaaattctcaatcaacagtttgtagatattagctaaagagactgctgttattgctctgtctccactacagtcatcagttcttgtatttattgttggatttttttgcttgttgcagattatcgaagcgctacctaatgttccatcacctgacctggcattccggttgtacttgcaatgtgctgaggtaaaactacgtacctgtttatttagtatgcacttgctcggtaaaatgctcacagatctttcctatttcatcaggctgcggataagtgtgatgaagaaccaattgcatacgaatttttcacccaggcatacatcttatacgaagaagaaatttcggttagttatgttttcgcggacgttcatatgtctcgtgtctaaaccaaagcaagtaggtgagtttaactctctctcgtgcgtcaaaaacttgccttttgaacaggactcaaaggcccaggtgactgcgttacaacttataattggaactctgcagaggatgcaagtatttggtgttgagaatagagatacattaacgcacaaggctacgggggtatttcatcatgatatgataattagtctcttaccatattcaattgtctctgcttaaaggctgacaagggaaaacttatactcttgcagtatgcagcgaaacttctaaagaaacctgatcaatgtcgagctgtttatgcctgttctcatttgttctggctggaagatcgtgagaccatacaagatggagaaaggtaatactttcttctgtgcgatagaacacagtgtgtttaaaatagctcattaggtttcttacttgaaatcagggttctactttgtctgaaacgagcgcttaaaattgcaaattcggctcaacaagtggccaacacagctcggggtagtacagggtctgttaccctcttcatcgagatactaaacaagtaagcgctttttattgtttgttttacttctcattttcccagatcagcaagcagcattatgtaatgtgaattatggcaggtacctctatttctatgagaaaggggttccacagataacagttgaatcagtagaaagcctgataaaactgatcaagaacgaagaatcgatgccctctgatccatctgctgaatcattctttgcaactacgcttgagttcatggagttccaaaagcagaaagagggtgccattggtgagagataccaggcgatcaaagtatagaatctcatgttggtcaaaagaagtcggtttgtttttattaaaaaaaaaaaaagctttgctttgagtcgtttgagaatcggaaagggactgatattgtgttgcttgctgctcgaaatgtaaacccgggtttaggtctagttttattcctcggattttcaaggcggttcatggtctgtaacttgtggagtttgatgtgtgtttatacgaatctttagtattctgagtttaacattggatattacatattagataatgtccttcatgaaaaaagtattcattttatgtattctgttgaatgattattgacgcataaaaacattttcaataccattgtataacgcataattaacaacctttgtgaggcttcagccttcaaatatatcaatagaaattcagtttacgaaatcaacttaaaaaattttgaaaaaataataaaatttaaaaaaaaaacaaattgtaggttaaatttttttaaaaacaaaataaaacagaaaagaaacgagaaaaaaaaaaagcaaaacaatcggagaaagttgatggaggagattgttcgttttgtgaacgcttcaatggcataaatttccggccatcacatttcttctactttctctttctctctcccttgttgttgttctctagaattcgattcatcgttgttaacgtcgtccattcttcttctttgatcccttctttgatctctcacatttccgattccaatttagggtttcctctcttttcacatttctagggtttttcttgttccctttgtaccggagatggtgaattgaaaggaaaaataaaacgcttttgagagcttatatttgaggttgtttcctcaggttttgtagatctgaggttgctatttttgaattagagattcttttttttttttttcaaaattttgtttgttgtgatcatacatagacgtacgtagctccatttctggtggagaaggaagaagaagagaaatg

SEQ ID NO: 27695 - DNA, 3003 bp, Unknown; identical to SEQ ID NO: 27694
  misc_feature (1)..( 3003): 2750-1469P.txt file - cDNA_ID_2991474; gDNA_ID_2214701; Annot_ID_189680

SEQ ID NO: 27696 - DNA, 3003 bp, Unknown
  misc_feature (1)..( 3003): 2750-1469P.txt file - cDNA_ID_2991483; gDNA_ID_2926270; Annot_ID_143406
gtctctgagctatctgaagagccatggaaaggaaagctaataactttcagccaaaatccggagttgcatttggtgaaaggagacgatctgtactcaaaaacagagtttgttaaaaaaatgcaatggggtatgaacactgattttcagaaagtgtttgatttgattcttggagtggccgtacaagagaagctgaagccggaagagatgatcaagagggtgtttgtgttcagtgatatggagtttgatcaagcggcgtcgtcgtcacattattcaagaccaggctatgcatttttaaggcagcctccaagtaatccaagtaatggatgggaaacggattatgaagtgattgtgaggaagtataaacagaatgggtatggagacgttgtgccggagatagtgttttggaacttgagggattcgagagcaacgccggtgccgggaaacaagaaaggagtggctttggtgagtggcttttcgaagaatttgatgaaaatgtttttggaacatgatggagagattgatcctgtgatgatgatggagactgctatttctaaagatgagtataagtcgcttgttgttgttgattaagaagctttactgtttttttgagtttggttttgtattcctgtttcatggttgaagcttccattgcaattttattttaataaatttggcccattgattttactttttttttctgaaccaagtaatcgatacgagaccactaacctggcttttattcatcaatcgatgctctctctacacgtaacctgcttcaaaacactcatagttcgccggaaacaatcactcgtatcatcggatctcggcgtttagaattcagaatccgacgactttggcgagcaaaccttacgcaaactatggatggtattggaaatgaacgacaacaagaacaaccgtttcatttacagatttacttcttcaaatgggcttttcttctctaaatgggtttactaccttaaggggcttttcaactataggttcaattatattcttatgtaagggtactaactagtgtgggctgtaaacgacttaaagtttcggccatttagttttatgcaagaaaaaaaatatagataatacagtaatgatgaatccactatacatgttaaatccaatataataaatccactatacattagtgttctcatatttcgtttcaagattcgattcaaaaaatttgaaaatgttaaatatgtgtttctgagattaaaggccaaaagaagggtaaggtcgtatatgaaaggtggacagaggggcaaattagtcagcttgaaaaatacatcgacattaaaaatcggcagcactgacaaaacgtgtgataacacaaataaaaataatcggaagaaaaagaataaataaggcgtattgactctggaacgtgagaagatgaaagagagcgacgaaaacctctaaagacttatcgagaagtgcaccttagcctagtgaataatgatatgtattgacattaactactactactacagctcccaacacgtgaaagacatgcatctaactctttcactttcggttgccaagaaaaaaaaaaaaaaaaaactttcactttcggcatcaaatatatactactaaaaaagttttttatacgtaattcttttttaatatttgattagttcagaatattaattaaaaaaattacttttcgtaatcactacattttgtagttatatgatttttaatttaaaatagtaaaaaggagaaatgtaactaattaagctaacatgcgcgcgatagaataaggtgaagtttaaatttgagcacaagatagaaaattgaggtcaatttaattcggaagtggttcaaggtatattttcacaagaaagaaaaacgtgagttcattgaatccctctataactttacttgagaacaatgtaataatatgtaaatctgttaggaaacgagcagccacatatgctttaaacaagagaacaagaaaaagagcggccacatgtgaaaaaaaaacaccagccaaaatgtgaaactaagaaaagaaaagaaaaaccatcgacatcgtccaaaggatcgacccgtcttttctggtttggcagaaaacaaacttccaagttccgacttgacctagtctttatgcatctgcagtggtgttttctttaaatctttttttgaatggatttgaaaatcttattttttcttcttctttcaaaacactaactgtgaatcaccaccaacattttattgttctaaaatccctatttgtatgttttattggttactttcccaaatatgatgaaagtttattggtgtactttagtttagaaatgtaagaaatttcagttgtattattaggtcaaccaaatattattcttgaatagtaatgtcaaattttgtttatattgaaaaatcaataagactgatatctactaaatgtgatttgctatactagtagagctagtagtagcaagattaaaattcatattaagaaaaaatggaaaagaaaaacatgtttcgagaaaaatatacagatcagagactagagtagaaaacaaatataatgtcagaagaacccaatgtgacgaacagtaacagaaacatgttaccaaatttttgaagatatatttttataaaacattacaatgttcattggacttccgttatttccggatataaaatatcttctttctgcgtagcaagcaattacattacattaggtatattaagaatttaaacatgtgttttgaatcattaaattaattagataagtaagagaagaggttgggagcctaataaaaacaaaacaaaaaggaaaaagtggataggttgccaattgtgccgaaaagaaagagaaagcatgaacctcgtgcgttaaataagtatcagagacatactacattttaaaaactctcacatgagaaatcagaatccgttattattcctccatttattcatctcaaaacccatatctctctgtcttgatctctctctcactttctaataagatcaaagaagatg

SEQ ID NO: 27697 - DNA, 3000 bp, Unknown; identical to SEQ ID NO: 1858
  misc_feature (1)..( 3000): 2750-1469P.txt file - cDNA_ID_2991486; gDNA_ID_1620459; Annot_ID_157691

SEQ ID NO: 27698 - DNA, 3003 bp, Unknown
  misc_feature (1)..( 3003): 2750-1469P.txt file - cDNA_ID_2991489; gDNA_ID_2926232; Annot_ID_142692
cttgcttgatttctttctaaacaaagcaaaagttgtctttttggagttgtgagcaactaattctctgaaattgaggaagagaaagcgagaaggtttttttggagtcagagacagaagaagaatttaacagattcttgtcggaaacatggatacgagtgaagcaaggaaccgtaaagttgttgcagttgaacaattcgatctcgaagtccctgagactgctcatcagattagcagcggttcgtttcttatcctctatctttggatttttgtttttgtttttattgtccttgttttttgtttgttgctgctcttttttggtgaatctacttgtcgtttattgcataatctcgagcttttcttgaaaaaaactcatttattattggggggtttgtgctccttttttcattaagcttttcttgagaaataatacacagacagagaatggaaagggtcgtttagctttgtttgtcttctttgttagattgaatgatactttgttacttgcttttaccctataagctgctgaaatatgacacatcaaagaattgaactgatgttactttccaaatcatgttgtctccgatgatgtttgcggtgccctatagtggaaaatgttgtctttgatgattcaagaatgtgaacattcaataactttaagtttcttgatcagtttttgtcttccccaaagttttaagctatgaaaactctgtttttttttttgttttctgttactctgaatttacattgagatgaaaaatgagtggctgaggaatatagaaataattgacaaataatatatactctgttttagtgttgcatgtgtgtgaaagcttaagtgttgaagaacttgtacagattcatggtttcaggtagcttttgttctaacgaccggtataaacagtgcctatgtgttgggatattccgggacagtcatggttcctttgggttggattggtggtgtggttggtctcattcttgctaccgcaatctctctttacgcaaacactcttatcgccaaacttcatgagtttggtggcaaaagacacattcgttatagagatcttgcaggcttcatctatggtaaattcttcatcactctctcgcaatatcaaaatacatttcaagttttacattttaacgagaattgtatttgcttgattgattcaggtaaaaagatgtatcgtgttacatggggattgcaatatgtcaatcttttcatgattaattgtggcttcatcatacttgctggttcagccttaaaggtacaataaccgaaacaaaccgttttgttgcgaaaatccgaaagttagctcatatggctctgcttttgcattttgtgcaggctgtttatgtactttttagagatgatagtctcatgaaactgcctcacttcatcgccatcgcgggtgttgtatgcgcgattttcgcaatcggtattcctcatttatcagctcttggaatctggctaggagtttcaacaatcctcagcataatctacattattgttgcaatagttctatcagctaaagatggtaaacttttatgttaaatcaaacctcgaaaatgatttcatataaccacaaaaaaactactcaccattttgtgtgtttttgtttctggtttaataggagtaaacaagcctgaaagagattacaacatacaaggatcatcaataaacaaactctttaccataacaggagcagctgcaaatctagttttcgcattcaacacgggaatgctcccggaaatacaggtcagtgtcatcgatctattattcatgctcgatcaaatctttctctgttttgtgagtgacactaatcttttgtgcaaatgattaggccacggtgaagcaaccggtcgttaaaaacatgatgaaggctctgtattttcaattcactgttggtgttttacctatgtacgcggttacattcatcggatattgggcttacgggtcctcgacatcgacttatctcttaaacagcgtcagtggacctgtttgggtcaaagcactcgctaacatttcagcttttctccaatctgttatctctttacatgtaagtctctatccagaccacaatgatgagtctttgagtcttaatcctaagcttaaccgttttaattcttgtgtttttaacgtagatttttgcaagtccgacttatgagtatatggacacaaagtatggagtcaaaggaagtccattggcaatgaagaatctgttgtttagaacagtagcaagaggaagctacattgcggtgagcactcttctctctgcgcttttaccgtttctcggagatttcatgagccttaccggagcgataagcacgttccctctcacattcatattagcgaatcacatgtatcttgttgctatgaatgatgagcttagtcttgtgcaaaagctatggcattggctcaatgtttgcttctttggattaatgtctcttgctgctgctattgctgctgttagactcatctctgttgactccaagaacttccatgtttttgctgatgtttgattaaaatgtcttcgacatttttaacgatgtaatctttataccaattagaaaaaatttgtaatccttttgttgttacttttattatttcaaatgaaagaaattttttataacataatatatatatttatttttcggttcaacacaaattttttttttaacaaaacaattcaagagataaatagatataaaaaaaagtaaagtgaaattaatcaagtagtcatattcttaagcaaagccatattcattaagaaaataaataatcattttcttatgcagagccatatttgggccaagccgtataaacgtttgggccaacttgtttgagatagcatataagcccaatagagttttgttgctgagcttatttgtgaatccatataaagtcttgacctaataacgaaagctagggttttttctctgtgaaatcgctcgccggcataaaagagagtcagaagaggaagaagagagttacaaggattgaaaatg

SEQ ID NO: 27699 - DNA, 3003 bp, Unknown; identical to SEQ ID NO: 27698
  misc_feature (1)..( 3003): 2750-1469P.txt file - cDNA_ID_2991489; gDNA_ID_2926232; Annot_ID_203744

SEQ ID NO: 27700 - DNA, 3003 bp, Unknown
  misc_feature (1)..( 3003): 2750-1469P.txt file - cDNA_ID_2991499; gDNA_ID_2214471; Annot_ID_133089
caacgggaggctgatctttgatatgcctcaacataggcaaaacaaagccaagggttttacctgacccggttttggcaaccccaatgcagtctctaccgctcatgatgattggaagtgcttgtgcttggataggcattggcttttcatagttaagcttcttcagagtatccaaaattttgctagttaatccagtctggtgccaaaattgaatgggtcttggaacatctttcccatgaactttcagctccaattcctttctataagcgttcactgcatcctgtgtcatccttgagatatccttgacttcgatataaaaattcttccggaaaggttcatactctattttggagtggtcaacaagagacaatttctctgcttttgtcttcttaactctcttcataaactcctcgtcgtcttcgtctaaacttggatcatcatcactctttggttctgagtaatctgaatcagaatcttcaccttgaattatcctaccaagggcggccttattaaaaccttttttggcttggtcaccagtttccttcccattcattttaaaatccaaaataccatcgatcacaatattgctaagcttttcaacctcaggtaataccatagtattcataaaagcatctaagggatcaatttcgtcttcatctgcagctctgtcacctccattctcagagacagtaacagctgtctcattctccgaggcgaccatcttggcatctccaccattttcgagtttagtatcacgatcaacatccatctctgagtctgatttaacttcatcatcagattcaccatcaagagtccaagccttaccggtctcaggacccttactttcaatttgagcttcctcgttttgcctcttcaactcttgccactcctggactcttctcctccgtttttctacttcctcagccaactgcttctgctcatcctctacttgttcatcccgagttttcttctcaacatcgtcatctccatgcctgctacgctccgttcttttgcgtttcaagccacacttgacatcatcactctcttcattacaatcctcacgtgacctctcctttttctgtttcttcctacccttttctttctcacgttctctcctctctctgtcccttttcagatattttcctctatctctgtcacgttctcggcgtcctcttcccttgtcctcccctctgcgtttactatccctctcgtattcttcttcttcaaaatcgctactttttctatccctccgtatccgtatcctctcctcttcctcagaatcgcatctcttaactctcgagcgcatctccgtcgtatctcgccgaccattctctttcttactgcgatcacgatctttgcgatcattttccttcctggacttagatttctctaacatcatctcaaacgcaacaaatcccgatagaaaattccgtaacttaaacccaaattcaaatcaaattcatccgccaaacaaaagcttcaacgataaccctaaaaatgttgcggtgaagaagacaaagctaccagaagaatcaaaactctctacaccgtaacgttgtaacgtctcgttagtgtcgagtaacagagataataaagctgtaaggttgggcccttattggtaaaagataaaagtgaaaaccagttattgggctatttgggctttagttaggtccactattaatcgatattttcctcatgggcttctaaacaacatcgcaaggttattctattcaaaataattattcatttcgttgatttcatctcatgaatgatttcctattatttatagttcattccccaaaccactcgcatcacaggcgcgttgagcacgtgaggctaaaatccatggactatataaccttcctttttggggattttttgcataaattaaaaactgagaggacctgcagcgcgtgggttgggatttcatttgttgtgactacaattttttttttttttcccccaaaggtctttctgtttattgactttttatcataagataaaacgttacaaaatgggttaaacctatctaggtgattacaaaatttcaaaaattgaaactaaaaaggcctaaccccaataaaaggatatcaaacccaacttgaagagaggcattgaaagctaaaaggactggaccaaaaacccaaacgactacagtattcacatgaaaatataaccaaacgaaaagaactattaccgtgttttatcttttgctcagattatggtccgaaaatattgttatcgattcttgatttagattaaaaatgagataaaactgtaaagattttctgaatattttgaggtgtgcattttaatagaaaacgaagccgatagtgaatacaccgagtttgataacttcaccaaatgactcggtggcagtgctaatcagtaatatctcacctgcttaggagcacttccatatttaggaaaagaatatgatttgaaatattttgccattcaagatcgagactaaagattatttgaactataaagcaaattttcactctttaacgctccatttcgtacattactttgatcatttttctttttatctatttttttcgtcgaccgttttctttgacgatgtttgttatatgattctaaaagcatccacaatggtagactcttagcaaaactcttaacaaatatttaaaaaattatataatttaaatattagataaatctcttaaatttggtaaaacttaggtcaattgtctcttagttaagagacaaatagtcgggttttattaggcccactagttcgttaaaggctaaagcagtgcccggttcttatagcggaggtaactttaaatattgggcccttactgaaaggtaaattagttgggtttattgggctttattataaggcccactaattcagcagtaaccctaacgaaaccctagcatatattagttcttaaacttcagctgagagaaaaccctaatttctcaaagagtctaaagagacggagagtgagagaagagagaaacatttcgagacaaatg

SEQ ID NO: 27701 - DNA, 3003 bp, Unknown; identical to SEQ ID NO: 27700
  misc_feature (1)..( 3003): 2750-1469P.txt file - cDNA_ID_2991499; gDNA_ID_2214471; Annot_ID_183027

SEQ ID NO: 27702 - DNA, 97 bp, Unknown; identical to SEQ ID NO: 409
  misc_feature (1)..( 97): 2750-1469P.txt file - cDNA_ID_2991499; gDNA_ID_1590810; Annot_ID_150094
  misc_feature (45)..(45): n is a, c, g, or t

SEQ ID NO: 27703 - DNA, 3003 bp, Unknown
  misc_feature (1)..( 3003): 2750-1469P.txt file - cDNA_ID_2991503; gDNA_ID_1620465; Annot_ID_157893
tgaaaaaccacaagtgtaaattgttgagggaactaaaacacttgaagatggataacaaacttctgctgacaggaacacctctgcaaaataatctttctgagctttggtctttgttaaattttattctgcctgacatctttacatcacatgatgaatttgaatcatggtacaaacatggtccttttctactattatccctaactagtcttctttttttttttttttttgttaacactggtggcagctttttgacatttattcctttcttagtatctaactgatagatgagtctctacaggtttgatttttctgaaaagaacaaaaacgaagcaaccaaggaagaagaagagaaaagaagagctcaagtatgtacaattatatcaattttcctttatttctttgattgtatttatgtcttatgctaagggtacatcttgtctaggttgtttccaaacttcatggtatactacgaccattcatccttcgaagaatgaaatgtgatgttgagctctcacttccacggaaaaaggagattataatgtatgctacaatgactgatcatcagaaaaagttccaggaacatctggtgaataacacgttggaagcacatcttggagagaatgccatccgaggtacatgatctattttttttttttaatactttgtttaattatgtcattttctgcattgatttgttcatcccctatacttcaggtcaaggctggaagggaaagcttaacaacctggtcattcaacttcgaaagaactgcaaccatcctgaccttctccaggggcaaatagatggttcatgtatgtcagtttcttttaagaaacgtaagaaaaacttctgtcatactgttctgtctaattgtttcatttcgtgacagatctctaccctcctgttgaagagattgttggacagtgtggtaaattccgcttattggagagattacttgttcggttatttgccaataatcacaaagtatgtttcacaaacccatggctcgtagctcatttccctttgagaacttctctgatccatttgctgatgaccaggtccttatcttctcccaatggacgaaacttttggacattatggattactacttcagtgagaaggggtttgaggtttgcagaatcgatggcagtgtgaagctggatgaaaggagaagacaggtttcacctgtgcttatgctgcttttgcgttgcttttaagcaatattctgaccaaatattataaccataaggtctctctctctctctctttgccttgaaacagattaaagatttcagtgatgagaagagcagctgtagtatatttctcctgagtaccagagctggaggactcggaatcaatcttactgctgctgatacatgcatcctctatgacagcgactgggtaatcaaatcaattaatttattttctttgaaggaaaatctttctctttcgtgttgtctccaactgtgttttgtctgatctccagaaccctcaaatggacttgcaagccatggacagatgccacagaatcgggcagacgaaacctgttcatgtttataggctttccacggctcagtcgatagaggtaaaactctttgttgttcatatcaatcaatcttaacttcaaaccattgagattgttgcctcatgagattggtttatgacatttgctcagacccgggttctgaaacgagcgtacagtaagctcaagctggaacatgtggttattggccaagggcagtttcatcaagaacgtgccaagtcttcaacacctttagaggttttaacttctcttaaagctcaatcctttttagatacacttattatcaacaaaatctcctattgacagcttgaaccaaactaacacacaggaagaggacatactggcgttgcttaaggaagatgaaactgctgaagataagttgatacaaaccgatataagcgatgcggatcttgacaggttacttgaccggagtgacctgacaattactgcaccgggagagacacaagctgctgaagcttttccagtgaagggtccaggttgggaagtggtcctgcctagttcgggaggaatgctgtcttccctgaacagttaggacacattaataagccaggccttgaaaccacttctgtgttttttttttttttttccggaacatgatcggttacttttggctgggaggatttaattattagagggctcggaagtttttgtaagttaaagaactcacttaaaaccctgaaaacatgacagttaatggtgattagctctcaatgtgatgaaaacaattggccctctgattttgctgttgcggtaatattatgacttgtgtacgtttatagtctttgtagtctgcaattttggcattgagctatttctcacgaacttatgggatcttatgttttggatttgggatttgttaacttatatgattaggctcaatagtttcacagaatattaaaaacttgagtagggtttaaaaaagaagcaaaaagctccgatgccgggaatcgaacccgggtctcctgggtgaaagccagatatcctaaccgctggacgacatcggatttgttgatgtctattcttgtaaatagtaaatatttagttttatcggttttgcatctaatggactaaaacatgaacacgagacgccgacaagaatgaatggggcaggcaccaaacatttgggtaaaagtatgcagtggggtattattgacaatttgaccattacaagagctaatcttagggggttttagttagtaaagcaaacccggtttaggagtaaatatggagtgagaataggggtaattaagggaatttaagagaagtcatcatcgttttccatttttcttattttaagcgcctcggtggctatctctcactccgttcgcgtcttcctcttaaaggaaacctcctctacgcgaaattcgtattctctcatttcttctacggagatttgcatcgaagaaactgactcgcttgtggaatcaacaacaagacgatg

SEQ ID NO: 27704 - DNA, 3003 bp, Unknown
  misc_feature (1)..( 3003): 2750-1469P.txt file - cDNA_ID_2991511; gDNA_ID_2926263; Annot_ID_143268
tatagttttgttgtgtcctgaggtttttctatttcatttcctgccaggcattggctgttattgattatctgatttcgaatggatcagaacgagcggttgatgagattattgagcatacttaccaaatatctgtcagtttatttctctttacatattgatatgcagttctctctaagattgtgttttttttactgactagatctttgtcatccatgtagtcactcacaagttttgagtatgttgaaccaaatgggaaagatgtgggaatcaacgtgagaaagaaggcggaaaacatagtcgctcttttaaataataaagagaaaatctcagaaatcagagacaaagcagtagcaaatcgtaacaagttagtttttacacaagtggaaataattggtctgaccgttcttctttctactttgccttaaatcgtttttttctgcctccaattaggtatgttggcctctcatcaacgggaataacatataaatctggttcctcagcttcatttggtggtagttttcaaagtggttcaagcaattttgacagctacaaggatagagattccagagaagacaagaatgactacgagtcttttcaaaagtcaagacgtggtgttaaaactgaggagcaaagctacacttctaagaagagtttttcacgctatggcaggtttatgtcaaccccattcattttctgatgttcgttacatattttgggtagactatgggagttttcttttccaaaagaggctgcttgtttgcttttcttttcttatttctggtttggtttatgactcattagtctcattttgtgtaccatttttctgatgtcgagtaaattaatcgtgcaatcttgctcactcgattccaattctgaatgtgcagcacggaccatgacaatctatccagtggtaaaaagtcacccgattctgccaaacataggtcatatgtatctgcagctccttcaaacaacgatgatgattttgatgattttgatccacggggaacttccagtaatagtatgtttctctctacgactgctgagtttgcagattgtttatcattcattcgggagaaagttggtttgataaacatgtatttatgatagacatatgtgcatgtcttacctgtatggtttttatttttggcagagccatccacaggcagtgccaaccaagtggacctttttggaggagatctgattggtgacttcttggattctgggccaacagaaacatcttccaccaacaacaacgagaactttcaagaggcggacttgtttgctgatgcagcttttgtatcagcctcggctcagggagctgaatttgggtcacagacacaggtggtgacttctttcatctaagctagtatgcagcttttaacaatggaaaattcccttattaactgtccagttatgtgatgcaatttctcgctaattgacaaaaacgtttgtctgttgaagtcgttctttacacctcacaattacttgtgctgttgaatcgttgactgatgtgtttccgcatttctgtttctacagaaacaagttgatcttttctctgcgtctgaaccttctgtcacagtttcttcagctcctccgacggttgatctctttgcatcttctgaatcagttgtaagcccagaagccaagatatcaatacctgagtctatggctactcccaacattgttgacccatttgctgcagttcctatggataattttgatggatcagatccttttggtgccttcacttcccactcggcttcagtttctacaggtccacaagctccaagtgtacatgggagtgcaacaaacaccacaagcccgctgtctttcgcagactcgaagccacaacatttgcaaaagaaagatcctttccaggtgaaatcaggaatttgggcagattcgctgagccgtggactgattgatctcaatataactgctcgtaagtcgttacttcctcttctatcgagaactctctcatttgatctgcactataagaaaaaaatgttttattttctcattagatgcagtcaaacccaaaaggtatagttgttcgattacattccaactatttttcaaacagtacattctacaaatcaaaattcttagctcacataaagttccagtaccatgtagcttgtttgcatggtgtcacgacaaagaaattgttgggttttagtttctaagttcgattttagtcctgattattattttccctgtaaccagccaaaaaagcttctctagctgatgtgggtgttgtgggggatctgagcaatgaagatgggaacaaagcatctgctgcatcgtactactcaggctggtccatgggtgcaggatccgggcttggtaaaactggcctatacagtacacagcagcagcagcaacaacaacaacaacaacaagcacctgatatctcagacgatttcttctccagcctcagtaaccaaaggtaccaatctggtggctttaagcagtgaaattgtctgtgatttggtgttgagatgaaaaggcatatcaagtttgattctacattccatactggaaatgtaagtttttttaatgggtttgttgttcttgcacttcattcatgggacaatctggtcggtgactgatgtgccattgttgttgtggcgtttactttgggtttaaatgagagagagaagaattgtctttatgttttttttgataagagagtacttttattattggtttaaagtttcgatttgttcatagaacaaaagtatatgtatctcttcccactcaacaaatattttttttatcgcgtgtgattcttaatccgaaagagactccaactttcttctcagttgttttattcacattcatattgaccaagttcattcttagtgattatgttaacactaatcttatcttacacaatttagttctccggtcacgaatgattaaaatatagaatagtcttatctacaaagaaaatgagtagttgtgacaaaaaaaaatagtccaacaccaaaataaaaaatg

SEQ ID NO: 27705 - DNA, 3000 bp, Unknown; identical to SEQ ID NO: 3922
  misc_feature (1)..( 3000): 2750-1469P.txt file - cDNA_ID_2991529; gDNA_ID_1620674; Annot_ID_48202

SEQ ID NO: 27706 - DNA, 3000 bp, Unknown; identical to SEQ ID NO: 3922
  misc_feature (1)..( 3000): 2750-1469P.txt file - cDNA_ID_2991529; gDNA_ID_1620674; Annot_ID_164197

SEQ ID NO: 27707 - DNA, 3000 bp, Unknown; identical to SEQ ID NO: 3922
  misc_feature (1)..( 3000): 2750-1469P.txt file - cDNA_ID_2991529; gDNA_ID_2926210; Annot_ID_141933

SEQ ID NO: 27708 - DNA, 3000 bp, Unknown; identical to SEQ ID NO: 3922
  misc_feature (1)..( 3000): 2750-1469P.txt file - cDNA_ID_2991529; gDNA_ID_2926210; Annot_ID_202545

SEQ ID NO: 27709 - DNA, 3003 bp, Unknown
  misc_feature (1)..( 3003): 2750-1469P.txt file - cDNA_ID_2991540; gDNA_ID_1621093; Annot_ID_170767
ccttctattcgagcaaaactcaagccgtcagacaccgctacatgtggctactcatggcggtcataccaaagttgttgaggctcttgttgcatcggtaacatctgctttagctagtctgagtactgaagagagtgagggactgaatccacatgttcttaaggacgaagatggaaatactgctctgtactacgccattgaaggacgctatttggagatggctacctgtctggtgaacgcggacaaggatgctccttttcttggaaataacaagggaatatcttccttgtacgaagccgtagacgctggaaataaatttgaagaccttgtgaaagcaattttgaaaaccacagacgacaacgtggaccgtgaagtgaggaagtttaacttagattcgaaattacaagggaacaaacatcttgcacatgttgctttgaaggccaaaagtataggtttgttttttgttttctttaataatcagtaacagctacgtttaatctgttaaaattatgtaaaaccagcttgggacgagaatctcctccccaagatggctaattgttgttcccaattgtttgagtaggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgacatg

SEQ ID NO: 27710 - DNA, 3003 bp, Unknown
  misc_feature (1)..( 3003): 2750-1469P.txt file - cDNA_ID_2991546; gDNA_ID_1620741; Annot_ID_166437
aaaaatgggtttcactattactctattagagattagaattgttcttccgtctatctagaccatacttggaacattgatagtatatagatataagtttcttaatattgaagacggacttgcgcactttattctgtgtataaacgcatctgagtgttttgcgcatatctaatatagttatgcattttaaaagataacaacttgacatttttgtacatgaattaacacaactttcagggatgtgatgcgtctgttcttctagactacgaagggacagagagaagatctccggctagcaaaacactaagaggcttcgagctaattgacgatatcaagtccgagatggagaaatcatgccccggcaaagtatcctgcgccgacatcctaacatcagccagccgtgccgccaccgtccaacttggtggtccttactggcccaacgtctacggtcgtcgtgactccaaacactcttacgctagagacgtagagaaagtcccttcaggccgtcgtgatgttaccgcccttctcgaaacgtttcagtcatacggtctcaacgtcctcgacctagttgtcctttccggggcccacaccatcggaaaagcgtcctgtggcaccatccagtcgaggctttacaactacaacgcaaccagtggttcagatccttcgattgacgcaaaatacgctgattacttgcaacgcaggtgtcgctgggcctctgagaccgtcgatctcgaccctgtaactccagcagtgttcgataatcagtactacattaatcttcagaagcatatgggagttttgtcgactgatcaggagcttgttaaggacccaaggactgctccgcttgtaaagactttcgcagagcaatcacctcagatattcagacagcagtttgctgtgtccatggctaagctggtcaacgttggagttctcactggtgaagatcgtgtcggagagatcaggaaggtttgcagcaaatctaactccagagcttactaaattataatcatcatccctcatgagaaggatcttttgtttcttgaaataatttcttgtttggtttttgagctcttttctattgcaattttgtaatttgttgtatgaacaagaacaaaaactgtgaattattttcgttgcaacttcgatttacatgagttctacacttaccgtcactatttgatcaagacaatacttaatatcagtccaacatgatcaatttatgtcaaagggttcatgatgttaatggtaataaccctaaacgttaactctaaatcaagttgtgatgatagcttttggtgcaagaaaaatgaaagatgggagacacaattcagacgcgatcacgtttttagggtttctatagtactgaaactcatggaaaaaacacagtacaaaagatgctatattctaagacattgaagaaccccaaaattaagagagaacataaattatgcaagtagaaaacaaacccagtagaagaaagccaagaccagttttagtttcgtttgcctcgaaggacacccttactacgacgattcttcatccccagcttaaacttcttcttcaacttcttcccaataggttttagcgacttgtttttcttctcatcatccatttcctcatctacaagcaaacaacaatagtatcccaaaacagaacaaacccttaataccaaaactttcaaagatatacttgtagatgcacacaaaattcaatataaagaaaccaaacaaagcttttagagcgatacgtttctcttagagtaacaaccttcccaagagtaatgaactaacaagctccttcaaagatttcaactaaaatgaatgattcagttaaatttcagattctaaagcttagcttaaattcgattcttcaagcgttaccttatctaaaaccaaatcgtacaaaatcaaagaggcaaatttagaggaggcataccactatcgttggcgattgtagtggaggcagatgcagactcagaggaaggcgtcgcaacttccataaacggagaaactggggcttgacgaactggtaacttcggagcagcgagtgcggcttcaatagcggcggatttggcgtcttctctcgttagagtgaatgattccttctccactatttctcttcttattgctctcaatctcttcaccctcttgcatctcattgatttcgccattgttgtgcttggggagatttgaaatcagggttttgaggcaaaaggggttttaatttctgcgtcggacttcttttataaagtctaaacctaattgaggaacaaaggaattgctccggttctgtttggttacgagtttaaatgtatcctatccaagtttagagcctattcggaaaattattggcccaatttaggcccaaataaatagagaagaacgcttcgaatggaaaacccgataatacccttcttcgtctgcgtgcagatcacactgtttgatttctgaggagaatccattgtttccatttgaagaaaactctaactttctcgttgaagctttgagctctctacctctttatctccgggttagttttgatttggtgtggatcggtagtggaattttgctcttcgtcttgctatttcgtatgcgttgttgtttctcgattagcgaatcagatctttgttcttttgttagatttgataaatttcgatagattttaggtttggattgattgtgttattgaacttgaatgcttctggttgaatcatagatctagttttggctttgctttgttatgcattgtcgtgattgaaattcgaaaaagcaatggaagtgattacgaattgagattatgactttagaatcgatattaggatctaagaagattctgtggaaattgaaattgaaattttgaagaagattctgtggaatctaagaagtaaatgttgataatactgtttggtttcaagagttaagagtttagaagttggagatgtgtattgactgtggttggtttggtttgagataaagatgtgattgttttggtttgatggcagagatg

SEQ ID NO: 27711 - DNA, 1944 bp, Unknown; identical to SEQ ID NO: 3442
  misc_feature (1)..( 1944): 2750-1469P.txt file - cDNA_ID_2991550; gDNA_ID_1620647; Annot_ID_47616

SEQ ID NO: 27712 - DNA, 1908 bp, Unknown; identical to SEQ ID NO: 3459
  misc_feature (1)..( 1908): 2750-1469P.txt file - cDNA_ID_2991550; gDNA_ID_1620647; Annot_ID_163268

SEQ ID NO: 27713 - DNA, 3003 bp, Unknown
  misc_feature (1)..( 3003): 2750-1469P.txt file - cDNA_ID_2991550; gDNA_ID_1620628; Annot_ID_162576
attctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatgatggggaataagcgaaatctcggatttgtgatcttcttctgggctctggtggttgcagtagtagccacggccatcgagcatcgtcgcaatgagaggactaaaggcgtcaatggtcttgacaagatcatcatccgcgaccgtcgtggccgatctgctgaggtactcactcttacggtttggtttagatctattgattgtgtcatttacatcaaaaaacttggcttcaaaacatcttttggatattgcatgatgcagattttgtttctttgtttattcaggtttacttgtatggaggtcaagtcagttcttggaaaaatgagaatggagaggagttacttgttatgagtagcaaggtaacttcagtcagattcactctatctccttttaggatcatatgattgctacaaatattgttctctgattggctaaaaatattgttctctgattggctgtatctgcgataatgtttttttttttgttttgcttttgtatgtgcaatagttgactaagtaaattatgcaaagatgaatctttacatcttctttttttttgttttgaatctttacttcattagaggcttgtaaatgaatagataagtatagcttaataatctgctttgttctaaagtagtagtaattttatgtgtgtgtatgagttccaaagcagagtgatctaaaacatgtgttacgtattgtgcaggctatattccagcctccaacaccgattcgtggaggaattccagtattgtttccgcaagtatgtgtttatagaaaaaaaaacttttctttgttgttgaagggtatagttttgttaatgaaatgttttttatggaagtgcagtacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtaagattcttgaaacatctctctctctctctcattttcaacattttttcagatatttgattaggaatattttacataaaatatggagactgttttttaatctatgtatccatttcaggtttgagtatagactgagagtagcattgggacatgatggagatttgacgttaacatctcgtgttaagaatactgatacaaaaccatttaacttcacatttgctcttcacccctacttcgctgtttccaatatcaggtaatccaaggagtcataacttcacgttgatatctttttttttggttgtgttggtgtaagtgtcattgaatcagctggttgttgtattcagtgaaatccatgtcgaaggattacacaacttggattaccttgaccaacaaaagaacagaacacgtttcactgatcatgagaaggttataactttcaatgctcaagtaagcctctttccatttgccaattcaaatttcaacccttttattattttagtccatcactaaaaaaaaacacaccttgcaaaaaaagcttgacaggttgtacctaagcactccagatcaactaagaatcgtggaccataagaaaaagaagactattgttgtacacaaggagggacaagttgatgccggtaattacaaatttagatttgtaaacatacatagacatagacacagtcacacagaaacagattgttttagtagtactaatgatggatcacttgtaattacaatgtgcagtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttgaccctataaaagtcttgcattcatcatcctcatcctttaaaaaaaaaaacttaaaactgtctttattaaagtatacttaatgttcccgagagacatcacatggtgaacacaaagttagttgggttccaaactggactcttgaccagttttattgttttgtaactttagcattcatgaataaaaaaagtgcgttaattacaataattgttaaatgtaattaaataaaagtgcgttaactacaataattggatattggttatttgcaaaattcatgttcttaaatcatcagtctaaacaaaaaaattagattagccgaagatttcttcttctacccttgatgatactatttgggatgggcttgcttagatgtgccgaatccaattctcgtttttgggtctatctatatttgggctgggctttataagaggcgaagcccatgtcgaacaatcaatttttttttaattttatatttcttttgggagtctgttctgtcgtattgattaataaagtaaaaaatcttagccacaaaattaaatcatctccaagacgtatcaatatcatcatcaatccaccaatgaaaagttctctctttttttttcccactcttactctgttctcgctacagaatctcctgggaaaaaaaaaaaagaaacttgatccacccgaattccccaaatcttcacaatttctggaaactctctcgatcgtgaagcagaaaagtgaggttccaaatg

SEQ ID NO: 27714 - DNA, 3003 bp, Unknown
  misc_feature (1)..( 3003): 2750-1469P.txt file - cDNA_ID_2991550; gDNA_ID_2926188; Annot_ID_140877
ttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatgatggggaataagcgaaatctcggatttgtgatcttcttctgggctctggtggttgcagtagtagccacggccatcgagcatcgtcgcaatgagaggactaaaggcgtcaatggtcttgacaagatcatcatccgcgaccgtcgtggccgatctgctgaggtactcactcttacggtttggtttagatctattgattgtgtcatttacatcaaaaaacttggcttcaaaacatcttttggatattgcatgatgcagattttgtttctttgtttattcaggtttacttgtatggaggtcaagtcagttcttggaaaaatgagaatggagaggagttacttgttatgagtagcaaggtaacttcagtcagattcactctatctccttttaggatcatatgattgctacaaatattgttctctgattggctaaaaatattgttctctgattggctgtatctgcgataatgtttttttttttgttttgcttttgtatgtgcaatagttgactaagtaaattatgcaaagatgaatctttacatcttctttttttttgttttgaatctttacttcattagaggcttgtaaatgaatagataagtatagcttaataatctgctttgttctaaagtagtagtaattttatgtgtgtgtatgagttccaaagcagagtgatctaaaacatgtgttacgtattgtgcaggctatattccagcctccaacaccgattcgtggaggaattccagtattgtttccgcaagtatgtgtttatagaaaaaaaaacttttctttgttgttgaagggtatagttttgttaatgaaatgttttttatggaagtgcagtacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtaagattcttgaaacatctctctctctctctcattttcaacattttttcagatatttgattaggaatattttacataaaatatggagactgttttttaatctatgtatccatttcaggtttgagtatagactgagagtagcattgggacatgatggagatttgacgttaacatctcgtgttaagaatactgatacaaaaccatttaacttcacatttgctcttcacccctacttcgctgtttccaatatcaggtaatccaaggagtcataacttcacgttgatatctttttttttggttgtgttggtgtaagtgtcattgaatcagctggttgttgtattcagtgaaatccatgtcgaaggattacacaacttggattaccttgaccaacaaaagaacagaacacgtttcactgatcatgagaaggttataactttcaatgctcaagtaagcctctttccatttgccaattcaaatttcaacccttttattattttagtccatcactaaaaaaaaacacaccttgcaaaaaaagcttgacaggttgtacctaagcactccagatcaactaagaatcgtggaccataagaaaaagaagactattgttgtacacaaggagggacaagttgatgccggtaattacaaatttagatttgtaaacatacatagacatagacacagtcacacagaaacagattgttttagtagtactaatgatggatcacttgtaattacaatgtgcagtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttgaaccctataaaagtcttgcattcatcatcctcatcctttaaaaaaaaaaacttaaaactgtctttattaaagtatacttaatgttcccgagagacatcacatggtgaacacaaagttagttgggttccaaactggactcttgaccagttttattgttttgtaactttagcattcatgaataaaaaaagtgcgttaattacaataattgttaaatgtaattaaataaaagtgcgttaactacaataattggatattggttatttgcaaaattcatgttcttaaatcatcagtctaaacaaaaaaattagattagccgaagatttcttcttctacccttgatgatactatttgggatgggcttgcttagatgtgccgaatccaattctcgtttttgggtctatctatatttgggctgggctttataagaggcgaagcccatgtcgaacaatcaatttttttttaattttatatttcttttgggagtctgttctgtcgtattgattaataaagtaaaaaatcttagccacaaaattaaatcatctccaagacgtatcaatatcatcatcaatccaccaatgaaaagttctctctttttttttcccactcttactctgttctcgctacagaatctcctgggaaaaaaaaaaaagaaacttgatccacccgaattccccaaatcttcacaatttctggaaactctctcgatcgtgaagcagaaaagtgaggttccaaatgggttctgtttcgggtcaaacccgaattacaacgatg

SEQ ID NO: 27715 - DNA, 3003 bp, Unknown
  misc_feature (1)..( 3003): 2750-1469P.txt file - cDNA_ID_2991550; gDNA_ID_2926188; Annot_ID_200785
ttctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatgatggggaataagcgaaatctcggatttgtgatcttcttctgggctctggtggttgcagtagtagccacggccatcgagcatcgtcgcaatgagaggactaaaggcgtcaatggtcttgacaagatcatcatccgcgaccgtcgtggccgatctgctgaggtactcactcttacggtttggtttagatctattgattgtgtcatttacatcaaaaaacttggcttcaaaacatcttttggatattgcatgatgcagattttgtttctttgtttattcaggtttacttgtatggaggtcaagtcagttcttggaaaaatgagaatggagaggagttacttgttatgagtagcaaggtaacttcagtcagattcactctatctccttttaggatcatatgattgctacaaatattgttctctgattggctaaaaatattgttctctgattggctgtatctgcgataatgtttttttttttgttttgcttttgtatgtgcaatagttgactaagtaaattatgcaaagatgaatctttacatcttctttttttttgttttgaatctttacttcattagaggcttgtaaatgaatagataagtatagcttaataatctgctttgttctaaagtagtagtaattttatgtgtgtgtatgagttccaaagcagagtgatctaaaacatgtgttacgtattgtgcaggctatattccagcctccaacaccgattcgtggaggaattccagtattgtttccgcaagtatgtgtttatagaaaaaaaaacttttctttgttgttgaagggtatagttttgttaatgaaatgttttttatggaagtgcagtacagtaacaccggtccacttccctcacatggatttgtaagacagaggttctgggaggttgagactaaaccacctcctttgccatcactttctactgctcatgttgacctgatcgtaagatcatccaatgaggatttgaagatctggccgcataagtaagattcttgaaacatctctctctctctctcattttcaacattttttcagatatttgattaggaatattttacataaaatatggagactgttttttaatctatgtatccatttcaggtttgagtatagactgagagtagcattgggacatgatggagatttgacgttaacatctcgtgttaagaatactgatacaaaaccatttaacttcacatttgctcttcacccctacttcgctgtttccaatatcaggtaatccaaggagtcataacttcacgttgatatctttttttttggttgtgttggtgtaagtgtcattgaatcagctggttgttgtattcagtgaaatccatgtcgaaggattacacaacttggattaccttgaccaacaaaagaacagaacacgtttcactgatcatgagaaggttataactttcaatgctcaagtaagcctctttccatttgccaattcaaatttcaacccttttattattttagtccatcactaaaaaaaaacacaccttgcaaaaaaagcttgacaggttgtacctaagcactccagatcaactaagaatcgtggaccataagaaaaagaagactattgttgtacacaaggagggacaagttgatgccggtaattacaaatttagatttgtaaacatacatagacatagacacagtcacacagaaacagattgttttagtagtactaatgatggatcacttgtaattacaatgtgcagtggtgtggaatccatgggataagaaagtatccgatttgggagttgaagactataagcgttttgtaacggtggaaagcgcggctgtcgcgaaaccgatcacagtgaaccccggcaaagaatggaaaggaatactccatgtttctgtggttccatcaaatcggaaagcttgaaccctataaaagtcttgcattcatcatcctcatcctttaaaaaaaaaaacttaaaactgtctttattaaagtatacttaatgttcccgagagacatcacatggtgaacacaaagttagttgggttccaaactggactcttgaccagttttattgttttgtaactttagcattcatgaataaaaaaagtgcgttaattacaataattgttaaatgtaattaaataaaagtgcgttaactacaataattggatattggttatttgcaaaattcatgttcttaaatcatcagtctaaacaaaaaaattagattagccgaagatttcttcttctacccttgatgatactatttgggatgggcttgcttagatgtgccgaatccaattctcgtttttgggtctatctatatttgggctgggctttataagaggcgaagcccatgtcgaacaatcaatttttttttaattttatatttcttttgggagtctgttctgtcgtattgattaataaagtaaaaaatcttagccacaaaattaaatcatctccaagacgtatcaatatcatcatcaatccaccaatgaaaagttctctctttttttttcccactcttactctgttctcgctacagaatctcctgggaaaaaaaaaaaagaaacttgatccacccgaattccccaaatcttcacaatttctggaaactctctcgatcgtgaagcagaaaagtgaggttccaaatg

SEQ ID NO: 27716 - DNA, 3003 bp, Unknown
  misc_feature (1)..( 3003): 2750-1469P.txt file - cDNA_ID_2991565; gDNA_ID_2926240; Annot_ID_142851
ctttattaccgtatggaaatagagacacgtcaaagctagtatttggacctacgtacgctcatgtattccgccacgtgtcgtggtttcactgacataaaacacatgtcggtcagataattctagctctcacgacgatgaagcaatgtaggctcacttccactcaccgccgcctatagcagtgacacacgtcctgtcaccggcgtgtcactcaataattatcagattttcattttaattaaataatgttatcctatatttgttaggtggatcccaacgggagggctttatggtaattaccatttactcctgagaagcttttatttttgtgtgtggagtagtaggagaagtgttgccgttccttgtcgaacaaaaaagagctttagacagacgctcctccccttttgtaatatttttgatattacgtgtgctctacgcgaatctatcaatatctaaatcctctctttctctctctctctcctccttcttcttcttcttcctgtcgctgccttgtggttgagtgagcaaaaaaactcaaaaccctccatggaaatgggagagagaatcaattcgagttgttgttagggggtttgcgatattttaggcttctgtcggtgatctcgaccaaaaaaaataaacaaaggagctagtagggttctgttttctctatcactcggaaggaagctggtttatgtcaaaactttgttcttcggaaaatgcgaaaatcgttcaaggattcactcaaggctcttgaagctgatatccagttcgccaacactctgtaaatctctctctctctctatttcttctctctgtttttctctgttttgatgtttcgatgtgttggtagaatctgatcgtgttcttagtcgagagtggttgatttgcctcataaatttgtttgatgctgtggttaaatccatatttagttggtacttcggttttccctttgcttgagttgctgatttttgtctcttccgattcgataggtcagattgtttttttacttctactgaagtttccagaggataatcagtttttgatacttgtgaatctgtatctctgttgtctgctgggtcttatgtgtgctgatgtcatattgaatttaagactttgcgtttacgcgagctcataaattccaatttattccttagcaagtctcagacgccaccaccaccttttggtcagatcacacaaaatctatctatagtggtcaattctttttcctttcgtcgtatatagtctctgatgctatcctaagttgacttggtatacttggattaagctgtgaagcaacatgttcatgttgcgtactaatctcaccaatcattgaatcaaaatgattaaaaaaaaatgaactatgtgtgtgtagggcgtcagagtacccagaggagtatgatggtggctacgttcagatgagattatcttacagcccggcggctcatctctttctcttccttcttcagtggactgattgtcatttcgctggcgctttgggcttgcttaggatccttatttataaggtctcttattaattttcctgctgttttattgctactggatcttcaagatcacaatgttcttgtctgcctgatatgtgattctctgttttttatttataggcatatgttgatgggaagaccacaatgtcgctacatgaacgcaaaactagtatcagagaattctatggtaatctgttaatcacttattctctcttaatctaaaggtataagattagaccagacgatatgtttttttctgactagcaatggatgttgttgggcagatgtgttgtttccttcgctattgcaacttcatggagggatcaccgatgtagaagaaaggaaacagaaggagatatgcgacaaaagataccgtaaaaaggacagaacagataaaggaaagatgtcggagatcgatttggagagggaagaagagtgtggaatctgcttggagattcgaaacaaagttgttcttcctacgtgcaatcactccatgtgtataaactgctacagaaactggtatataaagcttttccttcttttcactcactctcaccattcatcagcctttttcttacaagttatagaatctcttgtttggaataggcgtgcacggtcacagtcgtgcccgttctgtcgaggcagcttgaaaagagtgaattctggtgatctatggatatacacttgtagcgccgagattgcagatttaccagcgatttacaaggagaatctgaagaggttgttgatatacattgacaagttgcctctcgttacttctgatccaaatcttgtcccttatgctcctcttcctcggtgaacattacattctctctgtttcttgttatgcacatagcaatttctttcaaacaaatttcatctatttatgtccactttgtatataatatttatgtgtttttagttggtttttcatctttctatagtctcagatttgggtttgtatataacaaccattggttattgacatttagatcaaaaattcgatatcatatttgctgattaagggtacttaatcacattttggttcgtttaaattagtatctgtctatctgactatgaattacagtaaccgattggtgtttcagtcaaaccgacttgttttgatcgttttggggagtaatttggtttcggtatggatcgaattggctgaaccggaaaccagcaatttgagtgaagcacaagaccgcagtacacgtggcttcttctaactggggtaagaaattatttgacccaatcagattgtacctcatctagattttattgccaatggacttgaaacatcaccagataacgcagagtttaatagataagattagtaatcctactcaccgtcagatggatttgtgaatcgatccaacggtcataatcgtctttccaagataggccagctccgaaactcacctccacgcatctataatcgtgtatcaagaaacggatctttcttctctatcttctgaatatcacaaaacccaattagccggagatg

SEQ ID NO: 27717 - DNA, 3003 bp, Unknown; identical to SEQ ID NO: 27716
  misc_feature (1)..( 3003): 2750-1469P.txt file - cDNA_ID_2991565; gDNA_ID_2926240; Annot_ID_204041

SEQ ID NO: 27718 - DNA, 3003 bp, Unknown
  misc_feature (1)..( 3003): 2750-1469P.txt file - cDNA_ID_2991568; gDNA_ID_1971948; Annot_ID_58594
cacggatctctatttgtcgacgaatgttatttacaataagtgtttcttattttctttccaagatcgaaatgccaaatgtatacgagagacacaagtatgttacatcataatatacaaggtgtctccatagttttggtattagcacacaagtcaagagtatgccctacaaggaaaagattttttagatatcctattcaccttgtatctacagactgacaagacactaggactcctgttattcccaatcagcgtcgaagaatccagcatctttcatttctgaatagtagacattctccaaattcagatcttcctcctgaagcaaacacaagtgaattttagcaccaaatcatgtggtgatgaagatggtactatggtaatggtgatggtactatggtaatagtgatggcgatggtgatggtactatagttataaagaaggtgatggtgatgctgctatagtgatgaaggtggtgatttattgcatgtttgtgggtacatagatattatgtatagagactagagagagagagagagggagagacaaatgttaatttgagggatttacctggaaaaagtctgcaagaaaagtaacatacaaaagaggaagatagaaggcgtggtaacaaacacttgtgatcccatacaacctgcaagaattttcaatttgtatttcctaatgttagaagcaagaatctgacttagacgatgttactcttttgattgtaaggcttttatctaaagggcttaccataatccaaaatgagcaccgtttgccgtaagagcacatgcaaatagggagagcccatttaaggcgagcatgacagttatatacttgtagaatgcaggtcttgctgtcaaaccggaaaataaaaacatatgggatgagtaatagaagccagtgaacagctattggcttatgcaaccataaggaggatatgagtggtcgatgtattcacctggtaatctctctctccatttggagttgtacatgaagaatatcatcccataaatgccagctagtaagagcttgtggatgacccataagccccatttgaacttatgtatatgttcattgttgtcgataaacaatggtactccaaagccaaacagataaattgcctgaaaggaagaatgaaaaccgtgaagaaattaaactgactgtagttgagtaaccagacaatacaagtttgcatatatcaactgtagtggacacatgatctaatgcagaactaagatcatgtcaatatacctcaaggaagtatatctatctatatatcagaaagtgtatctaacagttatgaacacaaatctaccttgagaagcaaatcgagaccaatgacaagccccgagatgaggaaagttcgtgttaatgcttcagcaccgcttgcatagtttccttggaagagaaaggctaccaagcttacttccagaaacaacattccagatgttgtgaacaaagttaacaaattccaaataacttctttccccggagtgcattcccatgcctaaactcatgaaaagtaaattcaaaacgaaatctggagtaagactaaatcaggtaaaacatttcctgttaagcagcatctaaccaagaaatcaacactaatagcttacacaaaatacaaaagctttctaatcaccagtgtagaataaaaacaatgttgataagatcgcaaagtttctacatttacagagcctaaaacactctaaaaagcattcttcttcaatctaagttctgatctctttacacgcaacataggtatgagttacttgtgaaatgaatcgaagtaaagaagagaactttaacaaacctgaaggcaacaccaagcaagattgagcaagctaacaagccaaagaaaaccataataggcaatcataatgtaagatctccgattagacaacttggacaagctcttcttcgcctcgtacgctaagtaagcgacgaatagaatagatgctaaaaccaaaaccgtgttatgaagaaacccatgacacttcccgacccatccgccgataaaccctccggtggccgtcgaatcagggcttagccgagaaatcacgaacggtgactccgcaatctcgctgagcactcgcatttcatcaaattgtacgaatcagaaaccaagtagacttagcgcaaggagcggaaagcaatccctagttccagaaaaggagctcaatttcgagatttgatgtttttgcgatacagaattcgtatgaatcgtatatttcttcttctctctggcgaccaaatccatacacttgacgcaaacatgagtaattacacaaaagttaaagggtattataggtaattatcatcgcttctcccacttccactctaaaacaaaaaaaaaaaactatcatttttctcatcctttttatttttaactgattttacatgtgatgtttaaagagttaattattggacatgtgatgtttaaagaatttaaatattattcttttcaattctgtatcttaaatttgaaagacttattacaagctgatctaatttcaaaatcaatcttatgaaatgtaaatttttgaagtgctatttaataatcaataatgtgttattctttttaattaaattagaaaacgtgggagacaattgtctctcttttgcccaccaaaaagatattaaaaaagtcctattcaataatcatgatttatttatttatatttatatctcatattatacaagtaaaattgatttttaaccataaatgatcagcattcagcacaccaaaagtaatttccattcacttgaaataattgtataaatcgggtatttgaaggaaaattgaaccaagacgatccggtttaaatgtcagagattaaggttatcatgactctttaaaaaatgaagtcacagatcagaaataatagaaaactattaaggacttaaatgtaaatactctacaagttaatagatcggagcttcgttgcataagccccaaaccggtggagagaagacggaaagagtctgagagagagagaagaaatg

SEQ ID NO: 27719 - DNA, 3003 bp, Unknown; identical to SEQ ID NO: 27718
  misc_feature (1)..( 3003): 2750-1469P.txt file - cDNA_ID_2991568; gDNA_ID_1971948; Annot_ID_177294

SEQ ID NO: 27720 - DNA, 3000 bp, Unknown
  misc_feature (1)..( 3000): 2750-1469P.txt file - cDNA_ID_2991576; gDNA_ID_1620762; Annot_ID_50022
accccgaaaaattgttgcttgaggcattgacgtgtgtaagaccagttgccattcctagaccataagggaaggttccaaagaagctgttcacactcacatcaatgaccttcaaagacgtgagattagaaagagatttaggaagagaagactcaaatgcgttattgctgagatcaagggcttgcagagaagggaagctctgaatctgatctgacacgtttccgctgagattcatgttggagagaagaagcttagccacatagccatttgcatcacagtgaactcctgtccaatgacaatgaaccaactcagaaaatgttgtggcattctcaggtctcttccaatcttggagattatttgaaggatcaaaaaggtctgacttgaaggccaacaagatctcttgttcggagttttgaaatgtttcagaagaaacaaaagggaaaagagcgaaaccaatgtaatagaagaggaagaaaagtcgagggatcgccatttttctcctctatttcttcactttttggctagttttatggcatttttgtgcaactgagattgaaggtccccaagcgaagttgataataagagagtggaaaccaaaagctgaaaaacaatgattagtcagaatctaattttatttaatctctctcaattattttatcatgattgtgtttctttttcgttcggtggaataatatgcgagttccattggcgtcataacaatttgtatgatagcaagtagttcgctttgtttctgcatctgtgacattacatagtagaaaaagtgatacaatttccttgatgttttcatctatcttcgtgtgttaaattgtgaattgtgtttgagaaaacgaaattagattataagtttgtttcatatgcatacccaaatgctaaattgtgaataaagtcgaaccgaaaattttgaggagcactaattccataaccatatcctgaaggattatcttgctgatctgtgcaatatcaaacaactaagcggtgagaaagaagattaaaataatgataatgggatatataatatgaagaaatcgtgggtttctgaacagctagctaaatcataaaacactgagtgacttgtaaagctttgtcctcattagagatttgtgggacagtgaaacatgggcagagaatgtgtctcacttactgtccaatataactattttctattcaaagatgatggctaattaggcaagatcaaagtcttttaagaaaactaccattttagttctacctcaccaatgatttgacacaaacaatgtttttttacaaatgatttaacttcacttaaatatgagtaactaaagaacgcaaagtttttattggttataaggttagttatatcatccttggcggtcgagctaggttgagtttccgcatgtcttcattagtcgggagaatgttttgtttcgaatggcgtcattaaaaaaacacacatgaaagatgatggtcgtgagagaatcttcccacgttgttccaacataattaaaattaggaaataagaaagttcataactccattgccaagttgcaagtagctaggaacgtcccatgacacctacgtagagactagagagatatacatacatcaaatatatctacttacacatgcattgaaaaaaaaaaatacaaatacattaattaaattattgcattcatgtagacatatatgtttttctagatcttataaacacagattttaatgtttttcaaaatacgattatcagaatttttttttctctgtatattagtttgagttgagagatttaaggccatacatatgatatatgcataaagtttgcatattaatgcatttttagacaaggagcttcaataaactatgcatatgacatcaagacgtaactgaatatgtagccctaagtccgtaaccgaatttgtttatattcgtgtggttgcaacttgtgagtaaatatgcatgctgattgcgtgaagaacaaagtagcattaagtgctctcacgatatcaaaataaagtttagaaccatcgaaaagggccatctatcatttttattttgttcttaaaatctaaaacatatatattcgatcggatatacccattaaatgaatgaatcatgttcacattagaagaatcaccataattgatcccaaaaactatatgaaacatattctcgtgagtgtatagactttttggagatcgatatcttaattaatacatctagcacaactctatatattcttgcggattaacatctaaattttacgtacctcgagcatatatatccattatcgactatcgagtatcgactatcggttcgtccaacacatttaattgttgtaggtttgcaaggtagatatggacagtacctctaattaaagttctttgtcctttcaaatttatcctctattatcatattcataagaaggaaaaaataattgctcaaatctaactttataatatgccctttcatatttcacatgcacccatatgggactttttatcataatcaacattttaaaatataaaataccgaatggaataacaacaatacatcctatatgtgaatgataatgcatgcattaattattaattatatgtatatatactaatgatgagatcataatttcgatagtttagagagaagatgaggctggagagcatgtgctaagagctttccattaaccatctaaacacttaaatctaattagtttagccacattttgtttttttgtaattaaatttcacattttttttattttaagaagaagttcagatttcaataatttgacgtctttcaatttgagccgaatcaaaccgaaccggattaattgttatttttctcaagcagcaacgataaaaaagatatctaaaaggcccaaataagaaattgagaaaaggcccaaatagaattcgtgcgactgtggaatttagggttttgcatcgaagttggtttttaggtattaagtgagcgaggcgtcgaagctaggggtttgggtagagtagtaagatg

SEQ ID NO: 27721 - DNA, 3000 bp, Unknown; identical to SEQ ID NO: 27720
  misc_feature (1)..( 3000): 2750-1469P.txt file - cDNA_ID_2991576; gDNA_ID_1620762; Annot_ID_167178

SEQ ID NO: 27722 - DNA, 3003 bp, Unknown
  misc_feature (1)..( 3003): 2750-1469P.txt file - cDNA_ID_2991584; gDNA_ID_2926243; Annot_ID_142935
ccagggccagatcacagtttctacgaatgctaatctccaagtctctacccattgtgacatcttctgcaaaatagatgaaaaacattcaatatcatgtttttgagtttcagtataaagaagagtatggaagaaactaagagatcacagtttcctttctttaccaaatttatcatcatgttcttgagtctccttctcagcaggtggtgcaaccaactgattacttggaaactcagggttagaatgtaccacttgggcgcaagtgctatcaactcggtcccatagagataccgctcgtggactgtcatcaacatccacagcttttttcgtccaagagctctgaacaaaaaaaggtatgtcaaaatcaacctaggttttggagataaaccatgtgcaaaataaaacttcaaaatgaactagaaattttcacccagtttatcactgaatagatctaagttaaacatcattgagttctacaattggttagttaagcgcttccaccatttataagcatctgagtgcacatgcgaagttcgatcatccgacccctatcatttgtggttaagaaatttttaaaaggatagcttctcgggtgtatatttagattatcggtattgcacattcgtcttacctgagcgccactcccatcactacttccatcactagcattcaggccaatgctcccattttcattctcatcactgcttcctgaatcttgatcagattttttaatacttttcgatttcacagacttttgagtttgatgcgttccgctctcacttccactaccactagactgaacaagaaacaaggaaaaccatgagaaaccaaaaagtaagataccaatcatgtggaaaaaaaaaaagaagataccaatccacaattagaccatgaatttctagtttactacttatcaccagttgtaccaacaggttttcagattaatcatatatgagcaaggacatacactttggcatcttctccaaacatgctgccaaaggatcttaagctcattttttcttattggcttaacaagaaagtcaacagctcctttcgataagcacttaaagaccagccccattgagtcatgagatgacatcactgcaacacaaatctcacaggggaatgtagttaaaagcatctactttccaacatacgctagagaagactcaacaaatcgtgtaacttcaaaagaaagagctcaatgtaaaacgaccaaggaaaaagaactcactgatgacagggatgttccgacgagatttgtggttcaaaatcttgcacaagagaccgataccagataagtaaggcatgatcacctctgttagcacaatatcaatatgattgtttagatcttctaacaccttccaagcttgtatcccatttgacgcctcaacaactgccatgacagagttaataataatcaatcaacaaacagaaccgaaacgggtacatatatgcgctatagattaaagttgggccataggcttcaaaactgaccttcatagctacaattgcgaagaagtgcagtaacgatataacgagtgcagtcgtcattttcgacaagcagaactctaatggttctcacatgaagaaacctttcccaacagacagttgccgctgtttgttgcgacaatggaatttgcagtccacctgaactcccatttctcacatccatagtaattccattagttttctcttcttcactatgcttctctgtccgactctcaaccctatcgaatttcgtctctccggtctttcgatcagtgattgggtaacgtgaaccctccccctcctcattagcattcatcacaccaactctgcttcgctgaattcaaatgatcaaaatatcaaaacacagccataaaccctaatttcgattattgcaatagctagaggagttagaatcgtacaatatctcagattaacagaaaaaagagttgaagaacgacgaattctcaaaaaaccaactaatcaagtaactttttgaagaatcatcaaaaaatcgaatctagacaaattacatcaaataaaaatccaaccatacaaaagcatctaaattccaagagagtactgatcttacaataatcaaatactagaacgaagaatcgagctccagaagttgcatcaatcaccagaaaaatggatctagcacaatcagctaacggttgggaaatagaaacaaggaattcaaatcgataaacagaattaagaatcgaagcttcttagaactttagaaggaagataaacacagtgaacaatttttgagattatgaggtttttctgtctcccagagagtggaaatcggagacgaccataagccaccgatttttatttttccggagatagatagatattagaaagatttgtctcgggccaacaaaaaaaaaaaggaaattaaaaaatcgtaatatctgacatggacaaaactagaggtcccgaacgttcgagaagttccacgtcagagcggatatttccacatcatatattggcgaggattagtgacgtggatggtatatcaaaaacagtcgttcaggaggctagtggcagattattaagatctttttgaactgacacgtgtaatggtgggtaaggaaaacgtcaagtggtaaactcatctggaccgttgaatagattttggcggaagagactagcgtttaaagattttatagatgtagttaatattgggcttaccatatgggccattcaaaaagattttaacccaataaaaaatattcaaaaaactatcgtcgacagcagggttcgaacctgcgcgggcgaagcccaatagatttcaagtctatctccttaaccactcggacatatcgacatctcgttaaaagcacaattaattaacttaataaatgcgtttctaagtctacccctttagtttaccctagaaataacattcacgagatacgttgacctaaagggtaaattttcccgccattgttagtaccagaactctctgggccgccgcgtctccgtcgtcgtggctatctacagatg

SEQ ID NO: 27723 - DNA, 3003 bp, Unknown; identical to SEQ ID NO: 27722
  misc_feature (1)..( 3003): 2750-1469P.txt file - cDNA_ID_2991584; gDNA_ID_2926243; Annot_ID_204169

SEQ ID NO: 27724 - DNA, 3003 bp, Unknown
  misc_feature (1)..( 3003): 2750-1469P.txt file - cDNA_ID_2991587; gDNA_ID_2214518; Annot_ID_133993
caaaaacaaaaattgacattttttttcttcaaaggatcagaaacattttttttgttgttgctaaaaatgtaaatatttcatagaaaaaatatatattaggtttatgatcgatcattttcaacctagacaaatgaacaaaaaacactatcgaaatgcctagatttgcaatgtgaaaaaatggtcggcttcatgacaaacacttagatccacgttggtgcattacaacctcatcactactacatatcttttatcccatattatatttctctctcttttgtttttccttttatcaaattatatagggtctcaattaaatatccattcagtttgcgacgttgcgtgtgttaaacagatacaaaatcgacgtattaatatacacccagatttatgcatttcgacatataaaacacaaaaattcactttccttggaaagtttggaggttggatcaagtttataagtgaccgtctccaacaaggcaacaactcaagttcttagtagaaaaaacactgcacatacatctggatcggtaatccatttggatgattttattccaaaaagaaaacccaattacaatattttttttgaagtctagatctagaaatatctttgctattacatattcctctatatatatctatgttttaattcctctacaaacaattttttttttgtcaaagctctacaaaacatttctgtttttactttttaaattggaagtcaaaaatatctttgttcaacgtttcttttatatgtagaatgtagactgtagttctctcacttcccggccatttggcttcttttagtattttatcaaaggagataaagaaaaataaaatcgcgacccatatgatatgaagcaggcctcgtctctaatggccacgcagattcattttaatatgaaacggcatgaacttatatattgtttactacaataattagaccatacggtgcaaaaattaaaacaaaataagtcatgcatccctcgttctacggtgacgcatgttgatgaacggattctataaaaatagtaatatttaatatctgttatccagtcagatatatttaaaacaatataagaatttaaattgacaaagaaagataaatctgattaaccacggaatatgtgtgtttagattggtaacgtatgattagacacatcaatgctatttaaaagatgcatatgatgataacttttagaagtgagaaggcctttggattattagggattacaaatagtaaacttattatagattacttgagaaaagagattcattaaaacaaaatttgcataaagtaagaaccaaactagaggagcttattccaagaagatgcattttacatttaaaaggtgcatgtaattaatgtctgataaccataactcattaattattctaattcagctaaaagcgagcctaaacccattacacagagaattgcacgaatcacaagtacacaaattgatagaacatttagactttagaggttgatattttttgataaactatagtattgatttatgttattaattgggttgtgtagcacgaggacttctttgaacatgtgaaatgaatattgactttacgtaaaatcgaccatgccctttaagtgttcctcaagttcatacaaaaacaacagtcatactcttatatgtatattataacatgatttaaatttgaactatgtttatttaactatatcctatatataattattacgattgagagatgagaaagtttgttacagatgaagaagaagatattttccccttaaatttctgtaaatgtattttgtacaagtatatatacgatgacaatacaaccggttaatataacccgcgtaatacaaaatcaattaaaccgataaattaaatcaacactctctgatatgacccctcaatatgaggattcgaaaatgttgagaatgctcatcttggactttagatgttcaaactgatgtgagaacaaatgtttagcaaaatatcagctatttgatcatccgtgggaacatgaagcagtttaagctcaccatcatccaacttgtcacgcacggtatggcagtcaatctcaatatatttcgtgctctcatggaagatataattgattgcaatatagataacatctgtactgtctgaaaacaagataagaatcgaagtagtatccgtttaagatacgagcaatgtatgcaaccaaaccaactcacaagtagcaagagctaatgctcagtatctagaaataacatgttgcttcttagatcgacatgagatgatttatgaagaaatttgagctttgatggctctaataccatattacgatcgagagataagaaagtttgttacagatgaagaagaagatattttctgattaaatttccgtaaatgtattttgtacaagtatatatacaatgactattcaaccgattaacatcaccgtaatacaaaatcatctagaccgataaaactaacctaacacattctgataataacaaatatgaatttattgattttcttttaattaagaatagctcgttcaaccaaatgttgacatcttttttttttttgaacactaccaaatgtagacatctagtacactaattcaaccatgtctgtcgtctaatactatttcgagtagtgtgtgatatgcttaatatataaaaaaaacttgttcacgtttctgattttaaaacatagactgaccaaaagctcacaacacacaactagatataaagcccaggagtcaaacaaagaacctgattcgttattttgccgcacaaggcccaaatcaaattagtgatgttacttgaacagttcaaaaagaactgggattattatgcattcagtttataacttaaggggttattatgttattaacccgtttactttcgtttggattttggaattagacgcgaagctgtgaaatctagaagaagaagaagaagaagaagaagaagaagaagaagaagaagaagaagaagaagaagaagaagaagaagaagaagaagcaatg

SEQ ID NO: 27725 - DNA, 3003 bp, Unknown; identical to SEQ ID NO: 27724
  misc_feature (1)..( 3003): 2750-1469P.txt file - cDNA_ID_2991587; gDNA_ID_2214518; Annot_ID_184505

SEQ ID NO: 27726 - DNA, 3003 bp, Unknown
  misc_feature (1)..( 3003): 2750-1469P.txt file - cDNA_ID_2991738; gDNA_ID_1971712; Annot_ID_175124
ctcctctgttcaccactgcaaatgcagcctgaaccgccgtcatgttctggaacggtaacagacctgtaatcaactcccacagcacgattccaaaactatacacgtccactttttgagtgtagggtctgtgctggatcatctctctgcatcgatcaaaataagggaatatagtgtctaaatatgacttgcagagatatataaggttattaaggacaagacaaggatggaaaacgagatatttattcaacttacggtgccatccatctgtaagttccagtctctggtgtcatcccttcggtttgaacttcaattcttgcaacaccaaaatcagcaatcttgatggaccgatcagctgatatgaggaggttatctgactttagatcccggtgtataaagttgcgctcatggacgtaagccatacccctggcaacatccaacgcctgcataacagctaacttcaaaggcacagctcggttttgtctcttagtcagaaactgtctgacagaccctccttttgcatattcagtcacgatgcaccacaccatcggtttaatgcacgcaccaataaacctaacgatgttaggatgcttcaaaaatgcaagcatagaaacttcctgctgaaactgctgttcgagggcttgtgccttttcagggttgctatctgacctctcgagtagcttaatggctacatcttctccgttgtaagtccctctgtataactttccaaaagccccttgagcaaaagcaggacccatatgtagtttcctcagatctattgtccactcttcatagttcaccagtccctcggttggatacttactatccatcaacgcttgtgctaaggcatcatcgttaagtgcatgagtaacttttcctggccgaaatacgctttggccatccgagagagagtagggatggcgcataggcttcaaaccaggatggccaataagagcatcactcgaaccaacgctactgttatcgacagacattgacacagaccctccagcattacttgtctgcatactgtcaacagacatgtttgtaccttcttccccgagcttttgataaaagtcttgggtgaaggcatagtaattgttgtcgttgttgtgattgccaacagcgtgcaaatcgaactttggattctcaagcatcctttccaatctcgtgttgagtgtaatgtataatgtctgaccgagctgcaagtcacatgtaaatcgctttcaatcacttcaacatgcacctaaagcaaatatagaccatagtaaaggaaacaaaagaaaggatatgagaaatcactattatcaaaatggtattttctttcattgaagtaactgcaaatacaaagaacttacctttaagagcaaatcaagaagctagaagaaatgaaagtttatgtttcgtgaagctctacaccgtcaacaccctaaaatagaaacatatatatacatgttagtataagaatgaaaattttcgtgaattaagctgaaatcagatgctttaataactcagctcagcttcaactaggtaaaaatagtaacttcatcattgaattccataattttatttcaaagaaaacaaagaaaaatgagaggtcatatgagaaaactcgtggatgaaaaaaataaaatcatcatttcccacaaaacccaaaaaagtagacacagatccgataattccataatgagataagctaaagcaagaactcatagattacctagagcttcacaaaacacaaaaacacttgatatgacatgaaaagaaacacgcaaaccttgccttggtgtactggataagtaaaacgatcgaaaagagaaaaactctgaatccgatcgacaaaatcaatacccacaaagtaataagatcataacccacaagcttacttctgatcaaatttcagtgctaagaacctaaacaagaggtggaggaggaggaggaagaagagtcagtcgtcgcttcccatttactctttttttccagactccgattttctctcttttttttttttattattaatttgttttttttgggatttttatttaattttggtccgtcctttgctggcaaattcgtttttttattaattgggacagcttccgagcaatactctctccgatagaaagtgtctcacacgcgctctaccattccgagcaatacacattttaaccctaatttttttattaattgggacagcttcagagcaatactttcatggccgtcgctgctaaggtcatcatccccactatcgctattgtctccagctagtcccagaattcgatccaggtcatcttcgtcttcatcatcttcatcttcatcttcatcttccgtctcatcatcatcatcgggatccgagtcatcatctgttgctccttctcataggggtaaggtcttcttctttctcctttcttaatcgttttttttgtttaatagtttgttttgttgtttgctcgctaagatctacctctgttgttttatctatgattttgtgctttgcttacggttactctgttgtgtatgtgtattgattttgagcattataggattatggtttaatctaaactttaaaattagagaatatcgattgtttatcttggttttgtactttgtttactgttcttgtgttatgtctgtgtatctattttgagcattatagagttagggtttacttataaactttaaataatcgattatttattttggttttgtaatttgtttaagtatctcttttgttgtgtcttagtgttatgattcttttgctaacataaactgtttgtgactttgtttatgttcctgattgtatgaggcggcgcgttgtagcttctggttcacgctttctatttttcttttcgtttctctaaataacctccaattcttaagtattggggtcaaaacgaattaaataaatattaaaggggcctttttgaatttatctagtttttataacctacttacataaaacctagtgtttcgtttcagtggactgactattcattcattctcatcatg

SEQ ID NO: 27727 - DNA, 3003 bp, Unknown; identical to SEQ ID NO: 27726
  misc_feature (1)..( 3003): 2750-1469P.txt file - cDNA_ID_2991738; gDNA_ID_2926199; Annot_ID_141429

SEQ ID NO: 27728 - DNA, 3003 bp, Unknown; identical to SEQ ID NO: 27726
  misc_feature (1)..( 3003): 2750-1469P.txt file - cDNA_ID_2991738; gDNA_ID_2926199; Annot_ID_201716

SEQ ID NO: 27729 - DNA, 3000 bp, Unknown; identical to SEQ ID NO: 13396
  misc_feature (1)..( 3000): 2750-1469P.txt file - cDNA_ID_2991745; gDNA_ID_2214624; Annot_ID_187748

SEQ ID NO: 27730 - DNA, 57 bp, Unknown
  misc_feature (1)..( 57): 2750-1469P.txt file - cDNA_ID_2991756; gDNA_ID_1620359; Annot_ID_154573
aagcttcacttctcagaagaaagtaagatctgcgaatctctctcactctcacaaatg

SEQ ID NO: 27731 - DNA, 3000 bp, Unknown; identical to SEQ ID NO: 8487
  misc_feature (1)..( 3000): 2750-1469P.txt file - cDNA_ID_2991765; gDNA_ID_1971812; Annot_ID_175792

SEQ ID NO: 27732 - DNA, 3000 bp, Unknown; identical to SEQ ID NO: 8487
  misc_feature (1)..( 3000): 2750-1469P.txt file - cDNA_ID_2991765; gDNA_ID_2926171; Annot_ID_199536

SEQ ID NO: 27733 - DNA, 3000 bp, Unknown
  misc_feature (1)..( 3000): 2750-1469P.txt file - cDNA_ID_2991768; gDNA_ID_2926269; Annot_ID_143390
tgggaatttttgtatattttatggtttttgcttttccattcatatggttttgctgattaaaaactatctataataagtgttttcatgtatatgtgtattcatatttgccctataatgagtgagagtatttatttgttgaatttctttatttttgtttgagttcatgaccaaattaaaacctaaatttttggttcgttatacaaatttcgttttgtttgctcagcaaatttcttacaaaaatgacatgtaaacaacgttatgcttaaagttattaatcaatcaatgtataataaaaaaaaaggaattagattctttgactacattgaatttgtatttgttcgattcgatagcggaaaattcaaaaaataaccgatatcggtttatattttaggtaattttatctggttcggtgtagtaaattcaccgtttgaccgtatctatatcacagatgattcactgcgattaaaagttgtggttatcactatctaatcgtgatcgctaccaaaacgcaaacgctagttaccggaagacacgtcttgagtttcgcagcatctctctcctctcctctgttcatatctctctttagaaatttctcaatgaacatactcaacagattgggtttgggatcaagtgggcaaaccaatatggatccttctccgatcgctcagggaaatgacgatgacacaccggcgccggggaatcagtttgcccaattcggagctggatgtttctggggtgtcgagctggcgtttcagagagtcccaggggtgactcagaccgaggctggatacacccaagggaccgtagacaatccttcatacggagatgtttgttctggtaccacaggccattcggaggttgttagggttcaatatgatcttaacgattgcacctatgagtctctgcttgatttgttctggtctaggcatgatcccaccactttgaatcgccaggtatttttggatccaagagttgaaagttttaacctttcaagttcggggattgagaaagattctgtctttaggattattgaatctattgggatgtgcctgagtctgttgtgctttggggatttcttgatttttctcaaatctgatagctttctgattttcatcaccagtctttactttgaaactttttaaatttggaaccttgatcatctaagtagaatatgaggaaggaaatgatattgaatcttgatttttgttgaattatgaggcttgagttggtaactttggtcgttgatcttagtatgatccagattatgtagtagctctgtaatctctcccctgttgctccctttttaattgaggtagagatacggatttcagagaggttcttcttgttctgttcatgatcattgattagcattggatttcatgtttgtttatattgatgttagtttggcttatcatttgtcttgcatctgtgcgcagagaactataatcatatgcaagtttctgctagttttgtttgagaaattcactagcttatagtcaaattatctcgttggggttcatagcgaagtattctcaaattctacgcatgtacgaaaccaaatcgtaagcggtctgtttaggttatatggttttagcaatttctgttgttgcaaactcgggacaactatctcgatgatgttaaccttgtgtattatgatgaaaaaaaatcctatttatgcttttttccgacaatttacatttgcatcttctctgactttcaatagcatatactgaccagtcttatgactgtttatctcatgagtttgaattctctgtgtttactatcataattttagtttaagtactcagttttctcggcagcctacttccatgctaaattgatactttgatttatgactttgctgtgatcagggaaatgacgtgggaacccaatacagatctggaatatacttctacacacccgagcaggagaaactagcccgtgagtcacttgaacgtcaccagcaacaaatggagagaaagatcatgactgaaatcttgccagctaagaaattctacagagctgaagagcatcatcaacagtatctgtcaaaaggtgggcggtttggccaagggcaatccactgccaaaggctgcaacgacccaatccgctgttacggctaataagctgctttcctctgtccctctccgaaaacagaggacttagcatcaaaggacttgtgtgtcaaatagattgtgtaaaacttgactaagttgttcacacgctatgtaactacttctttggaatttcattcgcaatgttgtaatattgatgttatactctataaacataaaccaaataatcattgcgatccttactagatctaaaaagccatcaacatggtaaatgtagccaacgaaaaaaaaaaaaaaaaagagtgttggagggccattcctttattagagtaatgattctctagttttgattgcataaacaaacgtgcccaccaacctacaagttgcatacttgcatgattgtttattattaagtcatccttcatagttcatataatagagcttagaactagctagttgagtaattgacccaaaaaaaatgtgaacggtatcaaaagtcatttcataaacacatgttttccaagttttgatcaatattatatctgaccaatctatagattgtctttctcaaatacgaattgatctaaataatttcagaccaaccaatttttttgaattatgtttccaaattataatgatggttgttggattttttttttaaatagatagttgatacagtatttctatatacaataaaagaaatgacgcgtaatatatccattattcattaacaatttgaccaaattataaatgctacacatagtattgattgaatgtatttttcttgtgtgtcaaatactacttacattgaaatatgaatattcctatttagcgatgatttttaggtgttaatctctgactagcttctttatatatataaacgagcttcccgaggtctcatcatcaaacaatacacttaacaatg

SEQ ID NO: 27734 - DNA, 3000 bp, Unknown; identical to SEQ ID NO: 27733
  misc_feature (1)..( 3000): 2750-1469P.txt file - cDNA_ID_2991768; gDNA_ID_2926269; Annot_ID_205049

SEQ ID NO: 27735 - DNA, 3003 bp, Unknown
  misc_feature (1)..( 3003): 2750-1469P.txt file - cDNA_ID_2991799; gDNA_ID_1972192; Annot_ID_180209
aaacagttgcgctttgcattctcggggtaagctactagtagtttacacaaacatagaaactatgagatatcacttcttgccttgtcttggttaatccctctctgatggatgtttctccatgttgatacagaccaaagtcatcccagcaaaatacataatgaagacggatgatgatgcgtttgtacggattgatgagctcctatcaagtctagaagaaagaccgtctagtgcccttctgtacggtttgatctcatttgattcatcaccggaccgtgaacaaggcagcaaatggtttatccctaaagaggtaaaacttctcaatatttctcacacctctgtgggctctaatcctcttagagactcatatatggctttctctttgtgaaggaatggcctttagattcataccctccatgggcacatggccctggctacatcatctctcatgatatagcgaaatttgtggtgaagggtcaccgtcaaagagatcttggagtgagttttgtagtttcatcaccatagagttaagatataacgaatcctagatatcataagtgacgttgttcttatgttgtttgttgaaagcttttcaagctggaagatgtggcgatggggatatggattcaacaattcaaccagacgataaaaagagtgaagtacatcaatgacaaaagatttcataacagtgattgtaaatcaaattacattcttgttcattaccaaactcctagactaattttgtgtctttgggagaagctgcaaaaagagaaccaatctatttgctgcgaataaatctctcgagcatgtacgtatgtaacttttctggttctgtttcacacttcaggaagaagttctcccagttaaagacacactggctcgagtatgtcagagtatattggctattatctgtctttgtagattctctcaatcagcatatctacaaacatattcgaaccatagtttataggccaggagcgtgtcaaaggtgccattagtgtcttattcattgtcctcgtaaacgttgttgcttttgttgtatcggggcacacttatccggatttatcgattatgcaattgccctactacatcacattattatttaaatttgtcttcaagtttttatttcgcatagcacatatataaagaaaacgcttcgttcaaactcgtctgtgaactccataaaacttattaaaaaatccgtccaaaaaaatatatagtatagtttggatcgcatgaaaacatatctaaacataagtctttgttaggggtcggattgggcccttctcaagtagttcatcagctcgcccttctcaagaagctcgttagctcgctccacttcgtcaagctcttcagatcgcctttaagctcttcaaactcgactcgtcctcaagctcctcagctcgtcttcaagctcttcccatcactcagcgaccatttcctcgcctagctgtcagctagtcagctcgtccaactcctcgtctagctatcagctcatccctcgtcaactacctgccgacctacctccaatgacggcctagctcacttattctaatatgaactacgtgtggcttgatccctttctaagggtacgtaggcaaccttttacaaggttcagctataaaacgaataaactctattcttcctcggacatcaagttcgtcttccggcctcaagctcgcctttcatctacaatcagctcgttcttactccatctatgctcgttgaagaaatcatcctttgtaatccgtccaattcgcctaagtcgcaggctcgtctttaatagaaagattcttccttccctagagatcccattttcgtacttgtgtgattcgtgcatcaacagttggcgcgccaggtagggggatagctcgaagtggcttgatccctttctaagggtacgtaggcaaccttttacaaggttcagctataaaacgaataaactctattcttcctcggacatcaagttcgtcttccggcatcaagctcgcctttcatctacaatcagctcgttcttactccatctatgctcgttgaagaaatcatcctttgtaatccgtccaattcgcctaagtcgcaggctcgtctttaatagaaagattcttccttccctagagatcccattttcgtacttgtgtgattcgtgcatcaacagttggcgcgccaggtagggggatagctcgaagatatctctcaaaactacgaccccgcgacgaagcaaagtgataacaaacagactacatggagcattcgataccgactcgtcaggctctggaagtaaaacgacaacgtcgatccccgggagagccagtcactcgacctcttcattcgatatcgcagcatgttctccgacaagaaaaggacttcaaggaactatcgaccccatcatcctaggcgatgacacttccagcccggcagtcaggacaataacactgaccaacgaggaagtgccgccgatcaaagaggaacatcccataacctcattaaacataccgacctcgttatcactcacgcctaaccaagaacaagaggagaagtcatcaggcgggcgtcacttggagaacctcgacgatgacactcccagctcggcagctcggacgataacgtcagcgcacgggaagacaactcaaataaaggaagaatactactcggtatgtaaaaaaattttattattactttttcaacctagttatttgcaggtaaaaaaatcattactttttaaaaaggctagcagacgaatcaacacggtatgctattaactaaaaccaaaataaaaataaaacttagtggttttccaaaaataaaaaacagtgagcggatgacagttgtcaaaagcagcacatggttttacttactttcccggtttaaagaaagaagcaaaccctagttttagagcatctttctttctttctttctttttcccgtcgcttttaaagcatctttcttatccgtcgcagttcatcttcctaactccatctctataaaagaaaaaccccggcaacaatg

SEQ ID NO: 27736 - DNA, 3000 bp, Unknown; identical to SEQ ID NO: 1670
  misc_feature (1)..( 3000): 2750-1469P.txt file - cDNA_ID_2991813; gDNA_ID_1620433; Annot_ID_156904

SEQ ID NO: 27737 - DNA, 3003 bp, Unknown
  misc_feature (1)..( 3003): 2750-1469P.txt file - cDNA_ID_2991829; gDNA_ID_1972177; Annot_ID_180050
aaattggtacattatctcatttacctaggatcacatatatcatgatgtaataaaggaaacataaggcatggcagacagatgaacgaatctaaggacaataggataaccttggacggtgatgagataagcacgtgggatagtctaaatggtcagatcttaatccaatcgctaacattttcaagtttcaaatctttgaattttgctttgggaatttatttttttcctctttttaagaaactaacaatatacaagttggatgaaaaaaagaaagaagcaaacgcaacattctacgtttgcgtgaaattttggatttcaagttagataacagacgaaaaaatagagattgaatctaatttttcaaaataatcaatttttgttttgcatatttttttcaacgttgtttttcaactttatacatatgcgcaatcaatgcattatctctgatataaaaaagggaaagaaaaaaaaacagtgcatttttcacgccaatcatcaattcactattaataattacaatttcttttagttaaagaaaattaaaactaggtaaaaaagttaagtaaacaaaaaaaaaaaaaactttcccactagcaaatatcaaattcaaagttgagatttcaaaattttttatctgaaatttatacaataatgaacatcaaacttaactttaattttatttaccaaaaccaaacaaatattctacttattccttaaaatagaaaaatctgaaaaatagagagaaagctgaccttaacatctctgacaccagcacgaaccaaagcgttgttaagattcctcatcgccggtaagagattattgatcatgttattatctccggtgagcagaatctcatttccgactgagatatacttaatcttcgtctgaggatgaaacggcaaaatgttaaccgaaacccaccgacgagcttgtcttccgttagccaacgccggaatatcaccgttaggaacggtgacaacgacggagataccagttccagcgaaggcacgtaggatatcgggattcacatcgaagatcttgacgctatcaatcgaagtttgtgtcttgataaagttagccacctgagtcggtggtgggaggtttccgagagttccgtagttaacaccgatggcggagatcacggcggggatggtgaggaatacggcggcgcagaggaggaggagaagagagattgacggtggcgctttggccatctttttatatttcggaaatgagaaaaccaaacgattccaagtgaaacccgtgaatcgtttgagttgtgtttttattattacgacgaatagatttttttattcttatcgagaaagtatttataataaaaattaatagatatgaccgttttgtatagcgtatacgtgtgtatatttttagtgaggaacagctggattttgtggaaagcaaaataaaagaagaagtttgtgttgtctttgtttttcatgtgcgtcggcttaaatttaggccgttgtaaattattgaaaaagtggattttgttgtgaccgtggaaactttagttaattaatttggctaattatagagtctgcttttgtttggataatcaatttgtcatctttttctttaatggtttttggctggtaaatactcatactatccaagtttaatctaaaaatatacctctttcttgttaatcgtaattttacaatcctaattttatccagatacggatgaactatatttgaaaaaaaggaactaaagtgaagttaagaaaacaaaagagagatcgagtgttgttttttcttggatacgtttattaaaagatgttcttaatgaggtcaaaggagactatctgagtttttactgctaaacttaaaactaaaaaaaaaatcgattagtaatattgatgtatcaacgaaatgtatatggttaaatattaagtgaaaagaaaaagaagagagatcgacgcggtttgggataatgccattggcccattggacacgtgtttgtaggaggaatagtttggagtttgaacactacggaccaaagtcaaagagattcgaagtatgaagatgttgttgaggaagctgattcgaagtaacttttaccgacacgctttagccatttgttatgctttctttgggaaaagaagatccgcgtccatgtctcattgttaacagtttattgtcattttcaatgacatggttacactcattgcacacacacacaaaccacgtaattttgtatttttttaattaaatcccatccttattttttgcaataacaaattaccattgttactttttaatgatatcacataaaataatcgatgccactcgatagccctttagactaacaatatgtttgttgaagtatgccacaatgtttgaagtgagccggctcaatgctctcatggtggtttagtagtttaacttgagaacttacaacagttttctccttctccacactatttgtatccaagaaggggcattacaatatagaattgcataatacgatttaaacttttaccaaaaaaaaaaaagaaaaaaaaagaaagaattgcgtaatacagaatttatctttaagggaatacaaatataatttggtttcagaatcatctcaataggctttcctttaaccaaacttgggttttattgatgtgcttgctttaatgggcctaaagcccatacaacagcatcactatccacgccgttgtctattcttattattcaccccacccggtacaccgaccaaaccttggccaacacgtccataatatttcatcctccctcctaatttactttaatatcctcaactttcctaatcgttcagggaatattctcatataccctagacatatgcgtcttttccaatctaaaatgttgagagtatatttttatttatatatatatgagtgacccctgcgagagacaacggccactgaacactatcgatctaatcttttcagctctctccatcgtcgtcgtatctgtgactctcgtgatcatcgcctgaaaaaaatttgagataatg

SEQ ID NO: 27738 - DNA, 3003 bp, Unknown
  misc_feature (1)..( 3003): 2750-1469P.txt file - cDNA_ID_2991838; gDNA_ID_1972176; Annot_ID_180022
tatggaaaaaaatttaaaaaaaatgagggcccaaccgggttcgaaccggtgacctcttgatctgcagtcaaatgctctaccactgagctatggaccctttgttgtacatcatatctatattaagctatctaaatctacattaagatttctacatatagtagcttatttctttgttattgctttagaaatttggtaacaagatttatattagtagacctcttatatttgtctctaaacaataagaacaaaatgagaaaatctagttatacattatcaggccagaactccctgcggaaggctcgttcaaattcgttttccgccaatcgtttttcgtgctcgatcatcttcactaatttcttagaaagtttcttgctcttctttgatacttcttcaaaagctgtatcctgaggctgtgccggttttctcttggctggtttttcagctcctagtccttgtttgttatgttttggttctgcttgtagaggcaccaatataccttgttcagtgattcctagaccagttccttccttccagccatgcttctttaggagctgaaaaccaatgttagaagaactgatagcagtcgatggattgcttgattcagaagaatccccaataacattggacactttttcactgtagtgagaaattgtagcctgggacttttctgttttcttcctcctttgtataaccagtccctgtttggtgattcccatatcagtactttccttccaaccttgcctctctcggagctgaacaacggacgtttctctccgagtacaagccagatattctgttccttgcatcgtaagaaaggaacttcttccgtttagggtttgtgtttcttctgatgatccattctccttatatagaattattatgatttcctaacacatgaggacacaattattaatgggcttatatgccccgtacccacaaaagaaacaaaaattgtttgctaatccagttatgaactaatcgtgtttataggaactcaaaatttgcagagtcagtggcaatcctttaacttgttgaatctcccgtaacaaatcctaaccaaaaacgtgaaactcaagtaatcgccgaacaaaaccagaccaagaaaccctagaatcgctgatttgatctaattaagtaaaattgccaaaaaccgcttcgactaattagagaaggcctggccctcttactctatccgaaccaccgcctctgctttattttaaccttatctaatgtaaaattcgagtgatgcaactctgtacacgtagaatcgctcattaggtcattaatttgtgactgcaatataccccaaaaccagaacatttagccttagaaaccggttcaactagtcgacagaaagaaaacgtattcaaataataattttgatgtttctaaacttcctaattgaagcaaacaaaaacgacactagtacaacttttctaaactaccaaaccattatacaaatttattcgaattggttataaatgatataccgagcgattccaatcatgttttgggtcatatgtaatttggatgacataaaatggttagaatcttttttgtctggttcatatatttaattttctctggttcatatattttccccaaactgacaagtttcaaaaaagaaaaaaagaaagaaagaaagaatcagaccgaacccaccaccatctgtcagcaaaccggtaatagaggttgttggaaccacatgtcaagaccaatcatatctattatatcttggctttcctcatctctctttatttttatgttatcctatgaaaatcatttcatctttgatatagaaagcacacttcatatccttcactcgttggataaatatgaaattatatcattctatatataagacttggcagttatagacttattgtatatctcattttgtataatagattctggtttaaaatttttggtgtttccgaatataaatcacaaatgtggcaagaaaacagaaaagcaagttgatgatagaaaaaaatataagtaaataatattggtattatcatggaaaatctagcttttgaggatttcccgccttatcaaaatttaaaggaaaaaaaaaacaaaataaaataaaataaagaaagacctaactttgtatgtttaaatattatattgtttggaaaatattttaaaagaaaattatcactttgaaagttttttactttttaaaggaatttttgtcttttgaccaagagaataagaaaactaagtttgaaagatatacaaatttcacaatttgcgaatgcaaatcattcccaaattgacatatattgtatggtattgacacacccacaaatacttgaaaattatctgatattggatgtttttcaattatatattaataaaaataatatttgtatatagtaaataatagactatcatttataacaacaaaaattttataaactaatatagagtgctatataattttgtttaatccgaatctaattcaataaaaagactcaaaatttataaacataatttagaacatagtaaaaaaaagtgagagagaaaacaaaaaaaattgagagaggaagttcaaattgttcttgtatttagacaaaaacaaaaaaaaaaaaaaaaggaagaggtgactaataatgaatgatgcttttacacttataaaaaggtcatgacgcatcgattaaataaataaaatgttgtttgtttgttgaccaaataagaaaagcaaaattacttaaaattgatttttttaaaaaaggcagtgtatataaaaacctttgtcgttctcaaatcctctctgtaattctggtttttcttgcaatgcttcttccatttctctcctcctctctcctcctccgtctctcttctccgatcatgtcccctgatcccaaatccaataccttcttcttctctttttccagttgattaccggagaatttcagatcgcgatctccgatttattaataattacagaaaaaaataattaaaccctagagagagagagagatatatatatacatg

SEQ ID NO: 27739 - DNA, 3000 bp, Unknown; identical to SEQ ID NO: 2446
  misc_feature (1)..( 3000): 2750-1469P.txt file - cDNA_ID_2991846; gDNA_ID_1620537; Annot_ID_159917

SEQ ID NO: 27740 - DNA, 3000 bp, Unknown; identical to SEQ ID NO: 1983
  misc_feature (1)..( 3000): 2750-1469P.txt file - cDNA_ID_2991850; gDNA_ID_1620474; Annot_ID_158105

SEQ ID NO: 27741 - DNA, 3003 bp, Unknown
  misc_feature (1)..( 3003): 2750-1469P.txt file - cDNA_ID_2991881; gDNA_ID_2684091; Annot_ID_189954
attacagtagatatatgaagggaatcttatagaatagagactaacagattgtttatctgaaatgattgctagatcagtcatttcgcatagccccaagcttgtagagagctatctcaagaaccagtcccaattgtcatcattttctatctcgactacagaccaagcaatacggacaattcgattgtcaccatctcttccaactgtggctaatagatgtccttttatgtcccatttcagaaaagctccatctatccctattacaggtctgcaagtttgtttccatgactccctttgagcttgaaaacaaatatataaccggtaaaatctctgcttgcttccaatcactgctcctgcaactgtctctatgttgaactctgtccccggattccgcaataacacctctgcttgataatcccatatcctagcaaaatgagaatcatgactagcacgtctagctctcaaaacttttgtctttgccttagcacattggtctggagtcacttccaacttgtattctcttaagatctcagcaaccatctcatgtttagtgagttttggattcactctcaacctttcttcaaacaaaaacccaatagatgacacctttaacatcttcgaatgtcctgacctcacacaagtatgctcattgtaataagttcgtatttgcatcttatgttttctcttctcataagagcaacggactctgcacggacattcaacaccctcatcactaacatacacacacttagcagcaacaaccatagcttcagaattataaagtttaatgtcataccttgtctttagggaatacatcaaaagagcaagcttgaaatcttcaggagagttataagtcttctccaatgctagtaaaatctcaggatcaccaagatcatttcgagctgcctctactctatcatcatcttcatcatcagaggacaaaggatctggaatcttgtcttcatcccatatatcatctaccctgtcattgtcactagcttcttcttctccattagcctctggaaaatctctttccatgtctaagttaccatcttcttcgacacctaatccagcagtatcatcttcttctctattagtatctactgcatcatcaacctcatcgcagtcttcatctccttggactgcacagtcatcgtcttcatcaagagcaggaacttcagcctctaaatcctcctcttcttcatctctgattctccttcgtttacttcgtctaagtggagcacgaacttcgactgcatctgtcacatcaacgcctgattcttgagcttcatcgtgagcttcctcttctccgccacaagacgtttcacctaaagcttcctcttcctcttgtccaatttcacgacgagttgattcttcaactgcaacatcagcttcctcttccaatctattttgccttcgtttacttcgcctaagtggagaacaaactgcggttgcatctgccacatcaacggactgacctcgagcttcttctccaatttgatttgcttctccttccggcattggttcaactgcatcgtgagcttcttcttccaatctgatttgccttcgtttacttcgcctaagtggagaacgaacttcggccacatttgccacatcaacatttgatactacattcgcttgacctcgagctttttctccaattcgatctgcttctctttccggcgttggtttagctgcatcttgtgctccgtcttctccgccacaagactcagataccacattcgtttcacccccaacttcttctccaatttcatctctttctcctcgcggtggtgcttcaactccatctcccaccaaattctctgattcgtgaagcattggagatccaatcctcataacgacgccattctttctaactaatggcatttcagaaaacgaattgaagcaattagggtttcgattttgattttgggggcaggattaggtttcgatttgggtttagggtaattgattttgttttgagaatttctattctcgattttgatttctctttagcacgaaaacgaggtcgtaagactataataacagatgcttaacggattaaaacggctgtcaattacgctgttagaaggagttttaacggtggttaattagaccgagtcaacgcaaacttgaaagtttaaaacagaagtcaactttttgttgagagttaaaacggccatttctcgagttcacggttactttggccattttttgtaaattgaagtattaaataacattttttctaattaaacttaataaactacttaagaaaaatgggaaaataataattggaaccgactttaatttcacaatgactcttttgcccttccatcgttgacgacattgtttctccttctctcttccacccatttaaaaacgcaaacttggaaaatggagaactgtttaactacgccaacgggctgttttaatgacaaatgttagactgggctcagtaacggatgttgtttcttgtcactaaagaatacgattcatagatttaaaagtaatccatttactttgcttttactttttcatgtgaagagaaacaaaaaaaagttttgttggtgatcaagtttgtagtgtactagtaaaatagtaccatagtatgtgtgtgtgtgatgtggaaacaaaagaatatatagaaaattttatgttttgggtttcatgtattttcttttaacataaaaacaagaacagataagcataatgacgtaagcagtggcctaagcatctcttaaaactccatttaaaaaaacatatcgaattgaataacattgagttgacttgtttaacattcacaccttgcttgctacggtatcttagcttccaagattcaattaatttttcattttttatgttcacagtcaatagtaataagacatcagcatcgcatacaaatttcttatataactcgactagtttactctataaagaatcagcgattggagtatagaaaaggtttaagcaaaatccatcaaagaagagttccttttcacaataatg

SEQ ID NO: 27742 - DNA, 3003 bp, Unknown
  misc_feature (1)..( 3003): 2750-1469P.txt file - cDNA_ID_2991917; gDNA_ID_1971823; Annot_ID_58366
caattccacacattgagaattcttatgcaatagaataattaaataaacagtgacaatttaattttcatgcaaacaaagatatatgaacgtacaagtttctacatcaaaatatatttgttaataagattatacaaaactctgaaaacctaatacatggaaaaaaactcaatggtaagagattaagatactaagtgaaagtcattgcaaacatgaaaaggtgaagcttgcttggatcacgaaccaaaatgtcaaaaaacaaattcttgggtttttcattttcgatccaagtaaacttaaccacccccatgacatggttgtcattggttactattaaatgtttaagtaaaataataaattgacttttatgtcaaaaaaatattgaatagtacaagatctaaaatttaaatactcagtgataatcatggctaagaagaaggtaaagcttgcagtgataatcataaaggttttgattcacgatcgattgaggcaaatctcactttcttccatgccatggctatcactcataattatctctcacttagatttttttttttttgttttttgcagtgtgaaaagaaaatcatgcacttgtgatcttatataggaagaatcaaggataagagataaggatgtgggaatccaaatattagataagtataaatctaacaaaatccaaaaatccacacttactattttcttatgttaataccattttagagttaaaatttgtttgaatgaattttttgaaaacttaatgaatagatataggttattttatttgattctcttatttttatcttcatctttccaaatttgtgattcaatttcactttcacttactaggtttgtaaatttaatttacacttatacaactatcgaaccctaaaagcttttatagtcgtctttgaagaagtacaaactccaactctttcttcatttgaatgtcgctccccatttccgtctttttccatgtatatttctttggatgtgatatattgtcaatttttttttttaaggtttataatttactaaacttaagatatgacagggtgaaaccatatatgttttgaaatcaaagcaaaatatatcttgtgcattgttaggtctcactagggtattgatctatgcccacatagtaaaatcatttgtattttgaaatcaaaacaaaatcacattttggataacacattggtattattatatgagatatatagacaactgttgaacactcttaagaacataattaagattaggggatgtgatttggtactggtacgttataatggattgattagatgcaaaaccatatttgtttgatcttttgtagcttgtaaatcaaaacaaccacgatgcaaataattgtaaacgagtttagtgccaagctaaagataaaatacatatataggaaaactcaagttgaaactcctcctatattggtttcctctttggaactaaattgtatatgttacaaaggtgaaactactaaaataaaaaatgaagttgaattattagttgcacttgtagttatcctctctctcttagcaaagccaatcctgagaggagctagaaagtaggtttatttttagagtaattaaacctactgaaaataaaacatagcaaaaaagtacctttatttattagggccacagtaattcactcgccaaccatgttatgggctaaacgttttcaactttatttgctatattgaaagacacccaatatgtaggaatcctaaaacatcacaatatgtaggaatctttgtaaatcatcacatgttttgaaagttataacaaatgattttttttttttttaaaacatttgagccgccttaaaaatattatcgtatacaataaaataattgtagcaaaatcgaaatctctaatcgacagaagttaacgactgaaatatggatttgatgaatcatttagatgtatacaattgtgtcggtcaagttagtgttaatgcacatctttcaacaacagtaataaatcactcttgccaactgattaaacagaaaaatactccgactattttagagcatgcaaaaaagtgagatttagtctgcgaaaatgtacaagagcgaattgtggacgaacccatacctgcttctatcatgatttcagaggcttctggtttcaaatgctatattgacgggtctttgataaccaccaagatttccactagtctcggttagatatgctttgaaaatgacgagacgatgtcatcttgaactgaatgctactattggcgatgttgtggatgttcgaaaatcaagacgttcacgtaacaaaaaaaataaactcacgttccttagctatgacagttaaataaaaataatatcaaaattaaaatatttcgcactataaaaaaaggtttataaactaattttttttgtcattaacataatttcatttgaagttattgtcgttttgcaaaaaggtttctaaataaatcgatcaacacatgctggtgacatttatgatgagtttcaaatgtatgagttttgaagaagtttcaaactcttataagggtttataatgtgggaattaagttttgttaattcgtacgttcaaatataattggaaatgttgtggtaatataaatatttttccagtattcgtacgttcaaatataattggaaatgttgtggtaatataaatatgtttccagtaggggaaaaaaactacaaaagtttcagaaattttcataatgttttgtgactcccacaaattttaacgtgttcgtcatgtagaaaatctttggtaaaagagtgactagggcagtgtcccaagcaacgatgggtcggcacttggtcactccaatggacatgtgttatacagttgttacctatctgagctctaagtactgagtactaaaaaagctgtcatatgttagccacattttacacaacacaaaatccatttttcttctttcataactatcagaaacaaacacaaattaaatcaaagtttcattagttttaaccccccacaaaaaaacatg

SEQ ID NO: 27743 - DNA, 3003 bp, Unknown; identical to SEQ ID NO: 27742
  misc_feature (1)..( 3003): 2750-1469P.txt file - cDNA_ID_2991917; gDNA_ID_1971823; Annot_ID_176262

SEQ ID NO: 27744 - DNA, 850 bp, Unknown; identical to SEQ ID NO: 210
  misc_feature (1)..( 850): 2750-1469P.txt file - cDNA_ID_2991917; gDNA_ID_29590; Annot_ID_146748

SEQ ID NO: 27745 - DNA, 3003 bp, Unknown; identical to SEQ ID NO: 27742
  misc_feature (1)..( 3003): 2750-1469P.txt file - cDNA_ID_2991917; gDNA_ID_2926152; Annot_ID_139362

SEQ ID NO: 27746 - DNA, 3003 bp, Unknown; identical to SEQ ID NO: 27742
  misc_feature (1)..( 3003): 2750-1469P.txt file - cDNA_ID_2991917; gDNA_ID_2926152; Annot_ID_198158

SEQ ID NO: 27747 - DNA, 629 bp, Unknown; identical to SEQ ID NO: 242
  misc_feature (1)..( 629): 2750-1469P.txt file - cDNA_ID_2991921; gDNA_ID_76498; Annot_ID_147067

SEQ ID NO: 27748 - DNA, 416 bp, Unknown; identical to SEQ ID NO: 251
  misc_feature (1)..( 416): 2750-1469P.txt file - cDNA_ID_2991925; gDNA_ID_77238; Annot_ID_147154

SEQ ID NO: 27749 - DNA, 3000 bp, Unknown
  misc_feature (1)..( 3000): 2750-1469P.txt file - cDNA_ID_2991928; gDNA_ID_2328; Annot_ID_145643
  misc_feature (889)..(889): n is a, c, g, or t
aatcctcaaactgggctacaagacctcactgctccatttaatcctcaaactgggctacaagacctcactgctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaaaaaaagaagaagagaagagaagcaggatttacaaatccaacagatgcaaatcagaccgaatagaaggaggagcaagcacctttgtttcttgtctttgaattatgatttttattagtcaaaatctttttaatgtgtcgaaacttccctatcaacattctctgtttcatccttagaatctcgtatttcttcagagtattctcaacatttattcttgtttctattttgctatggattattgtatatatacttcttctgtctaaatcatatcattaatagtaaaaggaattttaatgatgaatactgaaaaacacaaaaactaatcgggaggaacaaaagttccaagtaaaaacgaagaatgaaaaaagtaaataagaagaagaaagtatcgtaccagatttaggaccataacagatgatgtagatgtagggcttaaatgggcttcgtttcgaatcctatttcgttggcccaatattttagctttcccaccgcatcattattcatcatctcgtgtattaaaaagccgatttgatctctttccactaaaaaccttgctgacaaagaattcaattttgattgtcgtcgatcgtacggtatcttgggggattgatggagaacacagacgtcgtctcgggtntgcataatttcttgagtaaaccctccgccaaagatttcatcaaatcaatcaaaaggttatctctctctctctctctctctctcgcttctcttcttcgctttttgtatactttaggtttatttactctctagttatgattacatgtgtgcaagataagatatcttgctgatttcacattgctctctagtagttatgaatagtttttttcgtttttgcgacaatgttatgatatcgatgatttgctataaacttaagcagatttttgttgtgatggaaacatcacatgccactggttttttgagttgtgaacgttttttgatgttttgcagtttcattgtttcgatcttgaacactgcaccagaccctgaaaaagattgtgatgcagttcaggacttcttttacaagatggagtctgctttcagggctcatccactttggtctggttgttccgatgatgagttagacaatgcgggagatgtgagttattcttcttccctttttcctgcttatctctctcatgatttatctataataatctttcttgacttaatttatgtatacacagggcctggagaagtatgtcatgacaaagttatttccccgggtttttgcatcaaacaccgaggatgttatatccgatgagaaactctttcagaagatttccttggttcaacagttcatatctcctgaaaacttggatatacaaccaacttttcaaaaccaaacatcttggcttgtaagtcacatctatctctccatagtgttgcttgttttcttataatggttcttacttgtgatgtttttttctcttattttatggcagctagctcaaaaagagctccagaagataaatatgtacaatgctcctcgtgataagcttatgtgtatccttaggtgctgcaaagtcattaataacttacttctaaatgcttcaattgcttcaaaccagaatgcacctggagctgaccaatttcttcctgttctcatatatgttaccattaaggtatgttgtcaaggattgtacaatttaagcaaaagctgatttctgatgtctcatgtttacttcatattaattcttatccttggattctgaaactgacattatttgctttgtttctccaggctaaccctccccagtttcactcaaacttgttgtatatacaaagatataggcgtcaatctaaactggttggcgaagctggctacttattcaccaacatactctctgcagagtcattcatctcaaatattgatgcaaaatccctctccatggatgaagctgactttgaaactaaaatgaaatctgcacatgctcgtctttctggtccgggaagccagtcttatcaaacggatcacggtgctgcattacccactgctcataatactaagagggaaaacatgcttctgcatacaaaatcaactgatagtttctctggtaccaatgaaacactgagtgaaacaccaacaaagaaagttgaccccattaccgatttggaaaataagggcgctgctacgcttttgaatgatagaagtgaggcaaccaaaatatttcaagaatatccttacatgtttgccagtgttggtgatttaaagataggagatgttgaagacttgcttaataattataaacagctagttttcaaatatgtttgcctttccaaaggcttgggtgatgcaacatctttaactccatgcatttcaccattgcaagcgtctaaagtctctgagaatcatacaacattgtcttcagattttcaaacgaaaagcgaaactgacaggagcgttgataatttgtttcgagctctacaaggtgagggagacaatgttcataatatctcagatgtaaaacaataatcagacttatctcttccaaatgtaatcggattcagttcttgaatgctacatgtaattttacattcactaattatacggttctacggttatacgacaaattgaaacacttaccggttttatctgagaaccggttaagggttcattacaagatatgaaaccaagataaacgaaaagggtattattgtaatttcgcttcattttctgctcctctgccattcccacaccactcagaggaacagagcttaacggcgactatg

SEQ ID NO: 27750 - DNA, 3000 bp, Unknown; identical to SEQ ID NO: 14308
  misc_feature (1)..( 3000): 2750-1469P.txt file - cDNA_ID_2991936; gDNA_ID_2684103; Annot_ID_190318

SEQ ID NO: 27751 - DNA, 3000 bp, Unknown; identical to SEQ ID NO: 9123
  misc_feature (1)..( 3000): 2750-1469P.txt file - cDNA_ID_2991955; gDNA_ID_1972003; Annot_ID_177762

SEQ ID NO: 27752 - DNA, 422 bp, Unknown; identical to SEQ ID NO: 481
  misc_feature (1)..( 422): 2750-1469P.txt file - cDNA_ID_2991959; gDNA_ID_1591360; Annot_ID_150880

SEQ ID NO: 27753 - DNA, 3003 bp, Unknown
  misc_feature (1)..( 3003): 2750-1469P.txt file - cDNA_ID_2991959; gDNA_ID_2926228; Annot_ID_142584
acgttattcatagaaagtaatcgacgttaacatttcttgaacactcccaattcactggtatggtcctcatggacatagacaatatttttgatctatgtcacaaaaacactaaatcgccaaggcctgattaattcgtaacagttatcatggaaacaatagttagattaagcctttaacaaacaaaataaaaacaaagttagaattctgcattaaaaaaaaaaaattttaaacaagtataactggaccatttattagttacctttgtgactattaatttggggataattagtttataagaaaaaaagaattaaaaactcactttttaggtggctgtgtgacattaggaatctcttttgaggaaagatcattagtttccatcattatccacaacatctttagcttttgctaatgatttttatataacaatacatatatactttcagaatataaatgtgaaaaaatcaaatggttttatcatttaagccgtctaaaatgcttaataataacaattaaaatcacaacgagaatacgtttaactcaagtctggagtctggacccatgaaacaaatcttactatacaatgaagtgctatttttctaatatatatgacaaattttattttcggcctaggattctctcaacttgtaattcttttttctttttgtttatgggatgggaattcgcttaattcagatttccttgggtaattaaacgtgttattgtcacaattttatgagtattcaagcgaatctaaaagaccattatgaaaagctggaccatttcacgcatacccaatgactccatacagtaaaaaggaattttaacttaagaatacacgcaacgtttcgatttagatatgcaagaaaaatattgtaacagcagaaaatttgatttgtttctgttttttccgcattttattttgtttgcaatgaaatttaaggaacagtaaagagaacaaaattatgattctgcaaagctgtttgattggaaaacaattgtgaattacataatgatttacttttcgtcattccattcctgggattctgctcagtcaaaacattttaaacaatatcgatgtatctgtttaatataattttctataaaaaaacactcttactcaaaaaaaaaaaaaaactaagacattattttgaaaaaatctttaaccaaaagtttcattttgaaaaaaaatcatccagataaattcgattttattagagaaaccccacaccaccactagctagaagcagaaagtgattgaaggaaataaaggggggcacgcgttgctctgacctcaatatatatctgggaactatatgaggaaataactgtaatcaactttattagaattaccattctcagaaacacaatcataattacttcttttcaaaagacagaagttacaaaaaggttttgtattttaaattaaagttgatgtatatgtggagtaaccaatcaaatgaaaatatgaaagctatcaaatgttgtaccatgtcctttttttctggccaatctctacacacgagaagcactgtaaatacctatttttaaaaattattttcgttacgttcaaattgtaaattttgaattcccccttgcagaaaattgcttcatgtgattgttgtgtctgtgtataatgtatatgacgctatagttcgtcccatttatcaagaagttaattatttgatccataagtttttcggactacagaccaaaacatattgttatttttcttactaattgttatcatccctctcaaaaagatgagattcaagtttttgttgccagagagttttgcaactctataaaacaacagaaaattcaataattcatgtgaagtctcattgtcatttgaaattgcaaaccttttctttttttcgtcttttgcaaatggtaattcactgagactaaccatgtcatgtggtaacttaaatacaatcattgatgattttgaaaaagatttcgtaattaatatgaaagtggtgagaaaaagggtcgtcaaaaaagtaaatggagtcaaaatccagttcctataataaattgggcatgcgtgtttctctcttttgtcgttttatatttcaatttctcacgagtttttttaaattaaaccctaattttttactctttacttctttgagatcgtcaacgcttttgtcctttgaaggaaaaataatagtttcacagaaatgtgaaagttgaaaacaactattcgatgctattattgaaataagcgctcgttatgatttacaattttcattttctacttctgtaaaatatatgaagatggatataaaaagaaaactcttgagtgactcacaataacgttgagattaatgactgcgtttataaagatctttttaaaatgatgtttacacttcttctttctttttttcacaattttacacttctaatgtaggaatcatatttgttttgtctgattaaatatagtttaatatatgtaaattaagtaagaacatcaatgaacattaaacatagaaaatattaacaaagagcagttaactatcaaggggaccaatttgattaaagaaattattttttgttcccattagaaattggcaataacgttgaggttgttctctcaaattaaaaaaaaaatattttctattttgttggtgtgctcttaaattccccattgttacattgaggttgccctctaaattttaaaatattttattttttttgttggtgtgcccttaaatcacccattacacaacaaacaaaaaaagagactaaccaaaaaataattttataattaattttgtttcttcctacctacaagtatttacttaaccattgcctcgatcttttaaaccatccacattttttgaatcaccatcaacatctttctctcttctttttcttctctctatctgagtccagaaacattcacattaattacaaactgaaaaaacattgaaacttttgaataaactcacgagaagtactctgttttctcttcttactctgtttcttgttgatacaatg

SEQ ID NO: 27754 - DNA, 3003 bp, Unknown; identical to SEQ ID NO: 27753
  misc_feature (1)..( 3003): 2750-1469P.txt file - cDNA_ID_2991959; gDNA_ID_2926228; Annot_ID_203576

SEQ ID NO: 27755 - DNA, 3000 bp, Unknown
  misc_feature (1)..( 3000): 2750-1469P.txt file - cDNA_ID_2991963; gDNA_ID_2213659; Annot_ID_132501
atgaaatcatctgtaaaatcgctcaggttttgattttttcatctactttttctttcagactataaactaagtatgtaataatttaataaattaaaggagaaaaatagactaggttggatgaaacagcagcaaaggccgtgaaagagctgttacctgaatctgcagaaggagacctctcaagcttgtgtctttgggctgatcgtgtcaagttcagataccactggtcttctcctcttcattacatcaacactcctgatgcatgctcataccaatacaatagtgagcgtttttattataatatccatatcacaaaaaaattaaaagcataagtgttgtgtatccaaccacatttcctttgtttcgggtccaaaggggactgcaaggacgaatctggagagaaaggaagatgtgttgcgggagccatttacaactacaccacacagcttctttcctacaaaactgcagcttcatctcagtcacaatgtagtactaaaacgttgccatctttttgcttttcaccaatttcctcatcttttatctccctcttatattctgtttctatttttccttgtggccagacaacttaaccgaggccctgctcttcgtgtcccatttcatgggtgatatccatcaggtattataaaagtcgatcaagataactggtttcttatctgagtatgtctgactggcataattgtaaaatacagcctctacatgtgagttatgcttcagacaaaggaggtaacaccatcgaagtacattggtacacgagaaaagctaacctccaccatgtaagaactgcgaaacgcatctattatttcagcatcagatagtacaaagttttaaactttagattcatacagatatgggattccaacattatcgaaacagctgaagcagatctctataactctgcactagaaggaatggtggatgcactcaaaaagaatatcacggtactaatgcaacaaaactactgttctctacatgtatgctacaaggtgtttctgacttgctgacatgtattaataaaatgcagacagaatgggcagatcaagttaagagatgggagacctgcacaaagaagacagcatgtccagacatgtaagtatgataatagtacctttgaatagaagtggttcttcttcatgccagcaagaagcagatttaacttccaattgctttccccctgtaaacttttttagatacgcatccgaaggaattcaagcagcctgtgactgggcatacaagggggtaacggaaggagacactctagaaggtaaagaatccacccaaaaaactatgatgattgacaaaagaaagaagctaacaaacacataatgtcttctacgcagatgaatacttctattcacgtctaccgatagtgtatcagcggttagcacagggaggggtgagactagcagctaccctaaacaggattttcggttgaagctgaagttacagcataatgattggtctaagcctgtcttcatattagattaaaaactgcattattgaaacaaggaaatagcaatcacaagccccgaacacggcaatgctctttcattatcaaacaaaataaattatgtttactcacaaagtttcttcaaacaatagtaaccaagcagagcattattatcaatatgtttacaacacacacacatcaagccagggttctcgaactctttcatgagaagaggtcttcaagcttttgttctcaccacaagaactgggcacttagcattgttaacacagtaattgctaacacttccaaggaaagtcctgtccatacacacacacacacatagaacataagacacattatcatctccaaaaccatcaaagtttaatctacgcagtacacacctttgtaatgctcctttaccatggcttccaaccacaagcatatcaacaccaagcttctcagcagcttcacatatcgcttctttaggatttccaaattccaacacctttcttggagtaacctaatacacaacaaccaaaccaattagttccaaaacacacacgaatctgactaatttcatataagtgaagtcaaaccccagtctcagcacaaattttggttccttcatcaagacgattcaatccagcgttcttatgactctcttgcaatgagtttataagctcaatcgctacaacacataagaccaaaattttcaaactcaatttcaaaaaaatccaaccattatcaacaaaatgaaatcgccggaatccgatgaagaagattacttacgagcggcgccataagaggaagcatagacgcagctgagatcaagatgaggttgagcagtgaagaggatgatgtcggaatcggcgaggctatctttgagatacacgagcgtccattgaagagcgcgtttactacattcgctttcatcaatcgccaccatcacttgcttcatcacgcttttctcttcttccgccatggttttcttcttctctgtgatcgctccgatgacttggtgatttgatttctcttctttgagaaaagtcagaatgatgacgtgtcgattgtgtagaggaaggcacgaggttcttctggagattttgaattattcgatgggcctgatccaatttcgggtttcttgtatcaggtccagagaaagcctataacctcgttgttcttattggctcatcggattccaaattggcggcgaggttacacagacctactcctcaaatccttaacgtactcgtaagcccatatccgatttttcttttcctgtaaatttaaattttcttacaaatttctcaaaatcgcaaaatctttgcctctttcttctctaatcgaactaaatcttaaaactttgctgattgattgattttcgattccggtatgtatctttctttagttttcaattcgctgcttgcttcttccctgggaattttagggtttttagggttttgtaatttccgattgaaaagtttcgtgctttacgagtctctgtaactcaatttttggcagggagaagaaaaatg

SEQ ID NO: 27756 - DNA, 3000 bp, Unknown; identical to SEQ ID NO: 27755
  misc_feature (1)..( 3000): 2750-1469P.txt file - cDNA_ID_2991963; gDNA_ID_2213659; Annot_ID_181800

SEQ ID NO: 27757 - DNA, 394 bp, Unknown
  misc_feature (1)..( 394): 2750-1469P.txt file - cDNA_ID_2991963; gDNA_ID_1591621; Annot_ID_151274
ttgtatcaggtccagagaaagcctataacctcgttgttcttattggctcatcggattccaaattggcggcgaggttacacagacctactcctcaaatccttaacgtactcgtaagcccatatccgatttttcttttcctgtaaatttaaattttcttacaaatttctcaaaatcgcaaaatctttgcctctttcttctctaatcgaactaaatcttaaaactttgctgattgattgattttcgattccggtatgtatctttctttagttttcaattcgctgcttgcttcttccctgggaattttagggtttttagggttttgtaatttccgattgaaaagtttcgtgctttacgagtctctgtaactcaatttttggcagggagaagaaaaatg

SEQ ID NO: 27758 - DNA, 3003 bp, Unknown
  misc_feature (1)..( 3003): 2750-1469P.txt file - cDNA_ID_2991971; gDNA_ID_1620815; Annot_ID_169211
ttttttctcacggattttttattttcttgcaatttttatttaaagttaatttttaatatttttagattaaaaaaattattttttaatatatataatatttttgtttttaagtgttaaagtttaatatgtgtaaaataattggacacaacatcccgtccataatatgaggtccttaagcggtgttctaggttcattaaatattttatacatacaaaattttaacatttttaaaaaagtattttttgggttttcagtatgtattattttttaaatatacataaagttttaatttaagtgttagatttaaatatgtgtaaaccaaaaagaatgtaaataatacatgtaatatagacataactctttttactaactttcaaaaccatactttatataataaaattgatttttgatttaccaaatcaataaaggtacatgtacaaccaattactcttttttttttctttttgaaacaaattaatggtaataagatcaatggtttacttaacttaatagaacttttctttttcataaattttatatttacatgatattcttaatagatgagccatgacttttatatagcaataataagatgcactaaaacatagtgataatattattttagcattttttaaatgagagtgatagaattattatcctcttaaaagctaaattctaacattcattttgtgtatgttaactctcatgctttttgccttggacaaacaaaagctagacgtctaaaaatagttagaaaataaaacatatataagatgaactaaacactttgggggaaaaaaaaattatgaacttaattagggttctatatgtttagaaaaaaaatgttggtgttagcattattttccatttacttcttatcaatagaagctgtccggaatgaatcatttcctgcgctattagcttttggagattcaatggtcgatactggtaacaacaattacctcctgactctaatgaaaggaaattactggccatatgggtggaatttcgactcaaaaataccgaccggaagatttggaaacggaagagttttctccgatgtagttggtataatattaaagagttctttacaatgcttttttgtaatttctggtttatatcatattgtttggctaatcatatagtgaagttctttttttccaaccgcagctgaaggtttggggatcaaaagaattgtaccagcttatcgtaagttatacattgctccaagcgaccttaaaacgggtgtttcttttgcatcaggtggtgcaggagtcgaccctgttacatccaaattgctggtgaaaaaattattgaacttgttatttggttaagaagtggtatatattctaactaattcgggtgtttgtttgatcagagagttttatcgccagctgaccaagtaaaagatttcaaaggctacaaaagaaagctaaaaggtgtagtaggcaggtcaaaagcaaaaaaaatagttgcaaattcagtgattcttgtttctgaaggaaataatgatattggaatcacatatgcgattcatgatgctggtatgcgattaatgactccgaaagtatacaccagtaaattagttggttggaacaaaaaatttataaaagtaagatggagaaaatgaattttttttattcatcaacactgttatatatgtgtttattcacatttttttggtttttgtaaatgtatgaaggatttatatgatcacggagcaagaaaatttgcggtgatgggagtgataccattgggatgtttgcctatgtcaagacttatttttggtgggttcttcgtgtggtgtaatttcttggcaaacacaatctctgaagattacaacaaaaaattgaaaagcggaattaaaagttggagaggagcatcagattttaggggtgctaggtttgtctatgtcgacatgtacaactctcttatggatgttatcaacaatcataggaaatacggtacgtaaatacgtaaatctcctttttataaaaatatatgcattaccaagatcaatacaaaggaaccacatatttagtgatgcttagacatttgaaatctcaggagcgaccataatagttaggtattgtgtacttgtatggtttcaggatttacccatgagaagaatggatgttgttgtatgcttacggcaatagtaccatgctccaacccagataaatatgtcttctatgactttgctcatccctccgagaaagcctacaaaacaattgctaaaaagcttgtcgaggatatcaagacaggacttgcctgatttcttacaatgctattttcatcttggaattaccataattaattatatacgtacttcttctgtttcaaaatctttgatgttctagagaatttttttttgttttacattataatgttctcatttttaatgtaaaatttattagtttaaaaaaaatgttttgaccatttatattttgcagtttgttattttgcagttggttgaattgtgttagataaataataaataatgtttttatctacaaaaaataaaaaatagaataaaggatttttttattttttttttcacaagaataaaggattttcttattagtgtacaatatccttaaacaatctcttcctccaaacacatcagactagtcacgcttctgctcactaaattttattctatttcaaatgaaaagagcgaagcttcttgaactctacagctcttaccaaactactttaaaatcttttcccactgtcacgtttcagtactaggactccacagcatctcgacgatcatatgtgcaaacttcttgaagctcaaccactatatatcttctatatcatttctcatttaaaagttctcctgctggaaaagtctaaacaattcgtctgtacagatttaattttcatttgtaaaattaaccgaaaccaaaagaaaaaggaaagaccaaataagaaatcaacaaacttgacaattttgactaaagtaagataaatttgatcgagtttttttcataaaacatg

SEQ ID NO: 27759 - DNA, 3000 bp, Unknown
  misc_feature (1)..( 3000): 2750-1469P.txt file - cDNA_ID_2991982; gDNA_ID_2926195; Annot_ID_141252
tactcatctgcagcactccacttacctcgcttcacatcataaatccaatccataaactcagccccagtctttacgtaaatctttcctcccaccacatcgatttttcgaacattatcttccgtcatcaccttaacgtcaggattcgccggtagaggtctccaacactgagtctttacatcgaacatttcgaaccaattgatgcccccagagtcacatcctcccattacataaatcttgtcatccaaaacacatgcggaggcgttttccctcttcatcttcatgttggggacatcgccccacgagcgagtaaaacagtcatatatccatatagctgaagacggaccaaaagcgtcacccatatgttcaccatatattttcgaacccatcgttacggttgaatttgaatatgggagagaatgatcagaaggaaccaaaacacttccacttctcctactgagagtaaaccagcgtgagactggttccgtagcggtaacaaaccgtagacagagataaaggcagcagatctccgtggttccgagttgatatcgcgcggagtagaggggttgagagtggaggagagaacgaaaggttttgcagacgagggagagtgaacggtaagacgatttagagagacgtgccaagcagttcaccaggatctcgtcgggaagttgcaagaacaacgacgtctcacatggtaacgacggaagcttcgtttttttctgcggccgctcaacttcttctttggggatcatctttggtggtgatggagacaaaaatcatgaaatggggttcaaatatatagaaatccttctccctgatgtaaagaaagatagtaatgtagtcaaaagaaaaatcaaagggaaaatttatcaagtttccattggaaaagagatatcttactataatctaaattttatttctcaagatatgtacaatagataggcaaactaatagctatattccacgcgctagagtcgcgcgtggatctaacttgcggacggttttctctttcaaatcttctttcttttgatcacaagaggtttactaatagctcaattctagctgcctttatttttaatattaaatttgattaatacaaaagcaagactatatatatcaaaaccttacaataaaactgtgaccagtggagattgaaccaaagataaaaaagctacacaaacctttgaatttcattgaaacaatgctttccagataaaagcatggtcaaaatttacttctagtgttttatcgttctaattaactattgttgataatttaactcaatcatatttttgtatgatatcttcgtaaaatttctatttcaaaatattaaaaaaaaaaaagggacattcaatctccaagagactaaataagagagagtcatcaaaccgaaagacttatacaatgctggaattgatatgactcgtattgtgtaaccatagcatcagaccaccactcagccttaccctaaacctcacttccattgcatcttgtttctaaggaaatctcggcataaaaaattgttgttcccgctctggctttggggttccacataaccattggggagattggtgctcaggcaattctaagcagaaatattcttagaattttgagatcgtgtagtgtagatttggggagaaatattctttttgaataaaaaaaagtaaaatagaaatattctttctaaatttttgaagtcaaaatgttaagagaatcgagaagaaattcaccgttgtttttcaaaaaaagattcactgtagttaatgggttaatgcccaaagaaaaataggagaagaaacccaattggcccacgcccactcaaatcaagaaattaacttggtacgacattatcatctttaataaaattttgtatacagtaccttcattgccatgatcaaatccatattagatacatcgtttgaattatacccttattaggctcaaactcttattatcattgttccaagcaatagatcatcttgattttaagtaagcctttataatgttccacatgttctcatcaactacttatgacactgcttaaaatctgataaaactagtagccagacccaaaaacaacttatgcttgtgcactctaaaattccaaaacaacatactggatttacattttcaaatggtaaaaaatcaaatgtaagaaattgcaattactttggtaaatacaaaaattgcattgagtggagattggaccgttaaaaaaaaaaaaaaaaaaaaaaagcagaccactgtggtctgtctgtactgtagtactctttgcactcgaacccatttatctttttaatattattttttattattataaatctaaaaaagtttttttttttttttttttttgttctcgaagcagtaaaatctactacaacagtcaaagagagagagcaaacatgctcgcttaattcacggaatcgagacgtttctacaaactcaattttatattttcagctggaatccgaactctgatatagaaagcacacaacgttcacctccagtgacttctctctatctctaaatctctcttgcgtcacttaaaaagtcggtgcttcctacttaagtgttcttgagagtgagacgtttcatttctgggttcaagggtgtagaataaacacttgagtgaagtttaaagcttgagaaagacagaggaaagaaaaatgggtcaaagactgaatctagtcttctggatttttgtctccattcttgcctttttgagtatgtctttacactcaaatcctcttttgggtctgcatttacctttgattctctcttctatgtttcactatctcttaaatttgtcttcttgatgttaaagttcgatgctttactttttgtcctgggttaatctctgtttcactgtagtagttcttgtctgaaaatctcgaatctgttagctttgaactacttttaggtgtttggaatcgacatttgagattcaaaagcagccatttttgagacttgttttgtggatttgttgcagattttggtatg

SEQ ID NO: 27760 - DNA, 3000 bp, Unknown
  misc_feature (1)..( 3000): 2750-1469P.txt file - cDNA_ID_2991990; gDNA_ID_2926057; Annot_ID_196150
actcgtcctcgtctctttttcacctttaaacacttcgattcccggaaacgtttcatcttctcagctcctgaacgcgacaacaatgacaaatcctccacagttgtcgccagacacgacatgacgatctcggatgtcgcctacatcagatctctccccgtcaacggtttgttttgctacacgcgtggtgattcgatcgcggtttgtaatcccaccactagacaaatagttaaattgccagatgtggaatccaacggaagagacgtatacacacacgtcttgggtatgatccggttcaagaccaatacaaagtgttgtgtgtaatgatgttcgatggacacgacgccaatcaacaagatatccaacaggaacacttcgttttcacgctaagctctcaacaaaaagagtggagaaagattgacataaccaaagaagaagatccttaccgccacatgaaaggtgggatttgcatagatggtgctatacactatggagttttgtatagaaaaatagctagatttgatgttagaaccgagaagattgagttcattcaaggaccagaagactttaatgcaatctcatgttattcaacacttataaattaccaaggaaaattagcatgtgtagcgtttgacccctactgtaacactgagatgggtatgtatattctacaagatgttgagaaacaagaatggtcaagcatcataacttgtgatgtgcctagtgagtggggagatttgtttgaaaaagagagatctttgtgcaccggaaagattcatacgggcgaggttatgattgtttccacacctgcgaggttaaagtcatatatgccattttttgttaactattgtgatataactagggagagtattagaagatgtgagattgatggaattgcggattatgagtttagacgtatccatggaattggtaagcgtactcgtgaaatgttgtgttttccaggtcacattgagaatattatcttctttcattagaccatccgcaacgaggggttttagagtggttcttagctttttgattgaataaaattaaatcaataatgctttctattacaagaggcgctcttatgtaagagcggttgttactttctaaaagatgttgacgtgtcaatggtgtagtattttcttttttatgaaacacaaaaaacattatttcccttttgttcctctcacgagcatcaattcttcatcgaactcatagttaccggcgttgttttgaggccactaccatcgtctctctccgtaatcctctccatcatcgtcatcttctcagtttcgaagcattttctcctttaataggtaaaattatgtaattttcgtttgtaaacaatgttgaaattgtagaagttggaattcagaaagtgttttttatcaattcattagcttttgtaatatagtcaatgatggattcattagcttttgactgaagatttaaagcttattatatattgcataccatgtgttcgatgatatgcctaaatgaattctgtctacagactctttgattttgtgtattagtttcagagaaatatgtatcttaagatgacaaattgtaattctaaatagtatagtttcagagaattctgattgtttgttggacgatgtaatcgaaagtggaaacgctacaagatttggtcccttaaaagatggtttcatgttcgaaacctcaattggtttatcaagaatgtgagtttcagtcttgttcctttcttttagatgaagttcatttcttgactctcctcactttactcttattaagtttttttttagaaaaattaagaacctcaacttaatatactaccattgatcatgccaaaacttaaaattcttacccaaactcttaacaaaactttcaaaatcaattcataaaatattactaaaagcctttgctaataacctaccattgtggatgctcttagcttctcctttctttggagatatatattttcttttgtttaaaagattttgctttggttctatactatttttatagagcctcatgagactaatctttgaaagtgctttagcaaagttttgtcttgcagtttgtgagtttttttttgtcatctgaaaatatatattgattaggatgagaccacaacaaacatcaggttggaaacaataaaacagacgcaccataactactcttcacctatactaaacaccttaacgaataaggcctttacaaaggactgctatttgctgatgcatcttcaataatcaatctccactctggaatcaacctcaaagtatccaaaattagagccgcttgatatctataagatggcaatgcttttggtcttaaaacaggaccaatcaattccgaatcttgcaaaccaacatacaaagcatggaatggaatatcagacatccatcctcagtattaattagcctaccattctttctgaagttttgacttcatgagctcgtcagctttgacttcacctcagtggacacactgccagaaaaatacacaaggattaaagcaagattcacctatatcaaacacttagaaaaagggattagaaccatagagtttatttcatcatcttgtggagaaaactgactctgaagatcagatacagaaatatctcacaatccttagatgacaaacaaaaagaaacgaatgttgggggcgatttttggtacttctgctggctttaccccatttgggccggctctgaacaaaaaatgagaagagcttcacttttgtctaactgaatcttttcaaccaattatgtgccgccatttgctaaactttctgtagacagaaccgtacatgattattctctcctccttggttggtcgtctccatcaaggtaagagtgttgtgttcaaaacccttaaacccaactgatcaaacgcatacatacataactccgtcatcttcgtctttactccaaaattccagacatttgaagcttttaagcatctgggtatttgatcttctatccacagatcatagaaacccaagaggcaaatg

SEQ ID NO: 27761 - DNA, 3003 bp, Unknown
  misc_feature (1)..( 3003): 2750-1469P.txt file - cDNA_ID_2992000; gDNA_ID_1620553; Annot_ID_160369
cttgtaagactcatatcttgaaacctcgataagctctaaatgaaaatggagatgtgctgtgaagagaatcagactttgaattgtttcgtgttgatttagttttgtgttgttgttgttgttgaaacttgcaggtccttaagattctaccttgcaggtctttaacttgtaaaagagtagagaagaggtctggtttatctttggaggggtttctgcgtgattattatctgccaggtacaccagttgttataaccaattctatggctcattggccagccaggaccaagtggaatcacttggactacctcaatgctgttgctggtaaccgcaccgttcccgtggaggtgactgccatcatttcttcacttagttcttagttagcttgtgagtgttgattagtagtcattagacgatggttttagctttagttggctcctacgctgctctaagttgccatgtccatatttttttagggttcttcttaagaatgttgaatctcatagagtcgtgtcaactgtatgataaaagggtttagggtctaggtttgaaataagatttgtatctaggttagattatcacataaaatcagaataagaacatgacaatttcacgagcgtaagatttctcatttttgcttcatagagatatgagtcttattaccactatttagtctgagctaataagaagatgggttggatcagaataattttttccgtagctgaaagctggtgaagtttaaaatgctattcaggtggggaaaaactatttgtgttctgattggaagcaagagcttgtgacattttctaagttccttgaacggatgcggaccaataaatcgtctccaatggagcctacttatcttgcccagcatcctttgtttgatcaggtatataagtaccgagatgtttgatgtatatgtttgtctgtactcggtgtgtgtcatactaaacctatggctattggtttaacacgaatgggcagataaatgaactgagagatgatatatgtattcctgattactgttttgtcggtggtggggaactccaatcacttaatgcatggtttggcccggctgggacagttactccgttacaccatgatccacatcataatatacttgctcaggtaactacggtgaaagatcttttccttacgtgagctgagcatggctcttgtctgtgctcgctgtctttaatgctatccaatatatatatatgtatgttctgtaagtgtttaacaacctttttcttctttgatgttcttgcataataaagcctgatcttctcgctggattgaagtttgatgactctttgactaaccaaagaaatcgtttggcctgcaattcatatgtttctagtttacggaaacttctttacttagatgctttctccttctactgaagttttgatatcatctgttcttcaggttgttggcaagaagtatataaggctttacccatccttcctgcaagacgaactttacccttactctgagacaatgctctgcaactctagtcaggtaagctttttcattccgaagtcaaatctcattttttggattaaacatacaaccgaaagctgactcgattcttctgttccaaaactgggtggtttcaaactatggttgaaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtagcgaatggatttatttttaatctctgtttcaggttctaagttcacgttgtgtctttatgtaagaagaaactatgtagagaagaaaacaactgctccgagcatgaagatgtttgtttggtttacgtctatgttgtaaaagacaattgagagctcttggtacagacattttttaggtattggtaatgtttgtctttgtttcaagtaagaaatggtttaatcaaaatctaatcttcaattagtatcttccttttagttggcttatgtcattgtaattgcacttatcttgttgatatcattcattttatatataacttgcgacctaaccaatgctttggagttcgtgggtgattaatatactcatgccaaaaccaataattaatttcttgacacgtaatacccgcagcaactgagctgtcgcatgacaagccaaaaaaccatcaagtttaaagaaacaaaatccaccaagatgagatttttaactcgcaaagatttttgttctttgggatgtaacattaaatagtagacgacagattttatgcgaaatacaaaaactttgagaaaatagttttaaaaaagacatattgtacccctccaggtaaaaaagatctagtccaacacctataaactttgaaaactctactagcattaaactttggacattactatgtctcgcataatcgcctttaggaatgctaaggacaaaaacatgttttacagttattgtctgtgagcagtagtttcatgtggctgccgtttattacgaaaccgtcggtgctgaattagagacacggacggtgaaaaatcataaacggtaaatgcttttacaaccatttatctatatgctttgaagcccaatcttagcccaagccatgatactagaagccgaatcaaaagctaatatagggcttgattggttctccctctgccacccgcaaacgcagcgtttgcgggtggtagcggttattagcggttggcaccaatcatagaaaccgctagataccgctttggaccgcttgaaatcaccagatttcaaaagctccttcccgcaagcgtttgcggttgcgggcggtagcggttaggttaaaaaaaaattaattaattaattaaaataattatgtcttccacccaaaccttatacttattcttatcagaaaaccctaatcaatgaaaccctattctctcaattatg

SEQ ID NO: 27762 - DNA, 3003 bp, Unknown
  misc_feature (1)..( 3003): 2750-1469P.txt file - cDNA_ID_2992012; gDNA_ID_2926225; Annot_ID_142518
ggaagtccagagcaatcgtatgcaatcttgagccaccttcatcttttggttgttcgtgcgccattcatctttgctgcagactataagcatttctactgccagtacaatgaaccatcatatgtcaaaaagttgaagcttgagatgttgactgctgttgcaaacgagagcaacacttacgaaatcggtaatgatttcaaactatgtcaatatggaatctgaagctagaaaacctttcttttccggctctttgattggactaattcgtacttttttcttttcagtgacggaactgtgtgagtatgctgcaaacgttgatattgcaattgcgagagagtcaattcgagcagttggaaagattgctttgcaacagtatgatgtaaatgcgattgttgatagacttcttcaatttctggagatggaaaaggactatgtgaccgctgaaactttggtaaactatcatttgaactattcacggagatgattggccatcacattgatacttatattgtttacattttcataacaattccacttgtctggttcctcttctaggttcttgtaaaggaccttctaaggaagtatccacaatggagccatgactgcatttctgttgttgggggtatcagcagcaaaaatatccaggaaccgaaagccaaggcggctcttatatggatgttgggtgagtatgcacaggacatgagtgatgctccttatgttttggagaatctgatagaaaactgggaggaagagcattcagccgaggtatttaggcatcacttttctgtttttccttgctactgaaattatggttccatttatgcgtgagaatgaggacttgctcattagtatatgttcccaatttgtgccattgagcaggttcggttacatctcttaactgcggcaatgaaatgctttttcaagagggcacctgagactcagaaagccctaggaacagctctagctgcaggcattgctgattttcaccaggtttcttcctatctccccttccaaatttctctttctttttttcaaacccattggcctattagatcactaattcaacatttactgttggcataggatgttcatgaccgagccttgttctactatcgggttctgcaatacgatgtacacgtggcagaacgtgttgttagtcctccaaaacaggcggtttcagtctttgctgacactcaaagcagtgaaatcaaagaccgtgtatttgacgagtttaacagcctttctgtgatataccagaaggtatgtttcctgactttactactgaagccaatgtagtagtatgcattcattagcctacattactcagaggtgttccttatatgttttcataataaaatgactttttgcagccatcttacatgtttacggataaggaacaccgaggaccctttgagttttctgacgaagttggaaatatttccatcacacctgaagcctccagcgacattgttccagctcagcaatatgaggcaaatgacaaggacctgcttctaggtattgacgagaaggatgaaaataaaggagtttccaataacaatggttctgcttacacggccccttcattagaaagctcctctaatataacctcacaaatgcaagagcttgcaatctccggccctgccacatccgcaactaccccacaatcatttggttttgatgatctctttggtttgggtttatcaaccgctcctgctccaacaccatcaccgcctcttttgaaacttaacgcaagagctgctttagatccaggcgccttccaacaaaaatggcgccaattgccaatatcactaacacaggtttttttcccacaacttttagtaaaagtcttttacttgcgatgctactttttcagcttccaagtacattatagccttatgaaagacgacagtttaactggcttttcttcctcttttgtcaagatgcttaacttagcacgaggatttttaacattagttcatgatcgtaatccttgaatttcttacactgttaggtgcatttggagttgtaatttgtatcatgtttctaaattcataaattctcggggattttgactcctgagagtttgtaactttcttaacttcgtgtgcaggagtgttctgtgaatccccagggaatcgcggccttaacagttccacaatcacttatcaaacacatgcagagtcattccattcactgtatcgcatcgggcggtcaatctccaaacttcaagttcttctttttcgctcaaaaggaatcagaaccatcgaactatctcactgagtgtatcataaacacttcatcagccaaagctcagataaaagtgaaagcagacgagcagagtacgtgtcaagcattcacaaccgtatttgaaacagccttgtccaaatttggtatgccttgaaaagcattcaatcaatagaattctctggatggatctctacacttgttgtaaaatgcgatgatactttttcgagttttgtagtttctctcacctttgatttcgtttcgttgtgttactaagatagtttgtttgaggtgttatgaagatgtactttttatccttagattaggaaatttcaaatgaaactatatcaacaaaacctcaatacacgttacgttgcaccatgtgatctctctgaaatgtaatctcggatcatcataagggtcgacttctggatattgcaagatcaatatatgaagttgtgcaatttttcaaggtcaccactcggtcactaaatgaaataaaagttttaggcctcaaaagtaagatatgtataaataaggggtaggtttggaaaaatattatttataaggcgaccgaagaaaaaaaagtcaacagctttgctttttttgttttgttatgtttttaattgtcgtgagtggttacgatttcttcaatttcgtaaacttctaggggagaaacaagggagatagagaagtgagagagggggaaaccctagattcgatctccattcgatttgattcgtttctcgaatcgaagcgatg

SEQ ID NO: 27763 - DNA, 3003 bp, Unknown; identical to SEQ ID NO: 27762
  misc_feature (1)..( 3003): 2750-1469P.txt file - cDNA_ID_2992012; gDNA_ID_2926225; Annot_ID_203467

SEQ ID NO: 27764 - DNA, 3000 bp, Unknown
  misc_feature (1)..( 3000): 2750-1469P.txt file - cDNA_ID_2992026; gDNA_ID_2926221; Annot_ID_203309
ttgtcatgcagactgcgagttggagtaacaaagaagttcaatggaaaataactgaagctgagctacgattagaagttactaagctgaagaaggtacactctaagagtttgttgtaacgtggtcactcttgtcactttgttttgtgcttggacagattaagattactagtaactagtcgagtctggaatattaagttggttcgttactcttaaaagggagctcagtttgactaagagttcccattataatttccctcccaacctaagattatatttatttttgtttttttttctcataaaattgtcgcacatgtttctctagttagcgtcatggctagaatttttgtttttgcagaaaatagctaatatggaaagtacgactaagggttcgcaaagccagtctaatgtggcttctcaggagaaatatatacctggtaatcacacaataacatgccccttttttttgttttcttcctcttgaaattctctgcgtctaaatagttgtaagtgcacgcctgcagctcataatatctaccaagagcatcatggacagtcaccttcttgcagcttcagacatcaggtgtggcttagtgctccttcagacacattgttttggtttagttgaagtattgtttgttttgcaattgtgttgatgtgtattatgcaaattataaagttcgttaccatccatttttcgtagggagatctgctaataaacggtggccgtatatttgacatagatggtggtagacaaatattattatatgcccgtaggctctcaggcgttggtggaacgtttgtgcttacgcaagtaagcttttttgttttgcctctcatttttcttttttatcttataccagtaaaatgatgcactatacgacctttttttttaatatattgcagatgagcctacattcgccttgtgagattgatgatattttgttgcctcgtaccactagagcaattaaagatcttcacctttcccctcacaataatgggcttgcagtatttgggtctctaggaaaaaaattatctgttataagcttggagagccacaatactgtcttatcttatgatctaccggctgcaccttggtcttgctcgtgggatctcaaaagctctcaccatatttatgctggactacaaaatggaatggttttgatatttgacatgcgtcaaaccacgggacctttcgcatcgatgacaggcttaacaaccaatccagttcatactgtccatcatctctctggcaattccactccaacttctgatgtccgtaccctcttatctgcttcttccatcgggctgtgtcagtggaacattagtggtagcgagggaaggtagaggtcacacatcacagaagttgaagaattttatcattgcatttttgaggctctaacatgttataatttcggtttttttttcctttgtctagcccatcattagtttcggaaacgggaaacccaggtgtatgcatatcctcctcgtactgtccccgcagcaatcatatagtagcttcttatagaccaagagttggatcatctgatgatacagtcccgactcagccctcattgactcaaacaggagtcagtaatagtaatagtaatggtgtagatggatttcatgtttgtcacaagagaagaggtgttgattcgtattaccagaaactatcctccacacaagctattgtagatcccatccgtttgccaagaacagcgattatagactttggtggggaaaggaaacaactttttgcatcttgtgacgagtccactcgggagctcatcttgcaagatccttcgacttttactatttctcaacggttgccattgtcaagtcatcttccgcttcaagatgtgaaatactgtcacgtcaatggttcggatctgctcggtctcttaacggatgatagattgcagattcttaggaacgaatctccatgaagattaaaaaagattgatagtcttgcaaggatggtgtttgttgaagagaaaacatgtatgtaaagcggctaactagtctatctatcttttgtaatctggagatgctatagagtagcgagccattacttaaatattattatcttagttatgaacctattgctgcaatgcagcctgctccttttttgtatatacgtattacttaaatcagtttttttttctttatcactggtggattaagtaaatctgtaaatgagaatgaaaaagcatggaaaaagagacgtatttatatgacgcacaaaaaaattgacagaattttccaaatagatgaaaaaaatccgacctgccggaatcgaaccagcgacctaaagattacagctactactacagtcttccgctctaccaactgagctaaggtcggttttgttaagctactgataatagtttattatatacgttaataacttgttggagaatctaatcaagtcctgattataagaaggataaagaaaagggaattagaaaagaagacattgattccgattggattctgcttttttcttttcacgtttccgattgtttctggaactttttgtgagcctaaggtttatctctctcttctagtcgtcgattctggtcatcgaagattccaatcagctaaggttacattcatctctctctctctctcgttgtcttggttttgattttggcagattgtgcttggaatcaacagtttcggttattcgatatatgagtactgttaattctagggttctatcactttcctcttcggatcttttgcctatgggttccagaataaaagttttagggttcttcttccctttattgcgaattaagtcatatgcattgcctctgattgtgcgaatcatgttgtagttccaatctttctcttaatacgatgagaataattgtagttagttgctaatgaaccttggtttaacaatctgtaggtaaagtgctatatctcgtttcccctgtctcggttcaagctttcaagagaattgtgattgattctataagggctctttgtcagtacaatg

SEQ ID NO: 27765 - DNA, 1670 bp, Unknown; identical to SEQ ID NO: 273
  misc_feature (1)..( 1670): 2750-1469P.txt file - cDNA_ID_2992029; gDNA_ID_99849; Annot_ID_147373

SEQ ID NO: 27766 - DNA, 3003 bp, Unknown
  misc_feature (1)..( 3003): 2750-1469P.txt file - cDNA_ID_2992037; gDNA_ID_2214579; Annot_ID_186438
attgatttattatttgagttaatctaataaagttgtcggaaaaaacggaaaagtgagaagagaaaaagtcgaaaattcagaaacggtttaaagttaaccaggattccggtttttataacagaaccgatcggttttgtaattgagacgaaaacttctgatatcacttaaaaacttcacagaaacaacacctcgatctcatcgaagctcctctctcttacatatcatcacttcacatcaaccaaacctacttctgtctctctctctcgctctctatctctcacgctctcacaggtttttttctctctctgtctctctcttgttctccatttgcgtctctgtttgtttgatgagtttctgaatgttaaatgcagatgtgttttggttttctgtggaagtttttatatctctgttgattgagtttttctctgatgttgttgggctccaaaaaattcgaaacttgtattatctctcgtttaggtttcgtgttctctgcattgatctgcttctttaatttgttaactatactcacgtatgtgaaaaatctgaactttgtttgttaactctaatccaaatcattagaaaaatgcagattgagatttctctaatgcagtgcttgaaattttggaaactagggttcttgttataatgtttcaagtagtgaacttatgtcaacttgtgctttaggtttgatctgattcttaaattttgtttcatatgtggtctttcttacaatgtttctggatttgttgttttagtagaagaaaaaattagaaaggttgtgagaatggcggctacagcagcttcaagcttacaaattgctacacgaaggccgagcatgtcttcgcctagcaaaattcttaaagcaggaacctacattgttggtgccaatcctggaaacgcttcatgggataaactttcatgcactcgccaattatcaaaccttggatgtttgagaaaccacagtgctgttccaacttgtaagagacccttttctttttccacaagggcaatgtctgaatccagtgaaaacaaggctccttcagggcttccaattgatttgagaggttggttggcatatctttctttgaattcagagaagacttggtgctatctgaactaagcaagtgtaaatggtacagggaaaagagctttcattgctggtatagctgatgataatggctatggttgggccatagcaaaatctcttgctgctgctggagctgaaatattggttgggacttgggttcctgtaagtcatttttggttcagctgcttttagtttccttcattgctaaattatactaacctatgaatggatggtctactaggcacttaatatatttgagacaagcttgagacgtggaaaattcgaccagtcacgagtgtaaggacttacaacatgatcttgtctggttttatgtaatgggacattaatttttccatccatgtatattcaggttgcctgacgggtcattgatggagattaagaaggtttatgctttggatgctgtgtttgacaatcctgaagatgtgcctgaagatgtgaaaacgaataagcgatatgcaggatcgtcaaactggaccgtacaggtatagattagagatacacaaacacgcctgcaagttaacatgtgttactccttaatgctttttgttgcttaaatcaggaagctgctgaatgtgtgaaaaaagattttggaagcattgacattcttgtccattcccttgcaaatggcccagaggtagagaactcgtatcgattattggttacagtaagtgcattgtgttgtatacaaactatttcctaatggtgttcacatgtgggtttaggttagcaaacctcttctggagacatcaaggaaaggctatctcgctgctatctctgcttcgagttactcctttgtttccttgctgaggcattttctgccaattatgaacccaggcatgtaacaaatttcgtatgtctctttattccttgtaaatatgttttcttatttggttctctatgatgatttaggaggtgcttcaatatctcttacttacattgcctctgaaagaatcattcctgggtaaggatggcttcttcacaagttattcaaaggaacaaactaatgcacacacataacgatgtcaacacattctcacaagtatctctttcattctgtgcaggtatggtggaggtatgagttctgccaaagctgcactagagagtgacacacgggtgagtttacaattctgtttcgtaaactcaaagatgtatcggttagaagtctcttagtccaaactgtgttttcaacataggtgcttgcatatgaagctggaaggaaatcaaacattagggtcaacaccatctctgcgggtaatccatctttccctcttacacgcctcgtggtacaaataacacgcctcgtcttttgaaattataaaagagtactactgtttgggtttcaggtcctttgggaagccgagcagcaaaagccattgggttcatagacaccatgattgagtattcctacaataatgggcctattcagaaaacactgaccgcaggttcatttccttcaaaccatcacctctcttgtgcttgttttttcttggaatcttacgctttataaatggcgatgatgtagatgaagttgggaatgcagcagccttcttggcatctccattggcctctgccataaccggtgcaaccatatatgtggacaatggtttgaatgcaatgggcgttgcactggacagcccggtgttcaaagaccttaacagcaagaattagagtcttgatcgacgactggactcgagaaattccgtgttttcgtgagcttgcttgtttctttatgagttagtatgtacggcatatgttccccatcggctgtctttttttttctttctttaagagaataaattatggttctaggttgggtcatttagcaactatatatgtagtgatggattattattcctcttatgattgaaaatttgcaagtgagaaaaactatcatg

SEQ ID NO: 27767 - DNA, 3003 bp, Unknown; identical to SEQ ID NO: 25274
  misc_feature (1)..( 3003): 2750-1469P.txt file - cDNA_ID_2992057; gDNA_ID_2213619; Annot_ID_180904

SEQ ID NO: 27768 - DNA, 3000 bp, Unknown; identical to SEQ ID NO: 2520
  misc_feature (1)..( 3000): 2750-1469P.txt file - cDNA_ID_2992061; gDNA_ID_1620550; Annot_ID_160284

SEQ ID NO: 27769 - DNA, 3000 bp, Unknown; identical to SEQ ID NO: 13588
  misc_feature (1)..( 3000): 2750-1469P.txt file - cDNA_ID_2992072; gDNA_ID_2214638; Annot_ID_188205

SEQ ID NO: 27770 - DNA, 3003 bp, Unknown
  misc_feature (1)..( 3003): 2750-1469P.txt file - cDNA_ID_2992079; gDNA_ID_2936582; Annot_ID_194949
gatggtagatacgatttgaacttcaagaaacagccaaacgatggagctcacgtactgtcagccgagagtcttgctgacctctacagagaattcatcaaggatttcccaattgtctctatcgaagatccttttgaccaggatgattggagctcatgggcttcattgcaatcctctgtggatatccaactcgtgggagatgacttgttagtcactaacccgaagaggatagctgaagctattaagaaacagtcttgcaatgctctactcttgaaggtaaaaataaaagtttttatattattttctcttttctaatctcaattctctagaccattttgacaaaacccccgttattggagaagaatttcaatttgtttgtaattcatggtttcacaggttaaccagattgggacagtcactgagtcaattcaagcagcacttgactcaaaagctgcaggctggggtgtgatggttagtcacaggagtggcgagacagaggataacttcatcgcagatctctctgttggtttagcaagcggacaggtacatcaaatcctctaaacctgtctgtattactctctagtgtttgcttatcattctctgttttgtagatcaaaactggtgctccatgccgaagtgaacgattgtcaaaatacaaccaggtagttaactaatatccaacttatgcttaatactatactctatataccacatatctgaacccttgagtttgatttatttccattgcagcttctccgtatcgaagaggaactcggcaatgtgcgctacgccggtgaagctttccgatcaccatgagaaattcgagaaaggcactcattggcggcttttgcttacagaattaggtgaaaccaaatgaggtcctcctagtatcagctccgttgtagctgtctctgaaaagtatcagattttctacaaaaacaaataaaagaacagctttttcactgagtcttctgttgtaatgtcattgataccgatataaacatggatcgaccaaagcgtttttcagattaatcagatgctcagagatatgtcgatttgattgttccaatgattaagaagagtgtttcattcgtgttacttaatattagaaaacttgttcacgcttgagccaatggtattggcatagttgtcggtcaacgaacaaattagttggcgttattccttcagctaaacggaacaaaaaacaaatatacaattaacaaaatactagatacaaaaagaaaaacaaattaacaatttatgtatattatttctttatagataaaatatttacatctttttaaataatttaatcaatttcgaataatcccaaacaaaactgaaaattaaatcgtaatggagaaaaacctctgattctaacgattaagacttcggatctgaaggaaattatgtggagctgtgagcaagttctattatccttacgccaatttggctttgaagttaaccattttaaattttaatgataaagttgagtataacacgtaatggccttaatggggaaaacatttgagtcacgtagtagttattttccgtgtttaaatttgatttcgccattaagcataaaatcaagccatcatcatggacatgaaccaccaagaaacaacaacgttaattgatgataacatattccccttttctttgtagtaccttttattttcttaacaaatcaaaataatcatacggtttgcaacaaaaaaaagttgaaaaaaacttcttaatttgaagttctcacaatgtataagcacaaaacactaacatttaacttggaagctcagtatttaaaatgcaaaatataaaggccacaactacgataaacaattaagataaagtactggttaacataaaaatagcgaaaccaaatcgtttcaggttatgccagccccgccaaaaaaaggtggctacggatctttggtgaccaatttattagctatccatcaagtctgatagtgatagcaaccaatatgtacgtccatctttatatttattgaaaaataatgatatattgggaggtcaaaaatcggataagcttatgattctttttgtgcatttgcattttatttacccaacatatggaccataatattatatcttctgtttattatggtctatatgctagaatgtaataatacatcggaattttgaaagactagaaacattgctttgaaatcctgtgtattttgcacccaaaaaaaaataaaaaaaattgtgtgtttatatacgcaatttattcttaaccacatagtagttgtaaattgtaaacgcaaacagtaaacataaaacattccatattattgacgttttacgtttgtgtttacaatttgcaattgatgtttgatgataaacgcatcgatcgtcaatatttgatcaacaagactaagatcattgaatgcgactatgcgaccggttgatttattaacagtatccatttggtcctttcaatatcacaaaaatcttaaatttccttttttttttaatatccaagcaaatattctagggtatttctcaaaagtatatgtattttatttatttgtaatcaactgctccttggaattacacttgtatatattttctgatatctaaatacctacttctactttatcaaaaaaaagtttacctacttctaatcaatcttagacacaagtacataaatttttagaccatgcgtttgcgatcttgcgttgacagtcgtacgtctaccccaaaaatcagcaatgtacgtggattgcaactatttgactttttgttccatgtgcaacttaatctgtcaagaaaccccgagaaacaactctaatctcttcactaataaaataatccgacgagcataacgtgtgccatcaacttaatttacaaaataagaaaccttcttaaaaattaatcaaaaaagaaaaagaaaagttaaataatcaaacctataaatattcgtaacgactacaaagtacaagaaagtctcatttgagaataattgagcgataaagaaacggtatg

SEQ ID NO: 27771 - DNA, 3003 bp, Unknown; identical to SEQ ID NO: 27770
  misc_feature (1)..( 3003): 2750-1469P.txt file - cDNA_ID_2992079; gDNA_ID_2936582; Annot_ID_143774

SEQ ID NO: 27772 - DNA, 3003 bp, Unknown
  misc_feature (1)..( 3003): 2750-1469P.txt file - cDNA_ID_2992082; gDNA_ID_2096294; Annot_ID_195499
aaaccaaacaaccaaaaaagaaagaaaacttcaccataacatatgttgcttgttccatatcatttatagttagattgtagcagcaacacaggattcagctctagccttgtcagaatcttccaagactttcttagaggctttaataacaatatgattagtgatgtaatgcttgcgacaaacaggcatatagacatcagctccaccaataagctcagttctggtgtcacaattctttcttaaagtgaagaaagctttatgtccacagacctcacaccttgcagttagcttagtcacagaatcagctattggtataatgtcaagtacagccccaaaactcctcctgcacatagagagatcaattccacattttacagtcaacaaaattgttaaacattgaagtaaaatatcaaaatcacagctttggtactaggatgaagcaccttaaatagtcaccatctaggccagcaacgatcacaattttaccatcatcatcagcgactttgcagcaaaactcataaagatctccaaagaactgagcctcatcaataccaatcacatcaagctgccaatcattttaagagaaaaacacaaattcaatacagatccttcacaattaagacccgaaacaccaaatagagcatcgaatttattaccttgttataagcatctagtccgaatttctcaggaaatgacatgagatctggaagagcccagcaagggaatccaattccatcatgtgtcaccaccgaatcttttgcgtatctcgtatccttactcgatttcagcatcgcaacacttctgcttaaccaaaacacgaaattaagaaatttacggagatagatctaacaattaaaatctacggagatagaaaataaactgtaccttccgtcgctgatctctgacttgattcggcgaaggagagaggtcgatttcccagaaaacataggacccatgataacatgaacagcacctgacccacgacgttccagatcggagagaaaatctccggtgacgtcactgtcgagggttttgatcaaaaaggaagctttgagagtcgccatggcagagacttgagaagaaaagatggtttgtagatgaaaaaagggagaagggttcaatttgcttgtggttttaggtagcgatggtgaatagcttgttgaagatatatatacgcggacatccagaagttgaacaaggaagaaaattgctggagaagatttgtcaaagataagggtttgaaattttgaatgggaggttttttcaaaaaaattacatctttggagggaaacagttttttagagcgaatctttttattttacctctctcttttcataaagcggaacactataaacggaatttaaaaaaaaaaaaactgattttctattggcttattttttttaattaatttccttaatgtatagatcatatgaaatttttaaacatgtgtgtttaggctttgcaaacacattatttaagagaatgataaatatttttaaaaaatatatccacataaaatggtactggtttttggtcatatattccactaatgttttttagaattattgtttaaattagaaagtcgtaaattcgtaatattcgagaaaacaactttctcacttgggtttttatcctacaaacccatcattttgtgtgtgtgcttttgaatgtgggcttaaacccaaaaccctgaggctttttttggccctgagatgaacatgttcacaaccttcttcaagtgttccaatacatacacgttcattgctttttcgtagttgcaatttttatttaatttttcgtatgtagttgcacaccttcatgtctaaagctacaaattgttgaaatgttttttccgatcacctcaattaatgtacaatcgtagctcgttgtattcctaaaaccgaactagaatacattttcatcgccaggttattacaagttaaatcaatttgatcaaaattcaaacatagataaaatgtacaccagtaggttaaaactaaaccaaacgtacacaacaagcctaaattatccaaacaacaacaactctcagttttgctttaaaaattctgtgaataagacatccttaattgcaaatttatttttaattacttctttttaaaaaacttttagtggcaccatcctaattagtaattactttctatataattcttctttaagatacaaactaaaaattccgcaaaaagaaacatctaaacattccaatatattaatatttttttgttatgacaaaagtaaaatttccgtgtaataaatggaagggaaaacgtataaaaagtttagtattgaaaaagagaaaaaaaagaaacaaaccaattatgtaataatgagtataaatatataaatacagacatatcttcttcttcttgcacacccaaaaagcctttgtctttctatctctctaccaaaacttctttctttctctctttttctatatctctagagcgcgttactgcgcgtcgtgagtatgtttttattgacgccattgaaattgggttaaatcggtttgaatcggattgaacaaaaactgtattaataataattcttcctctacttttctctctgattgattccaatcttctttcattttcttcttcttcttcttctggggaaggggcaggttaaaattatgccatctattcaaatcgtgcctatcctcagatcttaactcttttctctacgagattcggcatctgggttttattcttcttggtgggtttttttttattcttcttcttctgatctcagatttcccctgattggtttttttttttgctaaatccgttttatgttttcccgatcaaactctcctggcagattctcggatctgttgttttctagattcaatctgaatttgattttacgtttttgtctttgtaaagatgtttccttttgatcagattttgataatccattgacatctctgattcaagcaaaagctaattaactttgatccgattcctttgtgtgtgtgtgcagagcaaaatg

SEQ ID NO: 27773 - DNA, 3003 bp, Unknown; identical to SEQ ID NO: 27772
  misc_feature (1)..( 3003): 2750-1469P.txt file - cDNA_ID_2992082; gDNA_ID_2684204; Annot_ID_137280

SEQ ID NO: 27774 - DNA, 3003 bp, Unknown
  misc_feature (1)..( 3003): 2750-1469P.txt file - cDNA_ID_2992092; gDNA_ID_2926258; Annot_ID_143153
ggatcgtctagctctgattggtcaggctcagcccaatcatatgacttaacgtgcattgaaccataaacaagcttgcttagcactgtcatgcctggatgattatgaagtggtatgatagacccaggtggcatgcagaaaattccaatctgacaaaataatgatcaaagcataataagcagacaagtaaagcaagaatattgcatttcagaactttgtttaactgcagtaaacatgtggagcgtgttgctccatggcttaggcaagggccataccaggaaccaaaatgattagtgatgatgagaaatttggtttcaacatgagaaatctagcttaggtacttctacttaacctaaactttaatgcctacccacttactctcaagatttcatagccaatttctgactatatcgatgaaggcagactcaaactttaaaaggtgaaaactacatgcgataccatcctgcaagaatgtttgctcaccgagaagctgtcacactcatgtaactgaaggtattttattgctggcagagaatgatggtttccattacgctcgttcccaggaccaggccaattacgcaccaattgagcttcctgttcgagaccaacatcagacggcttgattttctctgaaataaaaattacaagtatcacgtatgtctgcaagtaatagacacgataaacaacagttgtctaatgccacaagaaggtgcgataaccaatatagaactgcaattcagacataacgagcaacacagtgtgcctaaagaacataatggagcaagcaagattgcagaaatagaagggaagaaaatttgcaagacagtgtatcaataatgtcgtcgtacccaagacattgcgaaccttgtctaaggcctcctcagacacaggaccattaggtgagagagatgacttgcaagtattgaaaagcctctgaataaaatatggcatgatacaaaaagaagacacagctccaagttcttgagcttctaactttggtaaccctctttcagcaaaacggctttgagttatcaaaacagcaccagcgatcaccttcttcaatgattctcaagcactgccctgaaaggagagaaaagaaaacaactttaacttcatatagagctccataatctaaacaaacacatctgaaaacaaatattacaaatccaggagctctgagtctctcacaaagtagtgtttttgacgaactctaacaagtgaatgattaatcttttttcttacatatcgaattcaaaatcactgcagctacctaaatgggctcactcaatgaagcaaaagtattgccaggaatagaatttaggtcagttattttgcaaaactgaatcatatatcgaattgaattgaattgaattgagctgtgcccagcaaattctctcaattcattgaagaatattacaagcagaaaaaaaaaaaaaaaaaaacgatttgaaaacatactggaacaagagaaatgatgatttggagttgttgcagcaagtagaagaagaagagcagctaaactagaagcaggagtgctacagagaagagaagagaagagaagggaagtttcaatttcaatagattaaaaaagagaagagtgagagacctttcgagcagaagagtgaaaatccgaagaacggcgacgaggagatgtatcggaggaaaccgatgatggaaatggttttttagtcggaaggaggaatcagaatttgatctcttctttttgtttcttttgctttgtgagtcgtttaaaaacgtcaagtctcactctctctccccttacttttcaaattagtcaatttcaaccccctttgctttttaagctcgaataaataattccacctatttttttaggacgagaacaaactgcaacttttttggtagtaccaacttactagtacaatttcgtatacattcattctcagattctcttgctaagttataagaatggtaaattatttaatgtgatttttgctatttgtgaaaatagaagataacgagcttattttaaaaaacaaaaaaaaaactataaacttcaaagattttgctatggttattagattatgacattaaaatattaattttaatagattttcattctaaaatgcatctagatttcaatattgatttccaagtagcaagaaaattatttaaaatcatagttaaattaaattaatcttaatttgatttaaaattaaaaaaactcaaaattaagttgtcaaactacaactgactgccacaaggttataattttaatttaagcgattgcaaatatagttcaagaaaccatgcattaaaaaaaaaaaaagtggacaaattttaggtgactttgggtatttatggtcatcaatgtactctattagtggacttgaaaactttgaaaagcccaacatttgttctggctctttaatctgagacctaaacattgctgatttggtccatctaaaaaacatagtcaaagtccgtttgtccggaagttttttctaccaattccaaaaggcctttctcggcctatatgacctttgtgttggtccctgacttctcctatgactaattgctgtgccctgtgtgccatttttttttaatcagagttttctcattttatatatcaacaagttatacaatttcggattaaattccgacatcgtcaaaaaggaagaaaaaatccgaccaactctaatattattggttatagtttttgcgtgttaacattttttagttaatatagagatcaaatttgggccaaaattatctacgagaaagtctgtctcaactatccaaagttaaagatattttcgctgagaagttaaaaataatatttcgatgggcccttcaatcttagctaatttactaaagtaacccttgtcgaaaaatcaaaaatataaaatcgcaaaacgaacacggcttagtttatcttcttgtctctctctcatttcttgttattatccacgaacgaagaaaaacctagaaaacagttgaagaaagaaaatcacaagagaagccatg

SEQ ID NO: 27775 - DNA, 3003 bp, Unknown; identical to SEQ ID NO: 27774
  misc_feature (1)..( 3003): 2750-1469P.txt file - cDNA_ID_2992092; gDNA_ID_2926258; Annot_ID_204620

SEQ ID NO: 27776 - DNA, 3000 bp, Unknown; identical to SEQ ID NO: 13123
  misc_feature (1)..( 3000): 2750-1469P.txt file - cDNA_ID_2992094; gDNA_ID_2214599; Annot_ID_135524

SEQ ID NO: 27777 - DNA, 3003 bp, Unknown
  misc_feature (1)..( 3003): 2750-1469P.txt file - cDNA_ID_2992105; gDNA_ID_1620401; Annot_ID_155957
gataattatggtcaaaggagttataaggagagcttacaaggatgttggcatgagcatagatgatactgccattatctgtatagatgactacatcagctttgtatccgtcattgaaaagacgatcccacatatctcttgtggctgtcgaaacgctgctatgcccaagttttttcttgagtccatcagattttgatggaagaggaggaggaattggcacagaagatgaatctgcagatttgaaagattgatgaagatcaacacaacctgtcaccattctcttgtttagcttatcttctcttccctgcatcaatcaaatgaaaatatatattgtcgattctttagccacagataaacttcattgtcatttctacacgaaatatgtgactcagacaacaattttcacagcattatgtaaccagatctcatttacgattacaaatcgaataggataagaacaaatctctacatatatattcacacgaaaatatcaatcagaaataacaagaattcttgaaacagatcgatagaaaatgtaagaacaagaatcaatcaatgctctaatttgttccgacatatataccttgaaaagattcagaccacagaatcaggttgcttcgaagaggcaagtcaaacaaaattaacgagaaaatcttctccttggtagaaagagcatgagaagaaactctctctatagagaagcttgagagatcagagatctcttaccattatataaacacacacactcacaaaaacaatagaagacgacaaaaaaaatcccaccgaaaggataatttattgttttaatttccttattatctcacttttttcttacttttgtgttcaataatttgaagatattttcttggttcatatcatcaacagagacacccacctgcgaaaattacccgagaggcgcgtggagtctacggttacgaaacggacggctgagaatccacgcgccttaacggccttttttcctcgttcttgaaaaagctttcgtcaagttggttttattatcggctttatcaattgaaacacgactctgcatgttttttttttataaatgatttaatttaagagccgtacaaaaacagatcagtgtgtcctttgttttttttgttcttgttcggcgttacacagctcataattagctgttcgttttttcaaacttttatccgtattattatcctttcttcttcaaagataaatttagattagtcttaattttaaccacatgatcagatactctcttcaaaaatgttaactaatcgtgaattatgttgaggtccgcaaaattgcgtcataaatattttactggtctctcttcatatttcttagcttcgcttgaattgattgttacccttttttccctttttttctgtgtttactataatgccacgtttcttctatcgaataatctaaaacagaagaagaagaagtcaaaatgctttttatatgatcattttcttgtatttttttttagtttttgatcggagtaaagttataagaacttcaaaaaaaaaaaaaaaaaaaaaatgcatgatgatgccaatctttttctaacttttaaagagtattggaacataatacatatatcatgtaaactgatatttttaattgtaattttatatcatatacggatttaattgtaatttgagcatcacccagttgtgcaattgtagttatcacagaagtgcacattgcaatgttgttgaacaacagaaataccttgacatcatctcactgacccatgcagccatgcctaaacttggaccagaactcatgtaaccaccgggtaatgtcaaacctgaactctgaactctcaggttagttaaactcatctcttgttgtttccttaattctaaatcatcactaaacctgtattaaagtgtcccaaattttttagatagagatgtatagatgcacatttaacccacctgaggaagaacttattaactattactggaataacaagatcaccagagaatgatgatccaaataaaggcaacgaatttgaagttctactacattttcttccattttctccattattttgcaaatacataaacacataaaacgaatttatttccatttttcccagaaatatataagaacaagctaaaacacagggatacatgaatcctctcagaaatcagagcatcgaccacgttgttcccaatcgccgtaccgagtcggttcaggacctctaggccctccaatctcaccagtatcttcgttcacaaactctccacctccaccaccttctccttcctcttcttcttccttctgcatctgcagattctgttgaagattctgatctggcttcacgtcccggttcagatcctgattcggagatggagcttgcggcggaggaggtgtaccggagcttagaaaccgtgacactggctcgaggaatctagaggagacggatcggcttggagcgatcaaacgtacgatgttgttcgtcgccattgttagatcagatgtgtcggccaaatcaagaaagagatccgaccttcacggtttgtgatagtatagggttcgatagtcatttaggttgggccataattggataataagcccagtagtatctaggcccaatcatttacatgtttataaataaattaagagaattagagagtaaatttggcccagtataattatgtttaacaagcccatcaggagctaggcctaacatgtttataaaacaaataggagagaattagagggtaaagttgacgtgggctgatttcgaacccgtaacctttttatatattagacctcattaccaaaaagcgattcgattatctcataaagcgtcatgtgtttttttgtgccacatcaacggctgtgagtggttagtcactaaagaaaagtcacaggctgttatatagtattggcttcgctatttattttcgtctaccacgagaaaaacaagtcgtaattcttctatcttgatatcttcaccgcctgccgatctctctcaatctccgatcaaccatg

SEQ ID NO: 27778 - DNA, 3003 bp, Unknown
  misc_feature (1)..( 3003): 2750-1469P.txt file - cDNA_ID_2992115; gDNA_ID_1620498; Annot_ID_158768
ttttatccacaactaagtacaagatacaaatttaacgatggtttctgagtgaaagctgacctataacatggagtttggttgtccaagagcatgattctttaaacaggcgaagacggtaaatcggagcaccatatgtaatctacagagaaccatctaaatatcactttgcattcaacaaacatagacacataagaataaaaagtgatacgaaaatattaccaggatatagactcctttatccttgaggaccctataggtttcatcaactgctttcattataggtgaaagaatcaagaaagaaatagaaaaagaagaagctagaacagataaacagaaaccattcaacatttcatgccaagtacctccaaacctcttcaagcatttgtgttgagtattgcctcgaattactcccacactaatacatgtaaaaagtataagacttagtgagaaatcgagcatctagagataacataagtaaagagaaagtagacctcactcaccaaaatggagtctaaggttcctgaaaacacacacacaaaaatccaaaatgttatacaaatgaaacataatgcattttaggctagtaatgatattcaaacaagtagtaagaacacctttatcgataacagcatcaaaagaagcatcttcaaatgctttcatatcacgcacatccatcttcaaatctgttttatttttcacgttatccaaaaatacacaagttcatgctaaatctagtaatatacccgattaaggcagacacagatatgtctcttcccaaattgcaacattaagtagaagaatcaacaaatgtaaaaaaaaaaccaaaaaaacaacgttacatttgagctgaggacgatcagagtatttcttaatcatggtatcaatcaccactgatgatatatcaatactgactacatcttcgtatccatcatccaccattccttcgctaaacgctacattaaaagttcgaaacaactaatgaccaaaacggatccataatacacacaaaactgtgaaatcaaaagagttgttttcttctatatacctgagtttccacagccaatgacgaggactcgttgattacgttgaggaacatagagattgatgagaggagctaaaggtgaatacttctggtaccaatcaaacggttcagattcattcttgtaacgatcgtcccaataccattgctcgctgtaagattgcgttggtgcctctgtagccatctccgtcgttaacttttccgatttcgcttcactctctgatcaaaaggaagaaggagacagaagaaagatacacgagcgaccacggtggtccaaatcttccacgtggcatatttatttaataaccgaccggttcaccggtttgattaaacatttaagattaaacccgttaaaaatcgaaataaccggaatacaaaccacttttcagcagtcacccctaaaagcaaacacaccaaaatcaatcagagggttacattgtttgataccatgctactcttctgcagtagcattgccactgcctttcttagttccttcctactgcataactgtggcaaaatatcacggaacgttatcgaactagaatacacaccattagaaaccatctcctggaaaatgtctaaggcggtattaaaatcaccaacttgacgaaacccatgaatcaaagtggtgtaagtaattacattagcaactattcctcttcgatacatctcgcagaaaagattcatcccatctttaacccttgttgctttacagtaaccattaatgagtgtattaaacgttgagcagctcttggatacctttctcgcctgagctagtttgttctgcttgcagagtccatggatcattgagttataggttatagtatcggggactagacctctacggatcatctctgcatataatttttcagccctacctaacgagctgaatctgatcatcatattgtaagtttgaacatcaggttgcaatccactgatgaggagattagtgaatatattccctgcttcgtcaaacttaccagccttgcacagtccatggatgatgatgttataaccagctgtatccatatccatgttactctcccgcatgaccttaaacattttcaaagccttttctagtttcccattatcgcaaaaagcagagaaagtattgatcaggaagctgctcggtctgggttatacacaatttcaacaccttgaagatccaattccactgttttgtgtgtgtttttgatgaagacacttcatctagattattagtgagtgactttgaaaatcatttggcttgtttaagactcttggtattgtttctcttcattgatatacaaactagaagatgcacactgaatcttatatatctgaatcaggaattaaatttcaacaagtaaaaattctttttcattatttccaagtgatgcttatcctcgtttatgtgtttttcgttcttttttttgggaatccccttgtttaaggggtgtagtatatatgcttgctaagttgatgtttattcttgctttttgattctgcaacctcacagggcataagtctaaacatggaaaaagctaaaatccttacaagcaaagtataaaggtttgatcctaaaaaacacaagattcattctataaatagaaatttaatatactgatgcttatctgtatattgactagttttctctctcgtttctgcatatcttctcatggccagttccggtgattatgatggtatcatctcactctccctctatattcttcacttaccctatctgattaaatacactgacgtaccagccgtgaatggtatatgtatatgtgcatatggtcctatagatagaccattgaatgatatacatcataggaaaccaagtgtgatagttaagatttcaacctttggatgatgttgttgccctgttttgttacggatagtgtaattagattgatttctccttccacttaaaggtaaaatgtataagtaaatttgcacaaaggtaacttttgtgagaaatg

SEQ ID NO: 27779 - DNA, 3000 bp, Unknown; identical to SEQ ID NO: 11359
  misc_feature (1)..( 3000): 2750-1469P.txt file - cDNA_ID_2992127; gDNA_ID_2214492; Annot_ID_133478

SEQ ID NO: 27780 - DNA, 3000 bp, Unknown; identical to SEQ ID NO: 11359
  misc_feature (1)..( 3000): 2750-1469P.txt file - cDNA_ID_2992127; gDNA_ID_2214492; Annot_ID_183697

SEQ ID NO: 27781 - DNA, 3000 bp, Unknown; identical to SEQ ID NO: 2142
  misc_feature (1)..( 3000): 2750-1469P.txt file - cDNA_ID_2992143; gDNA_ID_1620494; Annot_ID_158682

SEQ ID NO: 27782 - DNA, 3003 bp, Unknown
  misc_feature (1)..( 3003): 2750-1469P.txt file - cDNA_ID_2992152; gDNA_ID_1620388; Annot_ID_155517
atcttatctccaacggaaaaatctcactcggtacaagccatcctaatggaccccaagaccaaccaaacccggccacgtagacacacaccaaaaccacaaccgcgtaaccatacccttccttgatcacaccgtcgtgaacatcagccaccataacgatcacaccaatggtaacttgcgacacgagcatctgtaaccctccaatcaaaaacagagtctttctaccgattctgtcaacgacaagcatcgacaacaacgtcgacgaggttcccacgattccagtcacgagggtcgacatcaacgaaccactctctccaaacccaacggttctatacaaaaccggtgcgtagaaagcaacaacattgattccagtaacttgctgaaagaaaggtatcaccaaagccatcactaactcaggcctatattttctttgaagcagtttcaaaaacgcgtttgaatctgtatcagaaccagaactcgcttcaacgagatcagtaagctcatcttgaacgtcgttagttccacggacacggcgaagcataagctcggtcttgtgaacatctccggtggtctggatgatactattcggcgtttccgggagaaacagtgatcctaaagtgaggattgaagcaggtattgcagctgtggctaaagagattctccaaccatgtttgatattttgggtttcgtagtttattacatttgcagatagaaatccaattccgatacagagctggaaaccattgctgattgctcctctgtattttgccggcgccatctcggagagatacagaggaaccgactaaaatataaaacaacaaaccagtcaacatacagagaaaattgaaacatcattaatcaacttgtcttttgttacctggttagcgaatccaactcctacgccgagcaagagacgcgcaataatgagcatagcaacgttttgagcagagccaccaagagcagcgccggcgagaaaggacacaccgccaagaaatatagagggcttgcgaccccatgaacgagtcacggacgaagctaacagagtagcgatgagaccggaaacgtatagagaagatgtgaaggatgtaagaagttggctattgaaaaggcagtagtggttattgctattgcctcttcttcttctatcttcttcttggagcttatacacttttgggaaaaatctttttagaaatggccccattgacatcactccacctacatatttatatagttacatgtttgcatttatgtttaggtttagagaaccacaacatttcatttaaatattatgaaaaactaaaatgttttctacttcaaaaatatgatttattctttttgcaaacgcaaacacaaacacaaacaaaaaaaagaaagaacatatatatcctaattagcaagaatatatatgtgaacctgaaaccccgatgtcgtagccgaagatgacaccgcccatggcggccatgacacatgaagccaccacaaaataagtaatcttcccgccagatactgatttagccatggcttcttttcttgcttcttctgctaccatgtttacctagagagacactcaaacacaacacacctactattcaagttcggtaggtgtttttagatcctgtatttttgtatatcaatcatccaaaggttgagtttcaaggtagacgacgaaacttgttggaccattggagtgctttaattgacttgagtgtgggacttatagtttttgtttgtttcggttctggctgatgagatatcgaaagtggacaataaaagacatgtgaagaaagacttttcactgcctaccttcattatcttcctcttttttttttttttttttttttttttttttttttttttttttttttgaaaatcgatagaagaaaaagatggctatacttttttcaacgactgaatgataaagctctttcgatgatattggacataccaagttgcaaactttgattgtttaattccataatactgatattttgttttggaatttgactatgtagaaaaaccatcattttctatatataaatactgatatacatgtggaattaagttggcagaataattactatcaatcatgtaaatttatggaatcatttttacattcactttttataattataattttatagtaaattttattttttgcttttaattttatagtaaaataattttactctatggtcaaaaaacttaaaacattaaggggatgataagctgtgaaattagaagcttaggtcacaaatgagatactaaaagaagatgaaggaccatttttgtgaagagaaaaacttattacacgtggcaccaacagaatatttattaccgtcacagtccgtgacggagagaatatctgtgatttgcaaagggaagaagactttcctattcaaaattcaaagccgactttttttttacctaaacagcaataatatctttttttctctgctccagggggaaattaaaaaagtggaaccttttcatctcctggagcgatcaatttctttttcatcatatcgctgactctcgtcttcgtcgtctttgatcgtatcgaggaattgggtttagttcgattcgatcatcagctatctcaatttttctggggattgttctaaaggtttgatgatcggattgcttttgttctatttgttctttttgattctcgtatatgattgattagagaatataggattagggtttgtgttccttaaaagttatctccttttggcagttaaagacttggtttttattctttgtcaagaaattcattccatggttgacgatgaagtcaaggttttggttttcttttgtgtttcttctgtatcaattgtatatgattagattgaagatgatttcatgtgatgaagttgattacaacggataataccgcttgtgaggttgtatcataatttgctaagaataagtatatatcttcccatttgtttcttgatgcaaacaggtttctagtgacttgtttaaagtggttggtattggataatg

SEQ ID NO: 27783 - DNA, 3003 bp, Unknown
  misc_feature (1)..( 3003): 2750-1469P.txt file - cDNA_ID_2992154; gDNA_ID_2214633; Annot_ID_188036
gctagtaaaaacagtccaagtcaagtttaagacttgctccggcagatccaccacaggacaccaaaatcagagacatgttcactaaaatcggaggaatttgtcgccgagaaagcaaaaagaaaacacaatccaaggttatggaatctacgaacctgtgggtggtggatctatacacgacgcccctccattttcggaacttgctcttctccaagctaaatcttatctgaaatagaagatattgtgttacagactagtttactgagtccggtgggttacagggcgggcggcgatggagcagagtcctcctcaaaaaaattccagtcttcttcttatcgctcgatcgacgaattccaggcagtggcattgactattgctgcatttctttctgggtaagccgggcctctcggtataggcccaaaccattctaaggcccaaaccattatattaagttggttggtccaccaaagtcagcagcagctagaacaagagcgactctgcagctgctcttctcccgcttccttcctgttagttagcctcagagatcctcgttccccgataatggatttgggaaaactgatccagctgtctgcgctgctgtgcccatttcttctatcattacactttagaatcgctggggcctccgcccacatctactcttcccagcccttccacgatgtcggtaattctctcctcctctacggtggcagcgagggcatcttcgcctcttcccgatctttaatcaggtatattctatggattacattttcaactcttttgatgctctctactctactctactcatcctccctcctcactgcaggtttgagaacatcactctctggaggacaattaccggtaagggccaccgcagcaatgggttagttcaagcagtgatctttgaagcctccgatcgtaacaatatcggtggttcagcttacggaggccaaagatctatttgctgcactccagatctggccaagcttcaaggctgtaagcagggtgagatcattaggattccttctccacatgaccctcaatggcctatcctcttacctgtccgctttaaaggaaaacgctcgtctgctaagatggcagacactgagattcttatcaccaagactggaatctataatctcttattcatatcttgtgatccacaacttaagggcctcaaaatgaccggaaagactgtttggaaaaatcccgacggctatcttcctggtaggatggctccactcgtgaatttctatgtctatatgtctctcgcttatttgttgctcagtgccgtctggttcttccagtatttgaggttccggatggatatattgccacttcaacattgcattactgccgtcattcttctaggattgcttgagatgctcttttggtacttggattatgctaattttaatcacacggggatgaggcctttagcccttactacatgggttgttaccattggtgccttgagaaagactgtttcccgcattctcattctctgtgtttccatgggatttggggttgtcaaatctactcttggtggtctcacttctaaagtcctccttgttggagttacttacttcatagcttctgagatccttgatattgctgagcacgttggcatcattgacgatatgtccggaagatcaaaactttttcttgtccttcctgacgccttcctcgatgcatttctcatattgtggatatttacctctctttcgaaaacactggaacagttacaggtatctctttctttctaaatatagccatcagactctgtaagttgtaagggttttgaggcaagattcatcagaccagctataaaattctttattactgcagatgaaaaggacctcggtgaagctggaaatttaccgcaagttctcaaatgcactcgctgtgatggttgttgcctctgttgcgtggatagtgtatgaggtaccatcctgtcaagcctgatttgatgctgatttagtaaactcaaatcttacctctaggaaacaaactgctcaactaaaactggctttgtttcaagctaggaaaaaagaagctccttctttcttggaatatacccagcttgcttgcctgatgatttgtccccgtgcaggtgtatttcaaagcaacagatccattcaatgaacgatggcagactgcttggactataactgccttctgggatgttatcgcattcttgttgctatgtattatttgctatctctggaccccctcgcagaactcccaaaggtatgttacatcaacttaaaaggttttgatacctctcgggcataccaacaaataagcatggttttgtggaaacggtttcagctgagcatgttgtgggaagtcttggctacatgctagtggttcttatgtagtggtccaattttggtgttcctgggtgtgatagggatgctaatatgaaactaatgatggacagatatgcatattcgggagacgtggatgaagaaaacgaggaagctcaatctctgacaggggggaagcaagatggtgatattagcttagttaagcaagagaagaatgcggagtcggacagggaagaagatgttgaagaagataaaagagagtgaggagagtcagtatagaaacgacgtggcatctgtgtttgatcaagagttgacgaaaatataaatatcagcaagaggtcagctatatagcacaaagcaacgacgtaatacatatatatgatgtaactaaaggatagtaactgtgtgtttgtatttgtttgtttttttaatatcagatccaacattttttgagtcatctctaacccttgtctgagtgtgagatttgcctaaaattgctgtaaattacattattgatatttttattggtggttaaaattgtgaaacattaatttgtcaataatactagagtccagacacggaaacagggtctctctctcttgttgtgtataatttcaacaccgctattacagaagaagagtgaaaagggagagggagcttcctgctttcacttactatg

SEQ ID NO: 27784 - DNA, 3000 bp, Unknown; identical to SEQ ID NO: 10148
  misc_feature (1)..( 3000): 2750-1469P.txt file - cDNA_ID_2992162; gDNA_ID_2213627; Annot_ID_132078

SEQ ID NO: 27785 - DNA, 3000 bp, Unknown; identical to SEQ ID NO: 6163
  misc_feature (1)..( 3000): 2750-1469P.txt file - cDNA_ID_2992185; gDNA_ID_1620852; Annot_ID_51005

SEQ ID NO: 27786 - DNA, 3000 bp, Unknown; identical to SEQ ID NO: 6163
  misc_feature (1)..( 3000): 2750-1469P.txt file - cDNA_ID_2992185; gDNA_ID_1620852; Annot_ID_170349

SEQ ID NO: 27787 - DNA, 3003 bp, Unknown
  misc_feature (1)..( 3003): 2750-1469P.txt file - cDNA_ID_2992185; gDNA_ID_1620607; Annot_ID_161807
tcagcccatcgataaacacctttacgtctttgacctcgagacccggacttggtccattgctccagccaccggagacgttccacacctctcttgcttaggtgtccgtatggtgtcagtaggatcgaccctctatacctttggaggccgagacttttcacgccaatacaacggtttctactcgtttgacacgacaacaaacgagtggaaactgctaactccggtggaagaaggacccactcctcgtagtttccattcgatggcagcggatgaggaaaacgtttacgttttcggtggagtgggtgctatggatcgaatcaagacactagactcttacaatatcgttgacaagacgtggtttcattgttcgaatccaggagattcctttagcataagaggaggagcagggctcgaagtggtgcaagggaaagtatggattgtgtatggatttaacggatgtgaagtagatgatgttcatttctacgatcctgctgaagacaaatggacacaagtggaaacattcggtgtgaagcctaacgaaaggagtgttttcgctagtgcggctattgggaaacacattgtgatatttggaggtgagattgcgatggatccacgagctcacgtaggtccgggtcaattaatcgatgggactttcgcgttggatacagagacgttgcaatgggagaggttagataagtttgaggggactccgagtagcagaggatggaccgcgtccacgactggaaccattgatggtaagaaaggacttgtgatgcatggtggtaaagctccaaccaatgaccggtttgatgacctcttcttttacggaattgactctgtctgattaagcgcgatttgatcatgaccgtttgtgttttatttgtttgtgtgtctgtgtgtctgtgtgatgcaataagggagggatcgtgatacctctatatgatccttcgtcagcttatccattttattttttattttctaaatgtatctttttgttttttgttttctgttttgtatgtttaatgtttcgtggcttgttcaataagatgtttattttccgaattttttttgggtatgttacgttatactacaaacaaaaatattatgattttgattttctctaaagatgaaatgaatagaacaagaagtcagcagatagggtggtttcatctacttttgtggttggtaaatgtggttagaaaaatttgcattgaattgtaagtttctatccataaaagaaacaaaaaattaatgtaatcaagagtggaaagttaccaatggattataaaaatcttgcaattctaataaatcctcatgtcaacggtacagataagataagggtaaggggcaaacaatcttgttggttcaaatggcaagtaaacaagggcaattatatccacctaatccattgcgttttctttctctaatcttagaatctactttaattgtatgtttttctctttcatctactttccaaaactatataacctcatttctatactttttatgcatttattttgaaacccctttatcaaaaaaaaaaaaggggccaatttttcttcaaaaatggttactttaagattctcatatacagtgtgccaaaaaaaaaaaaggtacctaaaatatttattatttcagatattggtcaacatattatctgtaacagaaaaatgttcacgtgatatttgcgaatcacatttttctaggggcaaaagtgatatatgagaatcttaaagtaaccttttctagaataattgcccttgtttacttgccactgtagtcatttatttaatttatgttcaaaaacagattacctacctaattcaccgaaacgaaaaattttgttgccagtttttgttttttttaattttttttttcctctttttagtttaccttctcttttttctgttcaacattaaactagaaggtagagtaataaataacgatggatggatgtgttgaaaacgcgctttatgcatgattcatacgagagcagctgaggaggagacaaaaaacgggtctacactatatcagacttttttttgtttttttggtgtaaaactatatcagatggaaaaatatcaaccaaataatgtagaaactatatcaaacttttaacaaaactatcaacccaatattttatattttattaaaaaacaatactaataatttttccttttcctcgtttttttttttctgatcaaccattcacacgttgtttttcgtaattatgattctgcataatgctttctctaaatcaaaaactccacgccacggttcaactgatgtagtgcctccaccgttgtcgtttgactcgttgcagaggacaccattatgcacttcgattcattttcaaaatcgtctttctctactgaattgttactccatttaattttttggtccatagataacatagaccattatactagtatgttaaatgtatacttatcagttaccgcacaacattaattcttaaagagggttcattttcgagaattgagtacaacactaccattaggccaaaatgcgagaggcaaaaaaagatatagcatatacttatcatgaataatgaaaatcttttccatccaaataaaaatctttcttctcataaaagaaagaagagaaaaaacaatgagtttgcatatctttatcctgtagaatgataatcttccccatcaactactgtagatcgtcaacgtgtactcacttccattatcgatcgaatcatcaatttaatgcctcgtgaatcacgagatcatataatatgacaagaaattcgtcccgtttatctactgctggtcaataaatactcatgcaattcccaccaatagatcactcaaccaatttcttctcaggttctctcttcacacctctccccttctctatgattatagatagtatatgatttggttaaattatctatatttcttttttgataaaggatttggttaaatttttaattgcaggtaatactcgtaagatttatcaacacaagcaaaaaagatg

SEQ ID NO: 27788 - DNA, 3003 bp, Unknown
  misc_feature (1)..( 3003): 2750-1469P.txt file - cDNA_ID_2992193; gDNA_ID_1620482; Annot_ID_158368
ggatccatacttttggagaaacatattacctgactcaaaattttttttcaaggggctagattaagctgaatttatatagataattaacactttcaagtatcatcaccatttaactcttccattcaaatgcaaatacttgagtggacaggatagtcttaatattgataaagtaatagaaaaaataaagacgttatgaacaaagaaaaaccactaaatatattgtagctcagttaaaggaaaaatatatataccaaattaaggcttaaacgataaataatgcatataacccacttttcagtgcctccatggataaaaggatttagcaactttaaggaaaaaaggtttataccaaaaaaaagttcaaggagaaaaagaccactgatttacaattgttgggtagtttgaagtcccaaaatgttaaaaattcaattaaaaaaattgtgacagctaataaaaatggaactttagctggattcggaagatttattttattgaaaataaggattctgttttaattatagctctaatacagttgaattggttttttatagaaaaacatttctttattgaattttcttcaatggaaaaatatcattttagagtgaataagtacaaaaaataataaatgttgctttcaacaaaaaaaggaaggaaattttatgttttggctttgtatatttgctttcaacgtcattaaaacgctttttaaaccggagatatgcatcttgttttcctcatttacaagttcacaagatgattaattacattacttgggtcatgggcttaaaaagagagagtttgggtccaactaaaaaggctcagtaaaatacgtaaatgggcctagcgttatagcgagaggcagagagagaatttacacgacgacgacgtcatactcaatggacgtaaatgtccaaactacaaaagtttttttttttttttgtgtattaaaaaaaaaatctcaagttaaaaacacatcaagagtatattacagcaacttgtgtgttaaatcaccaattgtgaataaatcggttatggaaatcaatcatttttttttttggtttaatggaaattaatcatttgatcgttaagagtgtcactaattcgatacgtcacttgctgacgaatctgcagatgaaataggcatggtatgataaatctcgttaagaataaaatttcacctagatgtttgagtaatttttgtaagatgatgaaaattgtaacatttttcattgaaagaagcaaagagacaagcaacaagacaagagtgtccccacgcatgtgagcaccgttaaccataatagaaaaaagatatcttcatctaataataggtgaaaaaatcttataactgagcaaattttagagaatgaaaatagtgatctgtgaaataattttttttttttttatgatagacctcacctaacaactagaagaaataatataaaaccattattacttatattgataaactcttacaagatcactgtttccataaatcttgacaaaaatgtcactccatatgtttggtgtacaagactagaaactgtagttttgagttatgttattataatgttaaactgtattatgctcaaaattgaactccttttgaaaggtggtttatcttctttactaatcgtttcttcattttctctctaggagctaggtgggaaaaagattcaaccttgtcttagaaaaagaaaaccaaagctaatctttttcttttgtacctctctttcaaggattaacaaaacaaatcgatgaagcccgggttttagtacctaaacatctctttgtctcgtctttgaaaacccccccaagtagatccaacatcattcatatctctctctctatctctgcataagctacggagcgatgtcggcgtgcatcaatggcttatgcagagccgtgactgtctctcttcttcttcttcttctttctttctctttttcctcagcttgctccaatggaaattgccaggttcttgattctctttgcttattattctctggtttatggctatcaaatttgggtctaaatctttagggattttgcatttttgtgtctctttcagctgctggattcatgctcctcggctactgattgtgtctctggtttatactgtggagactgtcctgccgttggaagaagtaaacccgtctgcacaagaggccaagccacaagtccaacttccattgtgagatttagttcctataattagttggatttctctagagtttccaatttttgaagatgcgttgtttcaaaagatagtctagatcacttggtctatcaaaagttttgaactttgaagatgggttttgctgaagatttcatttggttgcattaaaagatagtctagatcatttggttgtatcaaaagttttgaactttgaagatgtggtgatgaaatttgtgtgtgtgttttttgtagatcaatggattgccttttaacaagtatacatggttgatgactcataatgcctttagcaatgcaaatgcaccacttttgccaggtgttgagaggattacattttacaatcaagaagatactattactaatcagctacaagtaatgctcttattaccaactctcttattatagtttcctctttttttggataaaactcttgaatgtatatttttgttctagaatggagttagagggctaatgctggatatgtatgacttcaacaatgatatctggctttgccattcgcttcgagggcaatgtttcaacttcaccgcttttgtaagttttatcttcagcttaaccttgctggatcgaaagcttgaaacctgattggattggtaaatgtgaactttgttttctttttgaatcagcaacctgcaattaacatactgagggaagttgaggcatttctgagtcaaaacccaacagagattgttaccatcataatagaggattatgtgcacagacctaaaggcttatcaacactgtttgccaacgctggtttggacaaatactggttccctgtttcgaaaatg

SEQ ID NO: 27789 - DNA, 3003 bp, Unknown
  misc_feature (1)..( 3003): 2750-1469P.txt file - cDNA_ID_2992208; gDNA_ID_2936585; Annot_ID_195057
gatatcactccaatatcatttggatattgcttctctagcttcaaaaccagccgttccttgtctgtcaattggcgttcctgtgtatattgagaaggtttcagcagtgccattcacaaggcaatttagagaaggaatcatctgaaaaaacaatcgaaattagatgactgacctgactctccatatgcagtcggcgttttaatttggatacaattttctttgttgtatcggcgtcagcagacattagcagggtgaagattgttcggacaacagatttcactttttcctcatcatgttcagtgatacagaaaacttggtttgcttcttcactcccaacaagttcttcaatctccggaatagctcgaatgacactcttaagctcctgtaacattattacaagaagaaacataaatccttcaattctgaaatataagctaacaatcctaaaagtttggaaactgaataacatacataagagacttcatagagctattctccaaaaccaaattgtttctaaagttttggtaatatatccagagaaaaaacgaggaaagagcgagtcatgtgcaacaacaccatgaaccaacataaatacttgttcagcgaatccaatctcaaaccttaggctcaaacttatagcaatagagaaggagacactgcagtcatttactactcatggaatttggactacttgtcaaaattgggaagctaggtgggccattgcataggttcatctcttatgttaaaaaaacaaaaaaaagtaagatatgataaagtatagtgataagatagcaatgtgatacctgaagaggtataaagccacagagagcctcgaattgagtataggccaaagccatctctggtttgtgattgtcgtctttataaagattaggatgagctttgtgcattttctttgctaatttcttatctggatgtgcttgaatcgacaacggccttgccaccgacaacacctaccaaatattttacaaaatttaatcacatttctgcaacacacaacataaaagtacatattcaactccaaatcagacgaaatgatcaaaatcaattcattgaactatgtatagatgtttgtaccttgaacagaaaggggagatcgcaaccccatttctccaaaaccctatttccaagagatttagggttttcggtgatccaggatctaagggtcacgccattggatccatcagcatcctccaagtaactcggaccagactcgtgagtccccatccatagctcggcgtaaggtcgtgtaggatcgatctcgtaatctgaattcgccgcataaaccctgtaaacgagtgaatccgatccaattttgccccaatcgtaatccttaacagagcatctcaatcggcgaagccgtcgtcgatccgcttcacaaccgccattagcctttacgacagtagcgatctccattacaccaaaaaactcacgattacgaatctaaatccgtttctcggaggtaaaaacaaaatatctcaagcataagctaagcgcccatgtcaatggaagactcaaagcttttctctttacccccgaatcgtggatttttttatgttttataaacagaggaaggtatgattgtaaaatcaaaagtatgggggtcaaaagttggaataaaatataaatgtagggttgcgatgtttaacttaagaaagtgcaaaagtgacagatgttcaaagaaatcacgtgttttgccgacggtattaacgtccgtccgttggttgtgggccgtttgctagctgtccacgtggactctaatgatgactcactctcacgtctttaaattattttgtactagtgtaaactaaaccgacaaaatgtaccaatataaaatgttctaaacgttctcattttattacgataattccaaattcactcttttatcaataaatatatctaatgtaagaaatgataaactataatttaaaaacatgaaaaatctattcagaccaataaatcttcatttttgtagtgttgtaaacgtcatacatccgacatcaaacagtaactaaataacagaattggaattttcaaattgtttaatatttatttaaaaaaatctgtttgaattacggataaaataattgaaatattgaatatttcttaataagttttataatcttaattggctattttaaaatatttggtttgggttttacattttgggccaaatgttattagcccattaaaataaaaagggtccaacgccgtttgttttgttctgacggcgcgtgactgtcgtcccattccacgtgcgggcacgtcatcttatatactaccaagtacaactgtacaaggaccaaacaaccagcatcttttgtctcccgtcggaatctaaatcaactcctacttctttctctctttctttttgcaactcccccttaacttttagatttttacaaatttcaaccctataaaaaaattatgacacacccttacccatatgaatcacacttactcataggcacatgatattctctttgtcatactctccactaaatctcaaaattttgagatttgttgttatagacaattcatgtattctattgtttaacttatttcagttcaaccaaaattttcattaattcgaatattaaaaaaaaaaaactagtaacaggccattccaaagagtctgttatcaaaatgtgttttggtactattatgttgaatatttcccacctttcattttcattcataaacttggtgacgtggatttattttgatatacaagtaaaaggttcaatttgtaaatataacaaaatattgggagctatttcgataaaaccaaaacaatgggccaagaattaaaaatttaccatgaacatgagagagtgagagaagaagatcgatcaatcaatcatcaaactctctgtgtgccacatgcattactactgttgacttgttcaataaaggtaaagtaagatcaatccggcgaatcttctttcgttttccggcaccgatctcggtggatctccgattcacatg

SEQ ID NO: 27790 - DNA, 3003 bp, Unknown; identical to SEQ ID NO: 27789
  misc_feature (1)..( 3003): 2750-1469P.txt file - cDNA_ID_2992208; gDNA_ID_2936585; Annot_ID_143842

SEQ ID NO: 27791 - DNA, 3003 bp, Unknown
  misc_feature (1)..( 3003): 2750-1469P.txt file - cDNA_ID_2992212; gDNA_ID_1620835; Annot_ID_57967
tcaactgctcatgactaacaaatccatctacacatctccaaagtgtacaaaattttgtccatttcaaacatattttaatagtttttaccatctatactcaaattttacaattccatggcaaccatttacaactagtataaaccgtgggtctgtaagaataaggccaccacaaaatgttaatacgcaagacatcttcggattcagaccattttccattcgttatttaaaaaactaatgtatcagttaagtaagagtaaaaataggcagtatagtacaattggaccattagtcttttaaaatccactaaaatttaccatttgtagtaaacagtacacgtattaaaataagtttaccgccgcagctgataataaaaagagaggaaacaaaagaggatggaaaaaaagaagtgagaaatggatgtgaaaaaaaaagtttgcacataatcaaagtttgactttattcatatcatccatattttattatctaacttattttttataaatttgtcgtcattgatcactttatcttgcattttcttctacatgtttaacattttttttgttcaaacatgtttaacatttaaaactagttaatatgaaggaaataaacggattgagtgagtgatcagggttaatattatttgttataaaggacacatatggagaagagaaagaaatggtcaggcctcagggctgtgagtctgtaacactgtccatcttctttattgctcccatctgcctctcttctctaccttttccttctttattatatatattcctcacttttctccatcttcttaaatataggcattcccgtcaataaatgtgtataatctcgattagtgattcatttccgggttttaaacattggtaagatgttttttgcaaatccactacgaggaaaacatccaaccgaagtctaaatgaccaagtaatctatgggttgtgtttttgcacttgcacacaatgaaatcgaacatggttccgtagcaccttcagactttgaaaaatataaagaactacgtaattcaatagattgtctcaataatatagcaagacaaaatcggccgacaaacaaaataaagaagaaaacataggggaaacttgaatttcaaccaaggaagacccaaccacgtcagaaacaccttgggaatagtgtaactagatttaaatatttgtgcattacttcttactataccatcaacactcttataaatgtattaccacgacacataacggtcttaattatgatgcaccttttttagcactcccaaagattctctagctataagtatcggtcgaaagtattcattaatgcactatttgttttacctaagtttgaattcatttcataagaatgtgtgttcttaattaattttggcacactggtcgctcactagctattttcttctttgggcatagcatttagccttttagtatatatagaaactagttaatgttaagaaatggtgtttgatcattaatgatttagcaataacttgtatttataaccaaaaatgacaatttgtattctaagattttgtctttatctttttcagcaatgtatttgttttatctcatgtatatatatttttttgtgtgcacttgtgttctcttttgtgttttctcacattcttgtgtggatttttatttttttatttttgtgtggatttttttatattaacattccaattaaatttgattttctaagcagttctttttttttgggttaattttctagctacttaatcaattatcaaacattcttgataaattttaaaaacaaatctttgtttatgtacatgtatattaacttctcttttttactcgtgttggtatgaagagaaaacgatgtatgtaatgtgtacacggacaaaaactatagatcaagacatagcctataatgatttatgctagtgttgttgatgtgtcactatttaaaatttaaatcatgtgatatgtatatgtaggttcaaatttgaaagatatgtgacctaatcaatgtgagcatgtgatccaaacaaatgattagtacaactaatatttttcattttttggacaaactatataatttattttatgcatgatcaattttttgtatatatatttgcaactaccatagacatgtgaatccgaccacaattgttatcagacaggtcatgtatcacattggtgacagaaacaagactaagcccgtaaggtagcaacattgggctcaaccaaattcggcccatgaatttagactagagaaacagaaccggattaaaccggggattcggtacgaggagaaacagccgactgttgtagaaagaatatgccaaaagagtcaaagattcgtgactcatcatctctgtcgctgttccttttcttcttcttcttctcctttttttccaaacttttctctctgttacttacttccattattttcgagcttattcttatcttcatcgcttaaggttcgaattttcgaattcgatctctttttgtagctataccaatcacaaggtccgttctctactcaaatctcgcatattccttatgtcatcactgagctaaatcttttctgtattatgattcaatcgtgtctatgctttgtctctgtttctccggtaacctaattcgttgcaaaattaataattagatagaattcgaatctattgcatgcttaccagatcaattttggataaattgaatccagtaatttacgaaactcttggaacaattagtgttaatcctatgaattcttgttgttttaaacagttagagcaaatctaattatagatgacaggatcttaaaacgacttgtacctaatttctcaatctggcaaaacttaatttattagttagttgattagtgttttttttgtttccaaaattgcaatttattgttaatggtgaatgtttttattttcttgtggtgattgtagcagtagctgaaatcaatagtattaagccaggctagctagaccagcaagtaaatttgctggctagcaggatcctcatg

SEQ ID NO: 27792 - DNA, 3003 bp, Unknown; identical to SEQ ID NO: 27791
  misc_feature (1)..( 3003): 2750-1469P.txt file - cDNA_ID_2992212; gDNA_ID_1620835; Annot_ID_169853

SEQ ID NO: 27793 - DNA, 3000 bp, Unknown; identical to SEQ ID NO: 9860
  misc_feature (1)..( 3000): 2750-1469P.txt file - cDNA_ID_2992216; gDNA_ID_1974092; Annot_ID_180646

SEQ ID NO: 27794 - DNA, 3003 bp, Unknown
  misc_feature (1)..( 3003): 2750-1469P.txt file - cDNA_ID_2992243; gDNA_ID_1620807; Annot_ID_50568
gttccgtggcgaccaagatgtgcggaacagtgaccgaggtcgatgataatgcaattcaccgatatatgttgacataattgttttagtttattagtttatcgttagcatgtgacttatgacatgtgatatatcaatatgtaactcgcaacatacgtacgtgtatatcagattctttttgtcatcttccctgagagagagacactgcatctcagcctctcagctatgtattactgttgatgtcattgcttatgcaatccgaatccaaattgtaaaatcaaagaaaattttctatttctttctatttacattacctgttaattcgtccccaaatatttttgatgtcactcattattacaaaggaacaaaataaggaaccgaaaacagaaataatgggaaaaaagactacttcgacaacttccggcctttttatatttaacgccgtcccactttggaacccaatctatccacgtggagctctatcactggtcattcttaattctctggagttcacaaatttatgcaagaaaataaaaaaattgattttgaccgcctccgagtctttttacaactttttaattcgaattttgataacatctatatatacatttttggagctattttagtaaataaatccttaagttgggacttatttacagtggatgtcattgatatttaattattataactaattaatattcttaattattagcatttctttatctaatatatttccatcaattctaattacttttaaaaaggagaaatcttaggaatttattaatattatactttattaaaaataaatattatagttagttaaacatttaaaatatttaacggaaaaacgttttataatatttataatatgtgaaatgtataaaaattaaataatcatttgaaataaaacttttaaattgatgtgaattataaattttttaataaaaatattattcaaacaaaaaataaaaaaataatgtttaattttaccgaacgagattagatgataagacgggtttataatatttataatatatgaattttaaaacaattaaataaccatttaaaataaaacttttaaactgatttgaattatatatcttttaaattaaagtattattaaaacaaaaataacaaaataatttttagtttcgctgaacggggttagatggtatgacgagtttgggtcgataggtaatacgagacagtatagcatgggtgaaatctattagatatgtttaatttcactgaacgagattagatgatatgacggctttggatcgataataatacgagacagtatatcatgggtgaaatcatatatatatatatatatatatatatatatatcaaaatatcattatattaataaaattaatataattaaaatttgaattatttagttataatctaaattttaacttaataaactgtgtgttattctttctatattgttaaacagtaaaaaataaacatagtaattgtatactaaataatatatatatatatatataagagttgtacatttagaaaatattaaaatgaattatatttatttaatctactaaacaaattaactttttagtttttaaaaaagatataaccccgcggtataccgcagattaaaatctagttaactgataatcttgctgcataatatagccaccactaaatttacggtttactatcagaaatctgttttgttctaaattaaattaaattccaagatctttattttcctttacttgacacaatcgtttaattatttgtcattttattttcttaatttttaacctaaattaattaaaaaaaaagatgacttgacccttatttcattatttgtatcatattaattggtcggtcgtcggtgttatattttcaccggctagtcggtaaagataatgtgcttatatttggtgacaaggattcactaactttgatctttggtgcaattgaagatcagccatatgtatttcaaccttatattatcccccaaatcattccaacttttattttataaacattcgtggccttcatttttccactctgttgttttctcatacttttaataatttcttttgcccatttgtctttatcattcgaagaactcagaaacaactaactcttcattcttgattctcccacttaaacgacggcgtttttgcttaacgtttatgtatgcaagcaaatttacatacttttcgtgacctttggtttctgtgttgtgtgatatttactacgaaaccacttgtcaccaaaggttcttctttctgttagcgttgggttcgtgattccaagatcaatggttgtgaacttcactagttagagatactgaatcaaagagatgattcttccgagaattgggtaaatcttcgattctgattttctgggtaagaatgatcaagacccttcctttattttctttttttgttcttgcctaataattcttattctctgaatttgatttctttcttttaatgactcagaatcttccgtattggatgtttttgttcctgttcttgataatctctttatgactgtatctctacctctggattctcactgtcactgatgttcatgtctaatgaagcttctttaatttagtcttgttcgtgtcactgttcgatatttttaaatcaaaagttgctaactttgtgtcaatgatttgcttaagtaggactattttgagtttatggacatttgattcttaaattctgaggttgcatcagattagggaacttgaatcttggttactgtaaatttactaggagaaacctgagattgactattaactctgatatataacttatgtttgcttcttgcatttgatcttaacagattaaagaacacgtaacctattttcaattcgcgggtttgattccatagcttcttcagatcatacattctcgcaagtgttcgatacgggagtagaagaagaagagtctttctatgctcctgatcatgatgtcttgactctgcttcaacctaacttcaccagcaacgatg

SEQ ID NO: 27795 - DNA, 3003 bp, Unknown
  misc_feature (1)..( 3003): 2750-1469P.txt file - cDNA_ID_2992247; gDNA_ID_2926232; Annot_ID_203722
ggatctgaaagtctcttgtttgacacgagatattaggctacgtaattggatccaataggctttcccaaaaccatacagtgtttacatacggaatttgcggcgcttctggtgaccagtcattagccacaactaagataacattgtaactcataaacatccaacaaactaagatgttcttcgaacttggtctctcctgggatgcttttggcgattaccatcagatttgtagatgtataatggggagcaggattttccactgaccaaaatgcaatttccactaacatcttgtttagtctctcactcttaccccctaaaaaaatgtatatatcagttatcaactaacatgtaaaattgcactgcacatacatatatatatatatatatatatataatatgtaataaaaaagaactagggtttaagtaaaggacaatcacttttgggttcgaagtcgattacatcatccagactgtcaggtttcttctcaccataagcagtgattgacacctcaccatgataacctacaaatcacagagatcgagatctctgggcatggtggtttcgacggagatcgagaaaacagaaaattagatttagaagtaagaggcctatcaatgttttacatttaagcacagtaaacatttaaagcccagcctagcccattaagaggtaaatctaatttgctacgaattcggttgttaattattaaaccatcggtttagttcatcaaacgcaaaccaaagccaataaccgaataatttctcgagaaaaaataatgactttccggtgaagatttttttttacgacggcttctcctgacaacggaaggtgttgagaaagtggcggaatttgattttgtttcctctcctctcctatctaaacaaggtctgttttcgtgagatccagatattcaatttggattcaaaatcgtgaattgggttttggattgatttctgttactggtctgtgtgctttgatctgaatgttgtttcattctctagttgtcagatttactgatgatgggaataagcaaaacggagatcaatttgcggagattgctttccgctgcacctaaccagcaaaatcagtcgaagcttatgcatgtacgtttcttttgatcttcattatatgtaaactattagtctcgtgtttatgttgatgtatgaaacaaaaaatctgcagtatgttgctacattgagggaacaattagaacaactctccgaagaaaaaacccctgaaggccttcccaggtttacttactctcttgttgattcaccattgccattaaaaagattcctgctttttggtgtctctttctaggatcaagggttagagatttgaactggattgcttcgtattatagttgttgttctaaaagtacatgttttttggtgaaatacccttgcaaccattatgagaatgtgcttattttctcctttgatctctttgtccagagttacaaaggctaaggttaatgagtactatgagaagattgaagctgttgcttccaagatagcttctcaagaggtaagtcacctgaactagaaagggacacttcttttcacttgtctagctaggacattaggctcttgttgatatgatactttgttagttacttccccaatttttactagatgtattggtctcaggaattagtttcaggaacgcacattttggttggttcctgcgtagaaccattgtttagctgcaagaattttcaagttttacttctgtaacttataccaaatttttgatttttgctaaatttacagcctgagacagaggtatctgatgaaccctttgcaaaagattcgactagtggaagctcaccaaaaatagaagatgagcctcgaagccccacttcgccacagctgagaagaagaatcgtgtacgtggaatactagattcacatccttctcaagttgtagtaaattctttcttttagtacttatcaacttccttgattgagttagccctgcaagttccaaggagcaaagctttgatgctgctgatgctgattcatcaaaaccaataaaactagacaccgcagctcaagcgcacattgacaagcacaggtagatgcattgatcaccaagaagaactaggaactcatttctatctatgcactttcgttagtagagagaaaaatttatcgcaaagagtagagctttattgattttaatataagttcaattttgccacttcatgccaagttggtgattcatttgatgacagaaagcttcaagaggatctaaccgatgaaatggtggtacttgcaagacaactcaaggagagaagtcaagcgattagtcaatctgtgcaaaatacagaaaaggtgagatgctaaccatttcctcacaaaaccaattattcttacttttttaatcaacaactatgtaacaagagaagaatctatattggttcatatatccttttaaccggcttcattgctcctaacatttttctttctttcttttcttgtggattcattaacaaaagatacttgactctaccgaggaggccattgagcaaagcctagcgagcacaggacacgcgacaacaagagcgacaaagatatattcacaaagctcaaagacaagttgcttccagtggctcttgatcttcgccatgatctgtgtgttcataatggttgttctgttgatccgggtcacatagaaattgttcagattgtaataccaaattagtgaaatccaaaaaacatttcagtctctttatcatacagtttgtgaaagttcttttgacttttgtaaattctgagtttttgatatgtgaaactatacttctaaaagatatgccagaaatcagtacaatttgtttgtgaagaggaattgagaaatgaagaattgtaatttaaccggtttggtttgaagaccggtatgatttggttagtatagtttgtcttcttcgtacacttaaaagttaaaaccctaaggaaaggccaaaacccagagactgagagaatccattttcttttaatcgccatg

SEQ ID NO: 27796 - DNA, 3000 bp, Unknown; identical to SEQ ID NO: 3205
  misc_feature (1)..( 3000): 2750-1469P.txt file - cDNA_ID_2992258; gDNA_ID_1620631; Annot_ID_162694

SEQ ID NO: 27797 - DNA, 3000 bp, Unknown; identical to SEQ ID NO: 3205
  misc_feature (1)..( 3000): 2750-1469P.txt file - cDNA_ID_2992258; gDNA_ID_2926182; Annot_ID_200338

SEQ ID NO: 27798 - DNA, 3003 bp, Unknown
  misc_feature (1)..( 3003): 2750-1469P.txt file - cDNA_ID_2992261; gDNA_ID_2926230; Annot_ID_142642
ggaaatctttctaaaatcaaggttatttagcaatttcctttatttcctttgttttagagtcaaatatatttttttgggggtcagaaaatcatatataattttcctatatagaaaaatggaaatcttagaaaaatctagggctatttaagcaatttcaattttcctaaacaaaattcgacgctgccgccggtaaaaattgagctcgtgaaagctttacccgggagaagtgaaaaatcatcagagtttttgagaaattcttccaagcgacggagagatgtcggagatggaggtggagaaaccggatttgacattgtacaacacaatgactcaactgaaggaagtttataagccgatgaatcccggcaaaatcggaatctatgtatgcggtatcaccgcttacgattatagccacattggccacgctcgtgccgccgtgtccttcgacctcctttacaggtcagttccatagttttcgccgtaggattgttgtttaatttgaatttctttaggtcacgaatttggggaaaaatcccaacaatttaaaactaattttgtctattgttagcttcgattaacaatgtactaagcttagagacatttgaagctggtatttatctctctagtgtactggttgattatgcagatacttaaggcacttgggttatcaagttacttatgtcagaaattttacagatgttgatgacaaggtctggtatccttttctgcgttttgaaactagagcaatgaacaccaaataatcctcctgtttatcaaactctgaatactgtacctgcaagtaattgaaaaggctaaaaactgtggagagaagccgttagatttgagtaatcgcttttgcgaggagtatcttttagatatggctgctcttcagtgcctccttcccacccaccagcctcgtgtcagtgatcatatggaacagatcattaagatgatagaaaaggtttgttgtcttttttcttcttgtttggtttcctgcaatgttctttgttaaaatatggtggtataatgatgatgcttccttggtacagatcattgagaatggatgtgggtatgctgtgggtggtgatgtgttcttctcagtggacaaatcaccgagttatggtcagttatctggtcaacggctggatcatactcaagctggtaagcgtgttgctgttgactcaaggaagcgtaatcctgctgactttgcattacggaaggtttgacaagtttaatctttttgttcaattcttatttcagttattaaactagagcagctggagtttatgctgaaatttttatgcaggctgcaaaatctggtgaaccaagttgggagagcccttggggtcatggaagaccaggatggcacatcgagtgcagtgccatgagtgctcattaacctgtctccgaggtttgacattcatggtggtggcgcagatctcaaattcccgcaccatgaaaatgagatcgcccagacatgtgctgcttgtgaagatagtggtgtgaactactggttgcataacgggcatgtcaccaacaacaatgtgaagatgggaaaatcattgaacaacttttttacgattagacaagtaagtttcttatttgtttcaatatcataaattgagtgtgtgttttctcacggctaatgcaaaattgttgaatctgtgtagatcgcggctaactatcatccactggctttgagacatttcttgatgagtgcacagtaccgttctcctctcaactattcggtttcgcagcttgagagttcatcggatgctttatactgtgtttatcaggtgggtgccttcacaatattttttagcatctcttaagggaaaacggtatgaatgtttcttaactttaaagctctatcgccatatcgagaagaaatgagtggagatgttggaaagactcaacagtctgcagaagccaaagagatgataaagaaggtgaaaagtgagtttgaaacaaaaatgtcaaaacgacttgaacactgcccatatactcactggtgcttttcaagacgcattgaaattcatcaacgtttcaatctccaagctcaagaaaatgcagaagaagcagcggatgtcgctggtagtgtcactggtcgaggttgagaaggcagtgagggaagttcttgatgtgcttggtttgctcacgactctaagctacggtgagcttttgaaagacatgaaacaaaaggcattaacaagagcaggaatgggagaagaagaggtcttgcagaggattgaagaaaggaatatggcccggaagagcaaagatttcaggagaagcgatcggattcgagagctgttggcatttaaaggaatcttcctcgaggatgttcctggagacactgtgtggagaccttccaccccattgaccaagcctaaatctggtttaggtttaggcatgacagccatcgtttttgctatcgtttttactttcttaggcttcttcttctatagccgttgaactctttatttatttcactatttgtttagattgtgttgtattagtgtgtggtaaacttattaactttaaacattgacctgcaactgaaaaattattggatcaccaaatctcaaacgtttttatatgtagtcagtcacattttgtgaaaaacgttcgttaactaaatctaatctaaataaatgcttaaaactcaagagcaattcgtatgtgaaactaaatgggacagatttataataaattttctttttgtttaaaaatggccgatggtctaattaactacttatagtagtattactgagtaaatattgtaattaatgaaaacgatagtatataggatagtatatatgataacgtgatgattcataagcatatttattattttatcaaattaaactattggagttggagataccgatacgactccactacatctatgaaaccattttcgtgtcttgactttggtttggttcaacgaagacacatagaggaagaagtcgccggagaagtgaaaagacgttgatggtgattatg

SEQ ID NO: 27799 - DNA, 3003 bp, Unknown; identical to SEQ ID NO: 27798
  misc_feature (1)..( 3003): 2750-1469P.txt file - cDNA_ID_2992261; gDNA_ID_2926230; Annot_ID_203651

SEQ ID NO: 27800 - DNA, 3003 bp, Unknown; identical to SEQ ID NO: 26845
  misc_feature (1)..( 3003): 2750-1469P.txt file - cDNA_ID_2992269; gDNA_ID_2213668; Annot_ID_182167

SEQ ID NO: 27801 - DNA, 3000 bp, Unknown
  misc_feature (1)..( 3000): 2750-1469P.txt file - cDNA_ID_2992273; gDNA_ID_1621133; Annot_ID_172568
ggatacagaactcagcctctgatgatcactatgatctctgttcaagttgttacgttgcctttagggaagcttatggctagggttttgcctgagaccaagtataagattggttcgtgggagttttcttttaatccgggtccctttaacgtcaaggaacatgtgttgatctctatgtttgctaatgctggtgctggatttggatctggtactgcttacgctgttggtattgttgatatcatcatggctttttataaaaggaagattagtttcttggctagttggattcttgtcatcactactcaggttcaatgttttctgattttttttccctttttttataatgttctaggtgaatatatagctgatgatgattttctctgttgttgaatgatcagattcttgggtatggttgggctggtatcatgagaaagttagttgttgatcctgcacagatgtggtggcctacgagtgttcttcaagtctctctgtttcggtatgctgattgatgcattttagagcatactatatataccacttgttttactattgtttacttagtggctctgacactgtctttgatctttatacagtgctcttcatgagaaggacaatgcaagaatgtcacgaggaaagttctttgtgattgcgtttgtttgtagcttcgcgtggtacatattcccagcttatttgttcttgaccttatcatcaatatcttgggtttgttgggcattcccgaagtctatcacagctcagcagttaggatctggaatgtcaggacttgggattggtgcatttgctcttgattggtctgttatagcttcttaccttggaagccctcttgtgactcctttctttgcaattgtcaatgtccttgttggttacgttttggtcatgtatatggttataccaatatcatattggggcatgaatgtgtatgaagcaaacaagtttccaattttctcctctgatctgtttgataagcaagggcaactttacaatatctccaccattgtcaacaacaagtttgaattggacatggagaattatcaacaacaaggtcgggtttatctcagtacgttctttgctatcagttacgggattggtttcgcagcaatcgtttccacactgactcatgttgctctcttcaatggaaagtaagtcaggaatatccataatggactaacttatgcaccaatgtctgaaaatatcactaaccttcttttttgacttaggggaatttggcaacaagtacgagcttcaactaaagctaaaatggacatacacacaaggttgatgaagaagtacaaagacataccaggttggtggttttacagtctgcttgcgatctcattggtgctatctcttgtcctctgcattttcatgaaagacgagatccaaatgccttggtggggactccttctagcatcattcatggcccttacattcactgtaccagtcagcattatcacagctactactaatcaggtaccacatataacttccactacagattcctcaaaataacatgatttggatattttctcactttgaaaatgttgtgatgcagactccaggtctgaacattatcacagaatatctcatgggtgtgttgttaccggggagaccaatagctaacgtctgcttcaaaacttatgggtacataagcatgtcacaagctatatcattccttaacgacttcaagctaggccattacatgaagataccaccaagatcgatgttcttagtccagttcataggaacggtgatagcaggaacagtgaatatatcagtggcatggtacttgctgacatcagtagaaaacatctgccagaaggagttgcttcctccaaacagtccatggacatgtccaagtgacagagttttcttcgacgcatcagtgatttggggattagtaggacccaagagaatctttggtcggctaggaaactaccctgcactaaactggttcttcttaggtggactaataggaccggtcctcgtgtggcttctccaaaaagccttcccaacgaaaacatggatctcgcagatcaatctcccagttcttttaggagcaacagcagcaatgccgccagcgacaagcgtgaacttcaactgctggatcatagtaggagtgatattcaattactttgtgttcaagtactgcaaaaagtggtggcagaggtataactacgtgctatcggcagctttggatgcgggattggcgttcatgggagtgttgttatactttagtttgacgatgaatggaatatcgataaatcattggtggggtgctaagggtgagaattgtcctcttgcttcttgtcctactgctcctggtgttctagttgatggttgtcctgttttttaaagtctttttaagatttgtttttctttgtttttttttagattttacagttttttttttctttttgaagatatttgttccatttgtacgtttttagacttgaatctgatctttttttttggattttttacgaatcgtataggttaacaaaaacagactcaatgattttttatccatgtatctgttatactaaaatttggtaagagtgagtatctgggattattttgtttacgtgaaaaaccttatatatctaaattagtggaaaatataagattatacaagtaatgcaaaaactctaaacaaggtacagtatttgtaatgtggcgcgtggacgagaaggaagtagaggagcgtgggttatcaatttggattgacgccaaaaaaaaaagtgattcattaatctgagagtttggttcaaccatattcatcaatttttctttattttattcactaataataattttgagtctctcttctctctctcttatatctcaaaatccgagaaaacgaagttcaaagatccgtggttgaattcgtgattctgaaatttcgtttcttcaggtctctgatcgtcctggttctcctctgatctgttatttgcttcgaaatagaagtttgtttctcgtttgacgatg

SEQ ID NO: 27802 - DNA, 3003 bp, Unknown
  misc_feature (1)..( 3003): 2750-1469P.txt file - cDNA_ID_2992285; gDNA_ID_1620335; Annot_ID_153760
tatctctgaaagtgaaatcccaatgataaactatgtgatctaacatctaaaacccttcaggtggtagctttgaacagttctcaagaagcagaaggtgaactctacatcgatgacggcaaaagctttgaattcagacgaggctcttacatccatcgtcgcttcgtcttctcaaagggtgttcttacatcaacgaacttagctcctccagaagctcgtctctcttcccaatgcttgatcgacagaattatcctcttgggacacagctcaggtccaaaatctgcgttggtggaaccgttgaatcaaaaggcagagattgagatgggacctctgcgaatgggtgggcttgtagcttcctcgggtacaaaggtgttgactatccgcaaaccgggtgttcgagtggaccaagactggaccgtaaagattctgtgattgaacggtttgaaccagtttcactcatggccgttagagtggccgaaatctgcttttccggcgacggaatatcacactttttaatatatgtttggagatttagacttaaatagttgtaagagctaacagtttgaaagtcactttgcattgttgtttatcttcatataaatgagtttagattttgataatttcagaattcgtggaatcataattaacaattttgatagggaaaaataatttgttttttttagtcagagggtcaaataatcttaccttccatcgttgcctaattattgtcaaatccttttactttttacctaatcaacccatgaaaaatcttgaattacacgttttaagagtcatgaagaaaaatcaatctgattctgttggctagatttgttttttttatactgcttagtgtttactgttatagaaagggttctaagtatgcaaagtttgccctaattagataatgttagatccgtgtaggtgaaacaagaagccaaaattctgtgtaaaaagagtcacgtaactacctaactcttgtaggtctaaagaccatcttcactttaaattagaacctcatgtttcccaaacaatatattccgttcatgaatctcgtttcgaattaaaactaaaatattacacattttagaatgtaagaaaaacacactcaaaattaagaatcttggaattgaaaacgagattttgaatgtgttcaaagatactctttagaaattataatggtagataatagcacttgcatgacaaattcgattctctcttctcatcatgcatttttgctttacattttgttcctttaaaccaagaatattttgactcacctaaaagataaaccaaacatatctgaaatctacaattgacaattaacttctctttttcttttctcttattcttactgaaataaaaatagtatgcaactggtctttataaatttcagttttatatatttaaaaaaaatcttctataccaagtttaccaactcatggtagtccaatgattaaaaaataaatcattatggggttaggacttaggagatcgaattcgaatcatttcaaattttcaatgcgatttcaatcattgtttttcactgttaacactttgaaatatctaagtgtatctaaaaatttcaagccttagagattaatttggacttcgatccggaattctgcgacgactatcaaacaaattttgttttaaccgaaatatagattatttgcatctctgattatcaaaccattcattctttttattattattcagtttactataaagtatatgtccctccctttatgaaccgtatcaaatactatacatagtatgcatgttcgaagaaatttccaacatactaatttgaaatcaacgaacatatcaaattataatgcgttgatgcagaatatatgctttctatatatataacttaaatacaaaaacctaaattttccatatgccttcgtaatttagtatataaatattcattcattcttaatacagcctaggactcggtagcattttgaagtaggaacgaattttgttaattaagatacatgagtgattagatcgaatccaaaaggtatggaggcgtagaacaagaatttggttctctttcattttacgtatctttcactaaagaatagagagaaaacaaaaccatgcaaaaacctctcaaaaattatatattgaacgcttagacaaagagccaaatttattcgctttttgatgtttacatcagtatttgtttctagctagttcatattatttaaactccataatcatttgaaagacataaaatacagatgtttaagatctgtggatgtttatataggatcttcgaattcggataatgaaatcatttatacactattaagtattaactttgtagaggacttaagtattcgaaatcttgattcaggttgtcaatcaagaaccgtaatgtttgatctatagagccatgggattaatggatgctaaaagaataaaacactcgagaagaagagtacacgtaaaatcactcacacacaaagaatgagagatgggagaagaatactacaaagtgtttgttttttttaaatcggctcatatataaatttgggcgatactctactacccacattattcttttaaacaatgatataaatgtgtatggcctatgtagccgaactttttacatatctgacctgtatatatataataattatttatcaaagaaattagagaaagattcttccacttttgatggcttataaaagatgatgacccaaaacactcaaaatgcagcagcaactgctctctcaccacccatctcctcatttctcttttgcatttctttctttttttctgcattgcattcttttgaggggtttaattttctgcatagctttgtctaatctcttagagctcaataagagaaggtactataactgatctctccctctttcaagttttttttttgtttggtttatagaaaactataaccgccattatccgttagttttaaccgttttttgaaactagtgaatcctcataactttggtttctcactaaaaacagatg

SEQ ID NO: 27803 - DNA, 2012 bp, Unknown; identical to SEQ ID NO: 6154
  misc_feature (1)..( 2012): 2750-1469P.txt file - cDNA_ID_2992285; gDNA_ID_1620851; Annot_ID_170325

SEQ ID NO: 27804 - DNA, 3003 bp, Unknown
  misc_feature (1)..( 3003): 2750-1469P.txt file - cDNA_ID_2992289; gDNA_ID_2926231; Annot_ID_203693
tggactgttgtaggacgatgatccaccgcgcattggaggcggaagagggaatctctccgggatatatccatttcttcttctgcggaaaaagttaaaagggtaaggaaaaagttgacaactttgggatgaaaattgataaagattatgtttggggatttaccctaaaaggttaagctctattgtcgccttgtattgttgaggaatctccatgagagcagaaagggcaaactctgtttccttcaaggattgagctttgttctttgccatgatctctgtgaagttcacgaactagaaacagaacatcagattaaaacaccaaactaacttcgatgttattagctagaaagaaacttacttggaagttatcaaacgctctggccggaatattatcgtcaaattccctcatcatgtcccaaggtccatcccccaccccgactaagacgattgatagaggaagcttactgtcacagagaaaaagttcacatcagaaaagccagccaaaaagagatataacttcaatggagagaacaatgtcaaaagattggacaatattccaacctcgcttgcacgatcgcatctaccgtcttctgttcttgtggacttaactgtccattttccgtgtcaacacttcttgtaacctgaaatggttcattgaggtttcttcttttgacacaaaaacaaaggttcataacatcatactggttttattcgtacctgcccatctgctattatcactaggacgtgatattgcccaccactctgctcaacaatggtcatggccatatcgatgatcggagcaaaggaggttggccctgcagaagtattcaacattcacatttaagaatttagctagcatttcatgaaaatgcggccaaataaggaaaagaaataaacctgcaagcttaagttgaggcacgatctccttataccgggaaagtacttcctcaaatccattacagaatctatcctctgaattgaaactgaacacgtcttgatcatgtgttgatgcatctccaaaaccataacatggaatcaagttgtcctcgtcaaaggcggctaaggttcttcctatgatagttatcgcttgttcataaggattgggactactgcctatgaagtgtaagcttttcctattgaaggacctggcccctgttatcaaacaagcaaagtatgattttgagagtgaaaccatttgatgcattacacaaagacagaatctagaatctcaccaacctgtccattcgttactcttagtgaaatcaataccaacgatgagatttgaagattctagacccgcccgtgcaagagcctccgtcacctaaaacgaaaacagaacataatgtgaatcttttctgtcaaacccatgagaatctacagttttcaagttttgtaatcatcaaagaacacacactagattccactaaaaaccaacgcgagactcagctaacctgctccaaagaagagtaatcatcagaaattttcgaatacttgcgctccaacctcttcttattatcactaccataactttgagaaggcggtgcagaataagacggagcagagtaaggctgagtactatataaaggaggaggaggttgcgtatactcaggaggttgggcataagaaggtggaggagggtaattatagctttctgcaccatactgaggataactttgttgagaagcccatgaagatgaagatggtgatgctgatgaagcagaagttgacctaaacgatgactgtctccagttttctttagaattccctgtccccatcaaacttaacaaaaaactaaacctttttagattcaaatcaaacctctcaggtcagttccgtaccctgcaaaacaaagatttagcctttagagtatattcatgaaaccccagaaaaaaaaagcagaaactttgtttaagattctgacattattagaagatgcaatttacctatacctaattcgttaagaaaaggtgaaagctttatctttgacagatgttgaattatctcaccgctctttaaaatcgaaggttggtagagatgtttatataaagaaaggagattcaatcacgtcacgtaattttccacaacaatacgcgatttagtgacttctagattaagataaaagtcctattacgaaaacctactccaacactctaacccacaataagtaaaacaaacaaaaaccagtttctgacaaatctacgagctttccaatttcgccgaattgaactgaaacattctctgattcatcaaaccaaagactaccccaaaatcgaaaaataacattaattcgagattgaatctcccgacattcatcagaaaatgacccaattcgattgagaggaaaagttgtctacctttaaactaaacgaagcagaggaatgacgaatcagagaagtactttgagagagagtcagaggagcttcaatggcggatcgaatactaaagagttcgcctttaaagtttcctccttttgttcgaaagcaatttcacttttcttctgtttgttgtatttggtttgtttctatgaaatcattaggagactaatcacttttctgtttttaaaaaagtgtgaagcacgctaatggtggaaacttcttctaattttaccccacattttattctctcttccaacaattggccctataatattattatcgatatccaaagtcataacatggtatcaattgacaatttcttttgattacttgaaattcttaaattgaccatttcttaaaaagtacaaatagtcaataactaaactaacattttttaattccaaatttttaatctagaggattgtattatacatatgtaaattatatgaataaaaaatacttaaagaaggaaaacataatcaataattagtttaaaaaattgcaactcagaagtttagaaatgatgtatcatataaataggactgccaaacaaaaaaaacttcttctgtatgatttgggcaaatactaatagtataataacaatgcaataaatacctttggggatgaaatg

SEQ ID NO: 27805 - DNA, 3000 bp, Unknown; identical to SEQ ID NO: 10843
  misc_feature (1)..( 3000): 2750-1469P.txt file - cDNA_ID_2992296; gDNA_ID_2214452; Annot_ID_182600

SEQ ID NO: 27806 - DNA, 3000 bp, Unknown; identical to SEQ ID NO: 10801
  misc_feature (1)..( 3000): 2750-1469P.txt file - cDNA_ID_2992300; gDNA_ID_2214450; Annot_ID_182429

SEQ ID NO: 27807 - DNA, 3003 bp, Unknown
  misc_feature (1)..( 3003): 2750-1469P.txt file - cDNA_ID_2992308; gDNA_ID_1620769; Annot_ID_50173
ctcaaaattcaaaatcattgataataccacacatattgactcagatcggagctgcaaagcatatcttaagccaatcaaacatgaattcagatcctcattatgcaatcgacaaaacaaaaccatattaagtgttataggcaaagatcgagatcgcattcataccatgattacgccggagaagaaacaccaggaaagctaattagaaattgaaatgacgatcgcgagcagaaaatcaatttcacctctctcttttttttttggttttttttcttaagtttttgtctccttgatttcaatatatctctcttttttacatctgtgtttcaccacctaaaaagagattcagtcttgctattctcacaacgtacatcgtcacagaccatctatgattgggtattgagacgtgtgatatctacgtggccgtctataattgggtcgttatttgagattttaagagcttgagaaggctcgagaattgagactcgtcggacaaaaaaacagacgtgtcatgtcaactactgaaaatctagcggacgtgtttgaaagtcaaagcacgaacctctttggggtcagtatttccaaaacaaccattttagatttctaattttctactagtagtagtaacctataaacttatagagagcttggttttacggactgtttttcctagaccgttcatgaacattgtgttctttggtggatagattttgattggatatgaatacatgatccgtgtttttagtgagagtttaaggattcgattattcgaagcaggctcatagagtgtggcatctcaaacgatgcacggtcttccacaaaaacgcacatatatggtcttgaagactcataatattcggattgataatagtttttcttgaatatgattgttttggtggatatgaagaggaatctcagaacattggattttcttggtgatgatatgataatggtatagttggaaatacatatttacttcgttttgtaaaatgacaaagcaaaatgtgtaaaaatctcgtccaactgtaaaaaccccatgactatattttagtatcactttctcttgacatcatcacagcaaacaagactcacgtaattccacaaaagctaaaatttgtgtctatcaaagagccatgtgtactaaaagtacaaatgaatggaatgtactatgtgttatgtactatgtactaacggtatatcgaccaaactcataatttcatgtttagtaatgcttttaatttaatttaaaatatatagttcccctaaactaatcttagtcagttcatcgtacgtctaataaattttcatttaattgtgatgttctcggggatggacactctaaaatattagtattagtgtacttgtgaaagtaaaagagaggtttatagatattaaaacttgcacgaattgtactaggtatgaatggtaggtactaggttctctaacaaatgaaaagagttgcagcctttttgaattaatgttttgaacatacaaattcgatttttcagcggctttttacatgtttaattagcgaccgataagaatatgaagaaagatccaacaatataaatttgacctttcttacttataatgttgttacttgcattttttgtttgttttacatctaattttagagagcctaaaattagttacaacttacaaatatttcatcattttgttgtccatatgattgtacctacatattaggcctgaaataaataaccaatttcgatatagaatcgaatctgtgttggtaaaaatataattcgtttcatatactagtattagttaaaaattagacaccaaaataaatacgaaagcccaaaaaacaaaaaaaggcaaaacagttgaagaaaaatagtgggaaagactcctctgagctactctcattcgattttcctcaggcgattttggtgtatggtcgtccctttcactgtatttcttagtcaatagcatcttctccgatcatcgacgtccggagatttcttcggccctctcatacttgaggttttgtactctttactccctcaaatttttccaaaacttgcgcttcttagatttgggcgtcttcgttatttattgtaaaattcagctttatgcctcttagactagttatagatcgacgaatcagtaaaattaccttcaaggtgaatggtctctaggtatagagaatttgtcaaaatgacgaatttgattgaaacattggtaactttttttaatctcttcgttagttagttgaacttattggtttggggggaccatttgctttcatcgaaaaccctagcttgcgagggagggaccttgattgggatcgtaacctaacttactgtcactttttttatcgttcaatctttattgctgcagataggtccactaatggctgagcttgctgccgttttctttgacatatagttaattcaatgtgtaaagttgtaagctttttagtctttggttttgaggaagttagttaggaaccttctccaagtacaaaggaggaatgggtagggaagggtttgcaattacaatgtgtacatcgtgtttcttgacaagttactgatagatactttggggaaatttttgatttgaggagtgtaggaccaattcaataaatgccacttagtttttgtgtgatggagatgagaagatgaaaagtaatacccttcctctcttgccctttttgctggtctgggtgaaacatagaaaagtttctcttgctcaagttaatgataaaagggtgagagcaataaacgctgataagccttgtctggtccttggaattttgaattttctttttctatcttacttatagtattggtagttgagggtgtcgtcgataaggtatctatttgcctagccagagttatatataggattgattgtctagtcttttcttatatgatttttgttctcatttactaatcaaagttctgcaaacttgtagttgttgtaggatttgttgctctggctctggtggtaggtctatgaaatcaacccatatcgtgaatg

SEQ ID NO: 27808 - DNA, 3003 bp, Unknown; identical to SEQ ID NO: 27807
  misc_feature (1)..( 3003): 2750-1469P.txt file - cDNA_ID_2992308; gDNA_ID_1620769; Annot_ID_167429

SEQ ID NO: 27809 - DNA, 3000 bp, Unknown; identical to SEQ ID NO: 7841
  misc_feature (1)..( 3000): 2750-1469P.txt file - cDNA_ID_2992312; gDNA_ID_1974075; Annot_ID_180350

SEQ ID NO: 27810 - DNA, 3000 bp, Unknown; identical to SEQ ID NO: 7841
  misc_feature (1)..( 3000): 2750-1469P.txt file - cDNA_ID_2992312; gDNA_ID_1621167; Annot_ID_173877

SEQ ID NO: 27811 - DNA, 3000 bp, Unknown; identical to SEQ ID NO: 9157
  misc_feature (1)..( 3000): 2750-1469P.txt file - cDNA_ID_2992324; gDNA_ID_1972015; Annot_ID_177889

SEQ ID NO: 27812 - DNA, 3000 bp, Unknown; identical to SEQ ID NO: 7788
  misc_feature (1)..( 3000): 2750-1469P.txt file - cDNA_ID_2992328; gDNA_ID_1621163; Annot_ID_57162

SEQ ID NO: 27813 - DNA, 3003 bp, Unknown
  misc_feature (1)..( 3003): 2750-1469P.txt file - cDNA_ID_2992336; gDNA_ID_1621202; Annot_ID_57709
cgtttctatattaggcactgataaaagttgtgatatcagactggaaaacaccaattgcaaaaagatatctagtcaaaagacaaggcctaatgtgaaagtttcactgaatgcttttaagtttcaacaaagaagcatagcagatgaaggggttaaactcaatgttcctacactttactaaaccgggaccttctttttagatccccatgtgttcacacagtaaaatagcttgaccataaaacactatgagaagtatagtgattgtagaacagtcttactggtttgaactgtggctccttgatatcttcctaggagcctattagttgacactagctagaacgtcaacacataacacaacaagggcatctctttatttctttagctgaaaaggggtctgcaacaagccataacttatggggccttggggaactagagtaggaagatgaccttctacgctgccagttaaacatcttcccctgttcagaaccaaagaggagattacagttttaagttttaactataactgagtatgattacaatggacaaacactactcggtaaggagctacaatagcagaatttacatactagatcttggcaattcgataccaaaggccattaagtcatagttgactaaagtttattggagctggtagaccatacgtttctaaatcaaaataacacaaagcaggatcttggatcatacttatgaactaggagtctaatatgtaccgtagtagctgtgcaatcacaacagataatcaaatctaacactgacaaatatacaaaggtttaaccattacctgcggggtgatatcgaccttgaacgcgaacgagcatgctattgcctacaaattggttatcggccacgtctgcggtctgcggattggataccttcttcttggaagggacctgcatgtgtgcattcaagaaataatccatcaaatgaaaactaatacaatgtaggcagaacatctataaaattgaaacactaatgcattgagttgcatacactataaataaattgatctcatcctctaattactacaatgcagctctttaaacacaaatttatcgtcacctaagaggagaacgtcttagagcaggactgccacggatccttcgagggtaaccctccagctgacagataaaaggtgagacagtgaactgaaatggtattgaacctcagacgaggaaactgaaaccgttttggaggagaacggccgctagaagaggacactggcctgcgtatgggtgatccaccactcataggcagaggtgattatcatatttctcaatgtcagtaccaacattatcagattttaaagcatctccctttggatcacttgaaacatacaccatccatgtacagctgtggtttctcagcatcagctatttttgccttgaattcaacatatgcatctcctcttgaaagattagcctgttaatgtcaatcgaaattatgagtaaagtacttaggaaacaaatctgcaaaccagccaagagcaattgataagaaacttacagctcgatctatcgcaagttgaacatgaatgatttcaccaaaatcgcctgcacataaggaaaaaaggaacatcactgaaattggatttaagcgatataacaacattcgagcattgatttgacaatttaaatgtgtaattgtaatgagtccacttcgtataagataaccaaattaccaaatccaatctctaattaatcaaattggagaagaataagaagaagacgacgatgatcttgaactggagcgggagcgtgagcgggaaatagaccacgaaagactcgaatcttcgccatggccagattcagattctagcgcgcttgtaaggttaaccccagacccaaccctaacggctacctgtcgatttacacacaaacacacacgagtccgcacgtgacaagtcatgggttgggtaagttaactataatgaacgacaaataaataattaaacttactaaagcaaattatagtttgacaaaaatagtcttaattttcagattattagttggatatgcatagtttattcaacttttctcttaatatttttattacatgattttttttatttttggagatttatcagttttttttgttttaataatagtttttagataatttggaaaagcaatgatctctgcatcatcaatcataaaaattaaaaaaataaggcctcgtcgctatatcttctctctagggttcgctgttgctttttcatcttcttcttctccttctctgtttctctgctttcgtcacgaaagggcgatatgtattgtttctcagtaggaagctcgttactctgattcgattcgattctcaatcctttcatcaaaccgttttgggacttcggattttcatattaaggtagcgtatccgcttagggatccaattttctccgagaattgtctccttctacaatctgattctcctcgatttttccagttttcaaagcagtcaattagggtttgtagactaattcggatttggagacggtagcggttatggacgcttttggaatcgggagtagtttaaatcaagctcccgtaactcaggatcttaagaaatttggagataattctacaggtttgttcttcttttttctcggatttgttttgtttctgctcttttgaattcggcgtcttgttctctgttagattgaatctggatctagttggttcttgttcttcaactgtttaggagtatataaaacttgaattgcctcttagttgattcgttagaccttggtcttcgttagattttatttactttcattgtcttgtactcccacgaagaagattagggaagacttagttgctaatttaaatcgtgaaatgagaaaccatattatgcctgttgagattctctccgattgagcaatttccggaagaatgtttcaggtttagatcaaacttgcatcagagtcttatagtttcatctcttgtttgggcttgtctaactgaaggtttcttttgtgcaggtaacacaatg

SEQ ID NO: 27814 - DNA, 3003 bp, Unknown
  misc_feature (1)..( 3003): 2750-1469P.txt file - cDNA_ID_2992340; gDNA_ID_2214700; Annot_ID_136851
ttctcagcctgagggaaagagtactcagtagctaaggcaacagcaagaacgttcttgtaagcattgaggaacatgtgaggcgcagctgctacggttgggtaagagattgcaagagaaagcgcagtgatcatcgagacaccagctgcaaacttctcaacaaggtcgtcttcagtgaggttaagcacttcagggttaaacactgacccattatcgtagactgactcaacaacgagaccatacgaaaagggcctgattccaagcttggcaagaagcgcagcctcggatgaaccgactttgtcgcctttcttgatgagctccacaggggttatgatctcaaccgtacctttgttgattttggttggaatgttaagcacctggaagaaggaggtctgtgaagggtcaagaccagtgttgcctggttgcacgaccacatcaattggagcgactaaacctacacgagcaggagctccaacctgtcaaaaaaaggacaatgaatttctcatcaattaacagtacaagactaagttgaaaaaatcaatcaatccaacaacatgaaaggacgctacaaaaatgtgagcctaggaaactagtagactctcaagtaagtttcttgaatgtggttgcgtttcaagacagaaaatagaggttttgagttccaatttaaaccaaaatgcaaactttatcacctatccaccttacaagttaataacctaaagccataggttaaaggatgatcataaactgactaaatcatcaagtaacagtagaagctaaaaataaaccaatcaatcaaaacacaaaacagaaactacaaatgtcgtctcctcaaacctcaatgaaccaaaataactagtactataatctaatcaaccctatttgcttggaaagtgaaagtttgcatttgtgtttaaaatcgaataatacaacaccttgcattcttgcttacttagagataatcagatacagcataaaactaaccaaactaagtaataaaccaatcaatgaaaatgtaatctcctcaaagctcaacgaatcataataatctcaattagaatgtggctgcattttaagcaagaacacatatgatttcatttcaaactcaaaaatacaaactttcactttccaagctatcaatccatatttgaactctactaaagcttaacaacaacaataacatcaattgagccaaagaaacaaaccttgtacttagcaacctcttcactgacttccttcaagtcacccttagtgaagatcaacccaacattcccctgttaaatagattctaacaccaaaccaaatcaaattctccacaaaaccaaaaaatcaatactttatatccaaatgaaaacaaactattcaagacaagagaaatgaaacctgaagaagaggaaggagactgaggaaagcttgattgccagttttatcagcatgaatcctcacagatctcttcatcattgtgttcttccccatcaaaacaactgaatcacctcgtaaacctttccttatgttctgaagctgagttgatccaacattgtcagctgcaacgacaagaatctgagagtactcattcaaaagctgacaaagctttgaatcgtaaacgatcttcttctccgcctttgttgctttcaccgccatttccacttaaaaatgataaagtgagactaaagaaactaaattttggggtagagaaaatggagggcctagacgaagcttggagctcgtacaaggtggacagcgcgaattggcgctgtctctttaacctctgtaactgtttttaacagaggaaggaagagagaaagaaaaaaagctgcgtaagaatttgcttaaggttgaagaagaagtttcttgggtttatatagttatcggaagacggaaggatgaacggtcagggtttgtgggatgacctaaatctaacggcttatattatttgtagtagtatcaatgggatgggccaatattgcccaacatgtttaacattatgaatctttttcctattgggctaaaagctctttcgacccacatctcaagcccaactgagatccattcattgtaattcatactttattattttttatagtaaccaataagaaaatggttgacttaacagagaaaatggttgacccaaacaaatactatattatttttttaattcgatttcattcaaagaagcatttttgggagacgaggaggcgatccacggcttattcttaagaaaccttccacagtcgccgccgattttatcttctccgccgtaagtactctctttccctatcgaatctgaacgaaacagctcagcacattgtcatctctgtagcaaaattaagttcgtgtttttgtgttttgttgtgattctgtttaggtttcatttgggtttgaattttagggtatttttggtttatctctagtgttactgattcgggatttttgggaaagagctcaacttttgttttgtttcatctttcgttgattttgttgttacataggtttgaaaaaagggatcacttgtttggttgcctttgtttgtttgtttgattataacccaaagacttatacttttggtcctccaatttcttctgaaactacagggaattgtgagggatcaacaaatggctcccagaggaagaagaaaggtataagctgtactgttttttttgttttgtttttccaaattaaaatgctggctaacaagtaaagatatgagcttttgaatcatatagtttttagagagtatagtggaaaactaagataaaagcatagacatagacattagagtagaatgactatatagatgaagtatttgaatgacatgattgttgaagttaacattttgtttctctctacgacttctgtgtactcaacgttgagaacactgatgagataagtttacaaatacttctttttatgatgggtgttcttgtttttttccttctatgattatctctcttttctatgcttttaaattgctacttttcttttgcttttttgcagaaggctggattgatg

SEQ ID NO: 27815 - DNA, 3003 bp, Unknown
  misc_feature (1)..( 3003): 2750-1469P.txt file - cDNA_ID_2992340; gDNA_ID_2214700; Annot_ID_189637
ttcagaaaattcctcaacggagagaaattaaaaccagaaaggtagttttgatgaagaaacaaaatatccataaacgtaacaaagaaattctgaacgtgaaagttttaaaggtccataaaataaataggaaaggctggcaaaagataagacggtgtattttaaccgaacagatcaaatcccatgtccccatcagactcttctgcagcttcttcctcaacagctactgccaccactgctccaccagactctcctgaaaccggtgcagccactgcaactgcaaacttggttggatcctgatccataaatgtacagttaacaaacaatttcatgactactaatcccaatatctgaaacgcaaaatgaaagaggacaaacctttaggaactccttcacattctcagcctgagggaaagagtactcagtagctaaggcaacagcaagaacgttcttgtaagcattgaggaacatgtgaggcgcagctgctacggttgggtaagagattgcaagagaaagcgcagtgatcatcgagacaccagctgcaaacttctcaacaaggtcgtcttcagtgaggttaagcacttcagggttaaacactgacccattatcgtagactgactcaacaacgagaccatacgaaaagggcctgattccaagcttggcaagaagcgcagcctcggatgaaccgactttgtcgcctttcttgatgagctccacaggggttatgatctcaaccgtacctttgttgattttggttggaatgttaagcacctggaagaaggaggtctgtgaagggtcaagaccagtgttgcctggttgcacgaccacatcaattggagcgactaaacctacacgagcaggagctccaacctgtcaaaaaaaggacaatgaatttctcatcaattaacagtacaagactaagttgaaaaaatcaatcaatccaacaacatgaaaggacgctacaaaaatgtgagcctaggaaactagtagactctcaagtaagtttcttgaatgtggttgcgtttcaagacagaaaatagaggttttgagttccaatttaaaccaaaatgcaaactttatcacctatccaccttacaagttaataacctaaagccataggttaaaggatgatcataaactgactaaatcatcaagtaacagtagaagctaaaaataaaccaatcaatcaaaacacaaaacagaaactacaaatgtcgtctcctcaaacctcaatgaaccaaaataactagtactataatctaatcaaccctatttgcttggaaagtgaaagtttgcatttgtgtttaaaatcgaataatacaacaccttgcattcttgcttacttagagataatcagatacagcataaaactaaccaaactaagtaataaaccaatcaatgaaaatgtaatctcctcaaagctcaacgaatcataataatctcaattagaatgtggctgcattttaagcaagaacacatatgatttcatttcaaactcaaaaatacaaactttcactttccaagctatcaatccatatttgaactctactaaagcttaacaacaacaataacatcaattgagccaaagaaacaaaccttgtacttagcaacctcttcactgacttccttcaagtcacccttagtgaagatcaacccaacattcccctgttaaatagattctaacaccaaaccaaatcaaattctccacaaaaccaaaaaatcaatactttatatccaaatgaaaacaaactattcaagacaagagaaatgaaacctgaagaagaggaaggagactgaggaaagcttgattgccagttttatcagcatgaatcctcacagatctcttcatcattgtgttcttccccatcaaaacaactgaatcacctcgtaaacctttccttatgttctgaagctgagttgatccaacattgtcagctgcaacgacaagaatctgagagtactcattcaaaagctgacaaagctttgaatcgtaaacgatcttcttctccgcctttgttgctttcaccgccatttccacttaaaaatgataaagtgagactaaagaaactaaattttggggtagagaaaatggagggcctagacgaagcttggagctcgtacaaggtggacagcgcgaattggcgctgtctctttaacctctgtaactgtttttaacagaggaaggaagagagaaagaaaaaaagctgcgtaagaatttgcttaaggttgaagaagaagtttcttgggtttatatagttatcggaagacggaaggatgaacggtcagggtttgtgggatgacctaaatctaacggcttatattatttgtagtagtatcaatgggatgggccaatattgcccaacatgtttaacattatgaatctttttcctattgggctaaaagctctttcgacccacatctcaagcccaactgagatccattcattgtaattcatactttattattttttatagtaaccaataagaaaatggttgacttaacagagaaaatggttgacccaaacaaatactatattatttttttaattcgatttcattcaaagaagcatttttgggagacgaggaggcgatccacggcttattcttaagaaaccttccacagtcgccgccgattttatcttctccgccgtaagtactctctttccctatcgaatctgaacgaaacagctcagcacattgtcatctctgtagcaaaattaagttcgtgtttttgtgttttgttgtgattctgtttaggtttcatttgggtttgaattttagggtatttttggtttatctctagtgttactgattcgggatttttgggaaagagctcaacttttgttttgtttcatctttcgttgattttgttgttacataggtttgaaaaaagggatcacttgtttggttgcctttgtttgtttgtttgattataacccaaagacttatacttttggtcctccaatttcttctgaaactacagggaattgtgagggatcaacaaatg

SEQ ID NO: 27816 - DNA, 3000 bp, Unknown; identical to SEQ ID NO: 7102
  misc_feature (1)..( 3000): 2750-1469P.txt file - cDNA_ID_2992345; gDNA_ID_1621127; Annot_ID_172357

SEQ ID NO: 27817 - DNA, 660 bp, Unknown
  misc_feature (1)..( 660): 2750-1469P.txt file - cDNA_ID_2992353; gDNA_ID_1620639; Annot_ID_47456
ttcatttttcttctttgaatcgaaaatatacttctttaactcttttctttcttaggtatatatagatgaaatattcaagactttgatcgatgaagattaatgatctcttgaatgatacttttatagagatgcaaatttcattttggataggaattcatcatcacatagatattttactcaatacgtgttggccgacatcgtaaaagtaatatattcaattcgtaattgattaagagtcacacacacatggcaagtaagacgtcggtgtagtagtggttagcgaccgacgtaattttaacttatatgggcctgtgggcctttagatatgaaaggcccaataatgcatatcttttactaaactaaaaaacgatgtcgtttggtatgtttcttccacctttgttgttcatcttttgattttttgaaattgttagtaaagaaaggaaaaaagctttgatttcgatttctcaagctgtgtttttttatttttcttcttcgcatcaggaaggaattgaaaaaggtatgattttgaagctttagctctcatttatctctgaatcctaatgcttttttcatgctgttgtttcagatttttggtgttaaaagatggatccagatgcagtcaaatcgactctctcgaatctagcatttggaaatgtaatg

SEQ ID NO: 27818 - DNA, 3003 bp, Unknown
  misc_feature (1)..( 3003): 2750-1469P.txt file - cDNA_ID_2992361; gDNA_ID_1620634; Annot_ID_47332
gtaaacatcaagtttagcatcaacatctggtaatccaactgggcgtacaaaattagatacacatactaaattggcaaaattcttgcagatagcatcccgcttcaggataaggtgcatcaacgttgaacagatgatacttgtgaaaagtctctggagttgaggtggtttgataccatcggaccgttatacttcggtttaagatcagtaatgagacatcttctaactgtgtttcttgaacaagatgctttcaaacggttactgccttggatactcatgcacaagcccttctgaaacactccttgctctagcatgtccgaacagcttgctaacaatagccagggaaaatttggtaacagttgcgagccccaaacttgtaatcacgtttccatctataacaacttcggctccttcgatcatttgttgattcataggctcgtctgactctgaaggatacacagtcgttctcttctcctaaaataggattccaattgtttatggcgtttgtccatgtatatgacaaagaaaagaacaatagttgtcttcaccttaccttgagtaaaccatgtttatgcaaaacggtagatgaagagttggtagctccatatattcgcccagattcatgttgttccctgagcagtttcttgagaattttggacttctgcagacgttctgagccagtatggcctcccttgggaatttccatcaaagaaaagaaatcatattactcaccatggaacaaccaacagttgtagtttgtctaaaagcttttcctaagcgcattgatttgacatggcatataagttatactgaaacatgtacatagcaagatttatttaagaagaagtaaactagcgaaatggtatgagtttattatgagactaggacatgcagggttttgcttaaagccttaccggaagaatgattagatcatatgatgactcagcagcttcaccaatcaatttgtcagtgataattttggtgccttggaatgccgtaatccgcaaagatcgttcaactgatgaaaccgtgacatctactttggctcttctaagaacatctgcaattgagaccagttcaaccgcttcagacccgttggctaccgggataagaacctggatttagatgcatcattaaaacaagtttctcagctttcaaactaaaatgaaatgttcttagaatcagctaactttttcatctttcaaaactaactgagcgtgaaaggagaaggaatggataaaagaaaaaactccataggtatagaagataaaaccaagatcagttctcatcatatatcatgagattacatggaaatgcattgatcatagcttcatgcgacttacacgaggtgtgtggtctaaagaccagtcaatgctattgaactctttgttcttaggattctggtaaccatcacgcagaagctggagaaatgattggaaaagaagactatgagaagattgttgcatatcgagaaggataaagaaaagcatgatccagaaaagtataagtgaataggatatagaccagaaactcttcaattgacttggctgtggtttctccgaagagctgctccgccaaggaaagagcaaactggaaagaagtgccgggtccacggctagttgtaagctcccctgaaatctgaatgtttgtcttaacagcccagaatgtaggaagcttcccgaaaaaagcaggatgtcccgttgtcttgcacgatgaactacaccaagtttagaaatcaaaacatgaagagaaaagattagttactagatgacatcaaagattttgatttataccctctttcttgtcaaaagtccccatggaagaagagtaatagctggagccatggatatagccccgtataaccgcttatcttcagcttgtctcttcatgatcttctcgagaatttcacagtctcttaacctaacagcaccaggcatgcctcccttcacaatttgtatttccagaccatccagaaacaaatacacaaaaccattaaagtaaagctcaaagactgtcctcacttatagtttatgaatcagcaaaagaggaacttaccggcaaagcaactaaatcataaacttgatcagcacatttcgagataagaacatcagcaagcaatctggtccctgaggatccttcaacctctagcttctgctccacagaagcaacagtaacatcagcaccagctcgccgtaaaacatcaactaacacaacagcttctatttcctccgtcccatatccaattggaacaagcacctacatagtttctcagttatctccaatctcaatctctctacacaaacaagctggacaattttagttatagataacaagaaaaaaggagaaacctttttagtagttgcagaagacccgacgccaacatcggaatctagcgttgttaccatacccggagacatggaagatctaagctttaaagttcggtccctccttgttgtccctagtgaagaagaaactacagagactgaagaaaaactaggagcaacagtcatcgagacacaacccatcgaagagataagccttgactccatcaaagttggactcagcgaagctatcattgaaatcgaatatcctaaagaccccattgacgatagctaatgcagcagtctgataatcccgccgctagacggagagtgagttgcgtcttatctactagtatacacttcttgaagaaagctaaaaacgtcgtcgtatcgttgtcttattgcttgattggataaagcttcaattttttcctccaatttttgtcgaaaatgtaacattttttttgctttccactgtgagattgtcacacacgattctctaaagaaatgagacgaattttgaaaacgatttataaaaatagtatttttgtttccttgagcttatctcctcttttctctttggtttgagatatgaattacagacaatcaagtagtcagtcacaacagtgtgtataaatatgtcttttaagtgaaatcggtttcgagagacagtgagacgaaaatg

SEQ ID NO: 27819 - DNA, 3003 bp, Unknown; identical to SEQ ID NO: 27818
  misc_feature (1)..( 3003): 2750-1469P.txt file - cDNA_ID_2992361; gDNA_ID_1620634; Annot_ID_162835

SEQ ID NO: 27820 - DNA, 3003 bp, Unknown; identical to SEQ ID NO: 27818
  misc_feature (1)..( 3003): 2750-1469P.txt file - cDNA_ID_2992361; gDNA_ID_2926206; Annot_ID_202227

SEQ ID NO: 27821 - DNA, 3003 bp, Unknown; identical to SEQ ID NO: 27818
  misc_feature (1)..( 3003): 2750-1469P.txt file - cDNA_ID_2992361; gDNA_ID_2926238; Annot_ID_203937

SEQ ID NO: 27822 - DNA, 3003 bp, Unknown; identical to SEQ ID NO: 23623
  misc_feature (1)..( 3003): 2750-1469P.txt file - cDNA_ID_2992369; gDNA_ID_1620704; Annot_ID_165194

SEQ ID NO: 27823 - DNA, 3003 bp, Unknown; identical to SEQ ID NO: 23623
  misc_feature (1)..( 3003): 2750-1469P.txt file - cDNA_ID_2992369; gDNA_ID_2926204; Annot_ID_202086

SEQ ID NO: 27824 - DNA, 3000 bp, Unknown; identical to SEQ ID NO: 4735
  misc_feature (1)..( 3000): 2750-1469P.txt file - cDNA_ID_2992375; gDNA_ID_2926149; Annot_ID_197949

SEQ ID NO: 27825 - DNA, 3003 bp, Unknown; identical to SEQ ID NO: 21110
  misc_feature (1)..( 3003): 2750-1469P.txt file - cDNA_ID_2992375; gDNA_ID_1621141; Annot_ID_172830

SEQ ID NO: 27826 - DNA, 3000 bp, Unknown; identical to SEQ ID NO: 4735
  misc_feature (1)..( 3000): 2750-1469P.txt file - cDNA_ID_2992375; gDNA_ID_1620725; Annot_ID_165929

SEQ ID NO: 27827 - DNA, 3000 bp, Unknown; identical to SEQ ID NO: 21113
  misc_feature (1)..( 3000): 2750-1469P.txt file - cDNA_ID_2992379; gDNA_ID_1620742; Annot_ID_166509

SEQ ID NO: 27828 - DNA, 3003 bp, Unknown
  misc_feature (1)..( 3003): 2750-1469P.txt file - cDNA_ID_2992383; gDNA_ID_1620844; Annot_ID_50930
tacaacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatggttggaatggtagaggagggtttaggcgtaaggtaagagaaaatgggattgaacccaatttgcatacttcaaattctctggtgagcttgatgtttcattgatttgacaaagcatgtatttgagattgtgggcagttgcaggatcagactacatgttacttacaacaggcatgatcaaggagtattgtaaggtagggtagagaaatgatatgacaatgatgcaggttttgagtattgcctagctttgtatcaagatttggatgagaagtgactttcaggcttgtagtttagtgattggagattctgcaagaagggaaaattacatgaaggttatgtggtttttctgcaatatgattcgttaaggaggccaagccaaatgtagtcaaatacaccacgttaatgattcatccgtatggggacagcttagatttttctgtgtgttgcatccaaagatgtactgtgtacccaaattccgagttcaccaaccagggatgaatgatactgtgtacctaaattccaaagatgtactgtgtaccctaacagttttcgtctggttaggagataatcacttcttgaaagcagtttgaatgtttctcaaagaatggtcatgtactacccacgttttttgtttggttatcttggaggtaagatgagctggtgacaattctgtttttggcttatactaagattaacgtggagctagtcctttgctttacggagctttgataagatgttttaggatttaattacccatcaagaagataatgagggagaaaaaggctaaagagattcattcgacttgcaaaaccatggttggaattttgtgcacatagtgattgaggagagagatagaaagtgaagggactttaaatgttagacccgttgaaactagtggtgggcctgtgaaggttgaggttgagggaagagccagcctgcccaaaagaaaaaatatcttgtgcaacttgtgatgcttggtagctttggtcctacatgcttatccagatatttgcagagaaagaaacatcaaaaggttagccacattataggaagaactaaaattttctaatgctattttgctcaaataggtgtttgagagctctgttcatttaataatgtccatatttgtggctatgttcactgaattattaacagggaaagcagttgaaagatagctaacatgatgtaggggttttggtttttaggaggcaaagaggctttcatgggaccacactggatgatagttgcaaaatacattgtggttaaggtttgtctcttgagcacatgttgagactgggatactcttctgtgagaacgcattaatagctgtattaagtgttgatagaatttgtggacggtaattcccgtgacatttatggaggtatctgtgatgtttttcctattaaaaagacaaataaggagacccaaaaaaggtgagaacaactatacacacaaagaaatttcttttgtctgaagacaaagggagtggtcaatgaccagtactcccctatatgttgggttaggacttctactcattttgcatcgttgagatactatactgccttgaaagacttggtattggatg

SEQ ID NO: 27829 - DNA, 3000 bp, Unknown; identical to SEQ ID NO: 5271
  misc_feature (1)..( 3000): 2750-1469P.txt file - cDNA_ID_2992383; gDNA_ID_1620775; Annot_ID_50283

SEQ ID NO: 27830 - DNA, 2251 bp, Unknown; identical to SEQ ID NO: 5260
  misc_feature (1)..( 2251): 2750-1469P.txt file - cDNA_ID_2992383; gDNA_ID_1620775; Annot_ID_167707

SEQ ID NO: 27831 - DNA, 3000 bp, Unknown
  misc_feature (1)..( 3000): 2750-1469P.txt file - cDNA_ID_2992383; gDNA_ID_2926205; Annot_ID_141709
acatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatggttggaatggtagaggagggtttaggcgtaaggtaagagaaaatgggattgaacccaatttgcatacttcaaattctctggtgagcttgatgtttcattgatttgacaaagcatgtatttgagattgtgggcagttgcaggatcagactacatgttacttacaacaggcatgatcaaggagtattgtaaggtagggtagagaaatgatatgacaatgatgcaggttttgagtattgcctagctttgtatcaagatttggatgagaagtgactttcaggcttgtagtttagtgattggagattctgcaagaagggaaaattacatgaaggttatgtggtttttctgcaatatgattcgttaaggaggccaagccaaatgtagtcaaatacaccacgttaatgattcatccgtatggggacagcttagatttttctgtgtgttgcatccaaagatgtactgtgtacccaaattccgagttcaccaaccagggatgaatgatactgtgtacctaaattccaaagatgtactgtgtaccctaacagttttcgtctggttaggagataatcacttcttgaaagcagtttgaatgtttctcaaagaatggtcatgtactacccacgttttttgtttggttatcttggaggtaagatgagctggtgacaattctgtttttggcttatactaagattaacgtggagctagtcctttgctttacggagctttgataagatgttttaggatttaattacccatcaagaagataatgagggagaaaaaggctaaagagattcattcgacttgcaaaaccatggttggaattttgtgcacatagtgattgaggagagagatagaaagtgaagggactttaaatgttagacccgttgaaactagtggtgggcctgtgaaggttgaggttgagggaagagccagcctgcccaaaagaaaaaatatcttgtgcaacttgtgatgcttggtagctttggtcctacatgcttatccagatatttgcagagaaagaaacatcaaaaggttagccacattataggaagaactaaaattttctaatgctattttgctcaaataggtgtttgagagctctgttcatttaataatgtccatatttgtggctatgttcactgaattattaacagggaaagcagttgaaagatagctaacatgatgtaggggttttggtttttaggaggcaaagaggctttcatgggaccacactggatgatagttgcaaaatacattgtggttaaggtttgtctcttgagcacatgttgagactgggatactcttctgtgagaacgcattaatagctgtattaagtgttgatagaatttgtggacggtaattcccgtgacatttatggaggtatctgtgatgtttttcctattaaaaagacaaataaggagacccaaaaaaggtgagaacaactatacacacaaagaaatttcttttgtctgaagacaaagggagtggtcaatgaccagtactcccctatatgttgggttaggacttctactcattttgcatcgttgagatactatactgccttgaaagacttggtattggatg

SEQ ID NO: 27832 - DNA, 3003 bp, Unknown; identical to SEQ ID NO: 25590
  misc_feature (1)..( 3003): 2750-1469P.txt file - cDNA_ID_2992387; gDNA_ID_2214506; Annot_ID_184123

SEQ ID NO: 27833 - DNA, 3000 bp, Unknown; identical to SEQ ID NO: 11996
  misc_feature (1)..( 3000): 2750-1469P.txt file - cDNA_ID_2992390; gDNA_ID_2214527; Annot_ID_134175

SEQ ID NO: 27834 - DNA, 3000 bp, Unknown; identical to SEQ ID NO: 11996
  misc_feature (1)..( 3000): 2750-1469P.txt file - cDNA_ID_2992390; gDNA_ID_2214527; Annot_ID_184785

SEQ ID NO: 27835 - DNA, 3003 bp, Unknown
  misc_feature (1)..( 3003): 2750-1469P.txt file - cDNA_ID_2992396; gDNA_ID_2214533; Annot_ID_134326
ctattttatttatgtgacagtttggatttgttgagagtatgattctaatgaatttgataattagtatcctcttactgcaatagtaagaggtatccttttttttgtcgcaaaggtagattacttgttatattagatattagcacaattacaactgacttgcagaaagtcagaccaaaaaatgagatcaaggggcacaagaaacacccactaaaaggtcaaccctgagaatccaaaaattaacagggcaacaaaagaataagcctcccaaaaagcaaggagcctaaaagcaaaaagacttcagtccacagaggttagaactctctcatccctaaagacaccaagaagccaagcaggaaaacttacggccacgtacgattgaagcctacactccttagtaacactttgggcaatgagattagcacctctattcgaagacaccgattcaagcaccactttccaaactgcaatgccatttaaagctaacaagatctccgaagactgaaacctaaaagaaggccaagcttgcggcctgtttaacaccccaacaagcaccgcagcttccacaccaaaaaccaccctattcacatgatgactaaccatactctcaacagcccaaacaatgcttagaaattgagcctccaaaaaggaggaaatattggagaaggctcttctactgtgcatcaagacattgcctctgtcattcctcaacacccaagcaacccctgcaagtctagtaagaggtatcctattttgtacaaaaaaactattatgattttgaattaccaatcgaattaaatttaaatcatacaagcgatcaaattaatatttgaatcaaaatttactaatttataaattagctgaaaccaaaaatataattaaattgaaaagcagccggtagtccaatgatcaatgtttgtttgtctttaattggcctgaaaataataaaactattttatggtaataatgattggtcattgagtaaatttccttttcctaaaggggaaatacaaaaggagacctttgtggcggagaatataaaatgtggaagataaaagtaaaacaaaaaaggaagtttttttttttcttcttcatgattattaatgaaagactttttgaatgacaatgacaccaaaaacaaaaaagcatataaatggtggtggtggaatttataaaggagttggggcctaatcacttactcatgcttttattctttaccatatcacatccatctaatctcttaaaagtaaaattatatcactgtctaccactgaatatatgcttagttataattaagttgacttgttgttaatcatttctattatcttcaagttatacgtctcaaaatttaaataattgaattttcacaaaaaaaaaatctatttgtaaagtatcagtcagtatgcaaatcaattcattttaactttttctgaacaaaaatatttctatcatcatcattgtgtttaatttttttccaaaacactcgattacaatctttgtatagcttttaaactcttaacatagccatatgtaaatagatatccgacattttaaaacccgtaagtacacagattatctctctgaactgattctgtttagaaactatgcatcttttactagttaacttgttgtgaattctagcactatgcatctttattggcttaatacagtgcaatggccaatatatatttttcttttgtaacatagtgtatcttagttttatatttcgttgaatgaccttctagatgattgttacactgattcatctccattctcagcgtcttgtgataaatcttcaatttataatgtccaacatttaaccatctataaaagaactaaacacatcgaaatagacttctagctatatatgtgatttagaaaaagattcattgtttatgttccaaaatattcatatcatattgttaatatacgaacaaagtctttgacatttcctcttatagatcatctcttatccaagatttcttcgtaatatactaaaagaagtaatcatcattctagtttattatgtcgccaatgttttcaaacttggataattaatctgtttgtttggtaccgtgaaacaaattttggtttatttatcaaattacagtaaaattcttaatatttttttttccaacaatcaatataggaataaagctaacagaagttggttgaacaaaactaacaaaagctcaacacaattaaaatgaattacttggtctgaatcgaactattaccttttggaatatagttagttaatgttcacaatacgaatacaagttggaaaaaacggaaagaagaagatttggcatagatactcactcactcatacacttagatatttttctgtctagctactttagataagaataagagaagagagaaaatcaaaaacaataaaaagaagaataattgtgaaaaacaatgtggattgtcaaatccaaacttaattgaaaatttgaagagtttaagcgaatggaagcaaaggaagatctttgagttgggccatagagaatctatgctcaccacatgtgcctttctttgcctttcctccttcaatatacacgagtatttggggcaacacataacaacacataacaacaacaacaacaaaaattacacaaacaaaaacatttcataataataacaaataatcattcaaaatataaatataaaatatattagtgggttccatcgccaatagaccaccaaacagcgactcttctttcttacatatctatcttcacaagcttctgaggattgaaaccaaagaaagaaacgtacaaacataaaacataaaaactatatattataaattaaaaacacttctttttcataaaagcgactacacggttttcatttctttgtcgtaaaaatcccatttccagctttaaaaatttcacgctttgtttttgtttatagtttcttgtatgaattttattgattggtgttgtggtttggtttacttttaatttcgaattttttataactaaaccggcgacgatg

SEQ ID NO: 27836 - DNA, 3003 bp, Unknown; identical to SEQ ID NO: 27835
  misc_feature (1)..( 3003): 2750-1469P.txt file - cDNA_ID_2992396; gDNA_ID_2214533; Annot_ID_185001

SEQ ID NO: 27837 - DNA, 3000 bp, Unknown; identical to SEQ ID NO: 12436
  misc_feature (1)..( 3000): 2750-1469P.txt file - cDNA_ID_2992404; gDNA_ID_2214551; Annot_ID_134671

SEQ ID NO: 27838 - DNA, 3000 bp, Unknown; identical to SEQ ID NO: 12442
  misc_feature (1)..( 3000): 2750-1469P.txt file - cDNA_ID_2992404; gDNA_ID_2214551; Annot_ID_185561

SEQ ID NO: 27839 - DNA, 3003 bp, Unknown
  misc_feature (1)..( 3003): 2750-1469P.txt file - cDNA_ID_2992408; gDNA_ID_2214610; Annot_ID_135735
gaaggaagtaattcttcattgcaacttaaaacagctttagacatgagtttcccaagccaagcatgatagagtagtccccttgatccgagccctgaaaatacccagaagttgcaaaactgaccagcacctatgagctgattaacacatcccaagagcggcagtgatccatggcttgtgacaggtggcattgctctcaagcccgcccttgctcccgcaaattcccacttttctatgtctggataaactgcacttgctttcggaagaagctcgttgagagctcttgaagcttcctctgctgggacatccgatgaataatttcttgattgccattcccatgtggatcccatgtgcagattacggggtccctgaaccgcgagccacgcatctgacaagatcgaaggtccatcgtccgggtaacttcctctgcattacataatttaataaagaaaagcttttgaacaggaaaaaaaaaccacaaagataagtagctgagctcaacatagtaatgtgcgagtatgcgactacatcaacacatactttctttttttggaaggtctcacactaaaaaaaaacagagaagaattgtacaattgaaagaggatgtaaagttgacatcagagttgaaaaagaatactaggaatggataactataggcgcaaggtctcgcaatacctggcactctcgtgtaactgcatatgagtaatgacacctcggcatgtccttaaagggagctttccagtaagccctggaagaaagtctaccttggatccaagacatattactactgcatcatatcctcctacatataacaacacaaaagctgttcatactaaatttctgaccatgcggatgagaacctcagagaaaaagcatggatactatactcttggattgttaacggctatctaaattgtgtttacggtctctagatttaagtttatcacatcagttttcatgcctgtgaaacttgatccaaaaggactagttgtggttggaggatgtttctataaagcttacgcaagttccagaattaaacaaaaatataagaatatagttcaaaatcattcaccttcaagttcaagcacatcagttatagacttgttcaccaaagttatgtttttccttcccagtgatgtttttgctgagctctggcatgctagaaagagtgcctagagaagggagaaaaactcggtaaagaaaaacgcaaaagcttggtgctaacatatttgtgttgtcttaacctggagatatcggtgcggattaacattcatagctcctggaaaatagaaggcgcagttcaaaggcaggtatagattggggacgagattttgtgcaccatctttgtcaatagtctctactacacaactagcaagacagtttcgagcattctaatcgcataagtaataaacagtaaaactacgggtttagttaatatttcaaaggtatctaagtcgagttcaaacttacatcactcattaaatctaaagtcttggcatttgttgctggtctcaagattcccctaaagcaagaagaacttggtcaaactaaagtatcattgaatgaacatttcaagttattagtgttattgagattggtaccttcttcgaaccataaaatttccgaaactctcgctaaagtctctgttctccgtagattggtaactagaagaagcagctgtttcagccacatttaagagctctaaacattctctccaacactcagcaccatgccaaagtagctttcctacataaagtaagaatctttatgaaacaatacaataatcaccaaaggggacaatttcttctacctttaggagaataaggatggaggagtcctccagaaacaccagaagcaccacctcctatgccaacttcatcatatacgtcaacacttaatctcagctcttttggactctcctgcaaaaacaacacatattttaaattcagaagcaattatctcacaacaacacaagaacaaaatcaaatttagagatttaaccttaagcaggtgccaggcaacagagattccagcaaaacctgcaccaaggatggcgtacctggaggaacaagaagaaactctaaaaatcacagtgagaaagatagagagaaacaaatgaagagagctaacctaagaggaggacggttgggaagagagagagacgccgaagaacaagggtgaagaacagcagtgatcatgtctacacgccaatgcctttggattccggcaaatgcttgttttgcctgcgacgagttcgttatatcggataactcagttacctaccactactgtaaaggaacctctgattcatctagagggtcttcttctcagggacaaatattggtttagatcggtacaagaaaaattctacatgattctaaacccggttgagtacattggattcgataatccgatgcgtatactacacgttaaaaagtacattgaattttggtttaggccttttctccaattagtttattttctgagtcagacaaggcgttacattattgttcgcctttttagttttattttatccattttcgcaaacgttaaaacttaaagacacaacaaaatatataaaacggagatatgattgaggggcatatttgtcattttcttgtgatcgttgatttcgaagtcgctataagagtataagtagcagccttgaaaagtgttgttcatctctcgaagtaaaacttttctctcagtgatcggataaaattctcggcgaagaagtgaagtttccggcgatcagaggtgagttttccgttagatccttatcctagttgctacttgtgtgacttcgttgattaattttgatctgaatatcaaaaatcgggttttaagattctccagagtcctgatttttctcatgcacatgatcttccaaaattcatagggcttatgcaattgattagataaggatcattttaggtcaaaatctggtaatcacgtattgatttacttagttgtttgcattttttgatcgttttgaaaggtgatatg

SEQ ID NO: 27840 - DNA, 3003 bp, Unknown
  misc_feature (1)..( 3003): 2750-1469P.txt file - cDNA_ID_2992420; gDNA_ID_1620814; Annot_ID_50638
tgtttttctctgctaatttcgtcaagtatcgaataatgttcttcgccactttcatatttattaacatttttggggtttggtcaggtgaggacgatagtgaaaccaggatgttctcaagacgtattgaaggcagcactgagtgtgatggcttcggtgactgatgttcttactactatttcttcaaatggtggtcaatgatttgcttaaaacttaaggacaaagctcttatgaatcacacacgtcgtgtttgttctcttctttttgttttctttcttttgagatgtaacttttgttgtattttttaagttattgagtttggaaagacataaaaattgaaaaggtttggattatagaggcgctatttcaccatatcaatccttgtccaacttttatttttcagtttcactattattacaaactttttttaaatatgacaattaggcatgcatgcatgatgcatatagcaatagcatcgcttgaacacgattttgtttacaaaaagaatcattaaaattttaagagttacatttttaatcttaactacaccaaaatactagaaatacagtgtatcttgcaaactaactttaacaaccaatgacgtgtcatgttcccaaatcccagttataaattttgatagatttttgacagtatcttaggtacagctttggcataaatacacttttatttattttaaaaactatctttagcctaaatacattgttagttatttaaaaattagaaactaaatgaagaaattatttagatattaagaaatatttatcattaaaagatattagattttgtcatttttttatattagtaaattttctttgttcaactaatgaaattaataactaacagattattttgcaaaatgacaaacctataaaatatatattaatatttgattttcaaattatcttgcaaaatcattcaaaaatttaactaaatttatattaatgttgtatttgaatttttcttataatggtgagatactgagattatccttgattagaattgattgttacttttttttggtaataatatgttgtctattattatatatatatatatatatatatatatatatatatatatgttgaaaataacacaaaaatattcacatacgccaagcaaaatagaatcatgaataatttgccaagaaattctcaatttgattcatcttccatcatcaatgatttacctttagaccttctcgacgagattctcttcagattagaacccaaatctatggctatgatgcgatgcactaacaattctatcaaatcatatttaagtgatccaagatttggaccggaatatccttcatgggtcagacctagtttgtttaaccttggtagctatggcgctacttatgtatgttgccatcctttggtctcttcatgcgattatatgtcaccgggaaatggagtagaactgtttgatggtagtgcggattgttacattttcggctcatgctctggtcttctcctattgtacattggttgtctctttgttgcaaatcccttaacaaaaaggtttcgaatcctggatcattctggatcaaagcttataccaatgatagttaatggtggacttaaaggtcttagcggaattagttatcctggaggtaatgttgcttgtacggaacgagcgatgtgcgttggatttgcggtaaatcgaaatctaacaaccaagagattcaagatcgtgggcatactcgagatggaaaacgtatacggattcgagatcaacgaaggagactcttggagattatcggaaacgagtatcaccactagctcaaaaagtgatctcactacgcggatgaaacctgtttacttggacaacactcttcactggctgagaaacgatggcagcatcatgtcttttaatcccgagacagagcaagcatgcttgattccttccatatttcatcgggaaccggatacgaagctacttttcgcggaaagcgttaagatcaatcgcctgaccctaatttcggggacgatagaaacaatctccgtttacacacttgtcgagaatcacaaatggacactcacaaggcggatcaagaacatatctatcgaggaagaaacgcttgtatattggaacatagctatgtacgatggcaagtgtcttgtggtgagggtgaaaaagatgggtttagaacctttggcaagtgttcttcatgtgtacgacatggaagctaacagttggggagttttggtgtcaacccttgcttggcccaattgcgtccgagatttctataaattgacgccctccttgttctttgtagaggaggatgagcaacagaaggtgcttgttgcttctaatgaccgacgcatctcctatataaattcgattatgggactcattgataccaccaagtaaacatttagggcctatagattatacaaaaaatgtcctgatttataagaatgtttgtttcccatttgcttttatcattgcactattatggtttatgtatttcaaatctaaaaattagttgtatattactatttcttttgggacaaaaaatcatttaagacaatgttgtttaagaacttgttcttctctggcttgtcaatttttcgtcctgcccaataaaggcccatcttgtgtgttttgtcgaatctaacaacaaactcacaccttttgaccaaaaaacaaactctccccttttttttttcctttcgtgtagctaaaccgtctccggatgttgacaaacattggttattcactttttccacgtcacacttaaaaacagaacataaaaaaaaaactaatgacgacgctccagttttgaattttgaaaaaagaaaaaaagaaccgttgaaaaaacatgagtgctcaaagagggaatatacctttttaataatctccttcctatttaaaccaattctcgaatctaattacatttcctctctctttccccaaattgaaaacaaaatctgagattcgcgaaggaagaagaagagttgtcttgagagattgatagagatg

SEQ ID NO: 27841 - DNA, 3003 bp, Unknown; identical to SEQ ID NO: 27840
  misc_feature (1)..( 3003): 2750-1469P.txt file - cDNA_ID_2992420; gDNA_ID_1620814; Annot_ID_169178

SEQ ID NO: 27842 - DNA, 3003 bp, Unknown
  misc_feature (1)..( 3003): 2750-1469P.txt file - cDNA_ID_2992426; gDNA_ID_1620761; Annot_ID_50005
ataatcttaatccttcatacactggagggtactgtctaactattttaaaatgatctaaaatgatttcatcgctaattcaacgcctagaaaaggcaactaatatcagcatcgacatggagacaataatcttgaaacctgatttgtcccacaagttttggttgctagaaagatcagcttcatgctgtttttttgcagccaattgctcgttgagtacttcttgtattgccatatcgtttcgctctcccatctagcatcgcacagaaagaacagctcaaattggtactgtattcataaaattactatccctagtaaaagcaagtgagtttaccttttgaagttttcgagtttggatgcgtgtttcgcgtaggcaaaattctaacttcagcaccttcttcttcagctcctgatcaattctcctttgattctccacctgatccagaagaacaaaggctttactacataaaaccaaaaataaatcacagaaataagagatgctaaagcatgtgttgttacctgatcttctaattcctttgtcttaaacgtccaatgagccgacataatcttcagttcatctctgagagtctgagtcttgcaatatcatcatctttagccgtcaaaagttatttagcttcggagttaccgagcctagggcttcgaattttgtatcatctaaagtaacgaatccttcgctaacctacgcatctggcgcagtaagctaacttgctaggtttgactgtagcgcggcaaaatctattcgttcaaagtgtagaaagccacgtgtgcatagtgtttatcgttagtggtcgcacactaataatcttcttgtcataaaataatgttgttgttcgttttattgccgcagacgctgccgctgccgcaaccgcaggtttatttgttcgttttgacgccgctacgataattttcatgtaattcttttatttacttttctagttatattctgaatataaaaaaatgtaatttaaatatatttacatccataaaaaatatttgtttagcatgtaatagtttttagctttttttggtaaggagtaataattttaaatattagttttctgaaaaatgcagaaacgattttaaatacaaatggaacaggtaaaggattgggataaaccatctttcctaacaaaatctgaactcgtacaatatagaattcagtcttgtttgatacaaaaaaatcataaaaagaacaaagcaagtgcaaaaattcttagaagagaatgaaaaaaatggaaacaactcaatagccacctttgagatcgttgacaacattgggaatgggagtgacagtctccaaggtcataccttcaaccatgaaacaaggtttaggacctttaggttgtctcttagtgctaatagtctcacatctagctttagcagcagtcttaaacacatcgttttgcttcttcctgagactaaactcatcatcacaccttgactgttgcagccttaagcacatcgttctgcttcttcctgagattaaactcctcatcacaccttgactgttgcacatgctccacacgtacatgtatcctcttccttataattctgtgcttaatctaaaactcaacccaaaactcaaaattagctctccaagagattcaactaaatgataaacatcaaagtcaaaatgaaaacatcactaagaatcatagtagattgattgcaaattatacaagtagcaaaagaaggacccaagaagaaaagcttgaagctttcaaaccaatactaatcacacatcacaaaattcaaaacagatagctcacacaagacaattaaaccccaaatcaaagaatcaaaataacgttcaaatcctaatttcaacaatcaaaactcttccaaacagatgagaattttgagtaatcgaaacctgtttgttgacttcaacaccaacggcacgcttagtgagattccagatacgaccaatacgactatggtagaacttatgaggaatacccttgtgaatagctccattaaccttgacatcgacgtaatcgccgaccttgaaggttatgaggtaagtggagagtggaatataacccttcttcctgaatggtctcgcgaacagatctcttgttcttcagggtcaaccagagaacttctaaaacaaaacccattacttcgaaatcgccgagtttaattcgaaatcgctgagctttactttttcagatcgaaatcgtgtaaaagagaagaaaagtttcagatcgtgaatgtgttaggttttagagttaggttttatcgtgggtttctaaatatgttaagggtatttctgtcatttggcatattaatcgcagttttttaattttaacgctgaatttaatcagcgtttaatttttttcgccgcataacattgcgtcggccgcagcgttttgccgcagctatctgcggtagtgaaatgaacagtttcatctgcgtctaccgcagctgcaactacctgcggcgacgaaacgaacagactaaatataaataaacataaaaattaaaagcacaaatgaattttagtatgtgtaattatgtatagtagtaattactcatcaatcatcttaaaaacctttttttctggtgatttctagttttaaagtttttacctatgattttgtcttgaggatgtctaggctttacaatatattgaaatatttatacatttaaaataaaatctataaaactgaaagaaaataattaatattctgaacttcattttttgcattttgtgtataaattaaaaaaaaaaaaaattactgctacgtgatttgttgaaaaaattaacacgtggggtgttttatttttgattacatgaacttgtgaaccttgtttctgcttacaaaaactgaagagcccatttcaaacaaggcccatattctgattgagcggccctattttaccaaaccacctactaatgaacactctcaagtcacctcattcgagttggaagttccctttaaaacaattattttcagacacagagagactcagacaggagatatg

SEQ ID NO: 27843 - DNA, 3003 bp, Unknown; identical to SEQ ID NO: 27842
  misc_feature (1)..( 3003): 2750-1469P.txt file - cDNA_ID_2992426; gDNA_ID_1620761; Annot_ID_167151

SEQ ID NO: 27844 - DNA, 3000 bp, Unknown; identical to SEQ ID NO: 8244
  misc_feature (1)..( 3000): 2750-1469P.txt file - cDNA_ID_2992432; gDNA_ID_1621202; Annot_ID_57693

SEQ ID NO: 27845 - DNA, 3003 bp, Unknown
  misc_feature (1)..( 3003): 2750-1469P.txt file - cDNA_ID_2992438; gDNA_ID_1620617; Annot_ID_46914
ttttaaccgaaccgaaccgatccgaaccaaccgaactcaaaccgacccaaactaaacccggattaacactaaaattattcggttaggcttcttctcaacccaaatagttcggtttaaaaacctttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctaggggtaatggaattgattgattaactcagctgcttgattttgccctaaattttagggtttttacattaaaagttcgttaattttgttgagttttgatttgggtttttagggtctctttgaaaaatcttagctttttctctaattttttattctttctgttaaactgtagaaccgagtgttgcagctgaggagggacatagccgtggatcttccaaagaggtaaactttagatgcttctcagtaaatgatgagactttaagtccttttttgttgaatggtccgttacttttgtttctacgctgcagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcaggtaatcagtttctgatgcatactgttgtgttttcataaagtactaatgagctgcatgatgattgttttattgctatgggctggtcaatctctataatctgaaataaatgttattatctgttttcgataatctaggtgggtttattaaataattgtggtggttctatccatatatgcttaatttgtcttacctttgtgctcttgttgtgtacctatacagtctgttgatggtcagcacattatccttcacactttgaatgtgaagtgccttctgcatcactatggaagctatgactttcttccaccaaggtaagattccaggtcgtttatgcatcacaattctcatttttcaaagactatggaataagttccaatgggatcttcttcgttatctaatcatttctgcatgtatttgggatgctgattcaaagtgtgatatatggcacttttcgttgattaatcaagaaccgttcgtataaagatccaactcttatttagtatgaaaatcagaacggacaatacattcaagtaaaaacggttcagtacaagatgttatcatctctagtttgttgttctaatagacttctgattttgatccattaaacggcagattgagtggaaagatactggaaatg

SEQ ID NO: 27846 - DNA, 3003 bp, Unknown
  misc_feature (1)..( 3003): 2750-1469P.txt file - cDNA_ID_2992438; gDNA_ID_1620617; Annot_ID_162082
acagtgagttgatctcttttcacaattcttcatgttaaactgatgaagagaaatttcagtattttaatttcctactttctagattgggcctataccagctgatgatggtattagcaaagagattatcactaaacttacaaccaccatgaagacaaatggaacattttacacagactcgaatggccgtgacttcatcaagcgggtattagatgcaaaattcatgtgaagtagtttatttttatttttgtaacaaggggtattttgtttttattgtaacatactttgttacattttcttgcagattcgggacttcagaacagattgggacttgcaagtgtaccaaccggttgctgggaactattatcctgtaaggcatcaaacccatctgagattccttctcgtggtgtactaaggtcttgtactagactgagctgcactatatctggccttttgtctaatatatatattttcttccagctaaatctcgggatatacatgcaagataaaacctcagagctatccgtgttggtggatcgagctgtaggtggatccagcttagagaacggccagatcgagttgatgcttcatcggtttgtcaactaactttctctatataaccaagacaagcatatgttgttttgcttgtatttcacctttttttcattcatgtaggagaatgcagcatgatgacattagaggtgttggtgagattcttaatgaaacagtctgtctccctgaaggatgcaaaggattaacggtaagcttaagttctcatctcatttttagctgtccaagttgcaacgtatcagcttttaagggaacatgtgacagagcttgtttccaaggtggtattaaatcgttatagttggtcttataaccgttatggtaactctgaattgttttgcagatacaagggaagttttatgtacagatagataaacctggagatggggcaaaatggcgtcgaacatttggtcaagaaatttattctccactacttatagcattcacagaacaggttgctcttaaaaaaaaaaaaatacttacttccctccagttctataagatagtgaagtgagataaggtactttttttgtaggaaggagatagttggattaattcacataagacgacattctcagcgtttgaaccgtcatattcattaccaaaaaacgtcgcattactcaccctccaggttagttggattgtgtactgtatacatgtcaaagacggttttttattagtttgaccacactcacactatgattaattctgacattttcaggagttggaaaatggggaagttcttctaaggcttgctcacttattcgaggttcttacttgtcctctctatgcgtttccaccgttaataatgtgttatagctatgtgctttttggttgtggaaatgtagtttaacactaggccgattaaactagcaaataattagagatatagaaaaacttgtattactcagaaaacccaaatcttgcagtgtcaggaaaccagacaattagttgtatagagttagttcataaaaccaaaccgtaacgtttagggtgtatttttcacctaaaaatcaaactgttttcatgtttatactcgtaaaaagctgactatgcggttgatcatcgtgctatgtcatttggttttccttaatagttccacatgtgaaataagatgagacctaaagtaatatagaagggagatggtcaagtccactaattggttttaaattgagaacccatgaacttcgacagtgttgcttttttggttcactaagcaacgggtaaaatctaatgtggaatttgataattattttctatctcttctcttaatggtttcatcgaagttgagtccttctgagttactgtcttgttaaccttgtgaaggttggggaggatagtgagtactcagttatggcaaaagtagagctcaagaaactattccacaacaaaaaggttcgccaaaaaaagacgacccttctcttatttgtctcactgtatgttaacaaaaacaactgccgttctgtttttaatatgttttgaacagataagggaagtaaaggagacaagtctttccgggaaccaagagaaggcggagatggagaagagacggctaatctggaaagtagaaggctcggccggggaggaagtgaagagaggagaggcggtggacgcagagaagctagtggttgagcttgttccgatggaaattcgaaccttgttgatcaagtttgatgatcaaattgaaatggttggtgataaagagcagcaacataggttatgaaataatacacgttgttgttgtctttttaagtttaatcggagaagagaaaaaagtttgaatttagtgtctgatgcgagtttaaaattcgggtgattgcaacagtcacgagtgcgatcccggtagagtatcgcaatttctgcattaacatttacgtttgctaaggggtgggcattttaaccgaaccgaaccgatccgaaccaaccgaactcaaaccgacccaaactaaacccggattaacactaaaattattcggttaggcttcttctcaacccaaatagttcggtttaaaaacctttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttcatg

SEQ ID NO: 27847 - DNA, 3003 bp, Unknown
  misc_feature (1)..( 3003): 2750-1469P.txt file - cDNA_ID_2992438; gDNA_ID_1620576; Annot_ID_160996
acagtgagttgatctcttttcacaattcttcatgttaaactgatgaagagaaatttcagtattttaatttcctactttctagattgggcctataccagctgatgatggtattagcaaagagattatcactaaacttacaaccaccatgaagacaaatggaacattttacacagactcgaatggccgtgacttcatcaagcgggtattagatgcaaaattcatgtgaagtagtttatttttatttttgtaacaaggggtattttgtttttattgtaacatactttgttacattttcttgcagattcgggacttcagaacagattgggacttgcaagtgtaccaaccggttgctgggaactattatcctgtaaggcatcaaacccatctgagattccttctcgtggtgtactaaggtcttgtactagactgagctgcactatatctggccttttgtctaatatatatattttcttccagctaaatctcgggatatacatgcaagataaaacctcagagctatccgtgttggtggatcgagctgtaggtggatccagcttagagaacggccagatcgagttgatgcttcatcggtttgtcaactaactttctctatataaccaagacaagcatatgttgttttgcttgtatttcacctttttttcattcatgtaggagaatgcagcatgatgacattagaggtgttggtgagattcttaatgaaacagtctgtctccctgaaggatgcaaaggattaacggtaagcttaagttctcatctcatttttagctgtccaagttgcaacgtatcagcttttaagggaacatgtgacagagcttgtttccaaggtggtattaaatcgttatagttggtcttataaccgttatggtaactctgaattgttttgcagatacaagggaagttttatgtacagatagataaacctggagatggggcaaaatggcgtcgaacatttggtcaagaaatttattctccactacttatagcattcacagaacaggttgctcttaaaaaaaaaaaaatacttacttccctccagttctataagatagtgaagtgagataaggtactttttttgtaggaaggagatagttggattaattcacataagacgacattctcagcgtttgaaccgtcatattcattaccaaaaaacgtcgcattactcaccctccaggttagttggattgtgtactgtatacatgtcaaagacggttttttattagtttgaccacactcacactatgattaattctgacattttcaggagttggaaaatggggaagttcttctaaggcttgctcacttattcgaggttcttacttgtcctctctatgcgtttccaccgttaataatgtgttatagctatgtgctttttggttgtggaaatgtagtttaacactaggccgattaaactagcaaataattagagatatagaaaaacttgtattactcagaaaacccaaatcttgcagtgtcaggaaaccagacaattagttgtatagagttagttcataaaaccaaaccgtaacgtttagggtgtatttttcacctaaaaatcaaactgttttcatgtttatactcgtaaaaagctgactatgcggttgatcatcgtgctatgtcatttggttttccttaatagttccacatgtgaaataagatgagacctaaagtaatatagaagggagatggtcaagtccactaattggttttaaattgagaacccatgaacttcgacagtgttgcttttttggttcactaagcaacgggtaaaatctaatgtggaatttgataattattttctatctcttctcttaatggtttcatcgaagttgagtccttctgagttactgtcttgttaaccttgtgaaggttggggaggatagtgagtactcagttatggcaaaagtagagctcaagaaactattccacaacaaaaaggttcgccaaaaaaagacgacccttctcttatttgtctcactgtatgttaacaaaaacaactgccgttctgtttttaatatgttttgaacagataagggaagtaaaggagacaagtctttccgggaaccaagagaaggcggagatggagaagagacggctaatctggaaagtagaaggctcggccggggaggaagtgaagagaggagaggcggtggacgcagagaagctagtggttgagcttgttccgatggaaattcgaaccttgttgatcaagtttgatgatcaaattgaaatggttggtgataaagagcagcaacataggttatgaaataatacacgttgttgttgtctttttaagtttaatcggagaagagaaaaaagtttgaatttagtgtctgatgcgagtttaaaattcgggtgattgcaacagtcacgagtgcgatcccggtaggagtatcgcaatttctgcattaacatttacgtttgctaaggggtgggcattttaaccgaaccgaaccgatccgaaccaaccgaactcaaaccgacccaaactaaacccggattaacactaaaattattcggttaggcttcttctcaacccaaatagttcggtttaaaaactttcctatcacgacaataaattttgtttggtgtttacataaccgaattaatcgtaccgaatccgaacttaaaccgaaattcccaccgttaacctggctatactgaaactatatatatacgtatatatatatatatatatacatgcgatgttgacaaatgaacacaaaagtagataaactcaaaccggtagttattacattaactgtgtaataaagattcggtatatcccacccgcgaagaaaaggaatcatatcacgggttaacgaatccgggtcgggtacacggagcaatcataaagaagaaacaaaaactacgacgacaacttttttttggccttggttaaaaaattttcataagtgaacacagaagaagcggtggctctgagccggcgaaatctcctttctcatccctaaaattttcatg

SEQ ID NO: 27848 - DNA, 3000 bp, Unknown; identical to SEQ ID NO: 3158
  misc_feature (1)..( 3000): 2750-1469P.txt file - cDNA_ID_2992442; gDNA_ID_1620628; Annot_ID_47180

SEQ ID NO: 27849 - DNA, 3000 bp, Unknown; identical to SEQ ID NO: 3158
  misc_feature (1)..( 3000): 2750-1469P.txt file - cDNA_ID_2992442; gDNA_ID_2926187; Annot_ID_140859

SEQ ID NO: 27850 - DNA, 3003 bp, Unknown
  misc_feature (1)..( 3003): 2750-1469P.txt file - cDNA_ID_2992453; gDNA_ID_1620706; Annot_ID_48883
tcttcattagcatcaccgaaacttcttcatgttcttgctgttgatgatagtatggttgatcggaagttcatcgagcggttactcagagtctcatcttgtaaaggtaactgttgtgtttgtgtttatcaaaaaaaagtgttgtgtttgtttatcttgtgtaatctgtttaagtacaagaatctgacattagttttgttctgtctcagttactgttgtcgatagtgcgacaagagctttacaatatcttggattagatggagagaataatagttcggttggatttgaggtaataaatctgatcattgtgtttaatatttttgagagtgagaatccattcaaatttggtgttaaaagatttttggtttgaaattatattttaggatctgaagattaatttgataatgacggattactctatgcctgggatgactggatatgaactactgaagaagatcaaagtaagttttgttgatgattcaattgttttcacaaaattaaaatgaagttctgatttgacgaaaaaaaatttaaaaaaaaatgaagttttgatctaatcttgtttatggattttgaactttttaacaggaatcatcagctttcagagaaataccagttgtgattatgtcttcagagaacatcttgcctcgtatcgataggtatattctactataataatcttaactatgatccttaattcttgtttaggtcaagattatgtaggaccaaaatttaccaaatatagtagattttgtgcatttattacttcaggagatggggatgattagatttagagggtattgtttgtttaggaaactttttaaagtaatcacactaatttaggatttgtgataaagttaccgttaaaggatatgtattgactaaattaaattgttgtataatcacaagattttgttatgatagaaaaggttattatatgattactttttaactatcatggggttaactttggtggtggttgtatatttgatcaagctgagatttggtgtttattttagtgggtcctaaaatgatttttaaaatggatcttaggaataataaaatttatcttgtggccataaatttagaaaagaataatccatcataagttaagcaagatcttctcttgagatttgattctatataagccggtgacatgttaggccctccaaaactttataatatatgttttaattgtttgggttgcataatcttaggtagggtcatttataaaatcccaatcctcgtgatagacacctcacatgcctttgcttattactaaggaaccaaaccctctttaccagattaagtttaatgattatcatatatgagctggccattttctgtatccaaagttataaactttatggaattagatcactaacatttggttccttatatttattcagatgtcttgaagaaggagctgaagatttcttattgaagcctgtgaaattagctgatgtgaagagattaagagattctttaatgaaagctgaggaaagagcttttaagaatattatgcacaagagagagcttgaagctaatgatatctactcgcagctaaaacgcgcaaagatctgagtttatcagattccacgtacgatatgttctttaaaagctcaaagattcacacacatgcatgtcctgattctttcggcttacaatttttgagacattacggcttcttttgctgatagaaccaagactgatcaagagtgacaaagatgggtttttataagatagaaatgtaaattgtagacttggattcattagagaggagaagagatacattttttttttctttacatgagagatatgtaaaatggtggtgtgttattttggaagttaacatatgaatttcttttgttaagattacttaaataatgatttaggaatggattagtagtttagtaccgttcattacacgaagacaagctaatcttttgtctaattaaaataaagctgtctacatgaatcgaatccagcgagataagttagttattttaagcgttggttggaacactttacatggcttttcgtagaaatttccccaagttgggttttattaagaccaagaaaattctagtctcctagacttttttttgtttcttttgttaatttagtctcctaggctttttcattctatctgaaagcaaaatatggttatgcaatttggtttagccaaaaaaacaaactaaatttttctagtccggttcatgtaacttcataatcaaacaagtaaaagtcgaatgtgacgcgtcttgccgaacgcaaaaacggaccaggcaagaaggtgtagttagttaattcggttaatattcagctgagagaaatcgaaccggttccatatcttgtagattatccggtttactttccggataagatttataagcaaaacagagttaaagtagtagatttcttctatacgagaccaaatctgaaaacccaagtcaagctacaaaaacttaactccaagcgaacaaatctcctcattcattaaacaacaaaattgttttccgacaaaaaagtgaatatcattgagttactgcgaaatcccaaccgagagtgacatctcaaaccaaaagatggagtctatattaaagagacgaagactccaaagtcaagctacaaaatttccaagcaaagattacacagagaaaactttccgaccaaatgtgaatgtttatgaaagtttctgcgaaactccagtcatgtcggatgtacaaagccatacaccaatgtaaaaccgacacgtggaaagctaagattcctagcttttctttcttcatgagtctccaatagccaaagagtcaactccaaaaaaaaaaacccatttttgcattgaaatggtctcatgatggggtattttgggtaactaattagtcctgtctacatcttcccataaattaacagagtaggagcggattaaagaagcaagacgattcaaaagaaaaaagagagaagaaagtccactaaagaaaagagaatagatatagatcaatg

SEQ ID NO: 27851 - DNA, 3003 bp, Unknown
  misc_feature (1)..( 3003): 2750-1469P.txt file - cDNA_ID_2992461; gDNA_ID_1620769; Annot_ID_50186
ggcgaacttgatcagaataagcaaaaagtgatcctgtgttagaaattgcactgcatatgatcttccgagcatctttacttttaacacgaaccaatggcttagtggagacacgcccactagaatcattgcttatgtgaatacgaagaatatctaaagaacaagaatcctgaaccaagagaagagaagtctgattgaacactgtattatgtaccatctgcatgggcactctctgaggcgcaggacatatatcatgtggagggaacttagtaaactcttgaaccgagtatgcataaagcttggcatcatcaccagctgaaatgagcatcggaacccccaaatgtgcccatttatggtaactgaaaccagccggctccttcctgcgctgtttaggacttgttacttttgcattcctatctggaatggaacctgcaaaaggtgggagcataagaataatttaaaaaaaaaaaaagactaggtagcttctagatacaaaacattgatcccatatgcattcggatacacatcatggcccaagccaaaatcagtgctacggtttctcgtgataagttctaagtagtttgatagaattaggttactggttttacatcggatttatatttgtagtcgaatgagggcttcttatgattttattatattgaaccctctgggtattctctgtgtttgtgatcctttaactctaaacacattcaatcttgaatcttaattatcaaccatacaggaaaatctgaatatagctcaagaagccactgaccttcccaacttattggcactgcaacagttagagccctgatatcatgtgtatgagcccttacacaaccgatataatcccacttctgagcagaagaaggtttaaaatcttgtgatctagatgtaccaccagagagcttatataaaataacctacaaaagcatgaacggagaattagaaagttgtcacaataacagccaaacaacatatataatgttatgtcaatgcagaaaggtttctttttaatcttacgagaccttaaaatcggtaatagtaattgtttctactttatataagtcccatttctcgtccatggggaagaacctgtctttattatataccaattattaactgggattcacatgagtaaacacactagcagtatcatttacctgtccatcagcgcctgcagaaaacacccggttatgacttggggatgctgcaagagcattgacatcacccttgtgattagaatgcgcctgcaaaagggttccatgctggctatcccaaaactggacacttcctgtactatctccactgacaagaactccatatctaaaataggatgtacataatcagtaataggaaaggtaaacataaactaacatatgagcacggtaatttttacctcaatgaaagaagtgaccagatgcagagctcagacccatttcccagtcctccaagtccaactgttattctatatacctcatggcatagattagcatcccagcatcttatcagcctacaaatattgttggaaaaacaaaaaaaaaaattaaaactttagccaaatcaaagaacatccaggggtcttcttgcacaccaaaaatgcatctctaaggaaagtaaataataatattgcatatcatacaaagtaaaataaattatcctcacccatcgctactgcctgaaaagatcctctgtgcgtccgcactccacgtcacacttaaagcacgacctatgaaaataatgttccataaagctctaagtaaatacaataatgaaagatcaaaacgatgcaaaggggagtaaagagttctcaccagtgaccctaggcaaagatctatagtacgttaacttgtcagattcagagatataatatatcctcacacagccatcatcacaagcagctgcaagatgcctatccaaggcctccactttctcatcaagctcgtccaactctgaatcatcttcaactccactttcttcctcgtcgtctgatttctcactcaagtatccattctgaatcagcttagcttctttactttctgcttcaatagagataggggccagagctatttgccagattgaaaacccaattgaatctaggacgacctgaacaattagataccatacgagcaaattagcgaatgaacttattttggaagtaactagaatcatttacaagaagctaaaaacttttattcaatgaaattcaccttctgcttcaagtcgaaaagatcccactctgaaattgagccatcaatgctcgaagaaaacaatctagcggaagaagaacctttagaaccagtaccaaaccacgcaaggtgcgagattctcgattttggatctccatgaatgatctagactcaaaagaaagtgaacaataaaactcaaatcagttaccacgaatataaccgactcaaaatgttcaaaattggaagagagaaaacaaaagcacgtacgagctgacagtgccaagaggaagcaccgggagagacgagccagagctcaagagaaccatcctcacgagctgcggcgacctgagaaccgtcggcgctggtggccagagctaccaccggagatggcttccaatcgatggagctgcaccggtactcaaacatggtggcgacggagaaagagaaagagatgagagacgacgaagcaaattgcgtttttaggtttttcaaagggttttgacttttttttagttaggagcgcagtttaaaatcggtcgggtcgacccgacccattgggccataaatctggtttcaagttaaatacgttgtataatgccacgtaggcaaatacaaaataagaaggaaatacaaaataaatatttgtagagcctctagatgattacgcgggttccatatccaccatatactacttatcttaagccttacgttttaagatactactctgtttttcaaattcaatggacctttttcttcaaatctccagctttctgcatagatccatgaccatgagagtctgtttcttagaacgaaaatg

SEQ ID NO: 27852 - DNA, 3003 bp, Unknown; identical to SEQ ID NO: 27851
  misc_feature (1)..( 3003): 2750-1469P.txt file - cDNA_ID_2992461; gDNA_ID_1620769; Annot_ID_167442

SEQ ID NO: 27853 - DNA, 3003 bp, Unknown
  misc_feature (1)..( 3003): 2750-1469P.txt file - cDNA_ID_2992465; gDNA_ID_1620769; Annot_ID_50166
acctcaaaattctagcccagaatcttcaccatcgtcttctacctccgccacgtccacagtcccaaatccaccaccaccacctccgacaaacaaccacccaatgcgaacccgagctaaaaatcatataaccaagcccaaaacgaaactctccctcctagcaaaaacagttcaaacccgacctcaaataccaaacacggtgaaccaggctttacgagatgaaaaatggaggaacgctatgggagaagaaatcaatgcccaaatacggaataatacatttgaattggttccaccaaaaccaaatcaaaatgttatttccacaaagtggatttttacactaaaatatcttcctaatggtactcttgacaggtataaagcaagattggtggctcgaggttttcggcagcaatatggactccattactctgaaactttcagtcctgtggttaaatctctcacaattcgcctagttctacaattggcagtgtctcgctcatggacaattaaacaactagacgtaaacaacgcttttcttcaaggtacattgacggatgaggtgtacgtcacacaaccacctggttttatcgaccccgatcgaccacaccacgtttgtcgccttaagaaggcgctttatggcctgaaacaggctccacgcgcttggtaccaagagttgagaaattttgtttgctcgttgggattcaccaattctctcgctgatacatcagtgtttgtttacatcaacgacatccaaatcgtctactgcttggtctatgttgatgacattattgtcacgggaagtagtgatgcgttggtaatggctttcatcaccgctctttctcggcgattctcgttgaaggacccgacggatttggtatattttcttggtatagaggcaacaagaacctcacaaggtcttcatttgatgcagcataaatatgtttatgacttgttgtctaggatgaagatgttagatgccaaaccggtgtccacaccaatggcgacacatcctaaactttcactctactctggcattgctctagacgaacccggagaatacaggacagtgatcggcagcttgcaatacttggcgtttacacgaccggatattgcgtatgctgtgaatcgattatcacaatttatgcatcgtcccacagacattcattggcaggctgcaaaacgcgtccttcgatatcttgcgggaactgctactcatggtatattacttcgctcaaactctcctctctcgcttcatgcattctccgatgctgattgggctggggacaatgacgattttgtttccaccaatgcatatattgtgtatcttggctctacacccatagcttggagctcgaagaaacaaaagggagtcgcacgttcttccaccgaggccgagtacagggctgttgcaaacacaacttcagaaattagatgggtatgctctcttcttactgagttaggcatcacattaccaaagatgcctgtgatatattgtgacaatgttggtgccacatatctctctgcaaatccggttttccattcaagaatgaagcatctagcattggactatcattttattcgcgacaatgtgagtgccggtgcactacgagtctctcacatatcaacacatgaccaacttgccgatgctctaaccaagccattgcctcgtcaacactttcttcagttttcaagcaagattggagtgagcaaactccctccatcttgagggggcatgtagagtatataagtaaaggatagtttagtaaatcattaatccctaattcattctaatgtagtccctatatatattgtaattatatcatctaatgaattattcagccttcaatactatagtttgatcatgtgcttactttcccttcatttgcgatacttcaaggttcttgctgccactgtttctttgaatgcgtcacatgtttgaacatgtgtgttctttttggatcgaagcttagctctttagatggaactgaataagtaaaagaggtcactggataagctctgttactagaataataggagggcttctgcttcacatttgtaatcctctctctttctctgaattgatgttgcaattgcttgtcatcagtatctgtatttccatagataactgaactcattaaagggcaaccgaagctgcttcgtggtttatgtttcttctttgtgggctattttgctttgcactttcacttgtttcttagttttggtttgatttttcatactgggccctgagcaaaacaattttagttatatgacttgtgaaacttaaatgggttttaatcgaatggtaacttcatctaatttgtttgaataattcatcatggaccttaatgataatatcttgagtctactaatcatttcacaaatcctttcattttccaacagcaagtagcctgatttttgaacctcagcgatagacagcttaaagtgcggtcattctcgcaaaaagctatcagtctttatttgattcacgaacattatacacgaaagtcaaaattaaataaccaaaaaaattaaacaaaaagcaaacaagaaaacgacttctctggtatgattggaacaaatttaatagagagagaggttagataagaatgtggtagaagataagacccaactacgcgtcataactgggtcccatctttgtctctttcccttcttcactcgccaaccccatcgcgtgtccccacgctccttccctttactttttctcgttatccaaaacacgacgattcttcattttagatttttttcattaataaaaaaaaaaaagtcttttattgcagaaatttcgatcgtttttgttgtgtgtacagagagattatcgtgttttgttggcaatcgccattaaaccttcttccctctaacccaatcaaatttgcggctctttcttttatcttctcgcctcggttttagcaaaccctttagttatcttcttcctcaagcaatttttcttttggattagattggtgttttcttttggtttgtgtggtgatg

SEQ ID NO: 27854 - DNA, 3003 bp, Unknown; identical to SEQ ID NO: 27853
  misc_feature (1)..( 3003): 2750-1469P.txt file - cDNA_ID_2992465; gDNA_ID_1620769; Annot_ID_167420

SEQ ID NO: 27855 - DNA, 3003 bp, Unknown
  misc_feature (1)..( 3003): 2750-1469P.txt file - cDNA_ID_2992469; gDNA_ID_1620740; Annot_ID_49595
actaaacaaaagccgactcataccaaatgtctagatagcaatacctccatcaatggtgaatgcctgcaaaccaatattttcaaccatggttaggtcgctaacataattagaaaccaaggttaaccaccattcgacaggagtatgagatattaacctgtccggttatgtaactggctgcaggactgagagccaagaattctaccaagccagccacttcttcagcttttccataccgtcctgaaaaccaaaccgttttgctttgtatcagaattcttttttatctaacaattttttcatgtctcagatacatcctatccatataaattacccagcaacaaatgtaagagatgaaatgtccattacctaatgggattgttcccaggattttcttttccatgtcttctccaagctctgcagtcatgtcagatgcaatgaatccggggcaaaccacattgacctggaatagagcaaattgtagacggaacaagtttcacaatcatgtccaggaagtttaaaaaaaagacgaatatgatgagggagataggtcacatacatttatattcctgctcgcaccttctctggcagcagtcttggaaaacgaaataactccacctttagccgctgcgtagtttgcttgaccaatattaccaatgagaccaacaactgacgagatattgatgattcttccctgcaattaagtataccatgaattatgcttgtcataatatcacttcttaatcttatagaagagctcaaaaaaaaaaaaacgtagttgtctttttatatatcatttctccctatgcttcagggaaggagtaacatgtcaaaaccaatgacaaacgtgtgaggatatagacggtgacatggcatatgacaagtaaaaagtgttaccctttttttcttcatcatgatctttactgctgcctaaagagagtaaacgagtatcagtccctgaaaatccgagtatcaaaattttagcagtattgcaggaatacaaacctgagtacagagaaatacaccagtgagattcaaagcaatcacttcgtcccattgtgattgcttcattcgtattaacaaggtatcccgagtaattcctgaaaatatgtagccacgtcagtaaggtactaagtaaaacttaatgggaaccaaggttttcatttacctgcattgttaaccacaacatcaatggttccccatttgtcaagagcctgcagaaaaataacaaaaggaaaatgaaaagatgtataaggattagggaatataagatggtgtacagttgatcactcacggttttcatcatcgcatccacatcagtcgctttcgagacatcacccccaaaagtgatagcctggccaccatattcttcaatctacagttgcacagagaagaaatgtcagagattacatgaaataagttgacattgtaaacgaaaacactattaactgcagatgacatttgttagccaaaagataatatttcatttggcagtgtggatcaagagcaaaatcacaaaacgcatttgagaagcatagggcaataagaaacattttccaggtccagaaaattcatttgtctacatttcttgtcccagaaaccaaaactgtttaaaggtattatcaacgttaaactcgaaaggtaccacatttattttcgtaccaacaacaacatccttccataccaaacacctatgcattatttggtctaaaccgatatcccgaagcagaaaaagaaggaaagagctgaaaaccattctagatacttggtgcatgaatcatgtaaattgcagtctaatccagggcaatgaatcacctgtttagcaacttcttcagcctcttttgctgacctagcataattcaccaagacctgcaacagaaacagagtgtttgcttccagatcagaaaatttatgtgtagcaattacggatataaacctattgatgtctccatcactataatgacaaaagaaattgaaagcaatcctgtgttaaaatcttcataactcaagactagtaatatcatgcaaattgaatgctcgaagagtacatatacagatcaaatctaacaacaaggcgctccaatattccgaatagtgttaagcctaaccttgcagccagctttacccaaggctagagcaattgctttaccaatccctctcgaggcaccagtgataacgaccactggagattccactttttgaacaacttcccctggtgattgctcagtagcagtagcttgagctttcacaactgtaataccacaaaaatgttgagaattgagagagatcaaatctatgccaaaaccgcaaaggaagagagaagaggaatgaatataccagaggtagaaaacggctgccgcgatctacatcgcagcattccgaaatgaggtatcgcagagtgaagcggagccaattgtcggatttgagagatctcacggaaacctagcttcgcgacggctttcaaggagatgagtctcggtgctgcgacggcggcggccatggcgaatctgttgttaaagtgaatccgtacaagtgaacctcgtaaagatcgacccagtggagaagaagaagagagaaaagtcttaattttgtcttagtttctgctcaaacaataataatatatagaatttcaaaaaagcgatacaaacgaagttatgtcaagtgtgtaaaagtcatgtttatagttggggcaggtcgtcgaataagaggagactcgatttcacgaatagaactgacctaggtattcgggttttgtatcggatacggttcatatttgttcggatgcgggtaattgtataatatatagttttgtggagcagtgtttaaaaaaaaaattggtcaaagaaaaaaaaagaaagacaaagaggattgaacggtagacgtagacgccattggagtttgaaagggaattagtcgacgttttatggatcattgtcgtttcggtgtcattttcttcttcttctttcgctagcacgatttaaagcctgactagatccatcatcggccatg

SEQ ID NO: 27856 - DNA, 2733 bp, Unknown
  misc_feature (1)..( 2733): 2750-1469P.txt file - cDNA_ID_2992469; gDNA_ID_1620753; Annot_ID_166864
ttcttttttatctaacaattttttcatgtctcagatacatcctatccatataaattacccagcaacaaatgtaagagatgaaatgtccattacctaatgggattgttcccaggattttcttttccatgtcttctccaagctctgcagtcatgtcagatgcaatgaatccggggcaaaccacattgacctggaatagagcaaattgtagacggaacaagtttcacaatcatgtccaggaagtttaaaaaaaagacgaatatgatgagggagataggtcacatacatttatattcctgctcgcaccttctctggcagcagtcttggaaaacgaaataactccacctttagccgctgcgtagtttgcttgaccaatattaccaatgagaccaacaactgacgagatattgatgattcttccctgcaattaagtataccatgaattatgcttgtcataatatcacttcttaatcttatagaagagctcaaaaaaaaaaaaacgtagttgtctttttatatatcatttctccctatgcttcagggaaggagtaacatgtcaaaaccaatgacaaacgtgtgaggatatagacggtgacatggcatatgacaagtaaaaagtgttaccctttttttcttcatcatgatctttactgctgcctaaagagagtaaacgagtatcagtccctgaaaatccgagtatcaaaattttagcagtattgcaggaatacaaacctgagtacagagaaatacaccagtgagattcaaagcaatcacttcgtcccattgtgattgcttcattcgtattaacaaggtatcccgagtaattcctgaaaatatgtagccacgtcagtaaggtactaagtaaaacttaatgggaaccaaggttttcatttacctgcattgttaaccacaacatcaatggttccccatttgtcaagagcctgcagaaaaataacaaaaggaaaatgaaaagatgtataaggattagggaatataagatggtgtacagttgatcactcacggttttcatcatcgcatccacatcagtcgctttcgagacatcacccccaaaagtgatagcctggccaccatattcttcaatctacagttgcacagagaagaaatgtcagagattacatgaaataagttgacattgtaaacgaaaacactattaactgcagatgacatttgttagccaaaagataatatttcatttggcagtgtggatcaagagcaaaatcacaaaacgcatttgagaagcatagggcaataagaaacattttccaggtccagaaaattcatttgtctacatttcttgtcccagaaaccaaaactgtttaaaggtattatcaacgttaaactcgaaaggtaccacatttattttcgtaccaacaacaacatccttccataccaaacacctatgcattatttggtctaaaccgatatcccgaagcagaaaaagaaggaaagagctgaaaaccattctagatacttggtgcatgaatcatgtaaattgcagtctaatccagggcaatgaatcacctgtttagcaacttcttcagcctcttttgctgacctagcataattcaccaagacctgcaacagaaacagagtgtttgcttccagatcagaaaatttatgtgtagcaattacggatataaacctattgatgtctccatcactataatgacaaaagaaattgaaagcaatcctgtgttaaaatcttcataactcaagactagtaatatcatgcaaattgaatgctcgaagagtacatatacagatcaaatctaacaacaaggcgctccaatattccgaatagtgttaagcctaaccttgcagccagctttacccaaggctagagcaattgctttaccaatccctctcgaggcaccagtgataacgaccactggagattccactttttgaacaacttcccctggtgattgctcagtagcagtagcttgagctttcacaactgtaataccacaaaaatgttgagaattgagagagatcaaatctatgccaaaaccgcaaaggaagagagaagaggaatgaatataccagaggtagaaaacggctgccgcgatctacatcgcagcattccgaaatgaggtatcgcagagtgaagcggagccaattgtcggatttgagagatctcacggaaacctagcttcgcgacggctttcaaggagatgagtctcggtgctgcgacggcggcggccatggcgaatctgttgttaaagtgaatccgtacaagtgaacctcgtaaagatcgacccagtggagaagaagaagagagaaaagtcttaattttgtcttagtttctgctcaaacaataataatatatagaatttcaaaaaagcgatacaaacgaagttatgtcaagtgtgtaaaagtcatgtttatagttggggcaggtcgtcgaataagaggagactcgatttcacgaatagaactgacctaggtattcgggttttgtatcggatacggttcatatttgttcggatgcgggtaattgtataatatatagttttgtggagcagtgtttaaaaaaaaaattggtcaaagaaaaaaaaagaaagacaaagaggattgaacggtagacgtagacgccattggagtttgaaagggaattagtcgacgttttatggatcattgtcgtttcggtgtcattttcttcttcttctttcgctagcacgatttaaagcctgactagatccatcatcggccatg

SEQ ID NO: 27857 - DNA, 3003 bp, Unknown; identical to SEQ ID NO: 27855
  misc_feature (1)..( 3003): 2750-1469P.txt file - cDNA_ID_2992469; gDNA_ID_1620740; Annot_ID_166426

SEQ ID NO: 27858 - DNA, 3000 bp, Unknown; identical to SEQ ID NO: 12802
  misc_feature (1)..( 3000): 2750-1469P.txt file - cDNA_ID_2992472; gDNA_ID_2214573; Annot_ID_135102

SEQ ID NO: 27859 - DNA, 3000 bp, Unknown; identical to SEQ ID NO: 12802
  misc_feature (1)..( 3000): 2750-1469P.txt file - cDNA_ID_2992472; gDNA_ID_2214573; Annot_ID_186238

SEQ ID NO: 27860 - DNA, 3003 bp, Unknown
  misc_feature (1)..( 3003): 2750-1469P.txt file - cDNA_ID_2992480; gDNA_ID_2214570; Annot_ID_135047
ctcctaaaaaaaccaattattcaacatatatatgcctgatactgatcgaataaatgatacatgatatcagagcagaagattttaacttccatttcgtcagcaagttcacgagcctctgtagtcacttccacgtctaaagccaaaattgtagcaaattcctttttcctctcgagcatcactcccgccttcattacatccttcttttgcacaggccctatgccaataccaccaacaggtaactttacagctggggacttcaagaattcaagcaatgcttccaaagaacctaatgtagacgcttgtatataaactccttcaccacttttgtcaatcctgctcaaaactgagtttacatcttccataaccaactccttaattgcttcgatgtcatcatcaggtccaacgacatgcagggcagtaccaacaattacatgttcaaggtccttttaaacacaaccaaaaaatggaaaataatattcaggatgtgatcattaattaaaagagactagaaattaagattaatgtagtatcagtccaatcaccttggcaataatattgatacactctgcagcctttattacttcgtgatgtacatgattaccctgaaataccagaccaagaattctcattgtgtatagaaaaagtacgtaatggtatttgcatgaactataatttcttaaggaataacagtaataagtacattcacatgcaactcctttattggatgaggagtcagtaatgctctaatcgttgtgacaataggtccctaaaatataagaagatataagatcattatttaagttctaagtattatccaatgcattacttatttgagtttggataataagtttttacttgcctgtagaccacaaacgacgatttgaccaccttcatggagttcaccatttaccaacacaacatcaatcgttgtaccatagccttccataactttgacctctaggacagtacactgcttaacagtttcaagaaaggatcagaatccaacatgctgaagtattgtacaaacaagtgttacctaaaagagaaaaggagcaagacctgcactttgtcaacatatgtaattagtttctcaaccattgttttctgagtcaattgaaccaacaacaacaatagatctgggatcccttccccactgaaatatcaagaaccaaaattactcaaccatttaggataaattacaaacaataaacaaagagagactcatatacctaatagcacaagtaggaacaatactaaaagtttctcccatttctttattcttgtaataaagctcactgttgagtccttgctccttaaactggtttataatctgtaataccaatgaaacaacatatacacaaagtgatagctcaaacccatagatgatgataaactctagatgaataacttacctcattcagcctcatgttaaattcatttataacatctttagtttgttgcttcatcgcctccaagataggagcattttcacatattctccatccatatagcctatccacctataagtacattgaaaattttattttccataaaaacatttacaccatagaacaaaacaaatcacaaacagttttaccttattcaatgcaataatgaactccgtattcttcattctcagaagatttagacattctatagtttgtggctctaacccatgcattatgtcaacaaccaaaattgcaaagtcacacaaacctaagcctcttgagcgaagatttgtgtagaactcgtaaccaggtgtatcgataaacagtggacgtggcaccttaagttttgtatcggatttcagttccatggtcttctctaggatgtttctcgctgagagatatgttgcacccatcttctgagtggtacctccagcctcgccttcttgtacatttcctgtgatgtaatctaacagctttgttttaccagtatcgatatgacccatcatacagcaaatgggagaacggactttgtcttcctcggagagcttattacgtctagagtgttcatcgccaacaatttgctgcttatcatctccacctcgagcactcggcttcttcagatccattgctaaacaatcgaataagctttaccttatatgggagatgacttgatcgacaaggttgagacagaaaacgagaattagctatgattttttctttgtgaaacttcctatacggtggagcaaacacgttgtgtagatatataccgattctaagtatgtaacgatgctgcttaaataatttctagaccatgcaagatataattgttttttctcggattaagattcatttacataaatgattttaaatggaatgaaatctactatatattaaaaggtaaatttttgtaaatctttaattattattcatatccaatgccattaatgtttttatataatacattttaaagatttttctaacttacttaaaaggataaaaaataaaaaagattacacatatagacacaatctagctactgcaaaaaagatttttttaaaaagcataaatctactttatttactaattataaatttaatttgtttcacttttattagtgataacaagattaattgttttgtttacacaaacaatattgttttatgatttcacttatatgaacattattatcaagagttataaagtttgcaaaagaaataggtttttattgactgaagaattgagaaattttctcatcacctttaaaattaatattgggcctagcgatgaaccgggccaacgcccattaaacatatccgataatagtttaaacccggagagactcaaagtagagaaaaccctaattgtatataaactaaaaatacttccttaattcttcacttcttcatcgccgtctgcacaaaaccctaatctcacaatctcctacgagatctatcagtctccacggtaaacgacactaatccatttcaatttctccatcgtcttctccgatcaaattctccatttacttatctgttcactatttttccagaagatg

SEQ ID NO: 27861 - DNA, 3000 bp, Unknown; identical to SEQ ID NO: 7255
  misc_feature (1)..( 3000): 2750-1469P.txt file - cDNA_ID_2992483; gDNA_ID_1621135; Annot_ID_56543

SEQ ID NO: 27862 - DNA, 3000 bp, Unknown; identical to SEQ ID NO: 7255
  misc_feature (1)..( 3000): 2750-1469P.txt file - cDNA_ID_2992483; gDNA_ID_1621135; Annot_ID_172629

SEQ ID NO: 27863 - DNA, 3003 bp, Unknown
  misc_feature (1)..( 3003): 2750-1469P.txt file - cDNA_ID_2992491; gDNA_ID_1620762; Annot_ID_50021
tgtcttgaatctcaaccacagtttccaagacctttcctttaccatgttcctgaattgctcgcgtgagaaactcttcacctccagcgttatcagtgatgatcttctcaatcatctcatcattagcatgttctccagtgacagtgaagtaccttctctcaacagtctccttgtactcactcatcatcttttgcctcagcccctgaaactccatcatcacttccttaagtttcttcctcagcccattagtcacagcggttctgctcctataaaccggagtcccagagagccttttaatctccttgttggctttatccatctcttccagcttcgacttaatcgatttcgccttcctcaaaccagacacaatctcgttagagatcttgttacgaagagacttcacagactctgccttgtgaacacctttactctcttcatggtactgttcgatccgagccagcgtctcactaatcaaacccatctctgctttcacatactctgcttcttctaagaaagatgacagattctcatccatcttgtctgctttcgtagaagccatctcaagatcaaagtcaggtcctgcttccatatccttcatcgctgcttttttcaagtcaacgtaactcataaacgatttcgtcatcaagtcgttcatctttttcacctgaaagtcaacaattttacaagaatcagagagaatcgcagtgattgtaacagaatcaaacaagagaaaatcaaagaaaatacaacatactcttctgattagtgtgttcttctagatccacaaagtttctgcccagaaagtgagagagtagtgtgaagtaaagcttactatagaatttgattagcgatttgtgagatgagagaaagctttctttctaatataagaaaaaggagaaattagccgttactgtgatttcttcgccccaacggctatattttggcgatgtatccgttgtcgtccatttgtctatctgtttctgtttcttcaaatctatttttaaattcatgtgaatttctttcgaaactttaaaataatatagggactaaattgtaattagatgtatgttttagtgccgacgtgtgtgattgagacagctttaaagatatcgaaactgagaagaaaatatagggactaaattgtaattatgtgtatgacatcgcttttgtcgacaaatcatcattggtgacgatttacgaaagcaaagaagaggtgttcttagctgcacatttgtcaccatttatacaaaaattgtggttcttgtgttttgttttttatgttggaaaacttatggtatagtttcttttgttacgatacaccttagttgaaccattcaaattattaggatattttcaaatatataatattttaattctaatttcgtatgtaaacgactctccaataaaacatctccactagcttgttggtctctaaacttgaaatcagtttttatttttcttgtaatattttcaaaattgtttcaatatcgtagacaaattttaaataaaatgtacatcatatctctataaacttaataatacccaaaattttgactaatcacattaaattccttatgatattcgaataaaaaaataatttaataatatttattgtagtcgcaattcaatatttattctgtaatgcttgaaaaatgtttttaaaaactgtgtcactacattactataacgttagtatgtactaaattttgtaacgtttcatggttataaaatagtattagtttaccgacaaaaatatatagattacgtaacgcttgttttacattaaaacaaatttgttaggattgttttgtctattctacattcgtcacatttgttttgtttaaactttttgttttctaattaaaaaattattctgtttttgtaattaaatatagtaaatttgtttgccgcccaaaaaaatattacataacgcttgttttacattaaaataaagttgcttcgattgttttggctgttcaactctagtcacatttgttacgtttgttctacttattgtcgtgaatcgatcgaaaacttgtgcaatgtggaattgagggggttagatgtaaaccaaaaaactaaaaagggcaatctccaattattttgttaaagaggtggcaattgcaaatctccaataatataaagttcataaaaaaggttaaaggagagagttgtggtggagagagtgagacccacgtgggtgatgtgttggcaaactatcttccttaaaatccaaatccatttatccatcactacttttttttcttttgtttggtagtaaaatccttcactagttgattgcagatgactaataaagtaataatctttcattttggtggttcatcgcctaatttgttgtttacttgattgataaatgtttgaggatgaaactgtatcatttatttttctcaaaattgtttggttcatgacctatataatccatttgtttaatattaatataggtaaatttaaaattcgttacttaaattggctaaacatactcttcaaaataatatatatccacttaacatagttaaaactctgtattcagataaaagcatggtaaaaaaccaaacatatccatttaaatgtattcaaagtcatgagaaaatttcctatacttgttcctttatatctgcgagaagtcatgaaccttatccatttattagttttcttctgaccgactaaacctgataatcactaatccaccgttagatcttaaaattccaaatccaaaatggacggtcaagatcacttaacgaaaaagaaaacagtttcctgtccagaaatgtctaaccttgaggcctttttctctttcctttaaacttttttttttcgattataaattttctcgtgaagctaatttttcctgagaaagaaagcgaaacttcgctggcgactaaagattgctgagaagacacgtcgtctctgtgagaactttttctttttcttctggtatattctggagacagatattgttttttcttctgattagagaataatatg

SEQ ID NO: 27864 - DNA, 3003 bp, Unknown; identical to SEQ ID NO: 27863
  misc_feature (1)..( 3003): 2750-1469P.txt file - cDNA_ID_2992491; gDNA_ID_1620762; Annot_ID_167177

SEQ ID NO: 27865 - DNA, 3003 bp, Unknown
  misc_feature (1)..( 3003): 2750-1469P.txt file - cDNA_ID_2992494; gDNA_ID_1621150; Annot_ID_56864
cttcaggtgtggacactgcaagcagcttgctcctgaggtactatgactttttcaatcacttaaaataggatttgcaagtggagttttttttttactggtctaattcatgtagcgatggctaatgggtggttttatttttgtttacagtatgagaaggctgcgtcagctttgagcagtaacgtcccaccagtggttcttgctaagattgatgccagtgaggaaacaaacagagaatttgcaactcaatacgaggttcagggtttcccaacaatcaagattttcagaaacggaggaaaggctgttcaagaatacaacggacctcgtgaagctgagggtattgttacttacttgaagaaacaaagtggacctgcttctgctgaaattaagtcagctgatgatgcttctgaggttgttagtgacaagaaggttgttgtggtaagtacaaaacatgttcttcagcttttctctctgttttatgattttaatcatgtatggtagttaaataatgtctatttctattgttttaggttgggattttccctaaactatctggctccgagtttgattctttcatggccattgctgagaaattgcgctctgagttagatttcgcacatacctcggatgccaagcttcttccccgtggagagtcatctgtaacaggacctgtggtcaggctattcaaaccctttgatgaacaatttgttgattccaaggtttgtatattacattggttctgttatatagtatattgttgcggaatgtttgtttgatttgcttctttgcattcaggatttcgatggtgaagctctggagaaatttgtcaaagaatccagcattccacttatcaccgtctttgacaaagatccaaacaaccacccatatgttatcaagttctttgaaagcactaataccaaggtaactcatcctagagttatcaaatatctcaattccattatgctgtaaccagttcatgatatactacatagatggattcatattatgccatttaattttactggagaattatgtttaaatttatgaaaattctgaaatgagtttatttgtaaaagttgatatttcgtactaaattatgttatggctatggaaggagctgcgagtgtgtgccatattagctgagtcggactctagtgtctataatttactttttgaatattctcagtaaaagcttcaagaatcctcagtctctgcaatattttgattttcaggcgatgttgttcattaacttcactggagaaggagctgagtctcttaaatcaaagtaccgtgaagttgctacatccaacaagggacagggtcttagcttccttctaggtgatgctgagaacagccaaggtgcattccaggttagtcttattcttctatcttcaatcgtttatctccaaggtagcattggtttcaaattgctgaacacatttctctcctttctaaaccattaacagtactttggactcgaagagagccaagttcctctcatcatcatccagactgctgacgacaagaaatacctgaaaacaaatgttgaggttgaccagattgaatcatgggtcaaggacttcaaggatggaaaaattgctccccacaaaaaatctcaacctatcccagccgaaaacaacgagccagtgaaggttgttgtttctgacagccttgacgacattgtcttaaactctggaaagaacggtgagttactttacattgttaaatcacaaatacctgtttgctcgtagcaaaaacttataaatcagttttcattcctcctatttacttgcagttttgcttgaattctatgctccatggtgtggacactgccaaaagcttgctccaatcttggacgaagttgctgtgtcgtaccaaagcgactcaagtgtagtcatcgctaagctagtaagtcctttctctttcttcacatttgagagtatttgttcttgatcaccggattcttactctttcacttgtccaggatgcaaccgcaaacgacttcccaaaagatacctttgatgtgaagggattcccgaccatttacttcaaatcagcgagcggaaacgttgtggtttacgaaggagacaggacaaaggaagatttcataagcttcgtcgacaagaacaaggacacagttggagagcctaagaaggaggaagagacaactgaggaagtcaaggatgagctctgaaaagagaagtgtgttgtgtctcttagctgctagcttagtttggtagttttgaggaaaatacacagaagaagacagagcattgagtagactgagagacagagagagagagacgacagacagacagagagaatctctttatctattcattaggtttttatatgtgcactcttcagaacaataatggctgcctccttttcttttttttggttgatgttacctttttttgtttgaattcagttctcctttaatatagtttttgaggcatttcttgggacgagttctaacactaaaaatatattaattctgaagcatataccaagataatatactagttgactcttaattggttccactatttgaaaagaaaacaaaaggctaatttggttgttgaggaaagtatgagagaaaggaaactcaagcagatcgtcgaggagatcaaacgttacttttactgtccaagcgtttatcaacatttacaattttattgacttgttcaacatgcttgttccttttttggtcctaatactttcagttttttcactaaacaatctaatggaagaacgagaaacagttaaactaaaccaattggttaaagatattgaaaccgaccttgaactgatttaactcagaaatgtcggtttcgttgtttgtctgaattttgtgaacctcgagaaaacaataaaataatattaaaaaaaagacagagaaagagtctctgtttctatcttcttctttttttttcccggtaacagggagctcgcacgggcggctacgaaatcgctgtattttcaaatcgtctctcagtttccatg

SEQ ID NO: 27866 - DNA, 3003 bp, Unknown
  misc_feature (1)..( 3003): 2750-1469P.txt file - cDNA_ID_2992498; gDNA_ID_1620743; Annot_ID_49660
aaacataatctcaaaatcttaggtagaagctttccactttatataaatgtttttttttgcaaaatcattatgttcaaatactatatttttgggtttacgcaacaaatttaacgctgtaagccaacgtgagaaaaagaaaaaatatagccctatcatttgtttttcttaaagaaccaccatacaaaatgaaaggcaaacgtatagaggaaataatttgccaaccactcattccaataaaagaaaggtcaaaaataaacacaagccaaactattcccaagtatataaagcaatgttcactagacaaaccatcatcaaccagtttaaccgtagacatcattccttattgtcccatccaaatagtaaaaaaaaaaagaaaaaaaaaataaaatgaaaaagtcaacaagactcttatggctattatccatcattgttttggtggcagccgtttctaaggcagtcgcagaggtagacaacgatgatgatgacgataatacttcattggaaggcatgacgacggctaaacgtgaaaccctcgaagttgaggatcatacttcattggaaggcatggttaaacgtgaagccctcgaagtaaaaccaccaaaagctggcaaaggcaaaggcaaaggtaaaggtcgtggcaccgttgccgcaggacctgagatgaattggcctggacaatgggagttattcatgaagaattctggtgtttcagccatgcacgcaattttgatgcctttgatcaataaagttcagttttacgacgcaaccatttggagaatttcacaaatcaaattgcctccaggcgtaccttgccatgtttttgacgccaaaaaaaataaagttgattgttgggctcactctgtcctcgtcgatattaacaccggagacatcaagcctcttgcggtaacaaaattactaattattactccctccgttccttttttatataacgttttagttaaaatcacgcagattaagaaattacaaatataattcattttacacattagtaattgttgatctgatggatttaatggaaacatgacagcttacaacagacacatggtgttcttctggaggtttaaccgtaaacggtactttggtaagtactggaggattccaaggaggagcaaacacggcaaggtacctatccacatgcgaaaactgtgtatggattgaatatccaaaggcactcgctgcaaggagatggtactcaacacaagccactcttcctgatggaactttcatcgttgttggaggccgtgacgctctcaactacgagtatatccttccggaaggacaaaacaacaagaaactctatgactcacaacttcttagacaaacagatgatccagaagaaaacaatctttacccttttgtttggcttaacactgatggtaacctcttcattttcgccaacaaccgatccattcttcttagcccgaaaacaaacaaagtgctcaaagagttccctcaacttcccggtggtgcccgtaactaccctggttccgcctcctcggctcttctccccatccgcctctacgtccaaaaccccgctatcatccccgctgatgtcctagtttgcggtggtgcaaaacaagacgcttacttccgtgcagagaggttaaagatttacgattgggccttgaaagattgtgcaaggttaaacatcaatagtgctaagcctgtatggaaaacagagaccatgccaacgtcacgtgtgatgagtgatactgtgatccttcctaatggagaaattcttatcattaatggtgcaaaacgtggctcctctggttggcacttagccaaagaaccaaattttgctccactcttgtacaaacctaacaaacctttaggccaacgtttcaaagaactcgctccttccactatccctcgtgtgtaccattccatcgcaatcgctcttcctgatggtaaagttctcgtcggtggaagcaacaccaacaacggataccaattcaacgttgagtacccaaccgaactccgcatcgagaaattctcaccaccttaccttgatccagctctagccaatatgagaccaagaatcgtaaacaccgcaacaccaaaacagattaagtatggacaaatgtttgacgtaaagatcgagcttaaacaacaaaacgtagcaaaggagaatgtaatggtgacaatgttggcaccatcatttactacacatagtgtatcaatgaacatgaggttgcttatgttgggtattaacaatgtgaagaatgttggtggcgataatcatcaaatccaagccgttgctcctcctagtggaaaacttgctcctcctggttattatcttctctttgccgtctacaatggtgtccctagcgttggagaatggattcagattgtctaattttgatatgcatatattatcaatttattttttgaaacgaaacctatataacatgtttgtaaggttaattttttttctttatacttacatgtatatattctttgattcttgtaattattatattttttgaataaatgtttttttgatagatataacaaattggagaaaattgtcataatgaaatcactatatagaatggttatttattattttatattttttcaacagtcttgtagtcctttattaataaatagtgttacttatgacatttattttccaacatcgattccattttttattttttgtaagtaagaaaaaattcatttcattttaacattacaatacaaaatctaaatatataagttccaataaggcagtaattaactaattaatcatttaactaataataattatgtctaaatatcacgaatcgttcaattttttgtttttgtttttttgttttgtttttttaatgaatctccaaaataaaaaagaataaaaaagctttatctctagtctctaccgttgtcgtcacttaatctccgacggaggaaaagtagccaccgcttgacgaatcattcatcaacacacgcagagagctctgaatctcgaggaagaagatg

SEQ ID NO: 27867 - DNA, 3003 bp, Unknown; identical to SEQ ID NO: 27866
  misc_feature (1)..( 3003): 2750-1469P.txt file - cDNA_ID_2992498; gDNA_ID_1620743; Annot_ID_166537

SEQ ID NO: 27868 - DNA, 3003 bp, Unknown
  misc_feature (1)..( 3003): 2750-1469P.txt file - cDNA_ID_2992506; gDNA_ID_1620813; Annot_ID_50620
acgttattcccacgagtggtaataacaggcaaaccataagatctaccataagccataacaagcatctcagcaccagctttcgtggcagagtaaggattcgtcggaagcagctgagaagcctcatggttaccaacaagagcatcctcatcagtttcaccataaacttcatcagtactaacatgaataaacctcctaatctgaccagtaactttacaagcctcaagaaggacatgagttccatagatattattcttagtaaactcgaaactgttaccgaaggaattgtcgacgtgagtctgagcagcgaaatgcatgatggtgtcaataccttcagtgatgagaagatgattcaccaagtcagcactagcgatatcacctttgacaaacttgaagttcggagagtgcttagaaggattgagattcttgagatttgaacagtaatcaagcttgtcaagcacaacgattttgtaatcaggatagcttcgtatgagtctgttggcgacatgagacgcaatgaaaccagcagctccggtgatgagaatgttcttgggagtgtacgaagccatgatcaaacgctgcgtttaagaagaatgaaatcataaacactcaaatacgcagaaatgaatcagtagatctaggaaatcaaacgcataaaagcttagatccagatccgaaatctcgattctgtgattatgaccatcggatcaaagagagagagtacgaaagggtaaatgaaactcagtgaagcattatgatcaatgtaaaattcgagataatggagtataaaggaagacgagagattcaggaaacataccttcgaatttttcagatcttcaacgatcgcaagagaattggagaagacaattggaaaattccgaggaaaacgtgaagaattttcgacggtgacgaagctgaggaagtagcgaaagaaacggagaagaagaagaatcaaaattcaaaaaagagtcttctcgttcgtcacacagcaaaaatagaagaagaagagaacgaacactaaagactcctggagagggaagagtctacgggaattcattatatactgcttgcacttacgaaaatacccttctcgttttcactcttttacaatagcgggtaggtacacgacttgactcgcgtgttgatgatcgcgcgttttgtcaaacattaacttcgcatgtcagctaattactaacatgttatagtctaaaattagtctagatttgatttagaaaatggaattttataattataaaagactaaaaatgtgaatatgaagtatgaagtaacgattgtacgaaaaaaaaacaagaatagaaaatgattattgacgatttttaataaagtcaatgaagttaaaaacaaaattaggtaagtaaaacaagggacggttggctacagtgcgtttacgtttgcgattgtggtatacgtgttaggtaccatgtgtggctctcaacttctcaaacctttcatttacgatctagggtcattttcgtcattagatagcaatcgaatttgtatttgtaatgatattcttactatattttaataatagtcttttaatatgggatatgtaatcatttattgcacttgcccatatgcttaattagagatcaccgacacattccattattgtcacttgtgatcttgtgagagtgaatgattaactaaaatatttgtaattgatttgattttcctaatttctttgatcattaacatctaaagacgccttggatgatttgtgtgaaaaatagtttaacgggggtagagtagagaaacaaatttaattcagggaccattttagcaaacaacgtgtttaattgacaaaaggcacgtgagaccacgtgagtacttgttttggtttcttcttcatcggtccgatcagagagagagaatcgccggtgagaaaagaaaatggcgtcggcgatttctctttctctcttaaacggagcaacgcctttgaaatcgaattcgctccacaaatctagactcactccacttcatcttcgaactatctcttgttctagactatcttactctccctcgagtcgcgaaatttctctcaaaactcaatctactgttcctatttcgtgtaggcgtagtaggtttgacttcgttcctcgttgcggcatttcgtcgaacgatttgcctactgagaaaaagaagagctttggggagtgggttgagtttgtgggagaggcggtttcgacggcgtttccgatatgggtttctctgggatgcttgttgggactgatgagaccaagtactttcaattgggttactccaaattggaccattgtaggtcttacgatcactatgcttggaatgggaatgactttgacccttgatgatcttcgtggcgctttatcgatgcccaaggagctcttcgctggctttctgttgcagtattcggttggtttgcttctcaatgctctatctttagtgttcgattgttacgaattatgcacaagttagaagagaaatcgagaaagatgagatcttgaaggaaccggtatagatgatctgataataggtttgtttggtttggtaacataatcttgtggagtagttagagttattgcttgagctcatgattcctgttttatgatcttaccaaattatagttttgaaagagtagtattagagcatggataagttcatagcttgctgatgaatagtgttgcaggtcatgccactatcagcattttttgtgagtaaactcttaaatttgccaccacattacgcagccggtctcatattggttggttgctgtccaggcggtaaaatacaattctttacttgattgcattatattaacacttgtatggtgctctgatgcttttccgtttgttgtttgaaggcacggctagtaatattgtcacatacatcgcgcggtttgtaatccaaacaaaaagaaacgacttttgagttccataatacaactggatgatctgagtttcttttttttcattgtacagtggaaatgttgcgctatcagtgttgatg

SEQ ID NO: 27869 - DNA, 3003 bp, Unknown
  misc_feature (1)..( 3003): 2750-1469P.txt file - cDNA_ID_2992510; gDNA_ID_2214706; Annot_ID_136964
tcaattctcacctaatttggtcacattgagttctgggtaggtttcaaaacttaaagcattggacttttctattgaatatgaaaagctactccagataaactcgaactttacatgaaacaactgaggaaatagtgaataatttgagcaggtttgggttacaagagttaattttctggttattgtgcgacatgataggagaatgaaactcaccagaaatcaagagaggtaagcaaatcggagaaaatattaccggcgaacaatatcgatgggagcttcgcggtactcttctctaatttacactgcttgccgttttgtcgtagcaatgttggtaaaatgtgtcatagtaggtgttgcccaaaagccaaaataatatttaaataaaaacaatgtcaatgagttttacatctctataaatagataaatgatattaagtgacatgtttcttgtgttgtaatattcatattttcagttcctattctgctattcattcgaaagttttaatcatcttcaaagtaattctatctagagctgcttatttgttattggtttgtggatataaatttgatagtagtctaaattgtgaattatatatatgaaagttggtcaactctctccataaaatgacatgtgtcattcgattttttttaaactaaaaattaataaaattaaataagcaaattaaatgtatcatcaatcttactcttaattgatttctttaaaataaaaataaaaaacaaaaaaatatgttaataaattaagcactactttcattatattctttttattactattttttataacaataatcactactctataatgactaaatttttttaatacactataataaacttttaaaacataagacctaccaaataatttaatacgcgatcatttctcttattcactgataagattgagtgtgtataattgaaatagaatacataagactgaaattttgtttaaaacaataattattaaattaaatatgaagaaaaatatattgattaccatacaaaattcaaatactatctataaaaatatatttttatagatagtatttgaattatataaagtatggttttcaaagttactaattcataagatcgtgtcatgtgtcaagtcaaacgatcagatgtttacatgtgtcattaaaaatttaacttttttattctcttaaaaaaatagaaaatctaaaaaagtaaacaaatttacatatactaatttatatgtctctatatataattatatatatatttaacttttattcaacaaaaggaaaattaacaaatttgtttttacatgtattattgatcatttaaatgtagcacatattatttttttttttaaataatttagtatggataataatactaattaaaaagaccattgaagtttaaaatagtaatataatttatttaacattagtttagttggataaaattatatttgtcaatgtaatataatgttttcattcgttaaatcaaaacacaaaatattaattataagaataaatttttgaatacctatgttttaacctaagaattttaacgcatcgtacgatggagcgtcttgcatcctttgatgtgttactatacctatgttttattctaaaatttttaactcatgtaatcataagtgaaaatagaatattttgagaaaaactgcttataggatttaacttttcaattacttttaatgagaatatttttatttattaattttaactcatttaaaattaatttccatgatgtaaaattaacttacgagattatggcatataaaaaataaatattttcaacaatgtttggtttctaaatatttttgtggatttctgttttttagttaattatgttttgttaattgttaattatttttaatacccaacaaagatcatttctcttatatggatatatgcaatgacagaagatttaaaagtatttacttaaatgatactttcatttttgttttatttttagtttttcatatgaatactcttgaaatcttgttgagtttatatcaattctatatatttaatcatgagcctataacaatgttgttggagtattatatcagaagaatacataaaaccggaaatagtttatttataatcaagttagacaattttcaattcattcaagacacgatcatttttctaatattatgaattcaaaccaaagtgattcacacttttctttcacaatttatgccggatctagtacccataaaacataaagttaaatcaaactaaagtgtgaattcaaaagaacaacaaaaaaaaaccattaaaattagtttagctttgattgtgcctcaatgcaacctgatacaccactgataagacgacatgtcatcaaaatgacacgtgttaaaatatcattcgctatctaaacgtacacctgcgtgtcaacataaactgaggaagttaatgaactttttttacactgcacgaagaagaccctctcaaaagcacgaggaaggatcaaatcggaaacttaacagaatttagctaccaattactgtctccggcgagatctcaatttgatccttcacggtggcgtcgacgtccgggcaacaacaagctctctcgagaagaaagccattatcatcatcatcatcatcttcatcatctcctcctccgtcttcctcacctgttcgagctcctgcggcgaagaaaccgagtccggaatacccattttggcagcagaactggtttatcggtctgctattcgtgatggctttaggattcttctgtctcgctatcttcctttacctaagtctcgatcctgattccggttacacgtctgcctccgccgctgcttctggtaaagaaggtgtcgaggttcgttttcgatttcattgcttatgattttcggtgaatgtcgatttgtttcaatttcccatagatttgggggatttgtattgaaattcgaattaggtttgatcatcttctcgttgctgtgatattgacagattacttatggaagtgcgatcaagttgatg

SEQ ID NO: 27870 - DNA, 3003 bp, Unknown
  misc_feature (1)..( 3003): 2750-1469P.txt file - cDNA_ID_2992510; gDNA_ID_1620626; Annot_ID_47139
ccaaaagccaaaataatatttaaataaaaacaatgtcaatgagttttacatctctataaatagataaatgatattaagtgacatgtttcttgtgttgtaatattcatattttcagttcctattctgctattcattcgaaagttttaatcatcttcaaagtaattctatctagagctgcttatttgttattggtttgtggatataaatttgatagtagtctaaattgtgaattatatatatgaaagttggtcaactctctccataaaatgacatgtgtcattcgattttttttaaactaaaaattaataaaattaaataagcaaattaaatgtatcatcaatcttactcttaattgatttctttaaaataaaaataaaaaacaaaaaaatatgttaataaattaagcactactttcattatattctttttattactattttttataacaataatcactactctataatgactaaatttttttaatacactataataaacttttaaaacataagacctaccaaataatttaatacgcgatcatttctcttattcactgataagattgagtgtgtataattgaaatagaatacataagactgaaattttgtttaaaacaataattattaaattaaatatgaagaaaaatatattgattaccatacaaaattcaaatactatctataaaaatatatttttatagatagtatttgaattatataaagtatggttttcaaagttactaattcataagatcgtgtcatgtgtcaagtcaaacgatcagatgtttacatgtgtcattaaaaatttaacttttttattctcttaaaaaaatagaaaatctaaaaaagtaaacaaatttacatatactaatttatatgtctctatatataattatatatatatttaacttttattcaacaaaaggaaaattaacaaatttgtttttacatgtattattgatcatttaaatgtagcacatattatttttttttttaaataatttagtatggataataatactaattaaaaagaccattgaagtttaaaatagtaatataatttatttaacattagtttagttggataaaattatatttgtcaatgtaatataatgttttcattcgttaaatcaaaacacaaaatattaattataagaataaatttttgaatacctatgttttaacctaagaattttaacgcatcgtacgatggagcgtcttgcatcctttgatgtgttactatacctatgttttattctaaaatttttaactcatgtaatcataagtgaaaatagaatattttgagaaaaactgcttataggatttaacttttcaattacttttaatgagaatatttttatttattaattttaactcatttaaaattaatttccatgatgtaaaattaacttacgagattatggcatataaaaaataaatattttcaacaatgtttggtttctaaatatttttgtggatttctgttttttagttaattatgttttgttaattgttaattatttttaatacccaacaaagatcatttctcttatatggatatatgcaatgacagaagatttaaaagtatttacttaaatgatactttcatttttgttttatttttagtttttcatatgaatactcttgaaatcttgttgagtttatatcaattctatatatttaatcatgagcctataacaatgttgttggagtattatatcagaagaatacataaaaccggaaatagtttatttataatcaagttagacaattttcaattcattcaagacacgatcatttttctaatattatgaattcaaaccaaagtgattcacacttttctttcacaatttatgccggatctagtacccataaaacataaagttaaatcaaactaaagtgtgaattcaaaagaacaacaaaaaaaaaccattaaaattagtttagctttgattgtgcctcaatgcaacctgatacaccactgataagacgacatgtcatcaaaatgacacgtgttaaaatatcattcgctatctaaacgtacacctgcgtgtcaacataaactgaggaagttaatgaactttttttacactgcacgaagaagaccctctcaaaagcacgaggaaggatcaaatcggaaacttaacagaatttagctaccaattactgtctccggcgagatctcaatttgatccttcacggtggcgtcgacgtccgggcaacaacaagctctctcgagaagaaagccattatcatcatcatcatcatcttcatcatctcctcctccgtcttcctcacctgttcgagctcctgcggcgaagaaaccgagtccggaatacccattttggcagcagaactggtttatcggtctgctattcgtgatggctttaggattcttctgtctcgctatcttcctttacctaagtctcgatcctgattccggttacacgtctgcctccgccgctgcttctggtaaagaaggtgtcgaggttcgttttcgatttcattgcttatgattttcggtgaatgtcgatttgtttcaatttcccatagatttgggggatttgtattgaaattcgaattaggtttgatcatcttctcgttgctgtgatattgacagattacttatggaagtgcgatcaagttgatgcacgagaaaactaaatttcgattacattctcacgatgtgccgtatggatccggcagtggtcagcaatcagtcactggttttccaggcgtcgttgattccaacagctattgggtaactttcttcatctagaaagattatctcacacttttaatcacatgtgttttagctctgatttagatgaggaagtttctagctatggtgtggtttcttggttttattaagtgttttagtgagggatggtggagtgattgaggaattgttttgttttgatagattgttaaacctgtgcctgggacaacagaaaagcaaggtgatgctgtcaagagtggagcaaccattaggttgcagcatatg

SEQ ID NO: 27871 - DNA, 3003 bp, Unknown
  misc_feature (1)..( 3003): 2750-1469P.txt file - cDNA_ID_2992510; gDNA_ID_2214706; Annot_ID_189841
gagaagcaagagacgactgataggaaatgggacaatacatacatccataaaccataggacctgtaatatcaacagaattgaatcagattctgcttctcactcaccaaaattgatcagatacaagtataagaagaagaagaacctagaacaggaccccttccggcttcatcgatacccattagacaaggttgagatgcccattctggtgtcaaacattcagattccattccttcaacaaaacattcatatacattagggttttagcctcaattctcacctaatttggtcacattgagttctgggtaggtttcaaaacttaaagcattggacttttctattgaatatgaaaagctactccagataaactcgaactttacatgaaacaactgaggaaatagtgaataatttgagcaggtttgggttacaagagttaattttctggttattgtgcgacatgataggagaatgaaactcaccagaaatcaagagaggtaagcaaatcggagaaaatattaccggcgaacaatatcgatgggagcttcgcggtactcttctctaatttacactgcttgccgttttgtcgtagcaatgttggtaaaatgtgtcatagtaggtgttgcccaaaagccaaaataatatttaaataaaaacaatgtcaatgagttttacatctctataaatagataaatgatattaagtgacatgtttcttgtgttgtaatattcatattttcagttcctattctgctattcattcgaaagttttaatcatcttcaaagtaattctatctagagctgcttatttgttattggtttgtggatataaatttgatagtagtctaaattgtgaattatatatatgaaagttggtcaactctctccataaaatgacatgtgtcattcgattttttttaaactaaaaattaataaaattaaataagcaaattaaatgtatcatcaatcttactcttaattgatttctttaaaataaaaataaaaaacaaaaaaatatgttaataaattaagcactactttcattatattctttttattactattttttataacaataatcactactctataatgactaaatttttttaatacactataataaacttttaaaacataagacctaccaaataatttaatacgcgatcatttctcttattcactgataagattgagtgtgtataattgaaatagaatacataagactgaaattttgtttaaaacaataattattaaattaaatatgaagaaaaatatattgattaccatacaaaattcaaatactatctataaaaatatatttttatagatagtatttgaattatataaagtatggttttcaaagttactaattcataagatcgtgtcatgtgtcaagtcaaacgatcagatgtttacatgtgtcattaaaaatttaacttttttattctcttaaaaaaatagaaaatctaaaaaagtaaacaaatttacatatactaatttatatgtctctatatataattatatatatatttaacttttattcaacaaaaggaaaattaacaaatttgtttttacatgtattattgatcatttaaatgtagcacatattatttttttttttaaataatttagtatggataataatactaattaaaaagaccattgaagtttaaaatagtaatataatttatttaacattagtttagttggataaaattatatttgtcaatgtaatataatgttttcattcgttaaatcaaaacacaaaatattaattataagaataaatttttgaatacctatgttttaacctaagaattttaacgcatcgtacgatggagcgtcttgcatcctttgatgtgttactatacctatgttttattctaaaatttttaactcatgtaatcataagtgaaaatagaatattttgagaaaaactgcttataggatttaacttttcaattacttttaatgagaatatttttatttattaattttaactcatttaaaattaatttccatgatgtaaaattaacttacgagattatggcatataaaaaataaatattttcaacaatgtttggtttctaaatatttttgtggatttctgttttttagttaattatgttttgttaattgttaattatttttaatacccaacaaagatcatttctcttatatggatatatgcaatgacagaagatttaaaagtatttacttaaatgatactttcatttttgttttatttttagtttttcatatgaatactcttgaaatcttgttgagtttatatcaattctatatatttaatcatgagcctataacaatgttgttggagtattatatcagaagaatacataaaaccggaaatagtttatttataatcaagttagacaattttcaattcattcaagacacgatcatttttctaatattatgaattcaaaccaaagtgattcacacttttctttcacaatttatgccggatctagtacccataaaacataaagttaaatcaaactaaagtgtgaattcaaaagaacaacaaaaaaaaaccattaaaattagtttagctttgattgtgcctcaatgcaacctgatacaccactgataagacgacatgtcatcaaaatgacacgtgttaaaatatcattcgctatctaaacgtacacctgcgtgtcaacataaactgaggaagttaatgaactttttttacactgcacgaagaagaccctctcaaaagcacgaggaaggatcaaatcggaaacttaacagaatttagctaccaattactgtctccggcgagatctcaatttgatccttcacggtggcgtcgacgtccgggcaacaacaagctctctcgagaagaaagccattatcatcatcatcatcatcttcatcatctcctcctccgtcttcctcacctgttcgagctcctgcggcgaagaaaccgagtccggaatacccattttggcagcagaactggtttatcggtctgctattcgtgatg

SEQ ID NO: 27872 - DNA, 3003 bp, Unknown
  misc_feature (1)..( 3003): 2750-1469P.txt file - cDNA_ID_2992526; gDNA_ID_1621160; Annot_ID_57127
attgaaggttcttcttcttcctctctatctctactaggtaatctctaacctaatctctgaactctctttcatactttggattatgtttgattaattaataataaattaatagtgtagctttgtccgaaatatagggtttccgggagaagtcatggctagaaccgaagtctcagggaaagataggttaagcgatttaccgtgtcatttgctatgtcgcatcctctctaatctctctaccaaggaatcggttcgtactagcgttttgtcccctcgttggagtaatctctggtcgcttgtttctgttttggatttggatttccaagattttaaaggtgaacacgacatgggagaattcatagatagctttatggaatatcacgaagagttaggcttgaagttgaagagcttcaatatgttttatgatgctaatgagcacttgcatgagccatttgtgaggaggctaaataaagtggttaggcgtggagtttgtgatctgaatattcagaatatggtggatgttgatgtagcattagttaggatgcctccctcgctttattcatgtgctactttagtgaatttgattctctactgtgttgtctttgatcatccaagatcaaaatcggtttctttacctagtgtgaagaaaatgtattttgagggggtcaagtttgatggtgattctgttctggagactctcatatcgcatagtccggttcttgaggagttaaccgtgattccgcatccggaggattatttggaagtcatatgtgttcgttctcaatcactggagagctttagacttgagtctaagcgttttgagtgtgacaatcccaaagttgaaatcgattctccaagccttgagtttatgagtatctgtgataagaaacctgaaagccttaaaatacatagaattggtccttttgcggaggtaaccgttgatgttgagtttgatgttgaggatgatgatccattggagatatctaagatacgtaagtttctcgtcgggttatccacatttcacgaactgaccatctctgctcgaactctagaggtacacatatgattggtggattaaatataacattaagcttgtacaattttgtatatggtgttgacttactttttttttggctatacacagtccatccatgactactccaaggtgggaccattgcctccattctctaacttgtttggcttggatgcttcgttagtcgaatcttcttgggaagttttaccagcctttcttagttgctgcatgaatctagattcgctcgtcatagtgagtttcatttatttgtctatatttcacgtagttacattgagattcatatcccaagaaaacttatcaaaagttttatgttactaggaacttgactgtgttccagagatggaggagattaaactctcaccagtgcctcaatgtgtcttatcctctctcgactttcttcagttgaaggcaccatcgacaccaagtaaaatgaaacttgcgacatattttaggaagaagtgtacacgcttgacgaaaatgcttttaagtgggcagtaacatcatcaagaaaatgaaaaggattccaaagatatgctgaaaggtgtcaagttgttatgtgtataatgtcgtctctcctaaatcaagtttacctatcaacagttaattatcaaataatctattgtaagactttttagattttcttgttagacatggctttatgttttctagtttttttttatggatgttctttagtaaatttctatctcttaaaacaaaattgaaattctatgttgcaactatatgtaggattgattataaatttttatattctttcattgattcttactcgtaaactatattgcaatgagtaaacttaaaagtgaagtatcttggacttcatccatgttgttacgggttggattcaacgtcaaagtttcgttgaaagtttgttgctatagttttctatatatatatcacatgcattgtaattaggttgctatagtgtacaatacatgtaaaatatacaaaactatagcaacaaagttttagatacttaattgcttcctttaatctcaaaccatttggttgaatctatcaagtacacaggacatatgctcattcaaattgggtaactaagagcacccccaacgctggactctatgaaaatcccttaaaaacatacaaataataatattttaatcttattagggcttctgtataatttgaccaataataaaaacacatgtatataattttctcgagactgtcccttaaataaagaattttagggcctctctctcttcttacacttaccttttaattatttttcattctttttatcattagaaattttgttaagggaccaccgttggtggtcctctaatcacgcatggagtctagacgaaataagaaacgcattaataagacatatattattttttggtgaaagtataatgtagacaaaaaaaaaagataaagcttttgttttcttagacataacccaaagaacataccatatatatagcagaattagattaaaaacagtcagatcagaaaacaaaacaatctgaatagctaattgcacaaaaagctagggttttgttaaggattttccgagtttaataccgggaactgatcctcgtgaattgtcgagatagcgcttaatgttttgtaaatatttaatattaaccccaaatattcgattttgaccaatttataccccatcgagatatttctactgctgactttttagtgttttgtatttgacctcgtttgatggacgaaccggaatataattgtgttggttggtcaaccatttgtttttagcattttctggtctttaattaatcgctaagtaatctaattctggattaagaagaaaaaaaaacttcaaaagagacgcttttatacaacgctttgagcattacttggccctctcaaaagaatacacagaccagtcttcgtgtgctcgtaattggcgattctcaaattcgatctccgtacaaacaatg

SEQ ID NO: 27873 - DNA, 3003 bp, Unknown; identical to SEQ ID NO: 27872
  misc_feature (1)..( 3003): 2750-1469P.txt file - cDNA_ID_2992526; gDNA_ID_1621160; Annot_ID_173694

SEQ ID NO: 27874 - DNA, 3000 bp, Unknown
  misc_feature (1)..( 3000): 2750-1469P.txt file - cDNA_ID_2992530; gDNA_ID_2926207; Annot_ID_141797
ctattttattcggatttgaacagaagcctgacctcgctggattggctggatttctcaaaccgttgaatgatgttacaatgaaagctaatgcaatgactgaaggaaaaaggtcggattttttcaatcacttgaaggctgcatgcgatagtttatctgcattggcttggattgctttcactgggaaagattgtggtaagcaaaaagcgatcatgttgaaaaagattctgactttatgaaacttttatgatgtaaattttctttcttggttattttgtctgcaaggtatgagcatgccaatagctcatgtggaagaaagttggcaaatggctgagttttacaacaataaggtgctaatcttcgatatctctatgcttcaatatgttatgatgttaggagcttatggaaaacaatagcgaacgaggactttatagttacttgttcaggttgcagaagcttatattgctgtttgatgctctttgtacagtggtaattctgtgatctccatgttcttcttcaggttctggtggagtatcgtaacaaagacgcagatcatgtggagtgggctaaagccttaaaagaactttatttacctggtttaagggaatatgtcaaaagtcattaccccttgggacctgtatggaatgcatcagggaaacctgctagtgctcctgcaaagggtccacctggtgctcctgctcctccaccagcacccctcttcagtgctgaatcttcaaagccatcatcatcgtcaaaccagaaacaagggatgtctgctgttttccagcaactcagctcgggtgctgtgacctcaggtaggtttgaagctgtacctcttcatatttctggcatggtgtttatttagaatgtgaatcattagtagcttacaatcattgtgctttgctttccaggtcttagaaaagtgacggatgatatgaagacaaagaaccgtgctgatagatctggagctgttagtgcggttgagaaggaaactcgtaccagtaaaccggccttttcgaaaactggaccaccgaaaatggaacttcaaatgggtcgcaagtgggttttactaacaatgactatatattttagtttttcaaaactatgatcaaaatgctataatactgattgttggcttctactgtattattaggtgggctgttgagaaccaaattgggaagaaggacttggttatcagcgagtgtgattccaaacagtctgtgtacatatatggttgcaaagattctgtcttgcaaatacaaggtaattttgcgccattccaatctcactgtgaaagttggatatctactcaaaagtctatgaagcccttactgttgttgcctaatctgtaggaaaagtgaataacatcaccattgacaaatgcacgaaagtgggtgttgttttcacggtgagtggaataatactgtttcctcttacattcttacagtatacagttatgtgatttctaataaagtaaaatataacatgtctgtataggatgttgttgctgcatttgagattgtgaattgcaacaacgtagaagtgcaatgtcaggtttgttttctagattctataagcttttctaatggttgcagatgtatattcttaaggaccatctcttttgcttctcaagctcatgatatagctctaaccatatgcaacatttttccgagacactgattgctcttgctactcatctatggctgatctagggttcagctcccacagtttctgtggacaacacaactggctgtcagttatatctaaacaaagactcattagagacagctataacaacagccaaatcaagtgagatcaatgtaatggtgcccggtgctacccctgatggagattgggtatggctttcctctctttgtaatcatcaaaacgttttggttttcttatattcttcagattcattcaccactgtaacgaagatagtcatgtgtgtgacactgttcatggaaggaatcattctcaacattgttttgttgcaacattgtaggtggaacatgcgctgcctcaacagtacaatcatgtgtttactgaagggaagtttgagacaacaccggtctcgcattcaggtgcctaagcaaaggagaaactattatcactctggattgtgcttgaatatcaggcctttttatactcatatactttgtttcttcagattataatagaggaaagaatctgtttgtttgtttgttggttttttcttttgtctctatcccccaattttgggtttggaggttgtgggtttttgattttttttgtgtgatctgatcatcttgtgtcttgttcgtccttggggttttggatttggatttgggtttctcgtttcttttgtttttacttgtgggcttgtcccgagtccttgctgatgacgttgtgcacaaatcatacttatcatggatagaaaaagttgcaatcctgtttttggaatatgcagttatttatttaacctttttctttggttttgttttgtatatgatgtgaccacagtcaacataataattgtgagttgtacattgtggaatcacgaaagctaaaattattggtggttgtgggtgaaactttgaagaatgtttaacttggactactgagaaatagcatggaaacgaacaaatggtgtatttacacactgaaatatgtgttttgcgatactaatcatcctatggaatacctcatgcttcaaaagcaaactcaaaaaacaaatgctctcttttcgattctcctaaagatttcctctccagaaatagcacttttcagtttccaaattagatgacgagaaaaatcaaaagtataaaattacaaaataaagaccgaaacgaagacttaagctcaagacttgtgaacagaagtcaacacgtgtagtgtggaaaaacaagcacaagacgtgtctttggagtttgtatataaccgttacagtaaaaaacctcttctttaagtaacaacagcaacaacaacacaattcctaaatctctctctctctcaccatcaatg

SEQ ID NO: 27875 - DNA, 3003 bp, Unknown
  misc_feature (1)..( 3003): 2750-1469P.txt file - cDNA_ID_2992534; gDNA_ID_1620767; Annot_ID_50132
cttggtatggaaccgggagctggtagacacagttcaatttttatctgatggggaatctctctcccttcggcttgcaagttcagaattgggtaggaatgaaaggcccttattacatttgaagtttcagctttctttatatgatgttttttccctctgcagcatggttttaagtttttgtttttctggtgattatttcagctggtagcaatcgaacaaagattattctaggtactactgtcagcctatctattttcgtaatcttggtctttgccgcttataagtcctggagatacagaacaaaacaaaatggtgagacacaggcactttgttctcactcactctctttccttgtcctcttttttaatctaactcggtaccaaatccgaagcaaattaatctcttcctcttcatctgatacacactacatttctagaattcttaagttgtgtcccaaggtacagtctcaggttgacagttcttttgggaagtctatatggtcagtttaaagctagatgtcctaacggttaatatgttcgcttctattgaaagtcaatgcttatgctaataaactgctacaaattaagcactaatacatgcacacttgttactcgtagaaccaaatcctatgttcatccacagttcacaagatgcatgggcgaaggatatggaaccacaagatgtctcaggcgtaaatttatttgatatgcatactatacgtactgccaccaataacttcagttcctcaaataaacttgggcaaggtggatttggtccagtgtataaggtaatgtatcattctgttctatttaccttttcttgttttcctattctgtattttcttcttctgtagatgactatgtgcaactattcttccagggaaagttggtagatggaaaggaaatagccgttaaacgcctttctagcagctctggacagggtacagatgagttcatgaatgaaataagactaatctccaaactgcaacataaaaacttggttcggcttttgggatgctgcatcaaaggagaagagaaactgttgatttatgagtatctggtgaacaaaagcctcgacgtgttcctctttggtcagtcctctataactctattccattgacctcttcgttcttccatcatatgagaattatgaaatgtgtcgttgtcactactatcactgatctgtactatcttattggatagattcaactctgaagtttgagattgattggcaaaagaggttcaacatcattcaaggtgttgcacgtggacttctctatctccaccgtgactcacgcctcagggtaattcaccgagacctgaaggtcagcaacattcttctggacgagaaaatgatcccgaaaatatcagatttcggattggctcggatgtctcagggaacgcaataccaggacaacactcgcagggtcgtaggaactctgtaagaaccattcttcgaaaacattctctacaagattcatagtcatgatattccatataggtgaacctatttgatgtttgaacagaggatatatggctcctgagtatgcatggactggggtattctctgagaaatcagacatctacagctttggagttctactgttagaaatcatcattggagagaagatctcaagattcagcgaagagggaaaaactcttcttgcatatgtaagttttttggtaaacttgcatatgtaagttaagacttaggtttcctacacttgcagagtttcttgctctaatattcttaggatgtgaaactaaataacaggcatgggaatcttggtgtgaaaccaaaggagttgatcttcttgatcaagctcttgcggattcttctcatccagctgaagttggaaggtgtgtccagattggtctactctgtgttcaacatcaacctgcagacagaccaaacacacttgagttgatgtcaatgctcaccacaatatcagaacttccatcaccaaaacaacctacgtttacagtgcactctagagatgacgactctacatctaatgatttgatcaccgtcaatgagattacacaatctgtgattcaagggcgttaaagaaacagtgtgtgatcgaaatttgttcgaatttgaagtgtgggttctgctcaggtaaattaaagtgatcaacttttcttcattaccttttaaaaatattttctctacttgtaaaagagtttgtactctttattgttgtccatgtgctcatgaagctccaatgttttcgttgacttggtcacaaactcaaacaaacaggtcatcatcatttttttattatattctttaacggttttataaatttaagataaacggtcgaaattaaaatcacaatggttaagttcgagtttttgaggcaattgtgaatttgtgagttcatttattcttcttctggtcaaagtttgcaacttttggctacaagcacatatttttctgagtcgtcgtcactgtctctgtctcttcaaagtcccacgatagttgaagtttactttgaatctggctcatctgaattatgcattgaatgtgttcgatgaaatgcctaaacgagaatttaaattggttttatcattcttttgttttttgctggtcttctaaggttttggatcttcactttgcaacttgcaaaacgtttgtcggtaatttccagttttgtgttgtccttctcgaagaatgcaaaagctcaacttcttggcttagtagaaacgagaaagttgacttatgagtaccacacgttattttctgtggacagtaaggttgggagattctttgtcaaggtcgtctattattttattatttttgtttctctctttgctggtcaatagggtattgtttagtacttgtaatattcaaagaagtagtgtgaaccaagatctagatatttaattatctcaggatacgttaacataaaagtttttttttctcttggtctcaatgctcactctatccccatgaagttttgctcatactcaagttatcttgcagagaaatagaaaaaagatg

SEQ ID NO: 27876 - DNA, 3000 bp, Unknown
  misc_feature (1)..( 3000): 2750-1469P.txt file - cDNA_ID_2992554; gDNA_ID_1620422; Annot_ID_156633
ttaagaatggaaaaggatacgcaagaaatatactttttaaagaccttacattcagagaatccaaaaatccgattataatcgaccaaaattatgtcgataagggtcgcctagacgtggaggtaaatcatcttagtattctttctattaaaatttcaaaagcataactagattgcaaacaaatttgtatattttgtgtttaggaatcagcagtggcaattagtaatgtgacattcacagatattcgtggaacgtcacaacgcaatgagattataaagatagattgcagcgaagtcacatattgcaaagacattgttcttgataaaattgatattgctacggtcgatggaaataaaccagttgttgaatgcagtaacgtgtatggaaagtctatcaatactaacgatgctaatggttgtttcgaagattagtatccattttcatagaaaatatgagaaatagaaattattgtatattaataatgttgtaagaatatttgatcatttgttttatatgtatgatcgaataaaataattttatatattaaattatttcaatatactcagaaatgctaataattaatgagataatctgaataaccttggtttgattttcatttactttactttagcttacatctgctgtttcttgtttatgcaaatcaataagaacttgcaattaattgtttctccttctctttaattaatatgcatgatagaggtcccaatcacaacataagatcaatcaacacatgaattgttttaaagaaatacgtttgcaagtccaatattacacacatatctaataacaatgttataaacttatatttaatgatttgagtaaacttgcaatatacaaatcgcttatcgagcttaaataggcatgaattattggtggtaaaatattttctctgtttggacaacaaaattgagtcgtctttccatttattttctgatatatatttctcttttatatctattacaaagttttctctccaaaaagagagcacaccttgtgtttggatgtggttatcctgaaatattcagatttggatctgaaattcaactatcaagatgatgatccatagcttttacatatcatagttttggatatatgtccaactatcaaagtacccacatatatccaaatctttatcagtaaaaaaaaactaaaaattaataaataatatgtcaaaacaattttctataaattgttttaggataaaatataatatattaaaattaaatcactactttatataaaatcactaaatattatttaataatatatactttttaactcatatgaatactgatatcaaaatctttaaattaagatacaataaaatcaagagaatttcttgtccaatctctgatctggaacatcttacgtggacaattcagtatagaagatcttcgcagttacgaaaattcgtggagtttggaaaggagatttggagcaaaaataaaaagggtgtaaggcaatgctgatagaattagctgttttgaaagaagaaaaagcaaaagtagtattttacatacgttagtcacttaactaagtgactatgttagtgtctagtgattgatttgcgtgtgtttcaaattcaataggtcggattaaaaaatacaatatatctcccaaaaaaaatgaaactcaaaatgccaagatattttcccattttcccccactcattactatcttgatatttacttttgtttatatattacaaaaatatgtatcaattgaaggcatgtcatatcattatatcaatctcttactatcataaaaagttacgaaatccaaaatttaaattttattgctaaggtaatggtgctctgagatttccttacaatatgtagttgaaagaaacaatattgaagtagagctactcgcatatccccctggttagctttgaccaaatttttttttctttggttaaagggattttgatcaaaacttacaatacaatagaaatagccacaatactacaaaagacagccgctaaattccaaatctcctctaaaatgccacaacaaagcttaaaaattcaataattttacagatgtagtaatgttgaaaggtcgtcgcatattttttcttttgtctacattggagagaatccaataaactcttctactttggtttaaaccttttttaattttttttttaattttatggtttaaattttaaaattaggcttaaggtctcttttgtacattaactagtaaatcacatctttacccgaaaaactcaattcacatttttgtcaacttattgacttatatatcttttgaaaaataagaaacgagagaaataaacaaagtctatcatggcagccacaaacatttgtttatgaaattattaataagtactactaataggaaacacccacgcgtttagactgtagtggactaaatcgatctagtgattctagtcaaattattgtatagtcttctattaataattaattataactattatactaataaagccgtctttatgaactttctggtgacatgaatctgaaattttgttctgatattattgtttgatacatgattttagtctaattttgtttaataaataacattctagttttttcttaattgcaaaatatattttaaaattcttgcaatttttgaaagatatgagagtgtcgttttgaatataaaattttatttttcatccacgtaatataagaaaatcatttcatttcactcgaaaattattgaaaaaaatcagctattatttaagattcataatataatagcaatgcacgattcgaccacttgtattaatttttggaatcagtctttttaattaaaaaaatcataaacaaaataataataaaacattgcacatttttaaaaaataaattaatattgcacattgctgttacaagaataccaatgatgacttttgccttgctcatgtacgttattataagaaccgacaaaaaacgaagactaaagagaagaaaaaacacttccaaacaaaataatg

SEQ ID NO: 27877 - DNA, 3003 bp, Unknown
  misc_feature (1)..( 3003): 2750-1469P.txt file - cDNA_ID_2992554; gDNA_ID_1620863; Annot_ID_170388
tatagtttatttaagtgatatttatttttatttatttttgtttagaatggaaagggatacgcaaaaaatatactttttaagagtcttacatttagagaaaccaaaaatccgataataatcgaccaaaattatgttgataagggtcgcctagacgtggaggtaaatcatcttaatatattttcttctattaaataaaaatattaaaattataaaagaataactagattgcaaacaaatttatatattttttgtttaggaatcagcagtggcaatcagtaacgtgacatttacagatctccgaggaacatcaaaactcgatgagattataaagatagattgcagcaaagtcacatattgcaaagacattgttcttgataaaatcgatattgctacggtcgatggaaataagccaatcgttgaatgcagtaacgtatatggaaagtctatcaatgctaacgaggccaatggttgtttcaaaacatagtatccattttcatagaaaatatgagaaatagttataattttatatagctaataatgttatgtaagaatatgataaattatttttacgcatgatcaaataaaataattttgaaatattagattattcgatatactcaaaaatgctaataattaatgagatcatttgaataaccttggtttgattttcatttagtttacatcagttgtttctaatttatgcaaatcaataagaacttgcaatgaattgtttcttcttgtgtttaatcaaattgtatgaattattacttttaggttacatctgctccattacctcgtccatttcttttgttccagacatgatatatagttgcttgaaaaacataccaattagtatactgaagagttgtaccgatagtagtttgaattgtttagtagagcccaatcaatagagtaaacattggcaaagaaccaacccatgagagaatgccaaactgcagctgagtaacgacatgagaagaaaagatgactataagtttgaatacgatctctgttgaaagacgattgttgatagctaaccatgtgaagaatgagtatttgggagttgcataaggaccagacccccttatatatacaattctttccgtggatgtgttgttcgaataatttctaaacttttatcgtatatcaaaccaatctttcaattttataatcatcgatacattattaataaattcatgatatcatattttattttaaattactgtctaaatatttcaaatttactgtttttctttttttctatttatatttttcgtttaggtaattccacggcatattgtttagctagtttttctagtttattgttttctgaggttaattttgtaaactcttcttctccaaattgggaaaccaattatcgagttacctttaatatatgtgtggttaataaaaataatgacactacctaataatcagaaaaacatttacagtagaaaccctataaattaatactcgataaattaataaacacgataaattaataaaatttgttggtcccaagtcgggccaatgtaaaaattaaccaaaatcgataagataataagataataatttttttgaaatccctatgtaaaattatagtcccaataatattataaattaataatcatagatcttaagtatatattttaagactcatttttatatgaaatttttgttcaagttacaattacaactttaaaaaaaatacaactagtatgatctttgttgtactcgcataactatttgcatatttgatccgtcatagttgattttgtaaaatcttttatttgagaaagcattgctaagatttgggtaaagagaaattggattaagcttcatgtttacgttcacgttaatgtcgtagatatacagacacaatatcttgccgaaaaataaatttaaaaagtcaaagaaaaataaaaatctaacataagtatatatgcaaacaacaaaacatatagaaaattaaattaataacatttttaaaaaaatatagtattgtatttacgtaaatatacctataaattaatttttattaacttatacgataaattaataaatattaatttataggataaattaatatcactataaattaataaaattgcatggtcccaacattattaatttatagagtttctactgtagttggctatttagttacacatgatattattactcgtatttgttaaatataagttaataatgcaatgagatcacaatatgcatccaaatttgattctgtctttgatccaaaatggtttttatttatttccccttactcaagaattttcatttctcttttaacttatattttttaattatattttatctatttgactagataaaatccacttaaataggcgggcgtaagaaataaataaaaaatttcttataatatttgaattctaatagtaatccaaacttttttcattttatctaaatattcttaaaccaaattttaatcttatccattccattttgcagtaaaatttaattatttacgtcatgacaacaaactgaattttaattctatatattttatcttaatggataagagcctcaaaaaaattaattctacatattccatcttcttgtttttattttttatgatatttaaattctaaatagtaacccacacagtttttcaatatttagtgttctaatgtttatctcaatttatctattctctctaaatataaataattaatttatataataagatgctatgattcatttctaaatctgatataataagaaagataatatcacttatatgcaaaataatatccattatattaactaatgattttaggcacaaaatatgtagagtttaaaactatatccatgaacctgtttaaaacacatatacctatgattttgtatgtgtatatttaagtgatcaaaatcacatacatatacactacattacatttcgacaaaaaaatacaaaaaaatacactacattacatctgatcatttgatcatcagcacccaatg

SEQ ID NO: 27878 - DNA, 3000 bp, Unknown; identical to SEQ ID NO: 5746
  misc_feature (1)..( 3000): 2750-1469P.txt file - cDNA_ID_2992558; gDNA_ID_1620814; Annot_ID_50631

SEQ ID NO: 27879 - DNA, 3000 bp, Unknown; identical to SEQ ID NO: 4422
  misc_feature (1)..( 3000): 2750-1469P.txt file - cDNA_ID_2992562; gDNA_ID_1620705; Annot_ID_48862

SEQ ID NO: 27880 - DNA, 3000 bp, Unknown; identical to SEQ ID NO: 4422
  misc_feature (1)..( 3000): 2750-1469P.txt file - cDNA_ID_2992562; gDNA_ID_1620705; Annot_ID_165245

SEQ ID NO: 27881 - DNA, 3000 bp, Unknown; identical to SEQ ID NO: 4422
  misc_feature (1)..( 3000): 2750-1469P.txt file - cDNA_ID_2992562; gDNA_ID_2926196; Annot_ID_141273

SEQ ID NO: 27882 - DNA, 3000 bp, Unknown; identical to SEQ ID NO: 4422
  misc_feature (1)..( 3000): 2750-1469P.txt file - cDNA_ID_2992562; gDNA_ID_2926196; Annot_ID_201454

SEQ ID NO: 27883 - DNA, 3000 bp, Unknown; identical to SEQ ID NO: 5793
  misc_feature (1)..( 3000): 2750-1469P.txt file - cDNA_ID_2992566; gDNA_ID_1620818; Annot_ID_169341

SEQ ID NO: 27884 - DNA, 3003 bp, Unknown
  misc_feature (1)..( 3003): 2750-1469P.txt file - cDNA_ID_2992578; gDNA_ID_2214700; Annot_ID_189626
cctcaacctcgacctatctactaaacagtgttaatggcccactctgggtcaaagcccttgctaacgtctctgctatccttcaatctgttatctctttgcacgtaagtttcttagcgccaagtctacgcttttttaacaaagactgtcgtctctaactatatgtctgactcaattctttgttgtagatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatctaaaaagcatataaaagaccactttcatcataatcattctgaaaatttaccaacaaagaatactaagttgcatgattaaagtctctattagaaatgtaaatcatagtattagagaagaacataaaaacacctaacttaaaaaaaccttaatttagtgagatagagaagagaagaaacagaattgttgttggtttaacaaaaacctaatctttcaatgattagctgtttaatttgaaattataacaataatttagacaggccaaagtggaaccccactgtctccaccaaagctctagataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagaggtaaccattttgccgtttgttagttcttaacgattttattctgttaaaaatcagatttttttttgcaatgcttgtagaaaaagattcgatttttgtgtactgattgaatcaaaatatgtggttatggatccatggattgatttgtttgaactgatgcaaatggctaatgtgaaaagtcaagaatgtgttaatgtagttttttttgttaaacctctttgtgttgttgggttttgaaatgttgttgttacagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaagtcagttttcctcttttgcctttcctaaatgtagttattagtgttttgagagtttcatttagatatttagctagagagatacttgatctgaattggtcttcgttaaagtgataaagttaaaacgtgttgatggtttctgaacagctgagcaattattcatcaatggaaggagtggtgtattgtaggcctcattttgagcagcttttcaaggagtctggtagtttcagcaagaactttcagtcacgtatgtaaaactcttttcttcaccttctggtccagcttttacatgtggtcactttaattttaatcttcaaactttttttttcctttcacagctgcaaagccattgactgataagccaaccccggagctggtaaacgcttcttaacaacgatgtttttatttagttacacgacttgagatacatgactctatttctcttcttggttgttctcagaataggacacctagtcgacttgctggtatgttctctggaacgcaagacaaatgcgctacttgcactaaaaccgtgtatcctatcgaaaaggttagtatacatttaagcttgtatatgtcattaccattgctttccaatacacttttgtgttctctctgtgattgttgtcaagaaaatcacagttaaacttatttggatcatttgcaatatgagttacatggatccgaatcacataaagttgagatctctttaatacagtcaattcttatatctcattgttctgttttctaaaaattgtaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgcgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgagtttcttgtttgtgatactactacatctataataaccgaggacttttggctttgatcttggtcttttgagctggaccgaaccggaatgttagaccggacaaatctctatcgttactcgtcgttagtcatctccggtccggttcttcactaaagttaaaaatccagttaaacagaaatcaattaagaaaacacaaaacccaaattgaattgtgtaaagatatgaactttacaaaagaaaattgtcaatttcgaaaaatg

SEQ ID NO: 27885 - DNA, 3003 bp, Unknown; identical to SEQ ID NO: 22896
  misc_feature (1)..( 3003): 2750-1469P.txt file - cDNA_ID_2992586; gDNA_ID_1620742; Annot_ID_49638

SEQ ID NO: 27886 - DNA, 3003 bp, Unknown
  misc_feature (1)..( 3003): 2750-1469P.txt file - cDNA_ID_2992588; gDNA_ID_1620813; Annot_ID_50614
gaaaagcgagatcttcttcatcatcaaaaattgcagtttccgcccaagtcaaagacgaagagatgggcttcagattacaacgaatgggctttagtaaacaacaatccatgagtcatgccgagagagtcataattagtccaccatgagtcaggttcgttgattcttaatttccttttctttttttttttttttaataaagattttgatttattttatgtttgttattttaaaagtttttatttttttggatgctaaatttatataatgatacgaaaactaaccggattttagatccagcattagtcgttagcgattccaaatattcaacttgttttcatattattatgtagatttagcattcaagtttttcattcggatttttaaagtactttttaaaatttagattttgtttattcggattttaaaaatcttttttcatgtgtttattttttaaaattatattatttaatggatactaaatttatataatgatatgaaatctaaccggattttggatccagcaatagtcgttagcgattccaaacattcaacttgtttttcctattattatgtagattaaacattcaaggttttacttcgcattttttaaaatagttttaatattatttttttggatgctaaatttacataatgatatgaatactaaccggattttggatccaacattagtcgttagcgattccaaacattcaacttgttttcatattattatgtagatttaacattcaagatttttatttggatttttaaaaatagtttttaaaattttgattttgtttattgtcggattttaaaaatcttttgtgtttgtttgtttgtttttaaatttatttggatgcaaaatttacataatgatatgaatactaaccggattttggatctagcattagtcgttagcgattccaaacattcaaattgtatttcctattattatgtatatttaacattcaaattttggatccagcattaaaaatttcagttttaagtaatgactcgattaaggcatgaatattagattttccttgcatctgtgatctcattgggaaggtttgttaccaattgaagaggaagtttttgttaatggtgactactgttgcttatggcatttgtattcattacatgtcatctttttcatgttgaagaagatattcagtagcaaaaaaaaataacgagaaatatttcaaattagaaagttttgtagcataacagagttgatagaagcgaaaacaagaatctgtaaagcctcctctggttttgggatgaagaaactacagaaacctgagaagaaaaaactctctgcgcttggcgataatggaacagtggtggagcttctatttttgcagctgtattctcttgtccctgataggcagatcaagcggtttctgggcctcgtgaggatggtcagggcctttgtacaccttcaggtgattgaacagagctctcccaagctgccacaaaatggtcagaccaaagttaagagggagttggaaaactagtaatcaatcaataccaatatcgcaacaagtagtttccaagttcaatccataagtttgaagaaacacggatttgctaagtgttaagacttaaaggagactaataaagagctgtggattatgtatctaacccgtccctttggaagcattccacgaacagcatgctcaacgattctttcaggaattctctgctgcaattgatcaaatgtctctactgtcataccaccaggtcgtcctgaatgcctcctgtacagcttttggttacgcttctttccagatacagcaactttctcagcattcacctttaaccaaacaattgaaaacagtattagaggtaccaagttacaagcattgcccaaacatctacatagaggctctacatcttgctgctaatgtgaatcttactaaaaccaaatcccaaggctcctccttcaggaagaaattaactaaagcagcacatcaaatttcttattctctacagatagctcaaagaaactcataccacaatcacaaaagctcccatgtcgacactaggagtgtaagaggcaagattcttcccacggatgtgattagcaattgtcgatgccaatctaccaagaattttgtcagttgcatcaaccacaaaccagggcttgtccgtgttcacatggtctgaagcttttggataccatgtcgtgttccagatgtcctgtaaaccatagaatacactcaataaaggtttcaagccaaagacttttaacttctctccaaccaaacattaataatttcataaaacgtccaagttaacaaattcagaagaataaacatcaattttcgaagccaattgatgcagacaacacagctaatgagtcaaaggcaaaatccactacttaataaatcgcaattgggagaagaaaaaaacaagccatacttcaaattcaaagcaagagctaaagtgcgacactttataaatgcgtagatgctaaacacagagggagatagaaaaattatcgttacagggccattagcttcttcttcgtcgaacatccatcgttgattcgccggaacaagagaagtcgtcgtcgtcggctcagcttcacacttcacttgcaatcctcttttcgaattcgcataaatgccgactcgtaccgacggcttcgagatagccgttaaagagaaccctaaaaacggagactttctctcacttccggaggatttcacggaagaagaagagagtatcaccgtcgaagacgagcaaagaaccgccatttttgtttttctctcttctgcaaatttcttctgctctttccgatttctcggataagattgggttctcagtaaatagtagtagtggcaacaccgtaaataatctgatgaatacgaccgaaaaataaacacaacacgggttaaggatccgggtttttttcggagctccggattcaacccgaaatactgttttttttttctcaataggagagaaaggtcttcttcggaagcaagctaagtcatg

SEQ ID NO: 27887 - DNA, 3003 bp, Unknown; identical to SEQ ID NO: 27886
  misc_feature (1)..( 3003): 2750-1469P.txt file - cDNA_ID_2992588; gDNA_ID_1620813; Annot_ID_169132

SEQ ID NO: 27888 - DNA, 3000 bp, Unknown; identical to SEQ ID NO: 7390
  misc_feature (1)..( 3000): 2750-1469P.txt file - cDNA_ID_2992592; gDNA_ID_1621143; Annot_ID_56680

SEQ ID NO: 27889 - DNA, 3000 bp, Unknown; identical to SEQ ID NO: 7390
  misc_feature (1)..( 3000): 2750-1469P.txt file - cDNA_ID_2992592; gDNA_ID_1621143; Annot_ID_172915

SEQ ID NO: 27890 - DNA, 3000 bp, Unknown; identical to SEQ ID NO: 5345
  misc_feature (1)..( 3000): 2750-1469P.txt file - cDNA_ID_2992596; gDNA_ID_1620781; Annot_ID_50360

SEQ ID NO: 27891 - DNA, 3000 bp, Unknown; identical to SEQ ID NO: 5345
  misc_feature (1)..( 3000): 2750-1469P.txt file - cDNA_ID_2992596; gDNA_ID_1620781; Annot_ID_167944

SEQ ID NO: 27892 - DNA, 3000 bp, Unknown
  misc_feature (1)..( 3000): 2750-1469P.txt file - cDNA_ID_2992602; gDNA_ID_1620790; Annot_ID_50464
agattggatacataccgtttactaatgtcttcccatgtgagacattctttgtctagaccatagtataatcgaatgatctctttttcccgttctccgagtgttgcacttataagcttgcttacttcctcctgcaattttatcatcaatctcatatgctcaaactctagtgtttcatgatagagaaaatcagaaccattgtattaaatgtagcttcacttatgacttgttctttttttttttttaccttgagtgccaaatcatcatacccgtgccacggattgttctccaaacgagtatccgcaatgtactggaaatagtgaaacaaacaagcaaatcgttataaactggagaggagagacacatggaaacatggatggtgaaaacaaaatcgtcgttttgttttaagagaaaccgaaaaagagactcacactgtgatgagtttctccagggagaccattcaaagaaggaaatgcatctctgtctagagaaaatactttgcttacagcctgtattttgcaaatgcaagagagtaagcacaaatacacatagatcccctcgaaaacgaaagggacatgaactaaaaatttagttttctttacctctgttgcatttctaactttcttctgcgacatgtttagagactctgcaatcctctggaaagaacaatcactataagcatacacaatgtagacttgagaaaccataattgtttaaatgttacacttacatcaatggagggtgtgattcctttctcttgaagtctaagctttgcatttcggattaaaccgagtctttcatgtaggtgagtaggtaacctcaaggttcttgagttgtccactagtgctcttgagacacccttatagatatttgaaacatagagtatcacttgtcaggttttacattctagccatattggcaagcacaaaaaatggttattctcacctgtcgaatccaccaatatacataagttgaaattctgaaacctttggaagaatcaaatttctctattccccgcaaaagtccgataagaccacccttcatagtagaaaacaaaaatctatcttatagaaaagttcatgaaaagctataacaaagagtacacaaaatgactttgaaattacctgaacaaggtcagacatttctgctcccaaattatcataacgctgagcaatagacataaccaaacgcacattactcatagccaacttctctctagctagatgacactccatcaaccacgcctgaagctcggcccgagatatcttcaaagatactgcaagctgttcatcagaaggctcacagcctaatctatccttcaatctaatatttcacaagacaataatttagtcttgcactataatacactttcagctcttttttctaagtatagtatgtttactttaccttgacttatgatcatcaagacgaagaccagatttgattttcttagacaagcgcacaacttccacatgactaagcacatcttcacttattacacctttcacataacctctaacttgctttccactagaaacatcagaaactgctttaacatgagtcatattagttttcttcttagcaccaatccttctttgacgagctgaaatccctgaacaggtgataaccggaatcttcttcttccgtatagtccccttgcccggatactcactcgacaccgccttttcaaatgaaagattccaacttttctctaacatagacttctgtaacagtaaaattgcctcaacagaatgactaattagatcatcatcatcataacattcttcttccaattccttatcagttccattaggtagccatggcttctcagtagaagcaacatctacactctctttcaaagctttagcagattgtgtgtgacgattcgacgaaggaaaactcggactatagttcgacgcctttttcgcagttatcccgcttttcgttgaagcaatatgatactgtgatgaacaatgatcatttacagatagaaacttctctgtaacatctgagtgataaaacgatgaactcaacaatcttttgccagtgttgagtcctataacagctgcagtagccattatataacactcttttgcactcaattcatcaataaaggaacaatctttgctcttcaagatcgtattctgctaacaaaaatcaatactttagatatcataacacaatttcagacacaaagaatcaatatcaacttgtgggtattgaaaattacaaaagttaataacgtaatccagcaaaagaattgtactttattctagttctgagctcgaagccaatcattactacccaaatttgactaatccattgaaacccaattaagaagatgaagaatcacttcaaaatcaaattttgcatctatggatagattccaaagacagagattttgagtaagatcttaaagagcaaagccaataacgcacctgagagtattgtcgagacaagaatgtgcaagagagtgtgtgtggcacagacaaatcgagaatgtgtgttttgttttttcttttttctgtttctcagttttttttttatccaagagttttttggtggcctaattcaaaccaccatgcagaaaataagaagagataaatataaaatggtttcaacaattggagaagtttagattatagtgaaaaaaacgaatatgataattaggagatataaaaaaaaatggagatatggaaagaagagatgggattggtggaagcagatactggctccatgtttctgtggtattcagctacgtctcttgtttcgctttcgctgccttctctctcccatttacatttcttcaccattaacgattaaggcccatttgagcccatgattcattagcttgcgcaaataaatgggccgttgaccaacatataaattggcccaaattcgtcacgctcacgcctccacccccactcagatccacatattaaaaaaaaaaaaaatcatttttgtgcaatcaatcagacgagaagaagattatccatcgccatg

SEQ ID NO: 27893 - DNA, 3000 bp, Unknown; identical to SEQ ID NO: 27892
  misc_feature (1)..( 3000): 2750-1469P.txt file - cDNA_ID_2992602; gDNA_ID_1620790; Annot_ID_168251

SEQ ID NO: 27894 - DNA, 2865 bp, Unknown; identical to SEQ ID NO: 5628
  misc_feature (1)..( 2865): 2750-1469P.txt file - cDNA_ID_2992610; gDNA_ID_1620807; Annot_ID_50571

SEQ ID NO: 27895 - DNA, 2865 bp, Unknown; identical to SEQ ID NO: 5628
  misc_feature (1)..( 2865): 2750-1469P.txt file - cDNA_ID_2992610; gDNA_ID_1620807; Annot_ID_168916

SEQ ID NO: 27896 - DNA, 3003 bp, Unknown
  misc_feature (1)..( 3003): 2750-1469P.txt file - cDNA_ID_2992614; gDNA_ID_1620782; Annot_ID_50370
gtgtctatgctgactaatgttgtctctggtgagaccgaaccctcggcatctgcgacatggacgatgggtcataagagagaaagagaagagttttctttgcctcctcaaccattgattaccggttcagctggtatgcatgtttttctaaatcgaatttttttttgttgagaacactatactaaccaataaaacattctttaaccaaaaacaaaaatcaataaaacagtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactctatgcaaccttctctgacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatattgtcaacgctttgtatttctacttattcgatctaccaattttttctctcccaatacaacttcagtctgattattgccttcttagatatgtcttcgaatgttatgactatacatgggtgtatataaaatttgtgatcaaagtcttgtaattagcgtgtgattctacatctttttcattagaaaaattgggttttcaaaattactaactcacgtgatcgcaacacatgagtataacataagatgtcgtcactaaccaaatataattttgttaatatatttaaagatagaatcagaaaatttcttaaaaaaagaagtatatacaataaataagaaattattttgtttatatattcaaactctttttattaatatattaaactattaacctctttctattaattttgttgttcttaatatattaaaaaaaagaagttaaaattctttattgtatcggaaataagaaaatgaaatttgttaacaaactattaaactaattttgttattttgttgttgttaatatatactccaaattgaattagttaataagtaaaaggctttagaaatcttttccaaattgtcaagataaatgaactgtaatcttcagaatagagaatagtggcttacaaagagctctcaaaaaagttgcaaaaaaaaaaaacgtaaaaataaaaattaggtctctatgggttttatacccagttaaataaaataagttatgaaactggataaaaaaaatctaatcgtagcatcaagaactggactgatagatctagtaggtggaccgcttgaccccaaggtgtttgaaaaacaatcttcgacgtcgtgacacttagttaatcgatccactctttgggatcaatcaatcccatcccttctagaaatctggtgctcgacgattaaaacccgctctttgtgaatttggcacttagatgggtgaaggttggaccgctcggtcccttataacctctcaaccacaaaggttcagtcttatcgcatgaaatcaattagtaaactacaattcatcctaacaaaaagaaagctatagtagtccatatattatgtagtttttgcttatgagtgcacataatgatgataacacaataaaacatggggtttcatacatgagcggagtaagaggtgttgtactagactaaagattagtttagcgatttagaattagcaaatagtgttaaaaatgacacaaagaaaaattttgaatgtataatctaatacatgattctcaagcctctaaatgagaaatattaaatctagattaagtttaaatatataaaatttagcttaaatctaaatttcaaaatgataggaactactataaaatcatatagtaacaagatacaaaaaaacatccatgtgttaccttaagttatatttattccctttagtaaccaacaaattttaactttctttcacgacaaaacttttgccgtctacaattcacacacacttccaactttgaagcttacatacaatacggtggcagcagtaacacacaccattatactacaaacatcgataaatttttatcaataaccatatcgatcatttgacaaaaccacccacggagtaaccatatcattataagtaaacataatgaaatttttgcttcaagtgaactgtgaacatgtgagtgtgttatcggatttagctgttgtcttttctttttatacgaaacaaaaaataaataaaacctttatcaaatttgtacaaacctctgggctttatttaggcccaataacaaaattcggcccatatttgagaattcacaaaacctagatactcttactataaattggaacatcattgatctaatacaattaattactgtgttaatattatttatactcaatctgaaatgtctttttttagctgtccaccagtttccaatctttgaaatacgaaacaaaaaataaataaaagtataaaacctttatctaatttgtaaaaacatttgttgggctttaggcccaaaacaaaagtcggcccatatttgagtgttcacaaaacctagatactcttactataaattcaaactagggttttaaagctcatttctctcttgcagtcctcatcgttggagcttagaagccgtcggcacaaggttcgtctttctctcatccctttcctcttcctttgcgtgaattcaccagaaaatgtatatctaccttagcgagtctgtctagtttagcgaatctaggataatctccggaagacacttttgaatcatcactgtttttgatctctgtttctttctctaattgtgttgttgtattactgttgatgtagaagaagaagaagaagaatg

SEQ ID NO: 27897 - DNA, 3003 bp, Unknown; identical to SEQ ID NO: 27896
  misc_feature (1)..( 3003): 2750-1469P.txt file - cDNA_ID_2992614; gDNA_ID_1620782; Annot_ID_167989

SEQ ID NO: 27898 - DNA, 3003 bp, Unknown
  misc_feature (1)..( 3003): 2750-1469P.txt file - cDNA_ID_2992622; gDNA_ID_1620758; Annot_ID_49943
caacttgtgtgttcccagctgtcacttagtcagcctgtccactcattttgttcttttttacaaaaacacacacatcatatattcttctaacatacattacatgctacatgtctacgcatctatatgtatgaatgcatcaattgtatgtatattgcggattacgttaattacattatttgtaagtcatttatgctgtaaagttttgtattctattctcagttaacttctaatgatgatatagtgatgatactatctataaaaaaaaagttctgatttaataggacctatctaggtgtaggcttgtagcaataccaaatgtagaaggttttatgtccaaggatttttcaattttctccatttcattccctaaattcctatcccgatttacgtccaccttacaccgtaagttgtgttgtcgaacattatcttccacacatattttatgtaaattattgactctctcgatcccattacatgtgatgtgggctctacctacggttccaccaacctcatattctaatctaatatttttctcatatgctaattttaaatactaaacgaatcttaacggctgatatattcgtatatgaattcatctacacaacatttatgttaatgatatatctctagtctagacattatttgtctacaaacgttttgtattgacttggccatctcattccaacaagatacaactcatcactccaaacattcaacttccatataaaccattcccttccgatctcactttccaaatcactcttcacactttaactaagcaaaccaataatggctaccactcgtctaactctagctcctctcctcctcatcgcagccgtactactcgcaaccaaggcaacggctcagccggcagcccccgctccagagcctgctggtcccatcaacctcactgcgatcctcgaaaaaggtggtcaattcactactttcatccatcttctaaacatcactcaagtcggtagtcaagtgaacattcaagtcaatagttcatccgaaggtatgacggtgttcgcaccaacagacaatgcttttcaaaaccttaaacccggaaccctaaaccagttaagccctgacgatcaagttaaactcattctctaccacgttagccccaaatattacagtatggatgatctcctctccgtgagtaacccggttaggactcaagcttctggccgagacaacggtgtttacgggcttaacttcaccggccaaacaaaccaaatcaatgtctctactggttatgtggagacacgtattagcaattcgttgaggcaacaacgtcctctcgcagtttatgttgtcgacatggttttgttgcccggtgagatgttcggagagcacaagctttcgccgattgctcctgcccctaaatctaaatccggtggggttaccgatgactccggctccactaagaaggcagcgtcaccgtcggataagtcaggctccggtgagaagaaagtcggactagggtttggtcttggacttattgtcttatgtttgaaatttctcttttgaaaatttaatagcaaagatttgttttgctttctattgattttatcctgcgatgtgaggtataaatatgaaatttgttgattaagttccgtgaaataaaatgtgagatttttaataacatacgtcgtctatagttgtcaattgtgcctgtcgaagtggataactcttttcttggcgaacccaaaacaacaaatttgtgatgtgaacaaaatattttgttaacttaattactaaagtacgtatacaattgatgagatgcttatttgttttctgttttaattgcaagttccattcacgacattttaactctagctacgtgaaaaatggatcgaaggatcggtagccgatccgaaaaactagccatcacatgcgattactagacatagattagtagtattatttaattctgaccagcagtatagatagtattcataataataaagtgttcagataatcgttttactgtaacacgctttaaaataaacatgataataactacccagttgccattaaattataattcatcgtccttagcccatgtgataatgggcttagtgaaacatattttaaaataatgggcctgagcaatgtctttaaaatttgtcaaacacttgaggacggaaaacaaaaacataactaaatgcctaaaatgggcctctcgaaaaagataatgtgtttaatgaaccatatttgaaagtaatgggcctaagcaaataggcacgaacatactagaaggtagtttgccaatgcatatctgaccgatttctcatttctaaaaccctaagcttcgccggcagctccgatcgtgatctttcataaatcctaccatcgccgtcgattaagagctgagctcaggtttatctatctgctttttcctcccagttttcactgtgtttcgttgtatgctctgtttggttgtcgatagtcacacagtgcctgatcgtcggtcaatttgctaatccttgtgtgatttagagttggaatgatcatttggtgaaatctcgtggatcttttcttgttgaaagcttgttgacttgctcgtcatatatattcgacgatctatgggtactgtatctagttgataatgttcaaaggcttgatcgattttagccttgggatctgctaccgatgctttcaatttctgacgcttttctatgcgatcttttcgaattcgtttttctctccagtttttgccatgtcaattgattctcttagtaacactacttctttgtttgctctcttggattttttgtttcttctgaaatggaggcttgtgcattgattgttctatgtgtgtgatttcttatgcggtgttaagtcctttggatcttcgtataatgatgtttttaatctgctgacaaacgaatttatccctgcggcgttttagtttgctacatataaagttcttagctgtgaactgtttctcctgggtatctcattgcggtttgaattctgttttgctatcaggaaatg

SEQ ID NO: 27899 - DNA, 3003 bp, Unknown; identical to SEQ ID NO: 27898
  misc_feature (1)..( 3003): 2750-1469P.txt file - cDNA_ID_2992622; gDNA_ID_1620758; Annot_ID_167072

SEQ ID NO: 27900 - DNA, 3000 bp, Unknown; identical to SEQ ID NO: 5228
  misc_feature (1)..( 3000): 2750-1469P.txt file - cDNA_ID_2992626; gDNA_ID_1620774; Annot_ID_50243

SEQ ID NO: 27901 - DNA, 3000 bp, Unknown; identical to SEQ ID NO: 5228
  misc_feature (1)..( 3000): 2750-1469P.txt file - cDNA_ID_2992626; gDNA_ID_1620774; Annot_ID_167630

SEQ ID NO: 27902 - DNA, 3000 bp, Unknown; identical to SEQ ID NO: 7260
  misc_feature (1)..( 3000): 2750-1469P.txt file - cDNA_ID_2992629; gDNA_ID_1621135; Annot_ID_56554

SEQ ID NO: 27903 - DNA, 3000 bp, Unknown
  misc_feature (1)..( 3000): 2750-1469P.txt file - cDNA_ID_2992633; gDNA_ID_1620785; Annot_ID_50417
aacgtacgatctattatgagatctcaaatataatacttgctaattatgtttgatcatgagaatggaaaattggtgacttttagagccggctcatacttatcatatttttatcgtttatgttgctttttaagtgattatttactattggatcatagtacaagcccgactcaggagactttccaagagccaaaatcatatcgaaacagttcgagattacaataatgttattacgaatacacgactacgactttaaccaaaaagttcacaacacttttgattaatataagaaagtgcatcggaaaattgtgtacactaggttgttctagataatgtaaagaacttacctgatcatgattgctaaaaataagaaaattagaagaaatttaagtcttctttcaggtttagcgaaatatctaattctccatatggctatatataaaaatctgtaaacagacaacttgtattctttgttaaaatttatcttgtgtagttgtacaaccaataattggaatattcgttgtcctagattcaggttatcagacccctaaagattaatgtcttatggaatgcttgtatagttgtatattctccagtttaatatataccagtctcgtatttaaaccttatactatttatccagcagcatgataatgtatagtttacaaattataaaatatttcaatgcttctacggtaatcatatttaaataggagaatttggcgccgtgatatgattgtagttttaaattttggttcctttaatcaaaatacatacatttgtttttccaaataaagttaaatttcagttcaaattatttcatggtgggtttggtttccacttttcaggtacgtataaaaaatctttttatatttaggtaagatcgatatagtttgatatttagatcaattttttggtttaaattaggtaggaagtttccgatctatatatgtatactgaaaactgagtagaatcgaacgttaccgttaatcaaccattacttaatcttggttataaataaaacaaaatttgttgcaatttcagaactatattgcaatcttgaggctttctacaaaacataataaaaaacttacacacaagacagttatatttttggaaaaataagaattgaaagcttgatttaaggatctcttttagttaggtaaatctttaagatcaatctactatcagatggcaaaaataatactagatactattccaacttcaagcgaggttagcagttagagtgtgggtcacgtacaaataatttcttttcatttgtgtagcttagaattggccggcattataaactttccatccaagaaatctataacaaaaagatataacaccagacaattgattatcgttggagaattttcatattaactacatcttcttacaacgagtctatataaccatttcaaacttaataccatcagaaaatgtaaaatttaaaatagttattcaaaacttaaaatagttattcaattatataatcggttactagctagatcaagttagtcggcgtagaagtgaaggatccaataatatctggttaataatgtcgacaaacattgtatacttacatgcaaacatatacataagcatatatatagtttatattattatcaatttggtcgtatatgcaaagagcaagttgatctacataaaacgaaacacaacagataagtgtttattttttcgccaactcatgactctaaagataagtatgccattgaataaaggaaagtttcatataaactattacattgatttgacaattacctgcttacttgagttagacatatatttgggaaaataacacgagaatgactcattacgtcattcgtttcatcatctttcgattaaaacacataagtatatttactccccatcaaaaaagaattaaattttacttgcatgtggctttggaggtttatggtatagttttttgcatgtgggtttgacattagagaaataaactgtctgcatgtggtcggaacatggggatttccaaaagatataaaattttacacttggcttgtgggttaacctatatgggtttcgagagacgaacgttaaataaagcatgttgcaagtaatatatcaaaattttataatatctcttataaaactgttttgtttggaagaagctaaaaccagactattagtattgagccgttcatgatgtctggaagtttctaggtaggtactgtctaaagtatcaatcagagaaattgaaatcattcacttatcattttgttcttctaagtgatgaagtgaaccaatactatcacttatcatttactaatattgatagttataatactctgttcgggttgaaaaagcagacaaaccaaaataaaactatatatatgtttactttaatttcactcaaagattaaagaatttagtttttaattgaattgaaatgtgatttagaaatttatatagtctctttaactgaaattttattgttaatgaaataatatttttttgaggctaacagttttcaaaagtattgtagatattaattatatttatattttttatataataactatataaaaaaatctgtagcatatttttaaaaaatacaaaagtctcacttttaagatcagtggatcttatttaaataaaagtctcgctcctaagttattctggttttacataataatatttaacaagtatgagaaagtaataggtaatggtgggagcaaataacataatgcccacacaagttctatgtggtattatttcattttctcaccacttgccaattgttgatttgtctctttttatcttcttctttctatttctatttctatttctatttaatatattttttttttctttctacttgacaatccaagcatcacacactctcctatatggctatatataaagtgttataaacagaaataacatacataaaaatcccaacatctcctaaaatctcccaaacttttaaaaagttaaccaaaacccccaaacaaaaaaatg

SEQ ID NO: 27904 - DNA, 3000 bp, Unknown; identical to SEQ ID NO: 27903
  misc_feature (1)..( 3000): 2750-1469P.txt file - cDNA_ID_2992633; gDNA_ID_1620785; Annot_ID_168113

SEQ ID NO: 27905 - DNA, 3003 bp, Unknown
  misc_feature (1)..( 3003): 2750-1469P.txt file - cDNA_ID_2992637; gDNA_ID_1621167; Annot_ID_57215
ttactaccctttcgcgggtcggataagagtctccgatgaagggagcaagctcgaggtagactgtaatggagaaggcgcagttttcgcagaagctttcatggatataacttgtcaagattttgttcaactttctcccaaaccaaacaagtcttggaggaagctcttgttcaaggttcaagctcagagtttcttggatattcctcctcttgtcatacaggttcgtaatcatttattttatttttttcttgctgggaaacttatgatttcaatttcaaaagtcaaaaccatgactcgtattgtttccatattagttaatttcgtgaaagaattatattcgaatttgttttggagggggataaacgtagctcgaatattttaggtttcttaaagttagttggatcgactgttctgtttaaatataattcgtaggaataatctaaattgtttttaaattcctaactcctaaattgattcggccactttgttcttttcaaattagaaatgcatacttttactggtcgtgcataagcattcgatgtatcaataacataaagttattttctactcttaaaatacgtgaactttaataaagagattatatggaagaaaaagaagggcgcatagagaataatttgtctgttcaatcatactctttttcttttctcgtttacacgaaaaacaaaaccctttttttcttgcattgaattagttcattctataagtcgttttgttcaactcatgttatgtgttttattaaaactgcgtttctatgaacttacgtataaagtatcagcaagtttgattattaacgcttgaaagctagtcgaatgtaataataaatcgacattttgatatcttacgaatattaatgcctcaggtgacgtatctccgttgtgggggtatgatcctctgcaccgcgatcaatcattgcctctgcgacggcattggcacatcgcagttcctacatgcatgggcccatgcgaccactagccaagctcatcttccgacccgaccattccactcccgtcacgtattagatccgcgaaaccctccacgtgtcacacactcacatcccggtttcacccgaaccaccaccgtagacaaaagctccaccttcgacatttccaagtatttacagtcccaaccattggctcctgccaccttaaccttcaaccaatctcatctcctacgcttaaagaaaacctgcgctccttcgctaaaatgcaccacgttcgaggcactagcggctaacacttggcgctcgtgggctcaatctctagatttaccaatgaccatgctggtcaaactcttattctcagtcaatatgagaaaacgactaactccagaacttccccaagggtattacggtaatggattcgtactagcttgcgccgagagcaaggtacaagacctagtcaatggtaatatttaccacgctgtaaaatcgatacaagaggcaaaatcaagaattaccgacgaatatgtaagatcaacgatagatttactggaggataaaacggtgaaaacggacgtctcgtgcagtttggtcatttcacaatgggcgaaattgggattagaggagttggacttgggaggaggaaagccaatgtatatgggtcctttgacgagtgatatctactgtttatttttacccgtggcgagcgataatgatgccatcagagttcaaatgtccctgccggaggaagttgtgaagagactagagtattgcatggttaagtttttagacggaaaagataacgaagatgagaattctcgtgcatgctaaagtttctatatacatttcagtggtctataataaaagagtacttcacttgtcgatttttgattggttttaatatgttttatgtacgaaatattttcttatatataagtttgaaaacagaaaatagacatatgaaccccaataaagactaattaaagagagtactagagtagctcacttgtcgatttttgattggtttttattaaacacaaaatggataatatgatgagtttaaaaacagtctttctccatgctagtatgataatgatattgactgatcgatgaattcaaaggaatacatgttttagtttagttcatcaactttagcttaacgtacggttcttaaatcgaagccaaaattcaaataaatattaatatatatccaattttggtaatctctatcagattatagctttatgaaaataaaaaatttaacaatgattcaaattgctaaatgctaatatattggttaaagtgttattttctgcaaaagttcaaataatgttaagactatttctatgtagtttgatcatttcaatctcaaccacataaaaaacgacactatatattaattcgaagcccatatccattatcgaatatgatgaattgcttacaatcataaagtcaaagcccatatccattttataaatagagttagatatttatcttttttaggtcgcaacaccgcaatagatcttttccccaagtttcagacaaacataaagcagcagagaaaattttcaagtttcaaagagcttttccctcaccaagcaaaatttgggttagtgaaatctcaaattttgctatccaatttcgttaatccttcctttgttagagtcgatttcgttgtcctctgatctcatctcttgaatcaatcggctcctctaatcctttacctccttcacgtttcgtaattattcgatctgttttctgcagatttcgtgaatttaatttaatcgcctcctcgattttaatatttcgtgatttgatagaatctgttggaaatttcttgatgttgcgataatgggtcaaaaaatatatatgtgaagctgagatcagatttgtgtcgtattatgtcccaaagctatttaacaatgaatctgtgtttgctatttgcagatatttgtcagcaaaatctgcagctaaattgggacttgtcttgttagttcaaagattgaaacttttttggttaattgtttggcggaagaagatttacaatg

SEQ ID NO: 27906 - DNA, 3003 bp, Unknown; identical to SEQ ID NO: 27905
  misc_feature (1)..( 3003): 2750-1469P.txt file - cDNA_ID_2992637; gDNA_ID_1974075; Annot_ID_180353

SEQ ID NO: 27907 - DNA, 3003 bp, Unknown; identical to SEQ ID NO: 27905
  misc_feature (1)..( 3003): 2750-1469P.txt file - cDNA_ID_2992637; gDNA_ID_1621167; Annot_ID_173880

SEQ ID NO: 27908 - DNA, 3000 bp, Unknown; identical to SEQ ID NO: 4578
  misc_feature (1)..( 3000): 2750-1469P.txt file - cDNA_ID_2992641; gDNA_ID_1620715; Annot_ID_49108

SEQ ID NO: 27909 - DNA, 3000 bp, Unknown; identical to SEQ ID NO: 4578
  misc_feature (1)..( 3000): 2750-1469P.txt file - cDNA_ID_2992641; gDNA_ID_1620715; Annot_ID_165628

SEQ ID NO: 27910 - DNA, 3003 bp, Unknown
  misc_feature (1)..( 3003): 2750-1469P.txt file - cDNA_ID_2992645; gDNA_ID_1620790; Annot_ID_50465
tgacacatggtgttccaacttccaagccactttcatggctataaacttgaaagactgtacattctggataataagatgggtcatgtccatctcttatttatgccttggagccgaagttgagccgcacaagagattgaatgagcttcagccatttctttctcagtagaactttgataaggcattattttagtgtagtttaagcatagacatagatttgttgggaattgttgctttgtttgacagcttaccaactgagttggattttgaaaggaaactaggggaaactggtaaatttctgctaaataatgaaggaactcgattgttttttattccaaacttgtgcagctttcatgtcgtcccctctgccataccctttagacagcttctgttcttgcttttgactctgtttagagcctcttgcttgttgtagattgattttattttgtgactatggctacattatggttcaaagtagtgctgcgcctgcctagcatattcaatgggtaaaaaatccagagtcatcttcatgtttaaactggtccaaaagctgcaaagagcaacacttctcctgtagttgtattcttcagatggtaatgattaagataaacttggtaggcttgagttgtcttgtacttttagatttgtagtgatgtaccaaatctgaggtttaggcgtggaagctttgaccgtgtatcagggaaggtgttgaagaacaagaccatagattaattgtcaggttgtttctgatgcagagaaacttgaaaggataagaacaatcaagaatagaagcagatcttgtttagttcatgcttgttttgttgtcctaaggagagataaacactggttttgttaattcatttcagtcgtaaatttttacatcaaatctctcatcttgtaactcttttgtttcaattacttccccaaccatagagtttgagtaaatcagaaaaaaatagtattatccaaccgttcaaccaatccgtgcgttgtttctatattttcgtagcagttgagttataaacacatttattatggtgacaatatgagaagcttaacttgaatcagaattcacccacataactgcaagagtcacaagagaagcatagattgaagtaggcagcttctgcacaactttgccaactccagggacaccttccgtggccttcttcgtcgcaatagccacagtgggagcaacaatcaaagctatgatcaaaccctgactaaccacgttaaacgtctcagccgtaatctgctcaataaacttcacaaactcttccctatcaagttctccatccaagttgatatcacagtcctgttacaagaacatcacacaaccattatgaccactcaagttgcctagaccgaaaagaaatagtaacattatctgatttttcaacctattcttccaaaatcagagtccagatgatttcaagtgtagtgttacaaacagtggttaatactaaacgtttaaagctaaacgcaatcgccaaaagaacatccgtttctgctttaaaaattgcattttgactttttctttacacaaataaccacaaacgcaaaagaagtaattcagcgtttgcgttttaaaagcgtttcaaggaagtgaaagtaccgtcataatgctattgactagatccttagaaggtggatcgaaatgaggaccaggcaatctcttgtttatgtcactgacaagattacacaacaagacaaaaattgtcagagattaaacataaaagtttctaaatctgtaaattaacactaaaaaaatgttatggaaccaaaagattttacttgtaaacgagaagaacagcgatgtataactcttcaaacgtaagattggctcttccggtttgcatcttgaaccgatcgaaaacacgatcacatatcgcttgtacctgcttatgtctccactctttacctgcaatttaacattgccatatacatattatacataacaaaagaagcaattttattacatatgcacaattacttgaccataaaactgattataaatgaaccaatgtgagaaactgaaaacaattttacaaacctcggagcttgttaaagacttgtcccatggcgatggataatcttcttctcgtctgattgattgcacaaaaatgattttttttttttttaatatgtggatctgagtgggggtggaggcgtgagcgtgacgaatttgggccaatttatatgttggtcaacggcccatttatttgcgcaagctaatgaatcatgggctcaaatgggccttaatcgttaatggtgaagaaatgtaaatgggagagagaaggcagcgaaagcgaaacaagagacgtagctgaataccacagaaacatggagccagtatctgcttccaccaatcccatctcttctttccatatctccatttttttttatatctcctaattatcatattcgtttttttcactataatctaaacttctccaattgttgaaaccattttatatttatctcttcttattttctgcatggtggtttgaattaggccaccaaaaaactcttggataaaaaaaaaactgagaaacagaaaaaagaaaaaacaaaacacacattctcgatttgtctgtgccacacacactctcttgcacattcttgtctcgacaatactctcaggtgcgttattggctttgctctttaagatcttactcaaaatctctgtctttggaatctatccatagatgcaaaatttgattttgaagtgattcttcatcttcttaattgggtttcaatggattagtcaaatttgggtagtaatgattggcttcgagctcagaactagaataaagtacaattcttttgctggattacgttattaacttttgtaattttcaatacccacaagttgatattgattctttgtgtctgaaattgtgttatgatatctaaagtattgatttttgttagcagaatacgatcttgaagagcaaagattgttcctttattgatgaattgagtgcaaaagagtgttatataatg

SEQ ID NO: 27911 - DNA, 3003 bp, Unknown; identical to SEQ ID NO: 27910
  misc_feature (1)..( 3003): 2750-1469P.txt file - cDNA_ID_2992645; gDNA_ID_1620790; Annot_ID_168253

SEQ ID NO: 27912 - DNA, 3003 bp, Unknown
  misc_feature (1)..( 3003): 2750-1469P.txt file - cDNA_ID_2992655; gDNA_ID_1620654; Annot_ID_47824
ttcatcagttacatgaaatggattgaaatcagtaaatctctttaatctgataaaaccctaattttacaaaccctctttggatgtggttgcagtagcggcggtgtcgaagtcatcggggtctttggttgggtcagatttgtcgattgaggagcggaatttatcgaggaaaggcttgaaagcgatctctatggctaaccatcctaacgccatcgctgcgaccaccacagtcgcctgtttcgctcccgaagtttttcccatcgctgcgtcgtcgtcttgttcgcgtgtcggtggtatcaaccgatggtttaagatcgggagatgggttttactaggatgtttaaaatgggccggtttgggcttctcattggataaagatagtttgtttgttaaactatggcccaactttttatccgtctattggttaattaatacaaactttttatataattgtaaatataattgaaaggatccctattttattttcttgggaatatatatatggaaaaaaacaatcaatagaattagataaatagttcaatatatcaacaatttcttttttgttaggataaggaacttttaccttttttctaatatagttacaaattgtgtttttttttttcttaatttattatcaaatttcttttttacttatatataacctcctttttcatatagagttattaactttttcattttctcagtaaatgtattaacaaatttagacttaatacatgaagacatctaatatttttattgatatgtgtcgtgaactcgtgacatgttagttagtaatttttataaaaaaaatttagataggttaaaattatttgatatgtgtaggggtgtcaatgggtcaaaatttattggtcaactcaactcaacccataaaccctaatgagttgaaaattttgactcaaatgagttgatgggtcaaatgagttgatgagtcaattggtttgatgagtaaaatgagttgggttgtaatgattaatggtttcaatggtttacccaattaacccatcaagttttgtaaaattgaattaaaccaactaaaatttctaaatcaatgtcaatttaagtctaaccaacacatctaaaccaatttaataaaattaatatttttccaaatttcttaaatatacatgcgatgaaattgagaaaaagtaaactcgtaaattttccaccaaaaaacataaacccgtgattttcccgccaaaaacgtaaatccgtgattttctcgccaaaaacgtaaacccgtgatttttccgccaaaaacgtaaacccctgatttttccgccaaaaacgtaaaccagagattttcccgccaaaaacgtaaatccataatttcccgccaaaaacggaaacccgtaatttttccgccaaaaacgtaaacccataatttttttccaaaaacgtaaacccgtgattttcccaccaaaaacgtaaacccgtgattttcccgccaaaaacgtaaacccgagatttttccgccaaaaacataaacccgtggttttcccgccaaaaacgtaaactcgtaattttgacgctaaaaacgtaaactcgtaattttctcgccaaaaaacgtaaactcgtaatttttccaccaaaaacgtaaacccgtgattttcccaccaaaaacgtaaacccgtgattttcccaccaaaaacgtaaacccgtgattttcccaccaaaaacgtaaacccaagattttcccataaaaaacgtaaacccataaaaagtagaatccgtaaatatcctaagtttgatgataatgaattaataatgataattatttattattattttataatagtaattaagtaaattattaattaaatgggttaacccatttaacaactcaacccatcaaattaaatgagttatgagttgacccaacccatttaacaaaatgagttgagttaacacataactcatttaactctaaactcatttgattatgagttgggttgagttgggttacccattttgacacctctaaatatgtgtctctagcctctactatttttaaaaactaaattttatataataaatttttttatcttaataataaccaagttgaacatattttagttctaaaattaactactcggtttaatattaaactttagaccaggacatgccggataacatggtcttagtgttgtcgtacgtcaccattagagtttcaatttgcataatacaaggtggttgacccaataaaagaaatttgattcaatttcgatataaacaggtttgttttggttcagttttacctattactttttattttgtccaatcccaaaactattatttcaaagacaaattggagaagaaacaaaaaaaaactaatggttggacaaaagattattatatatcaatttcaccacaaaaaacttagcattaaaatattcgaaatggacagcgacgaattcaaaccttcgtgttaattgtctccggcgactatgaattctaaaatcttccactttgcctaaaatatcaatacatcacattcatcctagccttatccactctttcttggaaattctggtctggtttcccttcagcaattcaattaacttcatcaaaccgaccggttcaaacaatcatctagaaattctattttattgttagactagatcatgaaattttgaccgagtcagcacacataaaatctggtacttgacgtggtttagttaacccaacaaagttgttttggttaaacggatttattgacaaacgtgtttcggttcactcactaaaaaacccggttaggtagatactacttcattgacaacaaacgaagcatcctttaatttcaaaaccgcgttttaatcagacttttccttttttattttcagttctaatgtttaaaactttccttttctttttctccatatttgactcgtcaatataaatacaattgtaacaaacagattttgatcaaaagattttacttttctcaattcctttcaactttcaaaatcgaagatctcttaagccatg

SEQ ID NO: 27913 - DNA, 3003 bp, Unknown; identical to SEQ ID NO: 27912
  misc_feature (1)..( 3003): 2750-1469P.txt file - cDNA_ID_2992655; gDNA_ID_1620654; Annot_ID_163598

SEQ ID NO: 27914 - DNA, 3003 bp, Unknown; identical to SEQ ID NO: 24301
  misc_feature (1)..( 3003): 2750-1469P.txt file - cDNA_ID_2992663; gDNA_ID_1621101; Annot_ID_55887

SEQ ID NO: 27915 - DNA, 3003 bp, Unknown
  misc_feature (1)..( 3003): 2750-1469P.txt file - cDNA_ID_2992669; gDNA_ID_1621117; Annot_ID_56210
aaagtttcaattctttaaaataataaatccgagtaaaatcagataactattttaattttggacgcttgataaatcaagcttcctgctcattcgtaatcagaatcattttggtccttttataatatgggtctgaaccattgtccaatttttctaagcgatgtgggacattgtacacatattatttcttcataggttgaataatatatgtccgtttaaaaaactttgaattacatcatattcagaaaaaaatataatattttattaactatatatattttatataaattcaaaataaataaagtataagatcaaataaaaatgaaagaagaattatatatttatgtttaaattaggtagaaatattttaggaaattggttaaggtaaataagaaatatggttagtttagagatattgtttatattaaatcattaattttcgtttttaattattagtttttaggtaacttttccaaaaattaatgttatccaatatcagaacagaattaaacatgttatccaggatccgaacagagttaaaccgggtaaaacccaaccatttgaattaattgttgaattatggctcaaatcttcaacattatcttcaaaaatctcctccaaaaatgtatatatagattaaagtttaatcaaaactaattataaatttgtgtggaagaaaacgaaacataatagttcaaatacgaaacaacaggaatagtaacatcatctaaaggctcttggagaaatttttaatgcagataacaattgtgaaccaagttagggtcttaatcatactctaattcatcaggtgtgataggtctcttgagaggaatcacagactttttctctacatctcttgataatgccttcctcatatctgtttttttagatcaaacgatttaagatttaaacaaaagaaaaagttaagcgcgaatcatagataaaaagaagttaatcaaagcctcacctaatccatcttcctctcctgaataatagcgtaaaacccgcctataaattatgtatccaagctgccagaaaaaggagaaacggtttgtttcatcaaaatggccatcaagaagaagcctatgaaggagatttgacactaataaatggaaatatgtaaaatgtgtgcatgtcccatttacaacttcttctttttttcctacaatgtcatcaacattatgaggcttctaatcaatttcataatcctaatatattaccttttcatacatcttgatggctggtgtgttggaagctcttacaaaaagatccacaaagtaggctttatcactgcaatcaataaccacaagtataataatcattagaagaccagaaattaccagataatatataaaatcaatgaggagaaattcaagattttcttcctttgaaacaatctaaatatatcggttttcaaataaataaatggtccactcgaaagccaatatcaatatattaaggctttcatattttatatcataacgatccatatcaaagagaacactaaaacttgagatgctttgtaattgttaagtcttacatcttatcacttatatcttccagaaggttcatcagtttctttgcaagttgctgcctgcggtattctggagagacagtgacggctgtcacatgaccatgccaagattcaccctgtccttcaactttacccataactgaaaccatgtagaatcttagttagacacatgcttttaaaattatatttataagaacaagttttacatatgtcacttacgttggattctcaagaatatcaaccataacatttcaactatacaaaagaacatttcagtgacactgcttaattttcaaatgtgttaatatccaaaagcttagttttactctcagttctttcaatggtttcactatacttccaaggtctctttccaaactataccacgaaaagggagaaaaacaggtatagtaatagggcaccacgagaacagaacgtcaataatgaagcatatatcgtacttgaagaaaataaagaaagataaagccttgtataaatcacatttcgaaccaatccaataaggtatagcatcattatactacaaacactgaaagacagaaaaatttgagccttgatataactcataactcattctctggacatttagaagttagcacaaacaatcttaagccatgcttcctatgcatcttctaccccatatcaagatttctaaaaccgctaactacagagactaggactaatacaagcagaatttgtttaaacacttatacatcctggtttgtgttaatcagttttcaaacagagtcactcttcctggttttaacaacattcaagctatctccatctgataaccaaaaaaaatcaatagtggcttttacactaacagtttatcatctaagtttcaaccctaaaagtaaacataatctccacgaatttcaaattcctaaaccaacgaagacataaagaaatcaaaacgaagagaacaagaggattacttactataacccatgacacgattgccgggaccttcagcaacatgaaaatagtcaggccatctcgctaaataggtcatgtagaaggacatattgaactgtttcacgaaacaaaattcgaacaaaaatcaacaaaatcgccatagcaaaacaaagcaataatcagacgaaaccagataataagaagaagaaacacgagattactgtttcagtgaggtggtccagattcacggaagtgaatcggagaaggtcattgcagctgaatctacgtatcgtcgtcatctcttctttttctcaaatcccttcgagcttcgtcagattctctggaaaaagaaagaggagacaacaacaaagcaatatacatggcccagttagaaaattaataaagcccatttatatttgggcctataacactgatgacgtcatgtaaaagatgatcaaatttcattatctcccgtcgtcgcgaccttctcagacaacagaaccaaatcctcggcggcgattgaagaaacctttccgatg

SEQ ID NO: 27916 - DNA, 3000 bp, Unknown
  misc_feature (1)..( 3000): 2750-1469P.txt file - cDNA_ID_2992675; gDNA_ID_1620818; Annot_ID_169365
aactttttcataatgtttttcataaccacagataccatatgtgtcaagcttactttcatctaagtgttctaaccttggcaagatactattgatcattacgattaacttttagtttctaatcattattattactacgtgttctacgtgttttattatttaaggtatcccgaccttccatctagatggatgagtcaatgatagtttatttctatttctaaaaccattttgaatccaaatccaaagaagaaagggtaacaccaatatggtttcatcgaagaaggaaaagaaaaaccttgttcttgtagtatattaatcggtttaaaactgcatttattctaaaacaacacttcatttaaaacggatggagtatatcccacgtaataacaaaaattctaaaaacgacaacgatacagttatctatgaactaatcatattttcatttttattttgactaataattaaattgctacgtcgattttaaaaagtatacaacataaaaatatacatttttaaaactcaaatataattacgatgtagattttgtaattaaatcattcaacacaaattctaagtaacatgaccttagataaaacatttcggagcgatgatgctaatggaggatgttggcacaacatcttcttgattatttgacagactatactaaatcaaatatcctataacaaaagaccaaacaaataaaaaaaactatcaattaattaataataattaaatatatagaaactgataattagccaatcatatattatttttttattttatcttatgaatttaattatacatagatatacatttgttcttggaagttttccggcgttatatttctcaaacattgtatgattcaaaatatataaaaataacaccaactagtaaaaaagtaattgtactcgccaatttaaacatatattaatgtgtagcacaataataagattgacgacacaattttattagataaacaacaacaacgacaacatcaacaagcacaacatgtaaataagaagttcagaaacactcaaaaatgagtagaggatgaagctggataaggattcttgcgaacgtacttacgagcccaaacatgtttgccatcgatggtgaacttgtttctaaacctcgcactcacaatctcatccatcatcgacgcacactgcagtttcatcaccatcttcgcaaacaatggctgctcgtttgcttcaacttcttgcatctctaccgcttctatcacttccccgaatctcctagtgaagtaaacccttacttccgcttccgagatcggatacccttttgaaaacgtcaggaaaaccgtccgatcatctgccgccagcacaccttccttctcttttacctccattgtctctttctctctaagggccttttctgtttcgtcttcaactggaggatgaggacgaggaggaggaggagaagcaatttttacttgttgtacacttaacctattagatttttcttgttggagactcaacctgagtttcttcatatcctctatgaatttctctctctctaaagccaattgtttctccctgttgatcctatgagctgtctcgcataaatctgagaatgctcgagtgcaaacatcggtccaactctttgtcactccagcgcaaaagtttttgcgttgttggttgatcaatctgagagtaaactttcctccagtaatacgtaagagcaatggtatcatggagttatcatcgttgtcagcagcgaagaacgttgatgcaaactctacgttgtataacaaatttatacacacaccgatttcgttagccaccgcgtcgacaaaagcgtttggtaacgagacaaggtacgcgattatgtcgcgggcataactggattgctcgaggaacaagagaaaacacatggctagaaacgactggtcaacgtctcggtttagattgaagacaagacgactgaacaaggttctgtcgattgtgtgaaaagcattgaactcgtctcgtgtcaccacaattgaagataaaggattgtttaagacagacggatacaaaggagaagccatgactgattttttatcgatatgtggtggtgatgggtgatgttatctatgtgattagagagggtttataaagagaatccattgaaatgttgaaaaggtgtaatcatatttttccttaataatttgtatttcattcctaaagagtttttgtcctcgttcatgtatctaattaattacatacaacagtcataaccttaaagaggcttggtatcgttttggtgtgagacattgtgacccttggatcatcatcattcttcacccataacccttcgatcattatcgtcatctatcacccttccctaacatttttgtttctttatgaagggagcctaaattattaagtattactattttctgacgctttactgtttttttttaaattaagataaaatatacagggtcaaacatttgataaggatattttaatcttgtcattaaggaaaataaaatatttgactacagtataatctcgatttaattaaatatattaattgtacatcatttgatttctccaaaataaattatatttcataaaggttttgtagtcaaaaatacttattttttgctaatagttaactgtatttttatttatttttataatttaagaattaaattttttatactttttcgtatatttccgtacatttcctatcttttaagttatttacattgcgttaatataaattaaaagaagaaatttagtagttagttaactataattataaaatggtaaaaaccgatatttgataaaataatatgtcattgaacgaattagcaaatacgtatcgtaaataaaatgtgtacggctccgtactgttttgataaataaaataatatcaaacaaaataatattatttatttaaaagtaatcacaaattttttattaaatctgaagataaaattctggataaaccataagattctttacctaaaataaaggtcaaagttttagtatg

SEQ ID NO: 27917 - DNA, 3000 bp, Unknown; identical to SEQ ID NO: 3940
  misc_feature (1)..( 3000): 2750-1469P.txt file - cDNA_ID_2992728; gDNA_ID_1620675; Annot_ID_164232

SEQ ID NO: 27918 - DNA, 3003 bp, Unknown; identical to SEQ ID NO: 19578
  misc_feature (1)..( 3003): 2750-1469P.txt file - cDNA_ID_2992728; gDNA_ID_2926203; Annot_ID_201974

SEQ ID NO: 27919 - DNA, 3000 bp, Unknown; identical to SEQ ID NO: 9237
  misc_feature (1)..( 3000): 2750-1469P.txt file - cDNA_ID_2992732; gDNA_ID_1972024; Annot_ID_178178

SEQ ID NO: 27920 - DNA, 3000 bp, Unknown
  misc_feature (1)..( 3000): 2750-1469P.txt file - cDNA_ID_2992736; gDNA_ID_2936586; Annot_ID_195099
gggtttgtgtgaggagagagatcaagtggacaaccatgtttgagtcaaaactacagggaagagagatatatttttaattcattgaatatatacattggtgaatggagagggaagttgtggtagattagattttgtctacgtatgtctaccacttgtctacatatgttaaagatttagttgtgacttaggaggtcgtcaagcgcacgtgctaagcacaccaacgatttcttgatcttttcttcttgttggtatgaatatgatcctagaggttagtttaacaattttctaatgattttatgtatagtgaaacagtaatattattcacaatttgtggaactggctgatccaaaatatgttaaaaatgacattcggctactagcggaggtctgattcttagcctaacccttattcaattcttttaatactactagtgttggtttgaagtaagagaataataatgtacgtaaatgtatgtaatttgaaagtaagaaaagctttcgatgaagtcttagacagtaacaaactaacaaacatatccgctcaactaaatttacctaacaaatttccatagttttcaaccaagatttaaattaaaaatacactggaaattctaaacaaccctaaattatgttttttttttgttgtgtgagagcgaaatagtcggaattagagtaagaccaatcaaattttaaatatttatcgtaacttttatttcaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatgggtcggctcaagttcgcatgtccggttcttgagatcaatttaatctcagctcaagacttagcccctgtctcaagaaacatgaaaacgtattccgtcgcttggatcaacaccgatcctatgagaaaactcaccacgcgtgttgatcaatccaacagagctaaccctatatggaacgagaagtttgtgtttcgtgtcaacgacaagattctctacgttgacgcatcagcgattgtgattgagatctacgcagcggcttgggctaaagatgctcttgttggtactgtgaatgttcttctcagcgatctttttgctccttggtctggttttggtgatggtaacgacggtggtggtgggaataacaacatgaggcttgtgactcttcagattcgtcgtccttcagggaggctacaagggtttttacgtctcggtgttgcacttcttgacggtggtcaacggagtatgcctttatctattgaggttttcgatggaagtcgaaaaggagagaggaatagtgttaaaagagaccaagaggcttcaagaatgatgcatcgccgtacgaatagcgatcaaacggatttaaccacgtctacgaatgattacggtgtgaaaacaggggttgttactggcaatggaggaggaggtggtggtggtggcggtattgttgttggtgcggatagtatggttaatggttcgctttgtagctctgatattggaccatcagcgtctgtggttgcggctgcgattgcgcaagggctttacaatagacagaaaacagcggttaaagcggctaacaaagaggacgcaagttcgatacttgaagggaaaacagagggaattgagcatagagttgaacggtggagagcagagaaaaatggcacgggtggagcgggtggagcggctggatcaagcgatgattctagcgggaaaggaggagcgggaaggagaagaaggaggaggagaagaaaggagaaacaacaagggaggagaaacggtggaggagagggtaagaaagggttgttttcatgttttggaaacgtgtttggatgtgagatttcgataacatgtggcggtggaagcggcggagaaggagacagcacaaagaagagatataataacaataaagtagtaaatcttagtgctgtagacgaaacgtttagtcattctgcgacttgagataagagaaaatgtttacttatttttggtttcttttggtggtgtaaaacgtttgatgatgggttaaaccatacagatttgaaagtattgaggttaaaacgtatgaataaactttcccgttacatttctggtaaatggactaatttgaatatttgtataatactggggttattgtgaaaagcttttaaagaaagggaaaagaaaagagagctttttgagaaacgcattaacacaccataacttcatcatcaaccttctcctctttcttacgcaattacaacttcaacgcctctctatctcttcgccgtgaatgtcgagatagtcgtaagctctctgcttttcaaatttctctcaaattgaggtagagagagagggcacagagatagagagagaggggcataggaaacggtgattttcccagttcccggaggaacaatcggctgatttctctgtaatcgaagaatctaaacctcacccactcgaaatcagctcgtgggttttggggggtctctattaatttccaaattctggagaaaaatcttgtatttcttcaagatg

SEQ ID NO: 27921 - DNA, 2522 bp, Unknown; identical to SEQ ID NO: 426
  misc_feature (1)..( 2522): 2750-1469P.txt file - cDNA_ID_2992736; gDNA_ID_1590940; Annot_ID_150290
  misc_feature (11)..(11): n is a, c, g, or t
  misc_feature (30)..(30): n is a, c, g, or t
  misc_feature (123)..(123): n is a, c, g, or t
  misc_feature (133)..(133): n is a, c, g, or t
  misc_feature (1429)..(1429): n is a, c, g, or t

SEQ ID NO: 27922 - DNA, 3003 bp, Unknown
  misc_feature (1)..( 3003): 2750-1469P.txt file - cDNA_ID_2992740; gDNA_ID_1620343; Annot_ID_154076
tcttttggccggcaaaattagacatttgtaagatgaaatgaactgatataatctgaggttagagaaacttttggtatatagtttttttttcaacttatttaactggagtttaggcttaacaagttcccacataaaagcggaattagaattctaataagatacgaaaatacacgagccatggcttgggtcggtagaaacttcaatgccagtgttatggaaattgcattgttccttggtggcaccaaggttctggtaatacaagttcattgcgaacgacgcgtgatctcttaccgtgtttggttcaaagcaaggtccaccggaattgagcgctccacagtcacggaatcctccttcgtcgctgcaaacccaatctatattcgcttgcagttgcttatctgtcgctttgtcacccgctatgcaccatactcctttgttttcagcagcctgcgagaggtttcttggtgtcgagttcacggatacggtagatacgaggaggacgaagatgagcgtcaatgatagagacatcagttttgtgaccattatattattgcttatagattgatatttgttcacagactaaacattttatgtgtttgtgtcaatttatacgctaaatcaaaaggtgataagaagaaaagaaggtttggtcataatttatgcaaaaatgtgtaacttctcacttgtttgtttttcctcgtcatatatatatatattattaaaatttatttcttttgttatattataagtaaaatttaaaaggtataaaggaaaattcaatatagtttaatgcatcatttaagaaaatcacattttctagcaacgtaactgaaattttcaactttcttgactctttttttgtcacatccacgtaactgcaatgtaatccaactttcagtccacttgtctctaatcgataagccacagcatgtgctcctttccaatgtaatactctcgtgctaaagattccataccttctttttcataggattaatcgaaattttagcctatttttttttttgttacgagtccagcaagaaaaacctttcctattagcatcaggtttaatgtatattatcacctcaaaaaacttgaaatgctctttcaagatacataaagtcattttatgagttggatcttgcgtttatgaagtctttagccatcaatacaagtattgatctgatcatgtactaaaaatgattaattcatcaacaacatttgagaaatatgaagatgttctataagttgagaatatactccaatatatagttacatataaacttatacagagattagagatatttgatcaatatatagcattttcaacttatttggagattcggcttaaaaatctaccacacatacattaatcataagatatgaaaatacacgcgtcatggcttgggtctttagtaacttcagagccagaaccgttgaaagtgcattggtctttggttctaccaaggttctggtaatataagttcattacgtacgacgcgtggtctcgtagagtatttggttcatagcaaactccaccgggattgatctgtgtacaatcacggaatcctccttcgtagctgcaacaccaatctatattcgcttgtagctgctcatctgttgcttttttattcgctacacaccaatatcctttgttttcagctgccggtgaaaggttttctagtgttgaggtcacggagacggtagaaacaaggatgaagaggaggagtgtcaatgatagagacattgtttttgtttttgtgaccataattgcttgtatatgatttgttgtttgattgatattgttcaagagtaaatattctggatatgtgcttgtgtttatatatatactaagtcaaatggtgacaaactaaaaaataaggcaaaaggttttgtaaaaatttctatcattaaaaattaattttattttgttatatatattataaataaaaatctgaaagatagattaatactccctctatttcattaattatatttgtagtttaaggttttttcatacatattaaaaaaacacaaaaatctcatttagtttctctattttctataaaaacatcattaactacacctaattcaaccaataaaaaactatcctgtaaaatataattggccaaaatttattaaatgcatttaatttttgcatagataatgaaaacaacacttattttgtaaaaagtaaaaaagtccttaaactacatataatcagaaacagaggaaatatctaataaagtttaataaaccatttatgaatctgacccttcttttattttattttataaatacgatcttatcttatcttgataaaataagaaacatgataagtgttgtttgacacatcagatctattatgatgatgactttccgaccgatttccgatgaattctattcactggaaatcttcgactgattcaacgaattcaaatttcaacaagaatcagtcgaaatatcataacagaataatgacaaatgcgtaatcatcagacaaaaagtcgcaaattgacatttaagttaacttcatacacatagttgaagatccaaagatttgaagtttgaatgcgataaaaagaattgagtcttaaaactcttaatttgacattctacgttttaaacatgaatgatatttagttatttaccctcggtcaagatttgctaactatttgtaaaaatttcaaacttaagaatcgaacatcattcaaaattatataatgtgttacgagagatgcgagtggagagacaacttcagggtctaaattgcaaattttaataagtatattgctttttgaaactaaactatcaattattacacttttgagacacagtttctttctgattctcacttgtgtcgcttttataaaaaagataaaacgcaaattgatttcttcttattctgcttcggtcttcgtttttctttacccttttgatttgatcttctcttctcggttgaaattagggatttctgtaaaattgtaatgtgtttctgagtaaatcatg

SEQ ID NO: 27923 - DNA, 3000 bp, Unknown; identical to SEQ ID NO: 14268
  misc_feature (1)..( 3000): 2750-1469P.txt file - cDNA_ID_2992752; gDNA_ID_2684096; Annot_ID_190124

SEQ ID NO: 27924 - DNA, 3003 bp, Unknown; identical to SEQ ID NO: 26779
  misc_feature (1)..( 3003): 2750-1469P.txt file - cDNA_ID_2992756; gDNA_ID_2213664; Annot_ID_182025

SEQ ID NO: 27925 - DNA, 3003 bp, Unknown
  misc_feature (1)..( 3003): 2750-1469P.txt file - cDNA_ID_2992760; gDNA_ID_1620669; Annot_ID_164035
tgctattgtggaacgcatcttttttttcataaactttatcatataagaaagaacttgaaaaaaaaagagattctaaagaagaaagatcaagatgtctccaagtaacaagttgcagaagattcaacagcttcatcgagctcaatatctccacaagtagagagaattgttgcaaatatataatcatcaacttcaaatccctctgcctccattctatacattagcttcaatgcttccctgcaaaacccattcctcgcataacccattatcatcgccttccatgaaaccaagttcttctcaggcatactgtcaaaaacccgaaaagcttccgagacaaatccacattttgcatacatgtgaatcaaagcacttcccacaaagacatttgatagagcatgattcttctttgcaatggaatggattgatctaccgataagaagagattctgaattcgcacaagcttttaaagccgaggagtatgtaaatgggtttggctctacaccttcttgaatcatctctttcaagaagtctagcgcttccgattcatgtcctaagctcgaacatccagagatcatagcggtccatgaaaccacatctctagatggcaattgctggagaacattgaaagcgtcacgagattctccgcatttacaatacagccacaccaaagtacttcctatatagacattcttttcgatcgaattcttgataatctgtgcatgaagttccttccccaacaataaagctccaacagatccacacgctctaagaatgcttactactgtcaaattgttagcaatcaaatgccgcctcttcattatccggaagaggctgatagcttcctcaccaaaaccttcccgagcatgagcagctataatcgaagtccatgtgaccgtgtttctattactcattccatcaaacacttttctgcaatcagaaatctccccacacttagcatacatgtccatcagcgaagttcccacaaaaacatctgtctttatcatcctcttaacaaccaagctgtgtacttgccttccgaatcttaacgctttctcctcactacaagccttcaaaatactgcacaccgtaaactcgttaggcaaaaaccagtgattcaacattccgataaacatgcctatagctttaattccatgcccttttctcgaacacgccgatataacagcagtccaagatatcacatctttctcctccatcatatcaaaagctcgtaacgcacttgtcaattcaccgcattgcgcataaaaataaacaagagaactctccacaatgagattccccactccaactttcaccatattaccatgaacttgtctccctaactcaaactctgctctcctactacacagattcaacaaacacacaaacatcctctcgttcgtaaaacgtattccatgcttcacataatcctcaaacagtgcaaaagcctcatcctcaagaccatacttcaaatacccatcaatcatagcagtccaagtaacagtatttttctcaggcatactgtcgaacactttacgtgcataaaccaaatcaccaagtctaacacaagaactaatcaaattgttcccaaaatagataacttgatcatcaaaacacttcaacgccatcgcatggatccttttaatgagtcgcatcccattagaagactgtagccactccgctaacagagcataatcaactctttcgctatcgaaagaagacgaatcatcctgattcacattctctcctttgaaaccactaaaacccgaatcgaaagatgctctctttccagaaactaatcgaaacccaggtaatctcacgtgtctctgttcctctcgcttagttcttgaatcgctactgtaacatatcgtcggagatttgtaggattgagtcaccggaatctctgaaatccggagacgcggttggattaacgataacgaaaacattgtcggcgatggagaaagagaagaagcttcacacagagatctcccgccggaaaaaaaatcagataaagttctcttttttatttattttggtaaagagaattaaaagtttataatctgatctggtaattatgacgacaacaaataatatctcggtcggtttcaaattcctaagcgagagacaaatatacagtacacacacgacttaatatcaaaaccaataaacgtaaaacacgtgtctcatcacttcccactttcctctctgcatttgttgtctctctctcctgaaaacccttgaattttgctacacgatctctgaaacgtgtctctttgactgacttcaatcttctttatcacttaccgtttctgggttttatgaagcaactgagctaataaaaagcttcttcttagactcggaagaagataaaaaacagaatctttattgtttaaagcttccaaattcgagaagagaatttgaaacgaccaagttcaggatattcgtttcttcgtctactttggtctcttcctcttctctttcgaaaagggtttattctgtcttaaaagaaacctttttgagagggtaaaaaaagcttcaattttcagagaaacacaaaaggcagaaacagagaaaaacaaatcatctaattcatgaaacaggtgagaatacatattttcttcttccttggtctcttctttttttattgatttcattcatatatccaatttttgtgtctattggctgtttaattgttgacgatgatgaattcagttagataattatgtgcatagtttaggaattttttagctatatcttcttctcatgtgtaaacatagaggaaaatctaaaaaaaatatctgtcaaattattgtcttttccaaattgtcctcattgtcctattgaatcaaataagattttttattactgatgattcaaatattgttaatagtttataaccttgctcagtgttcttctgatgtgtgatttaaaacctcttgtctctaggctctgatctatgttttcgtctcaaagtcttattatcaattctctaaattgcagggttcaatg

SEQ ID NO: 27926 - DNA, 3003 bp, Unknown; identical to SEQ ID NO: 27925
  misc_feature (1)..( 3003): 2750-1469P.txt file - cDNA_ID_2992760; gDNA_ID_2926170; Annot_ID_199462

SEQ ID NO: 27927 - DNA, 3000 bp, Unknown; identical to SEQ ID NO: 5385
  misc_feature (1)..( 3000): 2750-1469P.txt file - cDNA_ID_2992819; gDNA_ID_1620784; Annot_ID_50404

SEQ ID NO: 27928 - DNA, 3000 bp, Unknown; identical to SEQ ID NO: 5385
  misc_feature (1)..( 3000): 2750-1469P.txt file - cDNA_ID_2992819; gDNA_ID_1620784; Annot_ID_168080

SEQ ID NO: 27929 - DNA, 3003 bp, Unknown
  misc_feature (1)..( 3003): 2750-1469P.txt file - cDNA_ID_2992878; gDNA_ID_1621147; Annot_ID_173079
ttttttctttgagcacttgtgcaaagataagcgtgtttgtgtgtcttggtgatgttaggcaaaagcacaactgtcaagacacgctacacagtcatgtcacgggagacgctgcacaaataccctgaactagcaaccgagggttccccaaccatcaaacagaggcttgagattgcaaacgatgcggttgtgcagatggcatatgaagcgagcttggtttgcatcaaggaatggggaagggcagtggaagatatcactcatcttgtctacgtttcctccagtgagttccgtttgcccggaggtgatctttacctctcggcacagctgggccttagcaacgaggttcagagagtgatgctgtattttcttggatgctatggaggtttgagtgggctgcgcgtggccaaagacattgctgagaacaacccagggagccgtgtgttgctcaccacctctgagactaccgttctggggttccgcccacccaacaaagctcgtccttacaacttagtcggggctgcactctttggagatggagcagctgccctgatcatcggagcagaccctacagagtcggaatctcctttcatggagcttcactgtgctatgcagcagttcctgccccaaacacagggggtgatcgacgggcggctgtcagaagagggcataaccttcaagctaggaagagacctccctcagaagatcgaagacaacgtggaggagttctgcaagaagctagtggcaaaggctggctctggtgcgttggagttgaatgaccttttctgggcagttcatcctggtggaccagccatcctgagcgggctggagacaaagctgaagctgaagccggaaaagctggaatgcagcagaagggcgttgatggattatgggaacgtaagcagcaacaccatcttctacataatggacaaagtcagagatgagcttgagaagaaaggcacagagggagaagagtggggtctgggcttagctttcggaccgggaatcactttcgaaggctttctcatgaggaacctctaaatgtatatgaactggacatttctcaacaaataaaatatacaggaaccgatgctaacacacatacatcatgtaatggttgcattagttttgttctttaatggtaaatcacagaaatacatcaatacagtaagtttatatacataattgaagtattcttcaatggcatcttacttcatgcatccaaaaagtaatttcaaccttacataattcagatgtcgttttctctggctttcaaagattcactcgattctagcaaaggaacatacgtaacatagtgtgacacactagtctatatatacatttttgcaatatttttaacaaataaatcatagagttgagacttatttacaactcaatgctattgacattttattattatcaattaattaatattcctaattattaggatttccttatctaatatatctccatcaattctaattatttaaaaaaagagaaattttaggacattattaatattatactttattaaaccttaccaataaaaaatatatactttattaaaggtaaatattttagttatttaaagtttattaaatattttcacggaaaaaacgtttagaatatttataatatggaaaatctataaaattaaataaacatttgaaagaaaactttttaattgatttaaattataaatcttttaataaagtattattaaaacaaaaaataaaaaataatgtttaattacaccgaactggattagatggtataatgggtttagaatattataatatatgaactttagaacaattaaataaccatttgaaagaaaactttttaattgatttttgaattataaatcttttaataaaagtattattaaaacaaaaaataaaaaataatatttaatttcaccgaactggattagatggtataatgggtttagaatattgtaatatatgaactttagaacaattaaataaccatttgaaagaaaactttttaattgatttttgaattataaatcttttaataaaagtattattaaaacaaaaaataaaaaataatgtttaatttcaccgaatggtatagatggtaggacgggtttagaatattataatatatgaactttagaacaattaaataaccatttgaaagaaaacttttatattgatttgaattatatatcttttcgattaaagtattattaaacaaaaatgacaaaataatatttaattttattgatcgggtttagatggttaggacgggtttgagtcgatagaaatacaagacgatatatcatgggtgaaatccataagatatgtttgatattcactgaacgagattagattgtaggacgggtttgagtcgatagtaatacgagacggtataccacgggcgaaatcatatatataacaatcaaaatacaattatattatcttaaacactatacaaaacaaacaatattaacaaaataaatataatttaaatttaaattatttagttataatctaaattttaacttaatggacggtatgttattgttcctatatctttaaatagtaaaaatcaaacaagtaattatacagtaaataatatataaaaataagagttgtacatttagaaaatataaaacattaaatcatatatattttaatctactaaacaaattaaatttataccgcgggataaaaactagtattatatgttagcgaatcctactaaactatgacaacaaatatacatgcgagtcgtatacagaattgattctcacatttaagctgtcaacaaaacattcaacaagtcttaagcaagccattaaagaagggacctgaacaatttaatatatatggttaactatttaagtatcatgtccccacttgtccattacgtgattactacaaaagttcacataaaagttcctttttatatatataggaaagggaagaagatctcaataacacaaaaccttttaaactagtaaaatacacagattttaggatg

SEQ ID NO: 27930 - DNA, 3000 bp, Unknown; identical to SEQ ID NO: 14136
  misc_feature (1)..( 3000): 2750-1469P.txt file - cDNA_ID_2992886; gDNA_ID_2214702; Annot_ID_189711

SEQ ID NO: 27931 - DNA, 3003 bp, Unknown
  misc_feature (1)..( 3003): 2750-1469P.txt file - cDNA_ID_2992890; gDNA_ID_1620764; Annot_ID_167287
gatctaattaaagcgtatatttcgatttgattcctcgggaaaataacataattagaaataaaataaaaaattgatatcacaatttccgataattatggtgaacattgatttgatttgattggccggaaaactaaccttgatctctgagtacgatcaccggtgtgccggcaactgaatttgcatgtgaaaactggttgccggatattgccttgaatctgaacgacttgaggactacattcaggctcgccgtcaaactgaaaaacgaatctaggatcaggctccgccttcacattcaggtgaaactgagcagacgacgacgattttccagctccttttccgactgatatccatccgttgtggaagacgcacggtttcgattgcgtaccagatagatccaacggtacggagactttcgccagaagacgaccggagtgtacgccgcaagcagcgccggctcttccagtgtagatcaaaattttaagacaaggcttagaagtaaatatagatctggaagctaagcgttgaatatcggagctgctgagatgaaacgtggcggctagggtttggatctccggaaactgagtcgtctccaaaggaatgtacgggattgcggcggtttgcggcgggaagtttttgagtttgattttacaaaaacaaggagaagacgacggatgcacgacggagctcgttgtcttcgccgctaacggaactttcaaagctaggttcccgattgtaagacggatgaatggacaaggatccatttcaatcgcaacgagtcaattagggtttttcagagagagacggaggaagagaaagagaaggaaatgtgaacaaaaagggtttaggaagagttcgacattaatggcaggaaccgttcaagagacgatgacttaggggaattaggcaaaggaaaaggaggtgacgacgataaaacgcagcgttttaatggcgccgtattcacgacctaaccattggaggaagcagtcgtcttcttggtctttctgtgtatgtctctggtttttaagtggagacaaacaagcaagcacaatttacatttttcccatttttgcattccctcctttcgtttgctgtattttcctaaattgtccaattcgcctttattataccacaactttaatattggtaccaaacctttttaattttgttctttaatcccctttttcattaatatagacggttaagctacatccaccgatgaaaaaatcatttgaataatttttaattacattctataactataagtcatgttgtaaagagtttgttattagagcatgaatattccattattctctcataaaaaaagaattaaatgagaaaatttgtccctaattcttttttatttcaagtagccccctaaattgtggctaaacatccggtaatcgtaacaatgatgtagattgggtaactctctgctcgaatgtgacgcttattttggcaaataatgtttctttggtaaacatttgaaagtttttaaacaatttgttttgagtatttaaaatacgtacggataaagggtaaatccgaaatttagagttagttgagggctggtagagaaaattaaaagacattggagcacagctgggaacaggctggcgaagaagtgccaggtcggagagaggttgacgtaattttcttttgtttggtttctctctctacctgataagtgaccaaccacacaaaaacatagggctccacttctttgaagtttacgaaattacccttgatgcttacgtgtacattcgaggctctgattagtgccttgatcggggagaatctttccgcctctatgcggaactcacgttttcgtgtcagtctcatagttttctggtttttccttaacacacattttattcagattaagagatttcttttttcttctgttaaatttattttatttttagttccgtttcataattggcgtagctagtttccaatgtatttgctaacagtgatgaaagatgaacactacgaaacatttaaattttcttcatgtgcatgagttttggaatgataaacttcctaacattatttacaccatagtgaagtgttcttggttattttccacaaagtattcttgaattgtctttggttattaatagccatcggtctaacttttctacattcacctagaaacaaaagtttgatcaaataaggaaacaaacactttttagagccacaaaacttttctacatttgtgtacagtatgaaattagtaaggtgttttaaagtttcgaggaaccgtcatttaaaaatgacatcaaatagtcaccttttcttctactgcaaaggtaaactcaccactctattcgctctgagaatgcagcttctgtattatatagaatacaaaatttctaaattaagaaattaaataatgcgtgcgagtcaataaaataaaaataaagtagaattctttggggattgggcgagagatatgcgtgcacgtttacgacaacttagattcaatttcttttttatatagtagtagtatttgtttagataagtagctgaacgaggatcgtggatgatagctgtattttttctgctttttttgttttttaatgacattcatttatagaggatgaaggaaatgtcttcttcttgcctcagcaacacaaaattacgtaaaccatatttttgtttttacagtagtaactgtagagaagtccatcagaatattacagaagcccaattgaaaagcccatttgaaacccactgaattaaataataatcgaattcggcggagactccaactattgtcggcccatcaaacagtttctccggtggtttgagaactaactgaaatgtacgaaattaacctccgtggcttacgtgttctgatcggggaatctttccgccgaatctgagtttacgtttttttttggtgtcagtctcatagttttctggttttaaaacggaaaatatatgcgttagggtattgttggataacgaggaaggagtaaacgaaggaagaagagggagatg

SEQ ID NO: 27932 - DNA, 3000 bp, Unknown; identical to SEQ ID NO: 12819
  misc_feature (1)..( 3000): 2750-1469P.txt file - cDNA_ID_2992894; gDNA_ID_2214573; Annot_ID_186250

SEQ ID NO: 27933 - DNA, 3000 bp, Unknown
  misc_feature (1)..( 3000): 2750-1469P.txt file - cDNA_ID_2992900; gDNA_ID_2926236; Annot_ID_142758
tacgataactaatacgtgagaagcatacaatgtcatttaagcatcagacttgtcaaaatacagaacgatgaaagaaaaatcaaagattccagaacacatcatccattagcttcaacttattgactatcaaaatcgaagcaagtaacaaaagattttagcaaaacatgcttccatggaaaaacaaactagcaatatagtcaaaaagagaaatggaatctgcagggaagaagactaatctcaactagagaaatcaacgcaaacaatttcgtatgggaaatactaaaaataggacttacaaagaagatcaacacacataacaaaaactccacgaatttatgagaaagagcaacgaaaaagcaaatggcgaaaggtagatctgcgacactaaatctcagataaaaaggcaatcgccagcgaatacacagagagaaagagaaaacgtggaaaaagtgggagagagagagagagagagaaatagagatagagatgtataatgatgagaaaacgcgtttgttccagaagaagcaaaaaaaatagaaagaatcatcgtacaaagtgaagatgaaatttaccagaagaagaatgataaacacttcctcgttctagaccttgtgaaatccttctcactgctacgaacgatcctcctctatcatccatctctctctctcactctcttccgagtcacctcaatcaccaaatatcttctatcaaatgcagaaacaaacaacaaatacaagttatcgaatcaatcggaactttcggaatctgaatcaaacagagacgcaatgcgaatccatatcatgagaaactgatcaaaaacacctaaacagagataatcatactatatgtacccgccggaaaacgaacaaatcggcgtcgctgcttttagatacaacagagagatagacgaaaacagttaggattgagagatctaccgagagagtcgccggagtttaggcggcgattgagcttaacagatggcggaatttatgaagattcggccgtttctcttcttttttttctttctttgggtttaagaaaataaaaatggggatttacaactaaaggatctggcgcgtgttgttcagtcgctatcaaaagcttagtaacggaaaataatgactcgtgcggtcatcggtatttaagtcggacgacgtcaacgacaatcttctaattcattttttttattattatctttcaatcttctctatttttaagcatctttttaagattctgttttctactgttgtgaacatcgtgaatattgctgtaacacaatagtaattcgaaatgaattacataattaacttatggttatttgttttcattttttctatatactaaccaaccattagaaagttatactttaaaatcaaagatctacttggttgttaacacattcaaaatagctgagcggttaaggaatggttaggcaacaacaaaattttgaattacctgatcaaaatattgaaatctaatctcacagaattatatgattagtaaagtcttagtgccacacttccgtttgcaactagtgacgcttcgagtttggaaatgcattatcgaaattaaactttatttaataaaatctatctaaaggttagctttcaatctagtttttgtttactttcttaataaaacaaaacatcgaatccgagtaagataatatagcatgtagagtaataatgttgtcttacaaagctaaccacataagtgagatcacggtatcatgggtgcgacaatttcattaaggcgtgggccaatactatcaccggtatggttcaaatatagccgacccgcgtgtaaactgccttttctttttgttcgtgtgattagacattcacttagtaacatgtcaattattagtagatccttaccgtttaatgcaaaaataaaatttcaatatacaactactagtattaaatttacaacttctataaaacttttgggaaattgtcaaaagtcgttgtaacgaggcatgactactttctccgacaaaggctccgttctgcaagcaaatgtttctagatcccaaaaattatgtttgggtgtgtatattacatgatatgccagtccaatttttatctatcaattttgtatataaacgtggatcacaaactttacttgaacacaaacgaagaaatacaaaatatttctcaaactaaaaaaaataaaataaatacaaaatatttctcaaactattgtagtatttaactaacaaaaaaagtcgagatctttttttttttttttgtcgtaagtcgagatcttttaaaaatgaaacttgtgttgtctgaaacaaatgcttagattttgaatagataatataatgagttttatgcagagtcgtgcaccacgccaccacaagctcgtgtaccttcagtttctgaaacacgattcaactctagattttgtatagagttcaattcgtgctcttcatgtccgattttttaaaattaaaaagtttccttaatgtttacgatattattattatccgaagacctttgtcaggtctagctccgttgaccaatgcatcttccaagttccaacatgtatatgtactctaattccaaaaatcgtaatcttgttggttgtcatgtttgttcacgatttatggatttcatcttatgtgggctgtggcccatctgttttggtcgtttctgatggaagcaagcaatgagactaaactgactttagctaacacaaggcccaattatagaagcccattgtaaaatagaaagaacaaaaactggaaagcaaaaaaaaacaaaacagttgagaggagaaagagagaccatctttacatcgcctatgtcctgtcctccactctgttaccaaaattatatataatttttttaaaaaaattaaaattaaaaagaagaaaaccctagatttctccgtctctctaatttcctttctctctcaagcttctcagaaagtctgacactttcgagaatctaatctccaaatttcttgtctttttggagaaggaatcgaattatg

SEQ ID NO: 27934 - DNA, 3000 bp, Unknown; identical to SEQ ID NO: 27933
  misc_feature (1)..( 3000): 2750-1469P.txt file - cDNA_ID_2992900; gDNA_ID_2926236; Annot_ID_203877

SEQ ID NO: 27935 - DNA, 3003 bp, Unknown
  misc_feature (1)..( 3003): 2750-1469P.txt file - cDNA_ID_2992902; gDNA_ID_1620516; Annot_ID_159297
aagaacccacaagttggtggttttcaggtatattcaactctcagactgtaacttgtcataaatttgggtattgaatctttgatgtatgacattataatcatgtgcaggtaacaccgatgaccctgacttcaccaagattccgcaggaaccaaactccaggaaaagagaacataaaaaaacctcatcaaactcctcataaagcttcctcaatgaagatcatcaacaccaaaaaagtagtcatggagaagcacaaaagcagcaagatccatccctcctccaaacagcagacaacaaaaagaactcaagaaaatatgtctcctaatattcttcagaactaaccagagacaaaccagatcaatcgattcctcttcttcaagtctctagatcatcgtaaagattcgacttttcactttgaagattccgaaagttttgtcccttcagctagtaatctcatctcaagcttatggtttaggtgactagcccttgattcagattgtgtaaccacaagcttttaaggagctgtgtagaatagatagaactcaagtctacttactcttcaaagtaactatgtactcaatagttctgtagtatcaatcttgtatcatttgtatacatagagatttgaaataaagaattatgtctacttttcaatttctcattgtgtttctttcttgaattagtatagacaggaacatggcaaagctttctgttttacatttgttttaaacgacgacgttttggtatgatgttgtgatgttgtgttgttgtggtgtgggcctctcgtttcagaggtgagagaaaaaatcttatctctgtggactgtgattgtgtgatgtttccatatcttcagcttttcttctactacatgctctaatcacgtccttgtagaggaaaagaaaaaaaatggctgcttcatcttcctctttcactctctgtaatcacaccacacttcgtactctccctctgagaaagacccttgtcaccaaaacccaattttcagttcccacaaaatcatcagaatctaacttctttggctccacactcactcactcatcgtatatctccccagtctcttcctcttctctcaaaggcttaatctttgccaaggtacatttctcgactcttgcattgatagattgtttgctacagttgggtaacaactagttctgggaattagcttctttgttagaccaatgttttttggacaatctaagttctgttccatttcttttttatatgtttttgagtattacgatataaatattagcaagacaatagattgttagatacacagccatttttgaataagaaacaaaagatgtaaatattgggttttaagtctgaatttaaatgttataagaacagatttatgaatgtgttagtgcagaatcaaagacaaaatcaaagaaacttgtaatcagtgtttgttttagagaccataaactttcacatacctgaaaataagcaaatgctagaatgttcttgaatatgttcaatcctttattcatatgatttaagctgacacggcatatgaactctctttaaccttctgtgaattggtctctttgtgatgtttggtgggcagcaggttaacaagggtcaggctgcaccagacttcacactaaaggatcaaaacggaaagccggtgagcctcaaaaagtataaagggaagcctgttgttctctacttctaccctgcagatgaaacccctggctgcaccaagcaggttgttaaatctttactttctcctccttcccgcattcattgatcgcatatttagtgtttctaaacgtaaatggttttacttgtgtacaacaggcttgtgctttcagagactcttatgagaaattcaagaaagctggtgcagaggtcattggcattagtggagatgactctgcttctcacaaggtacacacatcaaaaatctctggtttcttgaataaacccatttcttttttccggattttaaagagagtggtgggactttaaacattgttgcaggcgtttgcaagcaaatacaaactaccgtatacattgttaagcgacgaagggaataaggtgagaaaagattggggagtgcctggagacctgtttggagcattgccagggagacagacttacgttcttgacaaaaacggtgttgttcagctcatctacaacaaccagttccagcctgagaaacacatcgacgagaccttgaagtttctcaaagctgcttgatcattctctctttctcttctttctcttctttcatgcatgtctcatgtctgtctccatgagaccatgaccttcttatattgtttctgttgagtatgaattttcaataataccatgttataccaatgagaagggagttggctttggtctagtacaaagatcacaacaggataagtactgaagtgtggttaaaatgttagttggttctgtgtatttgagtctctcgttttcattgtgaacacctctactatctctttctcttgtatcaattaacacttcaagtaaggtacacatatcaggtaactctagctagcccttgattaaaattgtcaaacacaaagctttaaggaattgtgtagaatacatagaactcaagtcttcacacaatagttttagtatgtgaactcaagtactcaatagtgttgtggtctcaatctaatatttgaaatttaaaacggttattttcgcattgtgtttctttcttgatttgagtatagacaggaataaaggtagagcctttggactgtatgaagaatatggcaaagctctgtttttttacgcatttgtattaaatgacgtcgtataagtcggagcaccgagggcctctcgtttcatgagagaaacaaaaaatcttatctttctgacaacggtggtggtgtgtgatgttgtcagccatggcaaagacagagctacaacgatctctctctcttttcttcttcttctgtgtctgtctttaaatagagtctctttgaaacgaagcagctttgtcctgttctgatatccatg

SEQ ID NO: 27936 - DNA, 3003 bp, Unknown
  misc_feature (1)..( 3003): 2750-1469P.txt file - cDNA_ID_2992906; gDNA_ID_2926093; Annot_ID_196595
aaaacttgtatgaataactaggttatgattattattacctcatatgttcctaagttttaagtttttcacatatagtaagaaaataaattaaaatttaactataaatgcacatttttgttatttacgattttctgtaacgctaaaccaattaattaatagtaaattagttttcttgaattttacaattcttcatcattttgttttgaaattgtttttaaaacatcttttaaaatttggaataattagggaccaagggagattcctaacctagtttttgtccgaaataatactctgttagttccaaactaatccaagtttttctttaagaaaaaattatatcacaggccagtcatgcctaatatattttctttatattttggaatcaaagtgttccacgtgaatttttgtaatttggaattaaagtgtttttgttgtccaatcaaagcgacaatgcctaatctattgtctttcataactgttcgcctgtcatttatgtccaaactatattgtttacgattttcatcaccaaaactctttaattatactaattatcggtttttaaatatcgaaaacactcagttaacgtattgcattcacattttaagaacccataatattttagtaaacattaatttttgcatcataagcgctaacacatatgtatatataactctattaattgacaaaaaaaaactctattaatttgttcactgccaaaaaatataactattcgtttctcaactattttatttatattttatctttgttaatgactttgtaaataatgttagaaacctaaaacatttatatacaatgaaagaagaatagttaagatctaaagttaactagtgtggcatgatggcaactttagatctaaagttagatctagacttcaaaaaaatcactttccattatattcaagttcgatatcggcttgcgtccttttttttaactcgactctcaaaatggtatgggtaaggtaacattacctttccccaattgagtggttagttctatatacgctttcgacagcatatacgattgagtgtgttgtttgtaccttctggaatcatgttttgaggtaggcaaccaaatgtgtgaggtaggcttttacgtctaaatttcttcccttgctttaatttttgaaagattcaacgggcctgttttctcctaagctcgaagctagtcaatccaaatcaatatcaggaaaattgtggaccatatatatgtaaccttaatcaagaaaagaatggcaataagcagttagctagtttaatagtctagtttagtggaagaattttagccgttaatatatttgaaagagttagttcatctatatgtttacagaattggattactcatacaaaaagtaaatgtctttgttcaattaatatttctaagacaacctaatttttaagattagaaagatatcgaagtttgtggtcctatatcaaatcatgaacgataaacggaggacgtacgtactatgaagtattttatataaacatgattttctgaatcattatacatacaaaatttaacatgaaaattggataatgacaataagaagtcgacatcatcatataactaattctgaaacttaatcgcactagagaaattaattgttagaaaataggtaatataaccaacctcaatgccacaagtcgtattcggtgcaggtaggcaaccaaatgtgttaagttaatgctaaataacatttgatgttggtatgaagagaaaagttaaatcactaatttttggtttggtgactcgctctcaatagcaatctttgtgcttaacaaatcatcactactgatgtcaataaaaaaaagagcatcattactattttatatagaaacaataaaaaaacaaaaccttaattagtttcattcctccaaatgacaaatttaagatatttactagtattagatgataaattattcattcacatataaaactgcataaacataatctatgtttttaatgactgatataggctgaaaagaaaaaaaagagactgatataggctttatatgaaaatactgcatttgaaaaaatttcattccttacatgttttttttttgtcaaccatgcataccttacatgttattttataaaatttaagacacaatttcagattatcaaaaaaatccaggaatttttttttttgtccatatttagatcaaatacatgaaatttataaataaaaaatttaccctctattctagttaaaatacgttttgatgtagattaaaaatagttaaatatgattccaagacacataatttatttttgattatatttagagaactaacgaaaatggtggcttcctgcaatgttgaacaaaactttttaaaaacctatatacttagaagttagaaagtacattgatttacgaatttccaaatttagaatttatatcatagattagttaagaaaaaatattgataattttatctaagactcatgggagatcgacaactactcatattggccaatcttaagatttcgtttgttgcatcaaatctatatttgtttaatcacgaacttattatatctataaagtagaagtaactttatttctccttaatatattttgaaaaaatgcaattcctaatgatttagtatagaggaagttcacgtagacagtcaccattatcgcttcccataggaaatattttattcaaaatacagcagacattgatttttttatttatttttttctgtgataacatctcaaattttaggtagttatgaaatagataatattgaagcgttttcatttataatgggccttataaaaccaatctagcccatatcactaccaacccatttattacatccgaatctaaattaatcaaacccgtatattaaaccgggtttaaaattctgacccgtaattgatccactgacctagaaattggggggaattgaatcttatccataattcaatctcttccaatttctcttcttcttcttcttcttcctcgcgacgcgttaatg

SEQ ID NO: 27937 - DNA, 3000 bp, Unknown
  misc_feature (1)..( 3000): 2750-1469P.txt file - cDNA_ID_2992910; gDNA_ID_2936547; Annot_ID_193898
tactcttttcgttgctattctcctcctcaggcatctgcattcaaaaacaattaacaatcaggaaggctaaagataataagcaccatctagtggaagtgagaatggttatgtttcaaacaacaaactagctttacctcgtgttgagttgaactattttccaagccattctgatgcttcactggctcaggtgtcttctttggggatttttttccttcagtttcagcatcttgttgtttcaatggtgtgactgttatgaccggggctggggtacatgtgaaacagattcacattgacattaaagatcagtattaagcgatgtagaaactaaacacaatgagttaaggaagattatgtttacctattgatgtttcttgaggggttatgagcagatgagttttgtcattcatcacagcatcagccttgttttttcctaattctctagtggcctaatttcaggtaacgcagatatgttaagcataatcaaagacatggcgaaagcaaaggaaactagtgagtgtctaacttacagatacaaattttgctttagtgggtgtctcgctaatttccttagaattcaggaaacttctcaaatgctttgtggcactcgtaggagtcattgacttagcagcagaacaagagcgcattggcttccttttcaagatggttggaggagtttcttttatgggtttttgctgaaaatagaaacaaacataaagcattcataccaataaaccaaaactgtcagaatgttgattgaaactagtgtaattgatacctttagatcgttataccaaactccatcttcccacaccatgaaaggcctaagatctgagtgtcttattgtagattcctgctgtgtagcctctaatctaaccgtgtaacggttctcagagagaattttcctcacttgccctttatgccatcccaaaccagaaaacgtctctacagattccaacaatgcatacttgtcaactgaagaaggaggcggtatgggtctaacacggcgcgaattaacaatgttggttggtctcgcctcatcaccattgcagctcaggtacctattacagtccttgacaatgaatttcttcttatcatccacatcagtctctttgactaccattgcaggggaccacacagcttctttggcagaaaacacttccaccattgtcccggggctaaacatggacttattcgattccttcaaagacaacaaattaaagtctacttttaagcattcacaaccaaaactaaacctttaataattttaatcatagcatataacaagaacaaagaaagcaacaaaattttgacagctacaagcaaaaacaacaccggatttaagaaaggatctcttaaccatggaactataacactcaacaaacgaaaaatagagaaaagtttcagccttttgaaactaaagctgaaacctttaaccataacacgcaaccagactcaaaacggattaaagcttcaacctttttgaaagagagcaacaaagagacagtttcaaacattcaagcaaagacccacttcgaataaatcaacctcatacctcaatttctggttggatccaagtcccaccggtccagataagatgagtccgcaactgctttctctcgaactgtataatgtcaggaggcaaatcaaaataaaccaaatagttgtcgtcctccattttctttacgacaacaccagtccaccacccgtctttgtggtcagcatccaccagcaaaccttcctccaaaacgacgtctttttgttgattctcctccggaggtacaggtctaatgaatctctgttcgatgtgttcgattaagggagacgaaccgtccatgtccagcaacgtcgagtaacgaacacgaagctttctgcgagatgagttccctgggttttcctctaaaacagctctgaaccaagctccttcgaacccttcctcttcagaactgacttcaactacacaatctttcgttatcttcatcgtttgcagctccatctccggaaagtgaaaaatgtggttactttgtagaaataatcaaaacccagaacccaaataagcaaagagtgaagcaaaaaacctcccttttgtaaaaccctaaaatttcactctgatactgaaagacagctagctctacaaatgaaaagcagagacagacatttacgaaaataggaaaaatatttattttctttttggcgcgattaaatttacgaaaaatagaaaatatttgataagaagagtatcttattgggcctaatagcccaaccatgaatggccaagcccatattaatgaatgggtttaatgttccatctctaatccccacaagacttttcagcaaacaaatctctctttctctctctcactctctgctcgatcgttcaatctgatagaagaagaatctcaaggtaaagttctcgactttgtaaatttcttggcttctcaatcaaatatttcattccacttttaatagtaaccttttgtgttttctccgattggttttgtaaactgttggtcaattctctgatttttaggctagaaattgaaaactggggtttatgttatttgcgctaaatcttccgtctagataattgtttttccatttgcgatgttatcttgtgcatggacgcaccggttctatattgggctctttgcgtttcgattgtccaaatgttaaattactcattttttaatctgtaatcttgttttgtgttttgatcattctgaatttgatggatcttagcttactaagtgtttgattaaattccccaaaagtttcgggttgaagcatttttttaagtttacaaatttgtatatctgcttccagtgtagtagattccaagtcacttgcatttggctttaaatctgcattgaaaagttcactggatttatttcagggtttagggtttacaagatgtgtgtggtgatgttaaaagttaaaaccctgtaatctgatggtgataataaagttttaatcgtggttgttttttatagttttaattcgatg

SEQ ID NO: 27938 - DNA, 3000 bp, Unknown
  misc_feature (1)..( 3000): 2750-1469P.txt file - cDNA_ID_2992925; gDNA_ID_2926240; Annot_ID_142863
aatatcgaagttttaggcaacctcacgtctgttccccccttctacttatacccatctgagctgtcaattattaactgtgtagaactctgtgtattagctataatattgcaggaatagttaagaagaaactgttccatgtcagcttgcttctcttccaaagactatgatctatagttaattgagacttgtaattccttctcggaagattatcatgtctcttgggtgtatcaaaatcaatgggatcatattggctaaatattttgcagttgatgcatgaggtgaaggaactcagggcatgcgggctggaaaattcaaccaagatatgttacttggaagagaagctggtaagattttgtttattgctattttgattttcattcttcctgctggaattctgtttgcatgtgtaatatgaccacacccacacagatattcattatatcagtgataatgatcctctatcattttcagctaggggttcatctcggtatcattttcccttgtttttggaaccaataagctcaaaatatagtggtggagaaaccataacacttttacttttcgatatttggtatttcaggacaaagcacacaaggaaatttatcaattgacagagcgttgcaacatgctggagtccatatcaggtcctttaatcaccaaagctggtggcagtgatttggagatccattcaccagatgataccagcttagatccaactgaggcaattcttcttttagggggatttgataaagactctgaaacatggttgtcatcagtgcagtcatattttccatccaggaatgttgtaaaggctcatagttcaatgagctgtatccgttcaaatgcatcagtggcaaagttggatggtaaaatttacgtctttggaggtgatgacggtggccgtggctggaccaactcaggtacggcctctctttttctcttgttcttaaaatgagttaactatttagtgcattagagcctgtatacaatacatatataaacctataaaccttccagatattcttaacagacaactaaaagaactagaaaacggaatatgggtggcaaaagcatactactgtgactttcattatattactaaaccaaatggctctagtatttttagcaaattgtgaagtgaggtgtattaatttagtgcacttcacttcggctgtgcatattttaagttaatgtctaccacttcacacttctttttctctctaaccataattatttaagcctgatctttgatttctgttttgcctcttcttttttctgtgaagctgaatcctttaaccagactgatggccagtggagcttgtgcccccccttaaacgagcgaaaaggaagtttaggtggagccactttggatggaaaaatatttgcaatcggaggtgggaatgggatggtatctttttcagatgttgagatgcttgatccagatatagggagatggatcagaacaaggtcaatggggcaggaggtaaacgttcttctctattcgcatgacatatggtgaaagccaaaaatctgaaaagttgtcaattagatccccactgggaaatttttgacagaagctcacagctaaaaacataaattcccaaagagaatccattgttaaaactactctatttcgctaagttataatttcaagtaaggagtgtcaggttaacaatagaaatgtagtttatgcttccactcacctactggttataagccttagcaagatgataccatgaccttctcctcggctttattctctgagttgtcactgctctttgatctcagagatttgcagttgcgtccgtggagcataaaagttcaatttatgctgtcggtggttatgatggtaaagagtacctgaagtaagaacatttaagccttgtgttctattttttcccctaatcttgacacatgtgaagctaacaagaacaatttattggaaacttacttttaacagcacagctgaaaggtttgatcctagagagcactcctggatgaatattgcatcgatgaagtcgagaagaggctgccattctcttgttgttctgaatgaaaaactgtaagtttcttctccccatttttcttcttctttgagagtaactaacagacaaattttgggtaagagttttaaggttgtattcatatgcactattgcagatatgcgattggtgggtttgatggtgagacaatggtatcgagtgttgagatatatgagccaaggacagggacatggatgacgggagaaccaatgaaggatttaagaggatattcagcagtggcagtggttaaagactcaatatatgtgatcggaggatacaaaggggaagaggatgacatattagacactgtaggatcagttctgaacttgaaatgaaattaaaacaatttacataagcagacacggtttaatctttgatcatgtgtgtgtttgcaggttgagtgttttaaggaaggtgaagggtggaaaaacgtgccttcttcctcgatcggtaggcgttgctttctatctgcggtggctttgtaaatggggaaactttgaagctgttgtttttttggtggccaagtcatgagagacagagataagcctttaggagttttgattttggggaaagagtttccctctatgaagtagaagcaaaatggaaatatcgatttgctataaaaaagtacaaaaaaacatctaaccaattaggtgcgttcgggtctaggtcgagagatctattttataaacgttcctgggcactcaaatttgagcgggcttttataactagattaaggcccatttctaaacaaaataatccaaaatcacttcatcagagcgtttgaaagaatcttcgaaacgagaatgcaaacgtaaaaacgatgggcttgggcctaagcgaataaaaaaggtttaaggataaaaggggaaaattcctgggtggtcttactctctttatccgcttgactaaaaaaaattggcgtcgagtgatagagacgaagaagaagaagaaaatg

SEQ ID NO: 27939 - DNA, 3000 bp, Unknown; identical to SEQ ID NO: 27938
  misc_feature (1)..( 3000): 2750-1469P.txt file - cDNA_ID_2992925; gDNA_ID_2926240; Annot_ID_204054

SEQ ID NO: 27940 - DNA, 3003 bp, Unknown
  misc_feature (1)..( 3003): 2750-1469P.txt file - cDNA_ID_2992932; gDNA_ID_2926232; Annot_ID_142687
tgagtttgaattaggttgtaggattcaggacttttggaagaagaaaatacagaaatggtcgtagttagtgggttgaatttatagtgttgattgtgatggttactggttatagtaaagaataattttgcggggttaagttggattgggatttatttatatttacttaggagaatagcaaaatcagtttctaataagcataattttttggccttgagagagttttgcatttcaattttcaggcatttgtgttttttcttacatttaaaatcttaatatctgattgaaaataaagatgattatattcaaaaaaggagttgtgtattgagtctttgagaagagtttactttgcaaaatgtcatggaaaggattttgtttaagtgaaacattgtagtaattattcttgtgggactggaatgtggaagtggaaaaaagaaaaaatggaaaaggaaaatagaggttacgctttgacgtgaagcgaggccaaagataatacactgaaatataaaacagatctttagtttatggcttagtcttggattcttaatgtggcttagtcttagtggcatatgctctttgttacgatttcagacctttgttgtgtaagttagtcttgctttcttagagctttgtatttcactgaaggtattaatgaaaattcagatagaagaaaagagaaaacagatcttttcatgtaaatcaccttagcttttactatcatatagtacatgtatttgtgtatatatataacacatatatgacattccggggttaagatattgagtctatatggtctaccctcctagtagtctaccttggagataagcacgaaatttggtatgattaggagtgttacctaagtttgccggtaccgtttaggtcattgaactttggttgcaagtttcttgcttgctttttcttttttgggattttccctttggaaaaagaagtctaagataagaaaacagaagagaaattaagagatacacaaggtaagccacaaataagaagattttgtttggattgggaggtaaaatcctcatacctttcgtgtttgattgagtcaaactttaatccatatctatatatcaaaatgtcggcatcttaagagtctgatgctcttgaaacattgatgttcttagaaattttgtaccaaattacaactagtgtttaaatgtcttttctattggaataaatgcgaataaatggttcgtattaatcatatgataatacgatggacctataattgtggatataacatagtttggagcttcttctttctcaagtttatgattgcatttaaggatcttacccacaatacttttttttaactaaaacgtacctaagacgatgacggtgtgcgtaaagcaaaagtcacaatcaatctcgctatataatgcttacctatttttatcatttttacgtaatcaattattatattttcgtgtgtttttttgggtcccgttaacaatcgaaatatggcatctgcaattatgttactgtggaatatcaacttcccctaatgcaacaacaacatatatggttgaggaccgttatcaaacaaaaatttttggttgcggtgcgtaacaaacttaataacaaaacacaaaacttatggaaagtgacccacatacattaatggaagtcatgaaagagatgatggatcatattacaattatttgttgcagagagatcactcacaagtcacaaagacacaaaaatatgacttatttcagatctatgatccaaaaaaataagaaaaggtgttagaatgtcccacatcgaaaatggagtgtatctagcctagtataaaataaacataaacctctgcactattatctaacatttctatttctttagaactactgaaggagatatatagaatgttacaaaaaaagtgacccacccaaacatagagagtagagagtcttccatttttctaaatttcatctcaatattcgatcatattcaaacaattttgtgaacttgacgaaattggggagatgaaagaattgatcttgggccgaccagtatattaacattatctacccaataagcacaactcatgcaaagaggctagttcttgacgaaagaatctagatgagttaaggtgaaaacatggatccattttggaagacttaaaagaacccaatccacctcaagattttggtttacaaactaagctcatgagttttcttctctcacaaaacttatcactgcacatcttttttatgcttggggtaatttccagggaaagaagcaaaacaacacaacacaacacacaattatccatgtgttagattagtggcagataacatcttctttttaattcaataatatgcattatacatttttcatcatgaattcatgacaacgactcggctacccacactttggctttcaatactactttgtatagttccattgtaactcttaattccgtttttttaaattatattgttacatattttgtgtatatacataccacgttgtcttttccatgtgatgattttagaaaaacgtgacattttccggtcttgcctaactatatattggtgaaaatatgtttcttatagtaaaggacagtcacttgcaataatctaatcagaaaggacaagaaatttcattttcacttgcgttagtctaatcagaaaggatcgtcatcatgaaactttatttaacatttgtttagtatattagtatgcaagtgtgagtttaaaactgtgagacaagagaaagaaaatttgttgcatgcaggtaaacaatcttggacaggaagttctcacaagtcaaagtcagcgagcaaacgattttattctcttttcacatgttgctatgacagctgtcaatttgtaattggatcatgagtgtcataattcataaatataagctatgctcatgtaaccgtaaacccttaacgacaaattaattaaacttctccaaaactcttttcctctaaaaaatctcccaaatacagaaaaaaaaacaaagtcagtaagaaaaatg

SEQ ID NO: 27941 - DNA, 3003 bp, Unknown; identical to SEQ ID NO: 27940
  misc_feature (1)..( 3003): 2750-1469P.txt file - cDNA_ID_2992932; gDNA_ID_2926232; Annot_ID_203737

SEQ ID NO: 27942 - DNA, 3000 bp, Unknown; identical to SEQ ID NO: 8963
  misc_feature (1)..( 3000): 2750-1469P.txt file - cDNA_ID_2992952; gDNA_ID_1971952; Annot_ID_177346

SEQ ID NO: 27943 - DNA, 3003 bp, Unknown
  misc_feature (1)..( 3003): 2750-1469P.txt file - cDNA_ID_2992956; gDNA_ID_1620325; Annot_ID_153474
aagttgaataatcttaatggattttgtgatcattgctaaagccttaaatcttctgtttacatgttctgcaaatagtttagtaaacatctttgttatacaggatctgaagaatctgagaacacagttgtattcagcagctgagtatttcgaactatcctacacaaacgatgaacaaaaacagatgtgagtgagtttattcctctccctaattgtgattgttctcttttcttggagttttgtaagtttttacttgtgtatgtagagtcgtggagacactgaaagattatgcaataaaggctctggtgaatacagttgaccatttggggtctgttacatataaagtaaatgactttgtagatgaaaaagtcgatgaagtagcaggaaccgaactgcgagtatcttgcattgaacaggtatccattattcttcaaatggacagatatttctgctttagttttattcagttggcatttttgagaatgattcttgtttgtattactgaactttcttatatgtgtatagaggctacggatgtgccaagagtacatggatcatgaaggtcgttcccagcaatcacttgtgatcgacactccaaagttccacaagcggtacttcttgccttgtaagtttcgactctccaaagttccctatatgtttctacaaactttcgttctcttatttgtcggttttgggactcagctaacaaaaacgaaattctctatcagctggtgaaatcaaaagaggtggcaacctcgcaaagcttaagaatgttgaaggtagttttgatggagaagatgactggaaccaattcagaaatggtataaattgccatttcatttacttagaaattgccttgattcttgatttgatatgtttcttgttgtgaattcttaaagctgttcgcgctacaattcgtgaaacgcctccaccacctgttaggtatagtccagtactcatagtgagttcccttgtcaaatgaccgagaagtactaaacttttatcgctttttgcagaaaaccgatacttcagtctccctctcaacggaaacctcaacgttcagcaaccttttcgttctcctctatcgccaccgcaccaaagaaagaacaaggtaaaagacagcttcaccttgaaattgccgtttttggcttaatatgtaaacagaacctttaaacagtgtgcatggtaaaatagataagcgagcagtatcaccacatcggtttccgctgctaagatctggttcggttgctatccgaccgtcatcaatcagccggccaacaaccccgagcaagagtagagcggtaactccaactcctaaacgggtaagcttcggttacatttcaaaaacactcacttctaggctctatctctaacggttgattcttgatattttctggctcagtatccgtcagaaccaagaagatcggcttcggttcgggttgcgttcgagaaagaagctcagaaagaaccagagcatcaacaacaaccgagcaagagcaaacggctgctaaaggcgctacttagccgacgcaaaacaaagaaggacgatacgctctacacttatttggacgaatattaaaccgaaagctggttttgtatgttgactggtaaaccggaaattacattccagttttaattgcatttacgtaatgtcaaattgtcaatatatgtgttacaaaatatgtccatgattctatgattttgtgtataccttatgactgtcagagtgtgaatgcagttttgtttacaagcgtagtaaaacttgctgtgaattattttactgccgattttaaccaaattaacagcaagtttatatatacaatttcgttctcgaaatattatttgacagtttaatatatattttgcatcaattactgttgcaagaataattatgtttttgaaacttttgcttttatttatccagtttttgaaattgattaagaatgtttgagactaatcctcccttttttctttttttttttttaagccgtggtaatgtggtattcgttcggtaaatctacctattcaaaaagatagtatcatcgacttttctgttgtattaacttaccatttacaaatattacattaattaatttgaaacaagtcaaatttattgtcaccaagaatgaagtacacgtatacagataaaaataaagaagaaaaaaacagagacaacttttccggagattttactttagaaagcaaagaaaactaaatcaaaccaagccttcaaaaattaggtagctcttataaaccggatcataaaaccaaacatcaaaacatatgtatgctctttcaaaacatggtaccaactcacgagtcttttcatcagggccgattctcaccatcactcaatggtctagacaccatcagtttggggttcaacttctgatcttttgggtggtggtggaggtggtgatctgtcgtaatgctcagcaacaagtgaacgatgagaagaaggaagaaaaacctgacgagactccatcgatggaaaataagatgatggtacattatcgtcaagaagtttccggttggtttgagcatgcccgatcatgatcatagctaagagaacacaacatattaagagatgattcctagaagccattttctcatccggtgatcgatagagttaatttctttgcttatcaactatgttgaggttccatcttgtaatgtcttatgtatatacatagctcacaaagtcacaatagagggttcccactaactattattagattgattgatttctgaaaaatattatttttgtgtaccaagtaaaattatatgattttagatttgttgttagttttgatttgttttagattttttttttgtgcaagttgaattattattgtatagataaaatgacgagaaaaaaaaatgcccggttcggttaggaatgatttgtccaaatacgaacacaaccaaagataaaccattaaaccgaaccggagaagcttacatataaaataggatccggttctatctattcactgtgtatcaatg

SEQ ID NO: 27944 - DNA, 3003 bp, Unknown
  misc_feature (1)..( 3003): 2750-1469P.txt file - cDNA_ID_2992963; gDNA_ID_1972113; Annot_ID_178820
atccatagactagagccaaactcagtctggttatatcgccttatcgcttacactttcttcttttgtcgatgttaaagtgactatgtttgataatttcctaattgtctagtatgattggagtgttcatgagatgttatgtttctgagcccttgttttttagttgtctagagttctaatatgaattatatgtcttttggtttcacagatgttactagatacgcaagctgtgaagtcgattctactagaaattccttcccttgccagacaggttactcatcacaaccaatttatgtcatttctgttatctcggtatgacgtattactgggtatcttctttgcccaaaagtagaatacctgatgcctaaaccctttggatattcttgtttcggtcatagagccgatattagggataacgtatatagagcattagtcagtaaatccatgacgatttacttttttttagttttgatatatcatttagtaataacattgcagacctcaactgctgccagctattccaaatttgtgagccgtgaaatgagcagagctgaagcactccttaaggtcatactatccccaatcgactcagtggcagacacttatcgtgcactgtttccggagggaacgcccatggagtttcaacgcatcttagaacttaaggtaattttggcatgtcttaacccatttcctcgctctcaatcgaacaggctcgaggctcgagtctggttcacaacagtattctagagcgacagtctgctgaaactttttctggtgtttggtgcagggtcttaagaaagctgatcagcagagtatactagatgatttcaacaagcatggtccaggattcacacagcagtcggttgcagcagcaatgccacaaccaatgccaaccccacctgcaccaccattggcaatcactaatccggctacagctgcagggttcatagcaaacagcgaggatgttttaaccagagcagctgctcttggcagaggagctgcaagcactggcttcaagaagttcattgctcttaccgaagctgccaaagaccgcaaagatgggcctttaaggagactcttcaacgcatgatttgttcctttactacctcatctcaacttttgatttatgcaattcccacctttgtttccttctgtatttaaatgcacttgtttctttgttttcctggttatgtgtatatcagaaattcgtagtgaataacgagttttcttacggtgcggatgtatcttagttgtttactgcattctttcttgagtaacgttacgaacactttcttgaactaaagtcagttgaaattacctcaatcttgtatgtaactcataatgtagtttacggaggtagtcaactttctagctggcatgtttactaatgttttagtcaactaaagtcagttgattcattttttagctggcatgtttacggaggtagtcaactttggtgaaagttggagacttgtgaattaaaaacattagtctgtgggctacagatctatcaaggaaaaggaagttgtggagtatcaacggcttctcatggaagaagaagaaaaagagttaaaggggcagctacttccactatagccttacatccataaagggttagagttaaacagcctttacatgaagttcgatctcaaaaaaaacaggacactggtgtatatgaccttttgaccataacaggtctatcatccagcataactttagtaagaaattggttgttgaagaagaatctgagcttctctacaaagttgtattgttggggacatttgaaagagtagaaccagaatggatgagagaagttgtgatgtttttagcacaagcatgtgtcctgtcttcttcgaaagagttttacgagtcattaaagtatgaatatttctccttctcaatgtatcctatcatctcctctttgattgttttactctgaattgtaatttggtaagtgttttacaaataaaacatgttttaaaagttcaatgatgcttaatttttccggtttagaacctggttcgggtaatttcattgtagttgactgtaaccaggttcttcaaatttattctgctattcctagtaattttttttttggtaagatgctattcctagtaattttatttcttgatcaaatgcaatattgcaatgtatcacaagattagttttcaacataacaaatacttaaaagtccaaaaaccatagagataaaaaaaattgtaaataagttggataatttattaggtgtgcttttattcatttttattaaataatataatatttttatcgaactattttaagatattctcacgctatttgtacaaatcaccaccaacggaattaattatactagatagataaataggaagatggaatgttggttttacaataataatatttactgtataaaaaacaatattcaatatccttttttgtcaccgaatatctttcttattactagtatgataacaattttgaattgtttccaaaaactatattagaatacaatgttcttttgttaataatatattaaaatacaatgtatcaaaatgattatgtttttttcctctttatgtctatatgcattacatttgtcaacaaaaattaattgtttcttctttcagatttagaattaaagaaagaagcaaactagccgttagttaaacgaaattcaaaagcttccaagcggcgcttgtttgctctccaacgttcactaacaaatccgctttaaattttcccttttcttttttattccatttaaagtcaaagcgacgtcgttttctctcactcatacgccgttttataaccaacctcagagactctcatcgatcgatctctctgtctctcgcatcggaagtacgaagaaggatctttgttttcttcctcttctccttcttctactttcgaacactcgtgaatctgattctactctagtctaattgggtgctttcgatttctgaataaaaattcgattttggtctgacgattaagaaagcgaaagtgatg

SEQ ID NO: 27945 - DNA, 3000 bp, Unknown; identical to SEQ ID NO: 1421
  misc_feature (1)..( 3000): 2750-1469P.txt file - cDNA_ID_2992979; gDNA_ID_1620400; Annot_ID_155920

SEQ ID NO: 27946 - DNA, 3003 bp, Unknown
  misc_feature (1)..( 3003): 2750-1469P.txt file - cDNA_ID_2992991; gDNA_ID_1972174; Annot_ID_179959
atgacactctcttcaaaatgagtacacatttttagtacctcctctgctagtttagttaagttagtcccatactcttcaagtgttggcattttgctgtttccgctgcttcccccaccaacgcttgctgtgacttcattgttttccccgaccatacgtataacctaaaaatgatatatgtatctcaaaatgttataacgaaatggtttactaagacataacattaaccttagaatccagagttggtgcatttacctgtgtccgtatattactaggatctgcacccaaattctccaagacacgagctgccacaccctccccttcacgaagtagaccaagcaaaaggtgctctgaaccaatgtagttatgccctagatttcgaaatagcaaaacatttcccaaatggagaagaattagttagcttcatcagtcaagaaagcttatgtattgcacaacacataacaagctccaaggctaaatattcataatagaaatagacccataccaagttgtcgagcttcctctagtgacaactccagcacccgctttgcgcgaggagtaaatggaatctccactgccacgaatccactgcctctcccaattatcttttctacttccacgcgtgaatctttaagattgatccccatggatttaagaaccttggcggcaatcccagtcccttctccaattagacccaacagtatttgctcagtcccaacaaagttatggccaagtctccgagcttcctcttgagacagcattatgaccttaattgctttctcggtaaaacgctcaaacattgctttgggtacacatcggctagctttttctctcccagatgattttgcaagtttatacttaacaaggaaacctggactaggccttcccaaataatctaatgcactgggggcccttaaccctgagaagctctgaattgtcagaagaggtgcttgtaaactggacatcatcttcacacgccctcttggttctctgtattctgtggcctgaattctcagaacaggtgcttttaaactgctcatcttcatcacacaccctcttggttccctgtattctttggcctgcacatgccttccgggaccaaaaaaaggaggtgtaagaagagctatcgaccaagccatgatgcaatgttggaggctgcattgggtaatggtagaacatcagtattgctaattctcttaaacacgtatacagaaagagctcaggcacaaaaatacacaatttcaattcaccaactaagagcagaacaatgtcacaaaagcttgagctatgtttcttatctccaaactctccaaagcaaaacaagcaatcatctttgaacaaatcgaaacgcgaatacacaaccctaatctcaaagtaagcatttttgcatatcaataaaaccaaataaagagtacccagattcagaaaactcaaaatgaaaccaccaaaagaaacgaaaccaaacgccatgagaaatagaagaaaagaaaaactcaacctttaaaacagctcacacaacagagaagcagaaacctaaaagcttcttcaatgaaacacaacaacaacaaatgaaaaataaaaacagactgagaaagagagtgagtgtagcaaagaaaagggttttatgtgtagcaaagaaaagggttttataccgtcgacgcctttggatagcgaagttggagaaagcgagagactccttttattgggaaagagataggaaagtgaagaagaagatacccaagagacaagagatttctctattctctctctctttatcttctctcgcatcgccgcccttcatagattaaacacactcacctaccaaagttgcataccagccgttagattactcataagtgtattccaccgtcggatttaactactttttaaagagtcaacctcaataagaatcttgttcccaaagataagggtttgtgttgagtttaagaccggtttaatctgaaaactccgtcaaaccaaaaccaaaccgatttatcataaaaaaattcatatcatctacttccattggctagagacagattgtaacggtgtcgtcgtcgccaaacgatttgcctcttcctaaaggtaggttcttcatttctctcagtgcccctttgcgtgtttcagcttcttctttatgatctaattcatgtctatgtttcgtttgattctttgttcaattctgaattgagaaaatggcgattcgagatctgtctcttcggttttttagttcgactgatttgggaatgtgaagagatcagattgatttgttgacagagtcttgggggttttcaatcttattcctctagattttcgaaattcgattcctttacatcagatttcgcttaattctctgtcctagtgagttttacgatctttagtcttctggtttgtcaaattctatgtcttttcatgttcttctgagttttaatggttgatcttcaattacttggccacaatctctagagtttgagactcttgacttgtcttgcatatattcctctgtagattggttttatgtttggtttcaattccttgttgaactattctgatacggaagttttcctttctaaggtttggtgtttcctttttctgataaatagtgatgaagatcgattatgatgatcatgtaagaatataatctagctttggtgtttgtattggtttacctgagggaagaaaagtctttctctttgggactttaaactttgattacttaactccaacattatcatagttgggttctgtagttcatttcacttatagcagtaataactcattgattgatgcaatcaatcaatcctgtgatggaaatggaatcatggaaattgagggattcagggaggattgattgattagaatttcatatttatgagagaataagagaactgatgtgtgtttcttttcctacttcttaaagttgtgctctttcctatttctataagctcttgtggataacaacagttgattaacgttcttatgcttgtttagggtacaacaagaatg

SEQ ID NO: 27947 - DNA, 3003 bp, Unknown
  misc_feature (1)..( 3003): 2750-1469P.txt file - cDNA_ID_2992995; gDNA_ID_1620319; Annot_ID_153261
aagagagggaaggagagaatcttttgacaattttttcttctaatattttcagttttggactttattaatacagagccatatgattttgcaatttattctaagtgaccatattaattagtcaaaacatgtttaagatctagtatttcttttgatacaacataaaaggaaaataattgaattatttcatttcatttattaaaattaaactgaagattgaaaatttatgatggtaacaaacaaaattcaaacttaaaaaactcaatagtagtccatataataatactgtgtatattaatatattaagcttttaggttttgacggatcgggagatatggaaacaaaaagtctttttgtatttttctaaagaatgatgccttccgcgatggaccgactttggattcttttgattatatattgcaaaaagataagatctacatgctgacttccaaaaagaacagagatgctctaaataatttctaataattcgtgccatttctatattattcaagtaaataatactttgtaaaatttaatacttttcgtggttgtaaagcttattatacctaaattatattttttttaaaaaatttgtatcaaatgtgctgcaatttagcaacatagaaaaattgtgatacatcaaaagaaccttgttatcaaatgtggttactggttatgcccatttgaaaccaacactatcgcccatttcaatctgaaataacataatctgaaataacattttctgaaagcccaattccgagaaaggccgagcttataacacctgaggcccaaagtttcaatttctgtttgctgattctagaaaatttacaaaaatgtatacattgtgatcatcctacatataaagtagcttaccaacaattcacaaaagactaagctatattgcgtgtaaagcagaaataagtaaaaagaatattacagttttctgaaaaaaacatataggatataacattgaaagctaactattgcctacaaaatacttgttgtacaaagtatcaaataatatatgtaaatgtactttgaaaccggcaaatgatatatatatatatattttttaaatgatatttacatctcttaattttgattgaaaatatatagatagggatatagtaaagagaaataaagggataatatgacatctgtattattattttctttttgatataaaggacagatctgtttcaattgattgcttctgatttaagcatgacacgaggcaatactgactgaaatgtcatcgagtgacagatgcaccgattcgaaccaccttccttccacagttgttaccattcgcaattgttctttctgacaccacaatcttaatttattagttactacctcttttgctcctattatttgtttctttaattgtgtttattttattaatctggatttgcctttttagcataagcaaatacaaaaaaaagttattcctttaagatctaatcctgtttagtaatgttctctagatattattggttatgcaacttgtgcttggaaaatttttaaagtataatagttgaaagtgactttcttttgtagattttgaacttatttgaatagtcatgagatgagaacaaaacaacatacttccaaactgactatgttttgtagatttttaatatagtatcattgtcatattggttttgaaaattgactaacgttggaaatatttctacaaaataatttgtcttttctggtcttaaaagtgagttgattgtgtttaaccaagtaattcatttacaagtaagtgatcattgtgtaactaatgtaacttgagagaaatatactcaaacaaacttcagtagtaagaaagaaaaaaaagagtaaagctaaaagccaaaagtgaatgaattaattattaatatttgtcacaccaatttcgaccgatcttacttgttttcaaagagatgcttcaactgttttgtttgtttctgttaaaccaaaatcaattaacgagaataaaaaggaattaacgaataaaaagtggtagaaagctcatgtttcaagagaaggttttgattcatcaaccaagttgcaccaactccatatatattaccaaaaccaaaataaatttacatatttggaaagaacataaattggacagaacatatcaagcatgtaatatacagaagccgacaaattgcaaaatttacctaaaccccatcttacaccaccgtcagattctgatgtaagtattatcaaagctcaagaacaatcacatcatcagaatctaacttatatatcaaaggtccagaattttctccattgaagctggattctaaggtcagttcttacttctttatctcaatctgatgattccatatcgaaagtcttactttttcacttcaatttcaatctgatgattctaagatctttgattcgaggtcgatctctgatagttactacatgtttctgggtttatttatttttaatccatatagtaattaaaaactcttatgaggtttaattatggttacttgagaatttgcaatcgtcatctttctttgactcctatccattttttggtttttcctttgtttaatttctgtttcataattgtaattgtaaattaaccaaaacaaattgatcagaaacctttttcctatggaatatttatcacacgcaagcctgtgagttgtgactctgtaatcacttccttgttctggtaatttcagtggttaaggctctccttttttctgatgttgtcagcaaaagttagtttttcttcttctttaatgggttaattacacctaaatctctggttattaaacaatccagaaagaaaaaaagtttattccttcctctatgtatatagtttcacatgcaagcatcacttgtttgttctgacaaattgcagagttttgagttctgtttttttttttttctaatgttttgtctttaagaaagttctgtttttttttctgcaggaaagttatcaaaagttttgagagctttggatagtgaagctcaaagaactaaacaatg

SEQ ID NO: 27948 - DNA, 3003 bp, Unknown
  misc_feature (1)..( 3003): 2750-1469P.txt file - cDNA_ID_2992995; gDNA_ID_2684233; Annot_ID_192320
aaagagagggaaggagagaatcttttgacaattttttcttctaatattttcagttttggactttattaatacagagccatatgattttgcaatttattctaagtgaccatattaattagtcaaaacatgtttaagatctagtatttcttttgatacaacataaaaggaaaataattgaattatttcatttcatttattaaaattaaactgaagattgaaaatttatgatggtaacaaacaaaattcaaacttaaaaaactcaatagtagtccatataataatactgtgtatattaatatattaagcttttaggttttgacggatcgggagatatggaaacaaaaagtctttttgtatttttctaaagaatgatgccttccgcgatggaccgactttggattcttttgattatatattgcaaaaagataagatctacatgctgacttccaaaaagaacagagatgctctaaataatttctaataattcgtgccatttctatattattcaagtaaataatactttgtaaaatttaatacttttcgtggttgtaaagcttattatacctaaattatattttttttaaaaaatttgtatcaaatgtgctgcaatttagcaacatagaaaaattgtgatacatcaaaagaaccttgttatcaaatgtggttactggttatgcccatttgaaaccaacactatcgcccatttcaatctgaaataacataatctgaaataacattttctgaaagcccaattccgagaaaggccgagcttataacacctgaggcccaaagtttcaatttctgtttgctgattctagaaaatttacaaaaatgtatacattgtgatcatcctacatataaagtagcttaccaacaattcacaaaagactaagctatattgcgtgtaaagcagaaataagtaaaaagaatattacagttttctgaaaaaaacatataggatataacattgaaagctaactattgcctacaaaatacttgttgtacaaagtatcaaataatatatgtaaatgtactttgaaaccggcaaatgatatatatatatatattttttaaatgatatttacatctcttaattttgattgaaaatatatagatagggatatagtaaagagaaataaagggataatatgacatctgtattattattttctttttgatataaaggacagatctgtttcaattgattgcttctgatttaagcatgacacgaggcaatactgactgaaatgtcatcgagtgacagatgcaccgattcgaaccaccttccttccacagttgttaccattcgcaattgttctttctgacaccacaatcttaatttattagttactacctcttttgctcctattatttgtttctttaattgtgtttattttattaatctggatttgcctttttagcataagcaaatacaaaaaaaagttattcctttaagatctaatcctgtttagtaatgttctctagatattattggttatgcaacttgtgcttggaaaatttttaaagtataatagttgaaagtgactttcttttgtagattttgaacttatttgaatagtcatgagatgagaacaaaacaacatacttccaaactgactatgttttgtagatttttaatatagtatcattgtcatattggttttgaaaattgactaacgttggaaatatttctacaaaataatttgtcttttctggtcttaaaagtgagttgattgtgtttaaccaagtaattcatttacaagtaagtgatcattgtgtaactaatgtaacttgagagaaatatactcaaacaaacttcagtagtaagaaagaaaaaaaagagtaaagctaaaagccaaaagtgaatgaattaattattaatatttgtcacaccaatttcgaccgatcttacttgttttcaaagagatgcttcaactgttttgtttgtttctgttaaaccaaaatcaattaacgagaataaaaaggaattaacgaataaaaagtggtagaaagctcatgtttcaagagaaggttttgattcatcaaccaagttgcaccaactccatatatattaccaaaaccaaaataaatttacatatttggaaagacataaattggacagaacatatcaagcatgtaatatacagaagccgacaaattgcaaaatttacctaaaccccatcttacaccaccgtcagattctgatgtaagtattatcaaagctcaagaacaatcacatcatcagaatctaacttatatatcaaaggtccagaattttctccattgaagctggattctaaggtcagttcttacttctttatctcaatctgatgattccatatcgaaagtcttactttttcacttcaatttcaatctgatgattctaagatctttgattcgaggtcgatctctgatagttactacatgtttctgggtttatttatttttaatccatatagtaattaaaaactcttatgaggtttaattatggttacttgagaatttgcaatcgtcatctttctttgactcctatccattttttggtttttcctttgtttaatttctgtttcataattgtaattgtaaattaaccaaaacaaattgatcagaaacctttttcctatggaatatttatcacacgcaagcctgtgagttgtgactctgtaatcacttccttgttctggtaatttcagtggttaaggctctccttttttctgatgttgtcagcaaaagttagtttttcttcttctttaatgggttaattacacctaaatctctggttattaaacaatccagaaagaaaaaaagtttattccttcctctatgtatatagtttcacatgcaagcatcacttgtttgttctgacaaattgcagagttttgagttctgtttttttttttttctaatgttttgtctttaagaaagttctgtttttttttctgcaggaaagttatcaaaagttttgagagctttggatagtgaagctcaaagaactaaacaatg

SEQ ID NO: 27949 - DNA, 3003 bp, Unknown
  misc_feature (1)..( 3003): 2750-1469P.txt file - cDNA_ID_2993009; gDNA_ID_1620379; Annot_ID_155264
cagtcgacttaatcattaggggtgttgagacattggttatctttttatcttttttttttatgttttcgtttgaactaatattttggaactattttctggagtttatttcttctatcgcttgttttcgtgaagattttttctctgaattcggtttgatgacaaaggttctcttatgcacaatcttgcaaatccaagcttattttggttatgtagcctataactaagttattagtatgactaatatggctaataaaatacatgaagcagctccaaatcatattgttaagcatctcagacaacacagcttacatattctttacaataataaataatttattgttcgacataatactgttgttactgtttgacttagcgttaattttctgcacaaatgttgttactactttgattaaaaaggataatttgtgtaacaattttttggtcagttttaaaggttattattatttttttaaataacttttacgattagaatatgagtagtgcaacgcaaaataacactgccgtttaagacgacggtcccttgacagaatcttcatcaacgctcgatttgacgtctgccgatttccttagctccgacgtaaaccactgatcgtcggtattcagctatattttgatttctcagctccaaaaattcccaacgaaatggagaaaatggccaaaggatggtttccgatgagcggcactagtagcagcggagatcagcagcagcaaccgctgcaaacaggaggaacgtctctgctagctgattggaattcttacgcagcatcgagagattttgaagaagacaccggaactttaggcttcgatatcgaatccgccgttagatctgccaacgacactgtttccggcacctttaatgtgtaatccatccatctctttctcttaatctttaggggtttaacgattgatcgtgaccgtatctgagaaattaggcgttttcgcctgctattgaggattggattggtgtaaattaaatctggaatctgagaaattgtgattaaccatatagtttaagctttgccagattcgttgatcagatttacaaattctcagggtttgaagctattgttagtgaatgattttgattagtgtcttctctcaatgacttagaattgattaagagtcttaagcatatctttttcttgaagtgttactaactttttgattttgaattttgttgtactcaaatctggattgttaacagtgtttcgaaaggagttagagataacctgcagtctgcaacaagtagtatgccttcaggaaaagctttgatgtatttcggtttacttctagcaagtggtgtattcttcatcttcattgccttcaccatgtttcttccagtcatggtgcttatgccacagaagtttgcaatttgttttacccttggatgtggatttatcatcggatctttcttcgctcttcgtggcccgcaaaatcaactcgctcacatgtcatcggcagaggtaataactaataacaaaaccttgtgttgtgcagcttcttatatctgctgtatttcgtttacatttttctctttggaattttaatttcttgtttgctggcttctccagaggcttccactaactttaggtttcattgccaccatggttggcaccatatatgtctcgatggtgctccatagctacattctctctgtgattttctctgcattacaggtacttaaatttcatcttccttcccgactcttgttggtgtttatatcctctgtttttcatatgttaaaattttcctcttccccatttcacaaatcttacctatgaagttcttttttaccctgcatgtttcatctagtaagctcttgcctcgtcgaaacataatgtgtttagtaaaaaacatgtagactttcttattgctgttttaaaatacaagttgggttagtatgaattatgaagaagccttgaacgccatatctttggttggtctcttggcttgtttttgcaaatgcacttacttgcgacagaaacagctttgatatattattactcacccgttatcgatatggaatatatactttaagaactcactaaatcatatccttcatgtcggtttaaagattagtcacgtatctgcacattctgtaagtatagtaatctcataaaaaacctggtctctgttctctgtgaatccataggttattgcactggcgtactactgtatatcatatttccctggtggatcatcgggaatgaagttcctcagttctactcttacctcctctgtcttccgaatgtttgggagatgagctttcgctttgacctatgcaaagaaaataacttgattctctcgtgtataaagaaagatgaaagatcttcaacagtggttaaatgacaaatctggtaaaatatgttggtccaatggctcaaagacagttttgttataaatttcctatattgatactttctgctaaattggttcaaaacttcaaatcactagccactggatgaggtatggaacttgaagagttgcttggtggatacattctctaatctagggtaagtcgttagcttcaatgtcttactgtgaattattacatcagaattaagaaagttattacacgtatgttttcactgagtttactacactggcaatgtggcatacatctcttactgcaaattgcagacaagtggtcaatcaaatcttttttagttgggcccaaaatgtctgttattggatacgttgggccttaaaatggcccccatcagtcaaaaacatcactgcttggagaaggatctagaaaaacttgcaagttagttcaaacaaaataaaggaaaaagaacgatctagaagaaagaaaaaaaaaggaaaagaaacccttatggaggttcccacaccactctatatataataacatccttctcctaaatcccgcatcagtacttctctctgctctcaagataattttgttctctcaatttcattcttaaaccctagttcttcgattttttccgatctacgacaatg

SEQ ID NO: 27950 - DNA, 3000 bp, Unknown; identical to SEQ ID NO: 761
  misc_feature (1)..( 3000): 2750-1469P.txt file - cDNA_ID_2993023; gDNA_ID_1620318; Annot_ID_153242

SEQ ID NO: 27951 - DNA, 3000 bp, Unknown
  misc_feature (1)..( 3000): 2750-1469P.txt file - cDNA_ID_2993031; gDNA_ID_1971772; Annot_ID_175389
aactcatagcggatatattgagtaaaacctaaaagtttatatcttagttggcttcaataattaaacgaaaacaaaactaaagattggtggtatattttcgcatggcatgatgccatgatgtgaggaccattggccgcttatacgaaccactagtttttcgactcgtgttctctacgttattttaattttttttttttttaaactatcattattatatatttaaattatcttacttaagaaaagaaattcatttattttccttcactcatacatagtacgatttctaaatattgaatttcatgggccgaacatattattcacatagacagttatgcaaaaatctcataccttgactatataaactagctagagaatgacataagttataaactaatattgatcaaaaccttcaaattattgaaaataacaagatttgtgaataattaatttgcattgagagcaatagtcgtatgcatcactttcaaatcaataatattattaattacatatagctacggactaaatctaattgtaagcatcatgaaattatatcttaatatcttcttcttatcaatcgcaaattattaggaacatcacacatacttaaatatagctgcctgctctttataatcattgttaaggaatcttataacctattttagcgatttttaatgaagattaatagtataaaccatccgtaatattagggttatgtctccgcgttagagattgaagaatctgtcgggtccaacgacaaatgaagtcgttacaaagtgctgaaattatgaagttgaaccaataacaaaatcagttaattacattaaaaagaataaggttgcagataggtaggtgttaatgctattataacatgcaaatctagcttggggtttgcttgcgcatgtatcatttgccacaacgagaagtccacgtgttagtacagttgacaaatctattagctgaattagctgttttggagaattaattaatagactgattgtatacactcagtatatggactgcatgaaataatagtaataaaacttaattgattatacaaaggattattaatctgtataaaaaactactatcttatggttagcacgaaatgatttctatcattaatttcggaaaaaaaagttgcgtacgttgattcaatggtaactggtagacagttgatgtaaaactttttttttaacagccgaacgcattcttatatacaacatactagtaactagtacttgagtttccttagaacatacaccattcttacaatagttttgttattagatgttcccgttttgtgtataatttgattcttcttctatatggtcttgtattgtggaaaacgattattggggagcaaagaaacatacaccaaaaaaaatatgatcaaaatttttagtgtgtggaacctttcgaaaaccctacgatgttcaagtaagaaattgcaattatatgagatattatatatatatgcaattgttcttagtatttaggtgtttagaatatatactttagaccgttttaagatgtttgttaaaagttagtcttcttctaattagaaacatcttcttttgtttttatgaagtaagtgataagatatacatataatttacctcgaccaagtttgaatacttgctaggttaccatgtcatgtttaatcgtccacatgagatatctgtgtgactgtgtcttcggttcgatgtggctaattttctagaacatgttatcaaaagcaaacgtcgtcgtaattggctgatactgaggaaaatgcagtttggcaatgacaagaaccacacatatatacaatattgatatctattgaataattatacaatattaaattcctttgcattattcatttgtttcgtataaactaaaacctttgaactctaaatagttgaaaggagcagagtcagcagacaaggaccaaagatcccttcgaccacacatataaaacgatataatttgatacgaaatcgtaatggttgtgcagttgatgttgccacttaagatcacttacgtaagacttcatgcaaatataatttaatatacgtacctctttgaatttacgatgttagtttgattatatatatattggtcatttttttggtatttgctcgataatagagttgatgggaaaccttgataatattaaaaattatcatatgaattttggaggaaagacagcaacacactcgagaactctctggaaaattgcgttttcactttttttgttttccaggattagttgatctaaaatctataatatatattaataaatacaacctaataaacaaaaattatttatgtttcagttaatgtaacccattaatatagaagtaatctcgtaaatatggagttgattaaaaatatgtacttaatcaaattcatctatatatatatatatgtgtatatatatatatatatatatatatgaattatattacgtcaattatctagcttttaaaataaatttttttatcttagctcttattcaaaagtctttattccatcacaaggttatgttatcttttgtatttttattttattttatacaaggattccaagttccaacatttcaatttctaagtacatgcatatcttattaaatagtgatttaaatacacaaaaatatgaaataaattctaaacaaggtccactctataaaagaagaaaacccacaaattccaaagcccaaattaaaacaccaaaagagcccaaaatacaaactcattcttcaccactaaaatattccaaagcaaagcaacgaacataacggataagtgttatcctcatctagtcatcttcaccctctaactcaccgagaaagaaaagtaaagagagtttggtgtcactatgaacattgccattcataattaccgtcactcaaaattcatcgtaaatcctcacatagacaagacttttgcaaggactcgacaggcaagatcaaataatattacattcatgacaagtactcatggaagaagaagaacgatg

SEQ ID NO: 27952 - DNA, 3003 bp, Unknown
  misc_feature (1)..( 3003): 2750-1469P.txt file - cDNA_ID_2993035; gDNA_ID_2936555; Annot_ID_194231
aaatttaaaattatatatgatttttgttaagattgttttttttgtcatatattttaaattatatcattgtattttaattgttagttataggatttcacccgttgtataacgtgtcgtattactataaactcaaacccgtctgaccatctaattccgttcaatgaaattaaacatatttaatggatttcatcctaggtatactgtctcatattactatcaactcaaactcgtcctaccatctaaccccgttcaataaaattaaatattattttattatttttgttttaataatactttaattttaaatatatataattcaaatcaatttcaaactttttattttaaatggttatttaattgttataatttataaagttcatatattttaatattctaaacctgtcataccatctaatcccgttcggtgaaattaaacattattttttttgttttgtttaaataatatttttattaaaagatttataattcaaataaatttaaaatgtgtctttcaaatagttatttgatttttataaatttcacatttaaaatatttctctatatgtaacatatagttttatattttataaatattataaacgttttataaactttaaataattacaatatttaccttttaataaagtataatattaataatcatttaaataatcatgtgtagctaattttaaggaatttgatttaaagttagttgtttggattaaatttgaatgaataatgtgattgatatattaaatcaaaaattaaaaatcaaatcaaataattaaggaaaaaaaaaataatgccaatggcatgccattgtaaataagtgtcaagtagaggatttatttgctaaaatggttgcaaaaatgtatatgtagatattctgaaatttaaatttagttagttttttttctttcaactgaaatatattatataaaaatttacacatttcaatagaaaaaaatatctatgaaaactaaacaaacaaacatattaaaatccccgaaaacaataacccttagaaagaaataatgttgaaaaagacataaaaatacaaaccaatgaaaccattagtttacttaatcccgttagatgagcttctctcttggagttttggaactattatatagaaaagcaaaattcagttacgaatgcggtttatgtataaaagaagtcacaaaatatcatcactgtaatattatagattgtaaacagagaaatacaaatatataattgtccgaccttatgatatacactactaagtactaacctacgcaaataataccaattaatcttcagcttattcggaaaatttcggctaattcatgttagatacggacaacgtcggatttaacccaaatcctcaatgcaaatgcacaattttctggtttgtttcgtttttattttctggttaaaaaaattcagattaggtttgattaaattaaaaataataaaataaagattgagaaatcactgtggtcttggttcagtcttttgagatagagataatttctgagccgagccgaggaagaagaagaagaagagatgggttttgtcttaatctgtacttgtcctccgtcctcgggtgtcgtcgtctctcagcttcaccatcaccaggtccgtcttccttcttcgtcttctgattttgattttctaattacacaatctgtttaacaattctcttttgtgggtcacaattttcagttctccgccggagtcaaaagcaatgaactttggtttcgtccgactcgtagaaccctaatttcgaaatcatcttgtttcaatctccctcaagaacccattctctccgaagctctcaaggtacaattatatagatgatgacaaaattgattctttttccgtaatctgtacttgggatgagttgttccagatagcaattaagcaattgatatcccaattttgtgatgtgattgtgtgttgtttgttgatcaatcttggagggtttttgtctgtttgtttcacatatgtatccttagataagtgttacattgtttgttttcatattggatggtagtattgatgcatcaaatgctctctgtttcaatgtggtttgtttgtataggagccaattgcattcttgggtgggatgtttgctggacttctaagacttgatctaaacgaagagccgctcaaggattgggtgacgcgaacagttgaagcctcgggtattacagaagaagaagttgatgcagatggggttgtttccaatgatgaagactctcctcaacagatagagattgaatgaggtgtcttggttctgcagtatttaccatctgcaaggaccttttgtatgtaacccctgtgttctttatgtagaaagaaacagactctcttatgtataacttttacattacagaggtatgtcatgtccttgagtatgacattctttgctggtagttgaatcaagatagtgatgatctaaacagtgctagagtgttggagatcagtcgaatcaaatcaagctaacaagatggcttttgcattgaggcgtaaaatctgacaaattatacaacacaaagattttacattcactctgtatcatccatagtctagtctctaaatttgagataggtatttgtgtggctatagtgtaggtcttactacttatttttgttggttgaatcttcaatgagattacaatcatttttgtggataatcagagatacttgtactgattactgaatccaggtaagtctctgcattacgcaaatttggaagagaccaaatgtacaactaaagacaatatcaaaagatctttttcataagagatatttcttagcttactgttgaattttgtccatgacgatgaaatgataataaccacagattatttcaaccaattcaacccaaccacgtcataagacattaagactcataaccaaacgaccgcgttttgatacctctgatcaatctggctcactagcaagctatgccagaccaaaccggtacgacttctgtgaattcgattcgtgacttatg

SEQ ID NO: 27953 - DNA, 3003 bp, Unknown
  misc_feature (1)..( 3003): 2750-1469P.txt file - cDNA_ID_2993092; gDNA_ID_1971867; Annot_ID_58426
tgtgagtaatatagaaaagagtttgattaccactaactagtatgtagatgtcagaaacctcaattagaaatttgtggatgtttcgatgtctctatgccttgttaatcgaacaagatcgaatttgaagaataatgtattaagttatgtataatgtcgttacaatctgaccctcctttacaatttcatttctctccttttatattaatattgtgagattcgtaatcacaaataatgtttttctcgtgtcgccgatcacgtctcgatttaatgttgttcgtttcgaatccttattccgccatcatcgctcttcactttactctgtgattcgtccgttacgaagcgcaaatactaatccccttctagatctttcttgggcagcgataggcattcctaaacccatgggtctttaagcaaatagacctgatatctgttctcggcccataacatgtatccgtctatattgtgggttgggtggataacaagatctgacatttacatagtgtatgagtgatttaaagcaatatgagaagttaaaactagcacttaactttgtgctaaattctttagtttaacttgttaaaaaatttcttaataaaataaattgccgaatttacttaacaatttatttctctccctaaaataaaagtatagcctataatttttttaaatttttttaatgtttttaactatctaattcgcaaaaaaagaaccctataatatcaacatataaaaactaaaaaggattagaaatatcattgaaaccaactttgttaatcaaactagaataagggccaccacattaaggacttaggtaaaagtggtgtaaaatgtaaattgttcattttacaaaaaaaaaaaaagtggtctaaattgctttttgtgatgtgaagttgtgaactaatatgaatttggtctaagtctattgcccaaattatttatccttttagtcctagaatttgttccaaatttgatagtatatagcatcatcatcaaattgatcaattaaaatacgtgacctatagaccatagaaacaaattatttagtaatttttttatggtatatagcaaatggaaattgtttttatggttttcaaaatttttttttctggtcaattttttttttatggttttcaaaaaatggaaattatttagtaatttttttatggttttcaaaaaatgaaaattatttagtaatcaaaatggaaattatttagtaattttttatggttttcaaatttttttttttctttcttcccgacctctctcccctctccttgttcgccctagccgtcaaggccatcttcctcctcgttttggccggtgattggtggcttccatagcaccgtcgccggtcctgttcttagtagtttcagtttgttgtctcttagttattctttgttctgattttagtttctcaaaccctagtttcgtcgtctcctcttcaaatctctcttttttgtggtggttccgatgtgatgactatcatggaggatgggtggcggatcggtgctctttgtagtcggatctattccccggtggagccgtctcgtttcttcgatctagttatggaggtttgtgtttccgatctggttctaatgtctcaactatcggtcttgttcttgttagtttgagaattggacttgatttgttgtatgttccggctggttctgatgtggatctattgagttctgttcttggattttgttggctttgcggtggtgctgtctcgtttggggcgtgtatttagtcggcttttcgtttccatgagttagttctgtttatccctttagtattgcagcaacggcctctttgtatgcggattcttcttccgtttttgagttcgagtgacttctagggtttgtgttttgctgtgtttttcgactggttatggtttgaagcctcaggttcagcttttgggtaggcttgtttgactcctagctctgcctatctctctgtcctcctcttggttttcggtgtcgtggcttggtggaaggttctgttttgtgggttcttcaatcggatgctagcctcctataatggcatctactagctctctgttggaacctcttttggtttcccggctgagttctggacgttgtggtgggtcgatctcttgtccttctctttgcgtggcgtaaccaatctttagtctgtaggtggctttggctgggtctacgaaggtccgtgtgtaaggatgagtggtcctttttagcgtttcccctctcggatctcaaggtcttccttgatccttcgccttctcatgttcattggcgctaaagcggttctgatggttaggttctgtgttctgatcttcttgtttcgtcgtcttcgtttttgttgtggagatggttgtgtgagctcgtattaaatctcttttcaagactcctgtcagttgcctctcctcagcgccaaactgttctatggaagtgttagtcggcggcttgttgggaagagttttcagtgttgtagctttggaggctttagctattaattctgtagctgttatctttgtatcttttcttctaaggcttgttttgtttgttcaccttttttggcctcatgtctctgggggtttctatgtacccgccgactttgtctccgaaaggattttttccttttcggctatatataactcaaacgcatccaatcaatgaaatccgtctaaaaaaaatagcaaatggaaattgttcctaaatctttcacaattttccaagtattttttcttttgaataattttagttattatcctgataatattttttatgtaataattattcgaaacgtgtcacatatatatacaccaagcacaccatttttgattatcatccatcatctcactcactgatatttatacattcaaatatttatttattttcaagttttacgcaaatctctttcactcttaaacctcataaccttagagatcatcagtcatcaatcatcttcttcgttgttatcacttctttagtagctctcaacgagatttctccaaaatcagcgatg

SEQ ID NO: 27954 - DNA, 3003 bp, Unknown; identical to SEQ ID NO: 27953
  misc_feature (1)..( 3003): 2750-1469P.txt file - cDNA_ID_2993092; gDNA_ID_2926155; Annot_ID_139473

SEQ ID NO: 27955 - DNA, 3000 bp, Unknown
  misc_feature (1)..( 3000): 2750-1469P.txt file - cDNA_ID_2993107; gDNA_ID_1971953; Annot_ID_58657
aggcttgaaagatggctctcttgcaaactctgcattttagattctctatcttttatcgttttatatgtaaaggtattggttcttgttgagaaatgatgtttccgtatgaattcaaaagtattataatgaaattcttcttctcttctataatcagaatcgttttggtcctttttcccatcatattctttaactatggagtcaaattcaaattacatagttatctgttataacttgaaaacttctttgttcttcataagaccaagtacgatggtacgatcaaggtgaagttgttcacatttgtcaaataataatttccaataagaaatctggtgaattttgttacttgtcaaaaaaaaatcaagaaaattaacaagactaatagtaataatcgaacgacgacgtaatgtttaagaaaaaaaaacaccaaacgacgacgtaatgggtaatgaaagtgatgagggtatttacgtcaattcatagaggtactccgatgtaaccctaatatataacgtgcatttgtagcgccgtgagtgtccttcttgtttacactgagcagaatctaaaaacacttatcgtttcgtctcttctctgatccattgttgaagatggtaagctctttctctccaacatttttctgtgccagatcatttggttttcgttagtctgttaggaaattgagatctgcgatttcacttagtcctgctagtttccgatgttccatacttatacgtttgtttcagctatgcaaaattgacttattgatcttggcttgtctgattcatagtttaggggttgtctgattaatctccatgtattgatattgagctgatggtatgtaattatggttaaataccagtgaacaatttgtttctcaaatgtgttttgttctctctgtatataatagtcgaagagaaaaactaaggagccaaaggttgagactgtgactcttggaccttctgttcgtgaaggagagcaagtttttggtgttgttcacatctttgcatctttcaatgacactttcattgtaagttttttctcatttattcttagcgtttgtgtaatataaccttctgtgtaatgcgtttatgacattgctttcaatattttgcagcatgtgactgatctctccggtagagaaactctcgtccgcatcaccggtatgtttcctagtagtgaattttattacctgtgtttatgttagtgtaaaattcatttatatttcgagaaatataatgattatgtgaccttttgcaggtggcatgaaggtgaaggctgaccgtgatgagtcctctccttatgctgctatgcttgcagctcaagatgttgctcaaagatgcaaggtctgaaatgattcgatgtccatgcctttttttaattgactttgaggttctggatgataatctataatggtttatgtgacaggagcttggcatcactgccatgcacgtgaagctccgtgctactggaggaaacaaaaccaagactccaggtcctggtgctcagtctgctcttagagcccttgctcgttctggcatgaagattggtcgtattggtaaacacacaaacttagtctcactcaagttgttttgttttgttttgttatgattgctcattggaagctgaatctttcttgaatgcattttgcagaggatgtgactccgattcccacagacagtacacgccgaaagggtggacgaagaggaagaagactctgattgcacgatgaggctcatcatcgttgcaatgtgctcttgagactgtgggtattttcttgggtacacttcgaagttagttttgtctctctccaatttatctttccagttgctttgagaacattataagctgtgtttttttgtatttggagtttttggtattgagaaaaaaaatgttaagttactgatcgcgtcgtgttactgttagttggcttattgatattttacattttctctctttttaactttggcgaatggatactttatcgagatatttaatgctatggttgctcatcagaatcagattagaaagtccgatgcaagttttagtatgtcgtgctggttccgaaatcaaaccaagccagatcgttgttaacttgtcataatctgtttttgaggcccaattattcaaccaaaaaagtcaattttaagaatgaaaagagttgatttgtggcatgtggtgaatgcaattaacaactatacgagagattgtatgataaagacatcaaatatcccaagtccggcttttggaattcttgattagaatgttatcgcttagattgtgttgaatggcatctcttgcaagaaaaagaaaacagattagcagattatgatcatatatttcttattagccctgagctgttagtgcattataagcatcagaccccacttatagcctcttgcaatgacttaaaactcatcatatcctcatttcttgatgctcttggttgttatcgaagacataaacaacatggatgtttaaagaatgctcttttatgttctttagtctctatgaggagccatatcacaggcaatatttcctagtaaggagaaaggtttggtaattaattgatgcagtgggtatctttcttttagttttatggcttttgactacatgtaattcagataattttggatgggtaatcacaattcaagataaattgttataaataatttagtaatataaatgactaaatatctctaattagtaacaccgggtgtttggtctagtggtatgattctcgcttcgggtgcgagaggtcccgagttcgattctcggaacacccctacttttatgttttgaaacatgtgaaaggctttttttgcggtcaaacccattaacaatgggcttgaaacgacggtgcttcgaccactctagttttgcagaccgacgtcattttttttctttctctttcgctctggagactggaatcaatcgagtaaagtgttcgtagctgagaaaaaccctaagctctcgtttttcgtcttctccgattctgcaagtatg

SEQ ID NO: 27956 - DNA, 3000 bp, Unknown
  misc_feature (1)..( 3000): 2750-1469P.txt file - cDNA_ID_2993107; gDNA_ID_1971953; Annot_ID_177401
acagattctagtgatggagaaaaccattttggggaatcttgaatggtacttgacagttccaacacagtatgtgttccttgtgaggtttattaaagcctcgggttctgaccagaaactggagaacttggttcactttctagctgagttgggtttgatgcatcacgacagtttaatgttctgtccttccatgcttgctgcatcagcggtctacacagcaaggtgttgcttgaacaagactcctacttggactgatacactgaaattccacacaggctactccgaatctcagctcatgttagtcttcttaattctttacactagcaagtttgtgatcatattgtttgtatattaattctctatgtgcgtttctgtgtgtaatcagggattgctcaaagcttttagctttcattcactcgaaagcgggggagagcaagctacgtggtgtgttgaagaagtattcgaaacttggaagaggtgctgttgctctgatttcaccagccaagtctcttatgtcatctgctccatgaacaaggcttgaaagatggctctcttgcaaactctgcattttagattctctatcttttatcgttttatatgtaaaggtattggttcttgttgagaaatgatgtttccgtatgaattcaaaagtattataatgaaattcttcttctcttctataatcagaatcgttttggtcctttttcccatcatattctttaactatggagtcaaattcaaattacatagttatctgttataacttgaaaacttctttgttcttcataagaccaagtacgatggtacgatcaaggtgaagttgttcacatttgtcaaataataatttccaataagaaatctggtgaattttgttacttgtcaaaaaaaaatcaagaaaattaacaagactaatagtaataatcgaacgacgacgtaatgtttaagaaaaaaaaacaccaaacgacgacgtaatgggtaatgaaagtgatgagggtatttacgtcaattcatagaggtactccgatgtaaccctaatatataacgtgcatttgtagcgccgtgagtgtccttcttgtttacactgagcagaatctaaaaacacttatcgtttcgtctcttctctgatccattgttgaagatggtaagctctttctctccaacatttttctgtgccagatcatttggttttcgttagtctgttaggaaattgagatctgcgatttcacttagtcctgctagtttccgatgttccatacttatacgtttgtttcagctatgcaaaattgacttattgatcttggcttgtctgattcatagtttaggggttgtctgattaatctccatgtattgatattgagctgatggtatgtaattatggttaaataccagtgaacaatttgtttctcaaatgtgttttgttctctctgtatataatagtcgaagagaaaaactaaggagccaaaggttgagactgtgactcttggaccttctgttcgtgaaggagagcaagtttttggtgttgttcacatctttgcatctttcaatgacactttcattgtaagttttttctcatttattcttagcgtttgtgtaatataaccttctgtgtaatgcgtttatgacattgctttcaatattttgcagcatgtgactgatctctccggtagagaaactctcgtccgcatcaccggtatgtttcctagtagtgaattttattacctgtgtttatgttagtgtaaaattcatttatatttcgagaaatataatgattatgtgaccttttgcaggtggcatgaaggtgaaggctgaccgtgatgagtcctctccttatgctgctatgcttgcagctcaagatgttgctcaaagatgcaaggtctgaaatgattcgatgtccatgcctttttttaattgactttgaggttctggatgataatctataatggtttatgtgacaggagcttggcatcactgccatgcacgtgaagctccgtgctactggaggaaacaaaaccaagactccaggtcctggtgctcagtctgctcttagagcccttgctcgttctggcatgaagattggtcgtattggtaaacacacaaacttagtctcactcaagttgttttgttttgttttgttatgattgctcattggaagctgaatctttcttgaatgcattttgcagaggatgtgactccgattcccacagacagtacacgccgaaagggtggacgaagaggaagaagactctgattgcacgatgaggctcatcatcgttgcaatgtgctcttgagactgtgggtattttcttgggtacacttcgaagttagttttgtctctctccaatttatctttccagttgctttgagaacattataagctgtgtttttttgtatttggagtttttggtattgagaaaaaaaatgttaagttactgatcgcgtcgtgttactgttagttggcttattgatattttacattttctctctttttaactttggcgaatggatactttatcgagatatttaatgctatggttgctcatcagaatcagattagaaagtccgatgcaagttttagtatgtcgtgctggttccgaaatcaaaccaagccagatcgttgttaacttgtcataatctgtttttgaggcccaattattcaaccaaaaaagtcaattttaagaatgaaaagagttgatttgtggcatgtggtgaatgcaattaacaactatacgagagattgtatgataaagacatcaaatatcccaagtccggcttttggaattcttgattagaatgttatcgcttagattgtgttgaatggcatctcttgcaagaaaaagaaaacagattagcagattatgatcatatatttcttattagccctgagctgttagtgcattataagcatcagaccccacttatagcctcttgcaatgacttaaaactcatcatatcctcatttcttgatgctcttggttgttatcgaagacataaacaacatggatg

SEQ ID NO: 27957 - DNA, 3000 bp, Unknown; identical to SEQ ID NO: 5932
  misc_feature (1)..( 3000): 2750-1469P.txt file - cDNA_ID_2993114; gDNA_ID_1620833; Annot_ID_57902

SEQ ID NO: 27958 - DNA, 3003 bp, Unknown
  misc_feature (1)..( 3003): 2750-1469P.txt file - cDNA_ID_2993122; gDNA_ID_1621101; Annot_ID_171439
attaaactagtcattcatgaaaatttctataagtgattatacctttaaattaagttatttatcaatcaatttatttcataaaataatcaagtattatatactaatacaattttaatgcaatattgtaaaaccaatcacaataaaactattttgtgcaaaatttggattttacatatatcttgacaaaacttttatttagggtaatatgaattcgtgtaagatttaggtaaaataatttcgtgcaaaattagggcaaaaccatgaacaattttattttatttttttattttttttttagataccacaaagatttagagaaaagaatcttataaaaagaaaaattatcttgcaacgtttttagtaaaaataataataacacaatcaaatatatggaaatcaaatatttaatagggaaaagtcaatatctaaaagtgataagatatgtataacgttttaatcaaaggagttaaataagggatatcatatcaatcataaatggattttagataatatagtatttataaaatgatattgaatatagatgcaactattcaaaactggaatgctaaaacattaatacatgcttacatcacccaccaccgggctatgaatagttacaaaattagttatataattataaaattggtaatttatatattcaatattgtaatagtaaatcacaaagattaacaattaacaagcatgattctcttctttaacgattttctttgtagaatcattgaatcatgcgatagtaattatagaaacaaatgataagcatgattctcttctttattgaatcattgaaaacatgcttttaccgatctatactataatcatcgatcgactcatattgttttgtttcaataatagaaaataagtactatgaaccatgagtcgataagtaaacatggttcttaaaaaaaatgtaagaatctctatatctaccttttagagcgtgctgataacgtgttgtaaacagagaaagagatagaggaaatcagtgtattattccattgagataaagggttctttatataggagtacaaggaaagggtaaaaccctagaaacatctcgatgatgggcttagataatgggccttataatgggcatcctcttgattcataacaatatgttgtttcttctagttttggtccccgcttcctcaccatctctagctagcatcatacattttctttattttataatatatattttcgacatagcatgtagattttctatttatcttttttaaaatttacaccaatcattgatagtatatgtattgtaaaataaaaataaaaataaaaatatctacaacgcatggtcatattcaaacttaattctaatatttacccaaatgattttcttttctagcggttgaattaacttagaaaaagaacaatcttcacttagagatcccagtgacgatttggacgcttaattattagggttatcgactcttattaaggttcttctaaagaaagaaaatgtaatactttgaagatgaagcaagacaaaccgaagaagacagcagatatatatatatatatatatataccgaccaagattcgtgtacgtaaaagcacaactgagatatgaatttgttggcatgcaaataaattacagatgtttgatgctaagaccaaatgaaattaaaaagggatttagggattttgtatctgtgagaggaacagtccattgaatcagtgagataggatactttaattatactgtcttcttctgctcagcatggttcgaatccccatatcaatcatccattgtctctttcacctttgttttcataaatggcaaaaactttggttgcaatttgcgacaaaggatgacgtattcggcgccatttaaagttggagttttaaaagtaaaaactattactatatcatgtgaaaatataattagattgtgaagtataatttttagaattctgtcgtttacctcttagcattgttatttgattagactaaactaataattcaattaaataacaaatctaattttttcatagtcgaatttcattagttaatcgtttagttgtttctctcgtggatcttcacatcatcacatgtgccaagaagttaatattaatatatagtcattttccgagaagagtctatttgggttgtttgagtaaagcgtggatatctttttccaaagaccttttgagaacttatcaaccacaatcccttatatatggttgaagctgtgatcacttgtattacaattatattaacaactcaatcggcattaacacaattgctttcgattggatctatcagaaatcggcattaacacaattacattatatatcacgctaggtctgatcagctccatgtcaatctcgttgtttgtgtgctctcggtttagttatgtgactaagaagatgaaccgacttggataattgattgcctggttgcaatattttcgaaagtgataggatatcaactgtttcttttcaatccataacttacatacttaatgatataaccacatatatatagaatcgtgtggctgtcccgaaacacgtgaccataccatatcgtattcgaatgcacctacttatcaactatttgaactgatgtggatttaagaattggtcatatattatcctccatgcttcatagggtaatatccagagcgatgttgcaacagatccttacttgatgcgtggccaattgatgttgcttgtgtgagttgccatagatcctaaagccaaggaatacattttggaatccatagaagacatgaacaacattaagcaaagccttctgtagatttttaattctttttcgttgttgaggatagtgatatgtacattaattaatttggttccgtataattttttaattaattagcgtaacactccacccgaaaaggtccaaaaccttaaacaacacacgaagctcgtagacaagctgaccaaaaccttattagttttgtttgcaaaccccaaaagaaaaaacatctttggtgtaacaaaaatg

SEQ ID NO: 27959 - DNA, 3003 bp, Unknown
  misc_feature (1)..( 3003): 2750-1469P.txt file - cDNA_ID_2993126; gDNA_ID_1971973; Annot_ID_58689
gagcaatcaataataaatataattttattgttatttaatttttatcgaaggtccaacacattatatatggcgaaattatgatagaaacggaaattttagcaacgacatatacaaccttcaccaactacaacaggatcacatggccaagtgcaatcagcgcatggaaccttttgcggatgcacaacatatggagaagtcttttggttaatcacatgcgacatggcttcatgctccaacgtgtttctaccttccaccacgctaacacttgagaatgttatatctacaccgttaaaactaacttaagtcatgtatgctaatattgttttaaatagtaataagtcttattgattgagttttagattacagaaatgaacaaaatctcagagatataagaaatgcttacgggataggagagctatgaggcaaaagaaagtgagaatgttagagacttacttcatttcctttggaagttctattgagaaagagatatttcaagagtaaatcagtgttgaaattgataacttatcacccttttgatgcaatttatatatgtaagaataattgtattttgtggcaaattagtcattattctgtatatagttttttctaggaatatacatttaataattggagatctttcaagaaattcatgataaaatcttatatggattttttatctaattggtttaaatatttgtatctcaaaatctataacaatagtaaatttatatgtttctatattgatgaaatttaacttgaggaaaagcattgaaatttcaaatatggaagaaaaaacaattgagaaaaaaaaaaaacaatgagaaaaagtttaaatatttatgaccatgttgaactaattatttatgaccacaaaaaatatatattagcccactaatgtaccatgttgaattaatggcctattaaagtttatttcactggcccattaacgttcctatttgtatatacccaacattccaacaaagtccataattcactgatccgaaagtttttactttaagcgttagtatttgtgtcagatgcagacttcctggtgttttcacttcaataaaacgacgtaacgtctcatactaagaacgtaaaacggcatcaatggcgtgatccactggataacaatttcagcttgctctctttcaccttctctctctctcactacgttctcgggctccaaacgtatgaaccagaacaaagccttttagatagttccgtctgcgaaccctaaaatcattcaataaacttcgaacaaaaacgaatgcttttgttcaatcatcttctcagtttctgattccgaagaaaccctaatcaaataaatcatggactgctcatgcagtactcgtccttcgtctctgcttatctcttccgaaccatcttttcgctttcctcactctaatttctcctcgaatctcagctttcaggtttgtattagtatccttagtcttctgctttaagatttgattcgaaatcaatggagaacaattttaaagttctgagattttctattttattttccagataccgaaagatacgaagttggtgaagcagcgtttggtagtgagaagttcctctggttctgattatcaaaacggcgacgttaatgggtttcctctcaaaccaaacaaactctttatgcaagaggtaaatttcttatgttttcctgtgtttttgttgattgagaagaggagattaaatggatttagtgatgattttgttgaattttaggcgattggagctgagtatggagaagggtttgagacttttagacaggatggtcctcttaaagtggatgtggtaagagctactaatgattatgaatcttttattcgtttgtatttgtttttatcagaagctgcttatggaaaccttttattgtagggaatatgtgatttgcttttcgttttgcttgtaaataggatttctggaatgagaaactacaagatggttttcttcaaagaatacgttacgcaatgaaaccagatgaagcctatggacttattttctcttgggacaatgtcgtggtaataattgtttgacaccatctttatgttagcaagttaagttagatgaagtttcttgtagcttatatatattacctacaaaagcttcttcttctagtggggcttataaatattagtgttttcgtttgtttagatgatggctcccctgttattggtaaatctcaaaagttgttggatagaattgcgtggtccatgcatactagttttgggtctattttaggcgctagggcttggcggatttggcaaaagttgtagaataattgcttctttagaatgatgcttgcgtgttagctggtagatctcaagaggtctatagtggaattgcatggtccatgcctattaattttggattcaagagtcgtattttctcaatgttccacttatggtttaaactttgtaggctgatactcgaagtcttaagttggaagcttggaagcagctcgctgcagaagaaggtaagctttattgcgctgctctcctgctcctaaaggttttacccaaatatagtctagtttctttctgcatacgtgtttgtggatagagatatcttgcaatacctgctcatatatgtttagtgcggcccatgcacccttttaaggaatgttgggagagtgtccagagatatcaatgaactcaaacgttacattaccttctttgaggcctcaattgtttgttttacgttttcttttacgtttagatgttaaattagtgtgttttccttgagtttcccacaaactttagtgttttggatgcgcaatcagtatagagttgacttgtttatttatgtaaaggtctgaatatgcgaactgctctattgaaataatcttgtgtgttagctcttttgctggtatgtattaaacttcaaaaaggaattgattttatcttacttatattaaactacccatttctcatattaaattgtttggcaggaaaagaaattacggaggaggttgacatccaaagactgatg

SEQ ID NO: 27960 - DNA, 3003 bp, Unknown
  misc_feature (1)..( 3003): 2750-1469P.txt file - cDNA_ID_2993126; gDNA_ID_1971973; Annot_ID_177516
agctagtcactgaccgtgaaacctcgtctctatcctcagccattttcttgaacttagcagaaggagaaccaaatttgagaagctggaatctactagaagcatcaggtaaagcactaatagaccatctcctaggtttaccatcaccaatcaaagttcttctagatgtagaaacatcaagaggacaaggaggaaccttagtatttttgccagaagaaccattagattcttcaatctctgctttcaaattcccatcacaattagatcccattatctctctctattgaagatcaaatctttgtaggaataaaacagctactcaaaggaatatatgctttgcaagcttaaacattgttggcaaagaatataaaacccagaaaaaagaagaagaaaagattcggacttgccaacgaagcttcttctacttctcagcacattgaaacctaacaaagtattcagatttgaataaacaaagatgaaaaagaaaaggaatcaaacccttagttgagaaactcgttgaatcggaatttaaaaattgcccaagatccgattcagctgcaattacagagaaacccccaagacaagaaagagatgttactcagactaagaatttatctaaaaggaaactttgaagaagcaatatgcgtgtaatgaaaaggtaaggcttctgttgtgaaattgatgcaacataagattggtcgttggggaagaactagtctcggattctttttttctcgtggttgcagttaacttagcgttgatcaggccgccattattgtcccaatacgtttttttttattcatgaaaaggaaaaaaaaaagcattattgtattagtgtactcacaaaaataagatacacaaaacgttttagcatatagtatttatcagattttaattattactactaatttactgacaagctgttacagatgtgtattgttcttactgttttttgggttgtgttttttgataatttatatatacttgattaataaagtcttcacaccttccaagactagctcttagaatgataaaatatcattaagtttataatgatctcgattacaccgagattctcgcacgttaatgacagaatcgaagccatccagtggttaatttagagtttttgtatcaagttttggaatttgatctagggaaaatacattttcttactaccaaccatattcttcttatctatcatagttttttttttttttttgtgttgtatgttaacttgaaagtagatcagctattcagctgtgcgatatcactgagacatagtatgttgtattgttcatgtgatgcgtgtacaacacatagagtgaaatcgatttggatgattaacaatgacaatgttgtcatgagaaagaaattatggtctccttctcagagtttataatcaataataattattattttgtggaaggccaaatacattttggcggatattcgataaaataaaaaaaactttagcatcgacatatatgacattctccagatacaacaagatcacatgggcaagtgcaaatcagcgcatgggtgcttttgcggatgcataacatgtggagaagtcttttatggagaaatgcaaatcaacatattgttttcttcaacttcctataccatgtagttatgagaaagagattcatggtatcattatatctctttctccgagcaatcaataataaatataattttattgttatttaatttttatcgaaggtccaacacattatatatggcgaaattatgatagaaacggaaattttagcaacgacatatacaaccttcaccaactacaacaggatcacatggccaagtgcaatcagcgcatggaaccttttgcggatgcacaacatatggagaagtcttttggttaatcacatgcgacatggcttcatgctccaacgtgtttctaccttccaccacgctaacacttgagaatgttatatctacaccgttaaaactaacttaagtcatgtatgctaatattgttttaaatagtaataagtcttattgattgagttttagattacagaaatgaacaaaatctcagagatataagaaatgcttacgggataggagagctatgaggcaaaagaaagtgagaatgttagagacttacttcatttcctttggaagttctattgagaaagagatatttcaagagtaaatcagtgttgaaattgataacttatcacccttttgatgcaatttatatatgtaagaataattgtattttgtggcaaattagtcattattctgtatatagttttttctaggaatatacatttaataattggagatctttcaagaaattcatgataaaatcttatatggattttttatctaattggtttaaatatttgtatctcaaaatctataacaatagtaaatttatatgtttctatattgatgaaatttaacttgaggaaaagcattgaaatttcaaatatggaagaaaaaacaattgagaaaaaaaaaaaacaatgagaaaaagtttaaatatttatgaccatgttgaactaattatttatgaccacaaaaaatatatattagcccactaatgtaccatgttgaattaatggcctattaaagtttatttcactggcccattaacgttcctatttgtatatacccaacattccaacaaagtccataattcactgatccgaaagtttttactttaagcgttagtatttgtgtcagatgcagacttcctggtgttttcacttcaataaaacgacgtaacgtctcatactaagaacgtaaaacggcatcaatggcgtgatccactggataacaatttcagcttgctctctttcaccttctctctctctcactacgttctcgggctccaaacgtatgaaccagaacaaagccttttagatagttccgtctgcgaaccctaaaatcattcaataaacttcgaacaaaaacgaatgcttttgttcaatcatcttctcagtttctgattccgaagaaaccctaatcaaataaatcatg

SEQ ID NO: 27961 - DNA, 3000 bp, Unknown
  misc_feature (1)..( 3000): 2750-1469P.txt file - cDNA_ID_2993130; gDNA_ID_1971796; Annot_ID_58061
tcttaaaaccaatcttgatttctagaaaactctgttcctggtaaaggatctaacttttattagtcttgttgcttcatatattgccttgctttaggtgtgtttgatcttgaaagggaaacaattttagatcaagtgtgtagtagtactgatgcaactgtgtgatgatggttttgattgttcaggtggctttggcgcatacgattggacatgtagcagcgatagtgactatgtctaaagttgtagtgtccttcacacacgtcatcaaaagcagtgagccagccttcagagtccttgtctcaagcttcttcttgggcgagtcattccatgtatctgtttacctctccctcttacccattactagaggatgtgctcttgctgcaatcatggagcttaacttcaatatgatcggtaattaacaacatccatttattgtgggctactggttcgcaaaacgttgtctcccaaatcaaaccaaacgttgactgataatttttataatgagctattgatgttagttcaaaacaaaaaaattaagtttttcaaacaacttgatttgaaaccttgtaaggtatttgattctaaatgttagaattcaggtgggtaatggcacaaagtgtgttctaccatttgtataatcaagtctcatacatgtccctcgaccagatttcaccactaacatttagcgttggaaacaaaatgaagtggatctcggtcatcgtttcctcaatcatcatctttcaaaaacatgttaaacctgtcaatgccctaagtgttgccattgcaattcttgggactttaaccttttcttaggtaaaaaatttgagtgaagaaaaaaatagactcttttcattgtctacacaaggcttctttctcattatcagtctgctttgagatgagaacatgagaattaaacaaacacacaatgccctttcgtttatatgttagattcagactacaatcttgttatttctcttagaatgtatgaacctttagtgataactctaggaatgggccaatgttgtatcacatgttggaatcaatcttgaacttaaagctcattgattcctgcgagtgttttggctaatgatgttcttttgttctttagttaataaaattttatatttttttgtatatgatgtaattcaaatttttttaaacgaacatatattattcaatcaatgaagaaataatatatgtactcacatcgcttaaaaaaattagacaatggttcatagccatactataaatattccaaaatgattctgaatacgaatgaacaagaaacttaagttttccaacgtccaaaactaaaagtgttccgtttactccggttctttatttcatagaatgaaaactttaaaaagtttcaatatattataaatatgtaacctttattaaagtgaaatcttataacagtttcaattaaaaaaatttatgaaattttaaatattataaatatctgaaatttctaatagttaaatttatgggtctagaagaacaggaaaaacatttatttggaaaacgctagctgctgcagtaagatctagaggacatatctgtcttaaagttgcctccaatggcattgcttttttgttgttagaagggggtagaacaacacattctaggttttcaatacctttgaatcgagatgaattttcagtttgtaagatcaaaccaaaatcagatttagctgatctgattaaagaagcatctctcattatatatgatgaacctccaatgatgagcaagttttgtttgaagcattagataaaagcttttcgaatattctcaagcgcgtagacaataaggtattgggtggaaaagtcattgttttcggaggcgatttcagacaagtgctaccagtaattaatggtgcagggagagcagaaattgttatgtcatctctaaatgcttcatgatcttttggatcactgcaaagtgttgaaattgactaagaatatgcgacttttaaacaacaaattaagtgttgatgaagctaaagaaatccaagaatttttcgattggttattggatgttggtgatggaagggtcaatgagcctaatgatggtgagacgctaatagatatacctgaagaattgttgattcaagaagcagatatccaataaaagctattagtagaaaaatttatggaagggtcaatgaaatccaactaaactccacaaaatcattgatccaaaattctttcagaggagagatattctaactccaaaaaacgatgatgttaacacaataaatcagtatatgctagagcactggatagtaagtttagatttgctctatattatttaatcttttaatttatgttctccattcttctgactttttgtgaagagttgattgttattttatttgttacaagtcaagaaagaatctatctttcggctaatagtatagatccttcaaattcagattcattaaacaatcctgttagttcagatttcttaaacagtattaaggtatcaagtatgccataccagtctttgcgtttgaagattacaaactgtcattatttaaaattaaataaaatagtataaccaaatttttaaggtgtaattacttaattttctacctttagattgtacacactaaaacaatcatatttaactcactaagccatactaagtattatatctaaacatacaaaaaatttaaattaacaaataagtattaaagtgtgaattatattttaagaaatcaattagtcccgatactaaaataaaatatagatccgcagtatatcgtgtgttaaaatttagtactaattaaattccataactaaaattaaaacttaaagctaatattagtacaaaaaaaattgatttttcaatgtccttggtataattccaccggttcttgggatcaatccagatcggtacagtcataaaccgaaccggctccatgttctcttcgtcgtcgttcaatcaaacagatccacaatgctcgtaagttcaagcaaaatcacaagagcgagagagatg

SEQ ID NO: 27962 - DNA, 3000 bp, Unknown
  misc_feature (1)..( 3000): 2750-1469P.txt file - cDNA_ID_2993130; gDNA_ID_1971796; Annot_ID_175674
gatgacgcttgtctcttgggtcactggagttgtagaagctcttaaaaccaatcttgatttctagaaaactctgttcctggtaaaggatctaacttttattagtcttgttgcttcatatattgccttgctttaggtgtgtttgatcttgaaagggaaacaattttagatcaagtgtgtagtagtactgatgcaactgtgtgatgatggttttgattgttcaggtggctttggcgcatacgattggacatgtagcagcgatagtgactatgtctaaagttgtagtgtccttcacacacgtcatcaaaagcagtgagccagccttcagagtccttgtctcaagcttcttcttgggcgagtcattccatgtatctgtttacctctccctcttacccattactagaggatgtgctcttgctgcaatcatggagcttaacttcaatatgatcggtaattaacaacatccatttattgtgggctactggttcgcaaaacgttgtctcccaaatcaaaccaaacgttgactgataatttttataatgagctattgatgttagttcaaaacaaaaaaattaagtttttcaaacaacttgatttgaaaccttgtaaggtatttgattctaaatgttagaattcaggtgggtaatggcacaaagtgtgttctaccatttgtataatcaagtctcatacatgtccctcgaccagatttcaccactaacatttagcgttggaaacaaaatgaagtggatctcggtcatcgtttcctcaatcatcatctttcaaaaacatgttaaacctgtcaatgccctaagtgttgccattgcaattcttgggactttaaccttttcttaggtaaaaaatttgagtgaagaaaaaaatagactcttttcattgtctacacaaggcttctttctcattatcagtctgctttgagatgagaacatgagaattaaacaaacacacaatgccctttcgtttatatgttagattcagactacaatcttgttatttctcttagaatgtatgaacctttagtgataactctaggaatgggccaatgttgtatcacatgttggaatcaatcttgaacttaaagctcattgattcctgcgagtgttttggctaatgatgttcttttgttctttagttaataaaattttatatttttttgtatatgatgtaattcaaatttttttaaacgaacatatattattcaatcaatgaagaaataatatatgtactcacatcgcttaaaaaaattagacaatggttcatagccatactataaatattccaaaatgattctgaatacgaatgaacaagaaacttaagttttccaacgtccaaaactaaaagtgttccgtttactccggttctttatttcatagaatgaaaactttaaaaagtttcaatatattataaatatgtaacctttattaaagtgaaatcttataacagtttcaattaaaaaaatttatgaaattttaaatattataaatatctgaaatttctaatagttaaatttatgggtctagaagaacaggaaaaacatttatttggaaaacgctagctgctgcagtaagatctagaggacatatctgtcttaaagttgcctccaatggcattgcttttttgttgttagaagggggtagaacaacacattctaggttttcaatacctttgaatcgagatgaattttcagtttgtaagatcaaaccaaaatcagatttagctgatctgattaaagaagcatctctcattatatatgatgaacctccaatgatgagcaagttttgtttgaagcattagataaaagcttttcgaatattctcaagcgcgtagacaataaggtattgggtggaaaagtcattgttttcggaggcgatttcagacaagtgctaccagtaattaatggtgcagggagagcagaaattgttatgtcatctctaaatgcttcatgatcttttggatcactgcaaagtgttgaaattgactaagaatatgcgacttttaaacaacaaattaagtgttgatgaagctaaagaaatccaagaatttttcgattggttattggatgttggtgatggaagggtcaatgagcctaatgatggtgagacgctaatagatatacctgaagaattgttgattcaagaagcagatatccaataaaagctattagtagaaaaatttatggaagggtcaatgaaatccaactaaactccacaaaatcattgatccaaaattctttcagaggagagatattctaactccaaaaaacgatgatgttaacacaataaatcagtatatgctagagcactggatagtaagtttagatttgctctatattatttaatcttttaatttatgttctccattcttctgactttttgtgaagagttgattgttattttatttgttacaagtcaagaaagaatctatctttcggctaatagtatagatccttcaaattcagattcattaaacaatcctgttagttcagatttcttaaacagtattaaggtatcaagtatgccataccagtctttgcgtttgaagattacaaactgtcattatttaaaattaaataaaatagtataaccaaatttttaaggtgtaattacttaattttctacctttagattgtacacactaaaacaatcatatttaactcactaagccatactaagtattatatctaaacatacaaaaaatttaaattaacaaataagtattaaagtgtgaattatattttaagaaatcaattagtcccgatactaaaataaaatatagatccgcagtatatcgtgtgttaaaatttagtactaattaaattccataactaaaattaaaacttaaagctaatattagtacaaaaaaaattgatttttcaatgtccttggtataattccaccggttcttgggatcaatccagatcggtacagtcataaaccgaaccggctccatgttctcttcgtcgtcgttcaatcaaacagatccacaatg

SEQ ID NO: 27963 - DNA, 3003 bp, Unknown
  misc_feature (1)..( 3003): 2750-1469P.txt file - cDNA_ID_2993134; gDNA_ID_1620823; Annot_ID_169567
gtgttttattggtcggagtcggcgcgtaaaacgctgttagaaattggacaaaatttggccattatgggccgagttacggtttagagactctcttccggcccaaccggttcgtgggaaaaattcatcatattatacatgggatcagcaaaacgacgtcattttggcggcggttttctcagcgtttcctaataacagtaatattattatacatgggatcagcaaaacgacgtcatttttgagtaatgtgttggatgccactttgtttcttcttggtccaaaagtttgtaaacaatctcaacaatctgtatcggtgttttagagaagtacaaacttacatgtcaaaaggaatctagtgctcacagctgtgattacttctttcattgttgctgttttgcagtgaggagtaatcactggatatcgagataggcagctaaatagtcaggatattgtgaggtttcctgcagaacaactttcaattttttacggatctgaggatgcatttttgaagcatatagaaccgagaacatagataaagaggttgatcattttatatttaaggttttaagcaccactgagaacaacatgctatggctgaggataagtctgctgaagtcaaataaaagaaaccacaaagcagagaaaagaagaagaactcaaaagattaaagaggttgagaatagttttggaaagttagactactcgagctaggaggcgttttaaattttcatcctatcttgatcgatcaataagattaaaagatgagttcatatatttcaagtagattacagcattaaaagcacacatgtctaggtacctattctacaaaaaaaacgaaagtagaggatctaaataaggacaaaaaaagaactggaattttaaggttttcttgatgttgtgatctgctgttgtttcctacttgctttaacatctaccggtggattacacctgatacaaaaagaaacactttttgatgtcaattacacctaaaactcatctttggggatacataaaaaaaaagaaaaactagattgtgtctcgtatcttctttacttgttctgtatagggtttgagccactccttgggattcttctgaagctatcattttctcccttaagtggctctttcttcatctccttgcttacaggcaaatctctcacagcttgactcgaatgtgtcatcgttaacagagaacgtccttctacactatacttgctgctaaagaaagctacaagtaacagaaccagagccactgaacagcatctcttcattctgagttctcttcttgaaatttcctttaggactcttgaaacctcttgactttttcttgttctgtttttctgtgaactgagaaaatcttggatggagatgtgtgttagagaaaagagagacgagagacttctaaagcttgttggttttatagaataagatttatgtgtgtttgaacacatagttattgggatctgatcacgtgatcttactttgactaatgctatttaatcagatggtgagatacttatcttattcttaatcatttacttacgatgatgatgatattcctcaagcatctacattgaaacaatgatacaatatcatatgtagagacaaagatccacatattcacattacctaactcatgtaactgctttgaaactaagagatggtggtcatgtgattagagcacgtgatttctgcctactgttatcggggaactcaaaagaggctgaaacttaactttattgaaattattttttaagcataactttggaatttggaggtattagtgtaagtccaatttcagaaaagaaaaaattgcaggtaacagctgttttgtctcactactaatcactagttttttttcttcttctgcagctattttttttatatttcatgaagagaaggaaaaattgattccaagaaccggcacagattctttgatgagtggtggagaataaagaaatagggaaaagtgcattacgcaaaataattattaaatcattgatcctctaataacgaaccggaatggattatacaataccggtctaacttgtgttgaattttgttcggtttagataaaccaagcgcgagttaggctaattctttctctctctacccgcggagaaggagaaagtgagattaacgagaaaccccaagagagaaaatcttcatcgacaaaattcgattcaggtgatcaatttctttcatattttcgcaattatttcttggatctgatgttatctactttggaatttcttcgctgcattatcttttgatttgttgttcttgttcctttgcgtttctgggtaagagcgaagcttgaaattgcaattggaatctctaacaagtttaagactttgctttgatacggtttatgtggaagtatctgtgattttcttatatatttatggaagatattgcagctgattcgagtttggtttgcctatcattgttgcaattttctcggttcaatcaaaggattttctaggttgatatataattccagggatttccagataatttcctttaatttggttggaattcgattgaattttcgttgctttcaattggtttgcagtgatttgggtgaaaagatttttccaagctcatggaaattggggatttttattcaaagggtgtttctggtgatcatagagttgtttgactcaagtttcatttgatcttgtgtgtatttggttggtttttcttttcaatcaggtcatgaaagtattgcataatagctagaagtattgttatctctgtatatgtgttgtgagatagtacaattggtaaagtttccatatcaatggcacgaaaatcaactgcaatttactcgtttcgatatatgtttttatgtagttcatatatgtaattcagacataagggttttatgtagtccatctcatcagtaggtggactttcactcatatttgtatttcgttttgttgataatgttaaatgggtgtaacagctgctgcagctattcacttcgtccatagcacgtagatg

SEQ ID NO: 27964 - DNA, 3003 bp, Unknown; identical to SEQ ID NO: 21142
  misc_feature (1)..( 3003): 2750-1469P.txt file - cDNA_ID_2993150; gDNA_ID_1621111; Annot_ID_171804

SEQ ID NO: 27965 - DNA, 3003 bp, Unknown
  misc_feature (1)..( 3003): 2750-1469P.txt file - cDNA_ID_2993154; gDNA_ID_2684096; Annot_ID_190106
atcaccactgcttccttgtgatacccactccgattaaacccactaagaataccattccaagacacaatattcgcctcaatacctgaactttccatctcagagaggatacgaaccacctcttctaagcaaccctttcgcgcataggcacaaagcaaagcactgcaagtgacaacatctttgtcagacattctatcgaacactttgcgtgcatcacccatcctaccacacctcatgtacatatgaaacatagacccctgaacaaacgcatccatatccaacccggaaacacacgacacacaatgtatctgtttacccactttaaaagccgataattcagcacaaaccttgaacaaattcggaagaacatgactatctggaatcaacccatgagagaacatccgagaaaacacaccaatcgattgcgtaaaaagcttagcctttgttaaagcgtatataagagaagagaaagagtaaatagtaggatccggaatcgattgcaagacgagatcagcatcgttgaaacaattatagttcgagtatgaagcaatgagtttagcggagatatagccatcgttttgagctccggatttgagtatacgagcatgagcttgtgttgtcttcgacaacgaagaagaccaatgatatgatgaagattctaagaatccaacgatcgattgaggaattttctctatcagtggaagaacttgttttgtcattgcttaactaaaaaataaaattttcccgcttaaccttaatcattcacttattaatcttcctacgtgaccagattattccacgtcaccacaatcagaaatcaacggctgaagatgaaggactgggtctcactcagcttctgagcaatcttagtcgttgattatgtcttcgagaaatcttggacgttgattctaccttctccgagttttataatctgttttcttaagaaaatttgattgatacagagagagcgatgatgattcgaacggcgttagtgttcgttgtcttcttcgtcggaacagtcgtacaagcgcagctgatacctccggcgaggcgtgatggatttttgtatccaccgggtcggaaaatcgaccgggatacgatacttatcgaggcgtatattgacccggtttgtccggattgtagagacgcttgggagccgctaaagctagcgattgatcactatggatctcgcgttgctcttgttcttcacctcattcctttaccgttagtgtttgatttctcttcccttcaatttcagttttcaatttctttagctagattgagaaattagttgttcgatgtttcaagtaattgtctaaatctatgcatgccatgaatatttgtagtgatttcaattgataagtagtttgagaaagtagcagattttgtttatgttgccatatctgttgtatgcaaattgttttattattgtgtgatgatgagcttagcttttggatcttgcagcttccatgacaatgcatttgtagcatctcgggctttacacatcgttgataccttaaacgccaatgccacgttcaatttgctggaagggatcttcaagcatcaggtttgattagtgtactaaaaaactaaactttgctgagattaaacagagaaaatgtatatccggcggttctatttcttgaaatgaatgtttatccatgcactccatttgatcagtacatatggtttggttgaaaatttgctgcaacagacattgttctacaactcgcaaacacaactcatgtcaagacctgcagttgtggaagaattaatcaagcttggaacagttacgttaggaaactcatatcattctcctttgaaatctggcttcagcaactcaaaatctgatcttgccactagagtttccttcaaggtgatcccttcagcttttccacttctcagtttcacttacttgaacattttcactagtataggtatttagattgcttattcaatttgttcctctgtattcgagttcatatcttcaactagataaccaaatggagtgatatggatctttcactgcattgtcactagtcattatctttgcgcagtaggagaatttcgggttctgtcacttgatttctagtagcttaccttaccttctatcattgctttgcttttgttctctttgcagtatagcgtctcaagaggagtctccgcgacaccaaccttctacgtgaatggattcgagctgcctggtgctggttctcccaaagattatgaaggatggagagacaccattgatcctctggttaaaccacaagaagtagacatacgagacaccttcctttcattcctcacgcaaccatcttactagtttgtactttctatgatgtgccaaactcccacctacttagttgaaaagtccagaagcataactctcatacatgttcatattgttacatcttcaactgtcttcatttgcagcttaatgtataataaaccaaaaattcttcaaatgcttctcatgttttgtataaacgataaaaattaaagtattaaaagttttatactgatgacaaaaaaaaaaagaaaaagagaaagagaaaagataccaatggttattgctggtctaatcctcgatttgatatttaaccggtttaaagtaaaaacttaaaaaccggaaatcgattagggcagttcactggtgcatgggtttgtggaagagaagttgtgcggctgttatatatatcagagaagcgccttcaacaaccgcctcttagggcgtataaaatcagaaacagaaacgagacaagaattaattctctcgtccaaatttcttctgggcagaaaccaacatttatccttatccgattcttctagggtttcggaagatctaaccagaaccttcgcaacaaggtaagcattcaagcaatttactgaggatttaagaaaaccctgtttcttctaaatcgtggattgaacgagaaaccttagtttccatcgctggttacatttttttgagaaggactcttctgattttgtgttgcttttcagatg

SEQ ID NO: 27966 - DNA, 3003 bp, Unknown
  misc_feature (1)..( 3003): 2750-1469P.txt file - cDNA_ID_2993213; gDNA_ID_1972177; Annot_ID_180043
actaccggattggtgcaatcttcaaacgcgttatatccattactagaaggtaagggaggtgttaatcaaggtgattctcaacagaagagtagtgattattccaatcagctaatgtttaagcccttgatggatttttcttcaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaagtactcagcactagctattcttgatgattcttttgttggttggggtgtacattggtgcttgtcatgcgagttattgctgaggaagatcaaaccatgcagctatatccaaaggctaattttgaggctcaaaggaaaggtatggttataaaactatctttttgatcttttaaaagatcttcaaagtgtgagtatgtttattggttggcttctggtgatatttatgttttattagaatttggtcttatatattggctatatatagaggtgtgggtgatatgtatgaattcaagagttgatgttggaaacttttttgtgtgttcattgaataatcatcgaattctcaatttcttggagacccattatgagacattgagacatctatagaacatatatgtaatgtatattaaacgtacttaagtcgaattttatgaccaaagtaaataaattatgccgaatgtacatgctaatatcgagtttaaactattttttccaatataacaactattttctctttcgtccaacttatatactcttattctgattcttattttcttctttttaattcctttttcctttcccaagacacaaaaaaaaaaaaatacagaaacgaaaaaaagagattttaaaaattcataacccacgagaattatgcacctaaattcagactaatcccccaaatttcagaaatttatgtatttttgcgatttaatattgtgttcacaatcataatggccaactaactaattgaaaagacaatggaatgactgaaaccatgcataatctctcaagtctcaacctatgaagaatcatgtaaccaatagactatcatcatgattagttaatgcatgatctataatgtattctttgaacatagatatgtcatttatctggatataaagatggcgttttaacctactttgcaatttttgttatatctttcttctaatacatatgatcaatacacttttgtttttaaaagaaattaaaaacttatttcaaacatcgatcacaacatgacatagggtgaatctacacctaaattgactacagtagttagatatatatacttcaaattttaaatatagtgatgtacgtatgtaattggtacttcatattattattatgatgtatgtaattggtacctatattttggaacagaacaaaaaaagaagacactaaacgagctaaagaacaatggaaatttcagttataaggaattgtgggataagggacaaattaaactaacgtaagactagcgcgcaggtctatatatgtgtcaaaagcacggacttatataggtacatacatgagatacaccccccatacacacttatacaacacattcatgaagagagtcatatttcattttcttttaacgtattttttgggccaatccattttgttttcgctattattcggattctatatttctagctccctattaatatgaaattcattaatcaataaaaacgttatttgtaaagatagaaacgttttcgaggaatttctcccgcgacatcaagtttacatattgcggtatcaatacacattttctgaaaatagagaaatgaatttttatcaaaagctgaaagaaacagaagttttttattgctaattacaaactgatttataagcgttaaaagtgaaccgaatttgagtgtgagtggtagcctaatgagtggtgatctccaagggattgtggaatctggacctttaggatctgcttttgcaaaaaccaatgccctcaaaagaaagcgtttatttcccaaaatcatatcactctcttccccattagcattagagttaagagaagcatatgtttaagtctcgtcctcaatacatatcaacgcaactttaggcccaaaggtcatctttcaattagtgcaacttctttttttccttgctctattctgtttttgaatgtacgtttttcatattacggtctatccgaaatagtcgctcacgttcttccacatgccctcaaaccatgacctcactatcttctttttcacatgataattttatgagatattacctttctctaatgaataaactttattctaattcacttttgattcttttccttaaaccaagtgcgatcggtttctgaattattttattggaaatttggcaaagatagagctttgttttgggcttgtttccatatgatctctagtgttcttgggctccttccaagattaggcaagtccagtctcctgctcatgtagtagttggatatatctcttctctgggatacatacctaatcggttttgatcttttgttggagattgttcgggtccggtcttcggcttcttcttttgtatgtaaccaaaccgaaattgaaattgtacatctctctctctctaactggtatattggatattttcctctaattcattatttccattgacaagatttttcccttaatatgaacaaacatattccattttagctttaaatcacaaaaaaaagagataaatttctcaaaagaaattataagtagacaccgccctttttataaacaaccctaaaagtagtaaaaataatatcgagacgagacgggtttgtttcttctctctatctctatatctaccaaaatcctttgccccccgaatctagttctctcgatcgaccctgtgacgatg

SEQ ID NO: 27967 - DNA, 3000 bp, Unknown; identical to SEQ ID NO: 3647
  misc_feature (1)..( 3000): 2750-1469P.txt file - cDNA_ID_2993217; gDNA_ID_1620654; Annot_ID_47805

SEQ ID NO: 27968 - DNA, 3003 bp, Unknown
  misc_feature (1)..( 3003): 2750-1469P.txt file - cDNA_ID_2993224; gDNA_ID_1620714; Annot_ID_165568
atggattaggattagcttatattattgtaagaaaatattattactttttctaaagtacattttttgtatttcatgagaaaattataaattcaattccttcttcactaagagatggaaaaatggcttgtaggtcaacaaatttttgttatttctttaatgtcttgtctctttctaaccaaaagcatacaagaggtggtctcatgatttcaaatttaaattttcattattggatacactttgacaaaagccccacttcttttctgtaaaaagttgaaatgaagattcattattggtgtatcataatattattcagaacatccacaagcgaaacgtgtcttcatattttgatcggaactttcgtattaatgccgcagtagtaagaaacaaaaataaaatttgatcacttagacaaaaatgagttcgctacatacgctttagttatagtcatcactcatcatgtatatctaaaataacaatttaaaaaaatgtaagaatttgactcaaaaaaataaaaagggaacaaagtccgacctgccggaatcgaaccagcgacctaaagattacagcaactactacagtcttccgctctaccaactgagctaaggtcggataattattagtatactcacactatagaaatatagcgcttatactttaatatgggcccctaatgggcttgattagaaggcaaattatatgcgtcagcacaatttgaaaagaaccaaattagtcaagtgatgatggagttcgaccctaattaggactcccataaacaaaaatccagctagcggactacatacatcgttaaaagactattggcttgatagttgatactgaacaacaatatgaatttttaatttatttattttttgattaaaacttatatattaatatttaaagacccatccctaatatgctattttatgatgctgctaacttatttaaactaaccaatttagactaatggatgaacaccaagaatttggacttggaccacaaaacaatgcatagtatatttggattcttgattaatcaataaatttgaagttacatgcatgatgattatttatttttcgtcacatgcatgatgattaattaagatggcaaactccacgtgattaattaagaacttggtgcgtcataaatttttttaaaaaatatcaggggtgattcgactaacaaaatacgacgaaccagacatgttttgtttttttttacatttggaatttcgaagttaacttttaagaacccacttgataaatcatatgtacaaattaatgagaaattgtagaatgccaataaaaattgtgatatccaagaaaactaagcaaaatatatttattttctaagcaaaacatgtacactttttgagcaaaatatgttgaaacagcagccaagcgtaggactttgatttcagctgatggagaaggaaattcaaagtcatatccaatttattatgattatcacataattttagctgtaggattttcagataaaattttaccgaaattctcggcatataaattttttagaaatctacaatctgttgtaaagattttataaatacttatctgaccaagtcactagctcgtcaaggagatttcctcttcatattcattttcaaagacaagtgttttgttttctcatcgccacctaagatgtagataaaacaacatattttatttattttttctaaaaccgcgtacaacatgacatgcctagggagttctaacaatgggaaatgagcattcatgggggatggttgaagacattcctcctcattctcctacatgtgatgagatgtgcatcaatggtattttgtattatggagcttttattgacacaaattctaactgaacctgcaatcatgagttttgatgttaggtctgaaaagtttcttcttatcaagggactcgtcaatgccggtgttaactttcttacttcttaagagctaagaagatcttatgaggggcagctagctgtacttttttttgaaaattgagttatttgtatgtttgccttgtgggttttagaagatgttgtgaatgaggaatggtcatacatgagttttgatttctctagtttagctgggttgacaagagacttggaacttcaactgtttagtgcagccaacgcatgaaaagttgtttacgcaccattttgtgtgtatgcattgacatatcatgttgtttattatgatccaaaaaatgaatttacttttgaaaatttgagagagaaagaattatagaaaaacttgttcctaaaaactctcaacctagattgaataagtattattttccacttttagcaaaacacacttacaaattgaaacatcttaggtggataagaaaccaaacaaatagtcacaaaaatatcaaacaaattttttaagaataaaaagactacttttatgtaaatagacgttagactcaattaaaataaagggaagacacaaatttatatggatttcaactttcaataacgttaaatgtgatatgatatgctcatggcaactaggatcagaattccagttgtggcaaccacacaaatttctgagcttcgcagaatccgaatcggtgtttcacctcgtaacttagtcttgaacgcctagaagcaaaccaaatcaatttaagttgtaatattatatttattttgtgtagattgctttaatctgtgtatcttgtaatctttatatttctgtcaaaaaaaaaaaaatagtactatttaaccttttactaaaaaatgaaaatgtgatatgggaaatttcaattgtaatattactattgtagagaaagaagtcagaaattcaaaagaaaaaccaacgtaatgcccaacttaataaacatgggctttgtttttgaaagaggcccgtatagatattgacctcaaacttagggaaaccctaatataagagcaaaccctagcagcgctatctccctcagcctcatctttcacccactactattcgccgttcgcttttccctcgccgtcgaaatcaacatg

SEQ ID NO: 27969 - DNA, 3003 bp, Unknown
  misc_feature (1)..( 3003): 2750-1469P.txt file - cDNA_ID_2993228; gDNA_ID_1971974; Annot_ID_58718
tgttgaggaggaagacagtgttgctgctcatctctgatctcaacatactacaagatgagctatcgattttcgagcaaatctacacagagtcaaggaggaacttggttggggtcgatggtaagagtcatatgccttacgaggttgtgtgggttccagtagtggatcctattgaagattttgaaagatctccgattttacagaagaaatttgaggatctccgtgaccctatgccatggtatctaacacatttatttcaaaacacacattctagtagttgtaaagaaagatggagaaatataattggaagttatttttttttgtgggggtcaggtattcagtggatagcccgaagctgatagagagacatgtggtggagtttatgagagggagatggcattttatgaacaagccgatacttgtggtgattgatccacaaggcaacgaggctagcctcaatgcgcttcatatgatctggatttggggcactgaagctttccctttcactagatctcgtgaggaagagctctggaggagagagaccttttcccttaacctcatcgtcgacggcatcgactctgtcattttcaactgggtatttcaaaagtctcatccttttttctttttatgattggcctggaaactctagaaacagagcaggcagggtttgacctaaattacattcattcaagaacgaggcgtgattaatgaacaatgatgggtctgatttgcagataaaaccggataattacattttcctgtacggaggagatgacttggactggataaggagattcacaatggcggccaaagcaacggccaaagattccaacgtgaaccttgagatggcttacgtcggaaaacgaaaccatagccacagggaacagatcaggcgtatcagtgaagtaatcaggtctgaaaacctgagccatagctgggccgaacctgccttgatgtggttcttctggactaggctcgagagcatgttgtactccaagattcaactcggtaaagccgatgatcacgacgatgtaagagttgactagctagggttttcaattatttcggttcggttcggttcaattggttaatgaatgattttgtgtgtttgaaaacgttgattaggtgatgcaaggaatcaaaaagatactaagctacgacaagcttggaggatgggcactactgagcaaaggacctgagatagtgatgatcgctcacggtgccatagagaggactatgagtgtttacgaccggacctggaaaacccacgtcccgaccaaaggctacaccaaagcaatgtccgaccaccaccacgatgaggtcctccgtgaaaccggaaaaccttgcggccactttgatttccacatcactgctcggagcggtcggattccggagaagatgaattgcttcgagtgtcagcgtccgatggagaagtacatgagcttctcttgttgtcacgatgaaaagctccacgaagacgagaactacaacttctaaatgatgcaataagctcacgtctcttcccgctgctttttctttttgttttacgtaatttgaattctctatatagtttttcataaataatttctgaatttcaatatctttgtatgagagagaattggtcattccatgtgtgtggtttggcctttgtgggacatgttcgattgaagtattcctaataattttcaataattaacaatttcttctcttaatagcatagataaatgttgaatttattttgttaataaaattaaccctgatgaatacaacaattttgaatatgtcaaattagaccaattcaaaatataactatttgctttctttcttctcataatgtttatatatcccactttagtaaatggacccccacgaagcacaccacagcatactcttttttattctttccagtttctaatggtttacttatatactcttatcattttctaattgatcaatttgtcatttattggcttatcttcttataaatgttttttgtgttagttgttgatatctcattttcttgtccagtgaattatagcatttcaatgtgtccctcatgtcgtcaatataatgttttattttccttgttatgatccatatcttcatgtgtggtccatcttcaaataaagaatggattgttactactcttatcgtttgggctagtttttataattagacacaaaatttgtaactttcattctttttttagtatttaacacaaagtaatttgatggattagtctaaataataaaggcaaaaagttaagtaaatgtcaaaagagatatggcatatgtctaatcataaccaatgaattgcatggttctatctaaatagcaaccatatcatcccacatgccattgtccaccttgtctatcttaggaaaacactttgtttgtaactctattgtactctttgaattatgaaatctatgtaaacccttcttattgtgggggacaaaggctaattttaatggtctgtccacttctgcttgactttgatacataaattaggggtggctcatgtcatatctatgagaattaggtacaaaagagttttcaaatgagcaagttgtatttttattcgattagccgtcgtattatgtcaaatataagttaaaaatatgtaaaagtacaaaatgtagattatgatattagggatgaattgagataaaattacctataatttattactacgcataataaataatttgttacgttaattctcatagatacgttatagccaataccgaacccctatttaagtcaaaagtacttctaagtattttttagcgtaaatcaatttttatgaaaagcaacaattaagattaatgtagtaatctagtaatcgttaaaaaagccactttgttagtattgcttaatactctctctctctctctgttcccaaggagatgaaaagcttcaatctcaaaacatagcagctctctcaataaaccaaacccaaatgcaagctgtgtagagagaaacggagtgaggaaggaaggagatg

SEQ ID NO: 27970 - DNA, 3003 bp, Unknown
  misc_feature (1)..( 3003): 2750-1469P.txt file - cDNA_ID_2993234; gDNA_ID_1621124; Annot_ID_56328
cggctgaaacttatgtctttttttggcgaagtagaactgtaacacaaacaaccaaaggttcgaaactgctcataaacaggaactgtaccagtgagaatctcatatggagtcttgtttgataagagctgggaaggtgtcctgttgataagaaacacagccgttaacacacaatcaccccaaagagagagtggtacctgagattggaacatgagagcccgagaaacattgagtatgtgttgatgtttacgctcaaccactaaattctgctccggtgtttcaggacaggaatgaaacgaaacaatccctttctgctgatataaacttgtgaatttcaattctggtgcattatctgatctcactgcctttactctcactttatactgattctcaacttgttcaatgaaagcaggaaacacagtaagaacttctgacttgtttctaagcaaataaatccatgtagctctggaatgatcatccacaattgtcaaaaaatatttatagccatccactgtctcaactgaaaaaggaccccaaatgtcaatgtgtaacaaatcaaagatttcattacaaactttattctgagaagggaagggtaactttctctgtttagctaaatgacaaacatgacaataatctgagcctttattcttaggcttagtagtccccaaagagtctgaaataacatccaatctctgtagagaagcatgaccaagtcttcgatgccacatactgatatcaaccactgcattcactgagacaataggatcttcaatatccagcacatatagattcgcaattctcctaccttgaccaagcatccgagccttgataggatcctgaatttcacaagaagtcttatcaaatattactcgtgaaccaatgtcatcagtcagagaacttatactgattagattcaggcgaaactcaggaatgaataagatattcttgagaagaatgtcatcattaagtcgcaatgtaccaacaccactgattcttacagtaggaccagctggtaaattcactgcactcacaacagaagtatccaaattcaagaaaagactcttatcatgagatacatgatgtattgctcctgaatctatcacctgagacttgtcaccacctttgcctttaggagtaaaaccaagagggaatccatgctttttatagcatctttctgcaatatgtccaaccctattacagaaagaacaaatcggtctgcccttgtttggaccactctgaacatagcatattcacatcattgttagtagccatcattgcctcagagacctgaaaagcagccggtggagcaaccacattggaaaaaccttgttgactgttgtcttgatccagaatgtgatacacctctgctaaacttgggagtgctttcttagcaatgatctgtctgcgaatgatagcataagaatcattcaaaccagctaacaatttcactatcttagcttgctctgccttctgttgcaaacgcatagccttaccacaaatacagggatcatctagttcctctgtactttctaattgatcccacaatgtcttgaggcgagtatagtactcagacaaagacaatgtaccttggcgaaaatcctggatctcttgagtaagattatatgtgcgtgggagattagtcacattgaaacgactgtgaagatcacgccatatatcagaagcatcattcatacggagaatgctcctatagatctgaggagatacagaattcaataaccaagacttcaccatgcttttgcatctagaccaaagacgaaaattcttatccgattccaacggacgagggagagttccatcaataaatccagatttattcttagcatctaaggagataagcatagcaacattccaatcaccatagtttgtttcatcaagacgatgagatatgatattcaaacctggatgatctgcactatgcaagaagaagggagactgagtcggatcaacggattccggtggtgcgatgactcgcgaagctccagaaacgttggatttgtgaactggaggagagatcggaggagattcatcaacaccggtggatcgcgatgattttcgagctgcagaacttgtaccggacttcgatcgagtggatttccgagtaactctagctgtcaccattgtatctggagcgagaacaacgaagaagacgaacttgagctgagaatgaagaaatcagatcgaaaacaatggagttttgagcttggaaggctttgataccatattagcggaatagagatgagagaaaagtttgttgaagatattatgaaggcttttctcattaattgtaaaatgattctgtacaaatgtcttatatactttacactatacaatggttctactaaaccaacttatatcaactaaaccaatatacatatctgatatgaataaatcgatgacataacaacgatttttgtttttgggtaactctttcaaaacactgcataaacaaaaaaaaaactattatatgcattaagtagtccaaaaaaatacgtataaaacatatcattgtgaaacatgattagattttttaggtgttaagtagtgaataacataaactttgaataataaaatttgaattactcaaaaaaaattcaatagataaatcaaaatacattattcttgaaaaccataataatcaaaaaatgaaaatatatgtaatttcaatctcctttaataaatttcagatgacaataaaaaataagtcactaaattcagttcattttacaacaaagataactctcattttggtgcaacaatatgaaaactagctctcaagaaattgaacaaaaacttttacggcccaataacgacccaaatcaaaacccactaagagttttgttgattccatcagagtttcagactttcagagatcagaaacctcttcttcttcttcaatttcacagcttcacgtcgtcgtctttgagtcgccggagctgtagctactgatttggtaccagaaagagagtgcgacggtggacgatg

SEQ ID NO: 27971 - DNA, 3003 bp, Unknown; identical to SEQ ID NO: 27970
  misc_feature (1)..( 3003): 2750-1469P.txt file - cDNA_ID_2993234; gDNA_ID_1621124; Annot_ID_172174

SEQ ID NO: 27972 - DNA, 3003 bp, Unknown
  misc_feature (1)..( 3003): 2750-1469P.txt file - cDNA_ID_2993281; gDNA_ID_2926134; Annot_ID_138842
acatgtaattacctacaaagaattttgaaatgaaaattgttcttattgaataatgaagatgaattaagctaagtttgtagaattgatatgcgaattggaaactggagaaagagaacagatacattcgaatttttatccttttttaaaaacattacgttggataattttagtaagatttagattcttcgaggaggctattgacttagggaacacgtaaccgagaaggttaatatgggctaagcccaagtgagttctatttaatacgttcattaaatgatataaatactaaacaaattctctacaaaacaatcactttaattatctctctttttcttcatccgtttctattgataaagttatgaagtttctcgtcgagaatctgaatggttcatcattcgaacttgaggttgattacagggatacactgttagtggtcaaacaaaagatcgagaggtctcaacatattcctgtttccaaacaaacccttatcgtcgacggcattgttattcttcgagaggatcttactgtcgaacaatgccagatcgtccccacttctgatatccaactcgaagtctcatctgacgatgataaccctaatcacaacgactgcgatcaaaagccgcaaaccgagcaatctccagcactaccattggtttcagcggaagagtactttgagagacaagattggcctttgacagcagaagagctgagacagatttatagttatcggcctgagcatgaaggttgagagcaaccacaacgatgatcaaaccgagcaatatccaccgtcgtcgttgcgaagatgaggcttgacgagatctttggaaacttttcattattatctttggaaatttttcattattatcttcaatgtgtttactattttttttaagttagtttagataattatagattatttacattttacctaaggttttggtttctattttcttaataaatagctcattatttcccattatttcatgaagttatttgtttagttgagattttataaaaagggataataaactaataagcatactagattgtaactcgtgttggtagtagaattttaatttttaaatatttatttaaagttggatcattgtttgttttataatacagctttaatcaatccatacataatacaaaacaaagaaacttagaccatgcacatagttggtattcataaagtatcataacattttttactattaattttaatgtttatttattgtttgagaatttttataatactgataataaatctgttttcagtgatgagatccgtaatgatatcattgaaaaaaaatatttgcaaaatcgaaaatacctgctagcatcggccactacaacgataccggagacagtccgattgaagagaacagttaaaagagaagcgcctccgacgtagatataaaggagtgtgagagaatttgcgattaaggttccaagggatctgaatttggaagatgattctcgttttcattgaaaaagaatcgtatcaagatgcactgaagaggagagaagagaagagcaaatgattttttttttctctcctttcccacaaaaacgcgttgccgactaatcacaagccgccaaatcatcaaaaactagtatcagaagtatctctccagtgatacgacttaggcccaaatcagttgttttacccattaatttaatgttttttgggtttctgatactcataaaaatcctactatgtacatggtcttacccttattccattgtcggtgaaatccttcagggtttatgcttttccagtgctaaaatcgcatttcaacgaaaccgaatccctaatgaatgaaatcgcatttcaacaagtagaaaaaagtgataagactagggctttttattcaaaatctcggttttgtttaaattcgaaccaaatccgaccggtttacttaattaaaccaaattgttaaccatctctcagaagcaaacccctaatggcctaatccgatgatcgacctagttctcaatgtacttgaagattttatattgccttctactcacaatattatgcataaccctattataaagatgatcaatgtttatatacagctacaaactttttcattctcacttagtctcattgtattatcaatcaacgatatagctctataccatattgaactccgatgatcggggctataatcggagaagagagagatgtaacaaacgtttattatcaactcaaaatattgttacaaagcttaaactaaaattagttacattcacatcttatatactattcacattaatcttaaaccgaaatctagttaactggagttaaccaaattaaaccagtccatctatcccaataattcattcattcatacaattttatgtacaaggttaccaaaagaatcaaagagaaaacacttggcttaagtaagagtataacaataaacagacaattaaagaagaatcatatgcatatataatttcaccatgtgatattgaattatataaaaagaaattttcacagaagtggacgaaaaaagatttgctctcaccgtttgtcaaagtgagaactggttttcacgttttgtcttttcattcaatttcggaccaaattaccctgggaaaacttaataatggcacaaaccaaaccgtgcagcagttcgtatcggttaagttgacggcgtaaaccaaaccctacagcagttggtttcggtttagttgatgcggttcagttttgaaaaagacaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttggatagttgaattgagccactgaactcccacatccggggaagtgaaagttactgtttttctcggcgaagccaagagaaagttactgtttattccggcgaaatttgaacctccggcgagatagcatctttagctatg

SEQ ID NO: 27973 - DNA, 239 bp, Unknown; identical to SEQ ID NO: 14882
  misc_feature (1)..( 239): 2750-1469P.txt file - cDNA_ID_2993295; gDNA_ID_2684231; Annot_ID_137625

SEQ ID NO: 27974 - DNA, 3003 bp, Unknown
  misc_feature (1)..( 3003): 2750-1469P.txt file - cDNA_ID_2993303; gDNA_ID_1971785; Annot_ID_57986
atgtttttttctcttttggaagagaagggtaaaatagtaatatcgtgaagatgatgggtgaatattcggaggatcagattcgattataggttcgcatctctttgtatgggctggaactgacgtcactattccaatctctttagcttttttttttcagataagaacgaaaactcaaccatttttcttctcccctaattaagattccagagttttgttttccaacgattgttttatccttcatttaacttaactatcatctaatagaaatgattttctgtgtttctatatgggcaaatctattcattaaatggagattttatgatttagaatttcaaatttaaagatttggtttttattatgcgtcttttccaaaaatcataaaaattgacgttcacctaacaaatatgcgtttcattaaataaattaaaatactactactatctcataaggaaaaattatgtttaaaactttcaatgacaataaatcatatcattagtgatatcttaattccaactccaaacgttaatcattcacaatttatgtaacctaccactcgactacgtttttacagatatttagaacgaatattaaaatttgaattggaaatgagctaatttggtgaaggaatattctaggggaggaaaaaaaaaaaaaaaaatagaaagaagaatcttttggaaggaagtgtgagaatcacatttgcccacgccgcgtattaattatttacatatccgacctttcatattcctcaagagccaatttgctaaatgttcacgcgcatagagcgcgtacccacgtgaccaaatattcaattgatgcaaccagattctctgcttttgtcatattcatttatcttattggtttcgtcgttatctttttaagaaaaacaaacggttctttggtggttcgattccttgataggatgagttaatgcatatgaatatgataatagtatttttgtgttttttagatacagcaagattttggactaatttcattcacaataatcaccattaggatcatcaaaattttattttatgggtctacttatgtatgattgatgaaactatttgaaggtcgattgaaatgatcaactgttttcttgtagatggaaagttacaacatgcttattgctttaatcatcatcataataggcaaatatcagattcattccacatgttcttaatcaaatctgttttaagaaaaaacatctaaatctacacatagaactttgttgtctcaatctgatggagctaatacatgtttggtctttatgtgggaggtgtgggacatatagatttaaacgagattggctccatcaattcttacctttattattagcacatgataaaatttgtttccatgggaaaagaaaacaaacaatgtctaagttgtagtattatgaatgtttgaagatgcaagtaagatctccaagactccaacacatgtattggagttctcttcataatagctattgcatagccacaattaaacaacaaagttaagagtgtcaattagagctaaaaagagacggttaatcagttaatgcaataattgtcaattggcaatgcacaaaaataaaacatatgactctgagtccaagggaaactaccaagaacatggaagttaagagttttttcaatgggagtttctaaacaaaattcttgatatataataaaaatattatattgtttaaatattagtttggtttcttaaatttgaagaaacttagtccaattgtttcttaactaagagtcaattgaactaagtttcttcaaatgtaagaacctcatcattaaaatatattatttatctatatttacacttgattctattttaaaaactcactagattttaacccgcggtacaccgcagaaataatttattttttaaagttagtatacataaaagtttgcaaattgtatctatctataaaatatttttattttatagtttacaattgttattaaataacatcctgccaaacccgtcccgtcaacccgtcccgtaaaaaaactatttattttattaatgttgatcttatttatgatatgtttatgaattattgtctaaatattttgtaattttgtggtaattaaatgctatcaaatatctctgcggtttgatgattataattgaattgttatagtcatgccgaaaagcaaaaatatcaaaaatgataattttgtagtaattaaatgatattaaatattttggaagttttattttagtaattaattgtgtagttaaggtagaaagattttgggaagattattaaatgtcaaatatttaattagaagattttctttctaattatcaaaaacaattattaaatatcagtggcagcaaatgtaaataaatctcaactccaagatttatttcacaaagtggctggatttaagaaacttccgttgaaaatggtttaagaaaataggctccggtttctattccagttaccaacctaaccttagcctctctaaaacatcgtcactgaagctagattgtgcaggataccgagacaacgaacatttacaaattacaatagaaagaagtaaagaacatttacatttttatatatagaaatgacaaaaccaactaaaaataaaaaaaaaagtataaaccgtagatcatacatacacacattgaaccggttctaaccaagactaacaaattatagcttaacaagacttacggacggttcaagtgttaaacaaccctaaaacggtaggtccaccttcaacgtatcggtcccagaggccagagcaactaaaccagaaatagattatttatttataggttcgaattttggttcggtaaaccgggacaatcagacaaaaaggtttaagcctttaaggctaaaacgtagcgttttgaatcggaggcaacgtaaaattccgtaaaccaccaatttctgaatttttcaaccttattcttatgattaaaattgttcggtcctgattatctctgtgtttttgggaactgagaagcatccactcgacaatg

SEQ ID NO: 27975 - DNA, 3003 bp, Unknown; identical to SEQ ID NO: 27974
  misc_feature (1)..( 3003): 2750-1469P.txt file - cDNA_ID_2993303; gDNA_ID_1971785; Annot_ID_175443

SEQ ID NO: 27976 - DNA, 3000 bp, Unknown
  misc_feature (1)..( 3000): 2750-1469P.txt file - cDNA_ID_2993306; gDNA_ID_1971801; Annot_ID_58075
ggcgtgcgcttcaacagtcgaaataggcactcgtacgtttttattttatctatctccctactctcactcacatctggaccctccttgctcctcttttaccttctttaccggttttaccattgaatcaacgttttctccccttttaacattacaactttctttggaaattgatttgtttatggaaagacagagataaatgggtcataaccactattactataaatgctcgagtttacaatttcatatcttccagaaagatttgttgattttctggtaaagaaagattcgctgtatatttttacaagtatgcgtgcatgctgtgctggcacagaatatcgatttcgttagatcaataccacaacacatttatgatttttggtaaaaatccatcacacaaaagccttgatctagaagactagaacccacaaaattaatcatattaacatgaaatctatatatagtcaaccattattggatagaatctaagatatttgaactttggttctcaatttacatagtaaatctatccaaccactatgaagtggtcgttacaagtgagctttaatttgattattctttatatatttcaatttttaaaagatatattaaaaataacaaattcggatggagacgtacgatgagtggggtgaaggaaataaatgagagatagagatagaaaggaagaattatcaatataaatgctatcataaatacagcaaaccccattctctcttcttcttcgacaaacaccaagacaaacgtaagcacaagcacgagtgagtgagagatgtttgccgtggagaatgggttgcagggagacccgagattaaaggccatctccgacgccattcgtgtcattcctcacttccccaagactggtccatttttctcttctttgcctttagtttttcttttagcttacaaactaactaagcttagagtgtgtttgtgttgcagggatcatgtttcaggacataacaacgttgttgctggatccagttgcctttaaacatgtcgtcgacatcttcgttgatcgttacaagcacatgaacatctctctcgtcgccggttcctttcactttcctttctttaaactttctcatgattattagatgccttcttttatagtttaagtcgctatttaattagtctttgccaaatacgacacacacgaacaaaaccggctaattattgatttagcttgaaaggcaacacatttctttatttattcttgattaatttacgatatccttaagagaagcattcagcttggaaggcaacgcacatatagattattaaatttataatatacgacatatagaatccgaagcgtaattatatcagccaatatgaaaagattgaataaacaaatagacaacttttatggattaatgattttacactcacatactagtttgtctagtgtggttggtgactagttacttatccctttactctttattattgtcgttagtctgtctcttgttttttcttttgtcttttagtgaacctttttggaacataattagaaatgtctaagaaatactaaaaacatagattgatgtatgcaggagtagaggcgagaggattcatatttggacctcccatcgcgttagccataggtgccaagttcgttccactacgcaaaccgggaaaactacccggtacgattagtaatatacatacatatcacttctcagacaaaaacgtacattttgatggaatagaaaaagtgttattgaaggatactattgattgtgatgttaaaaaagggagagtgataagcgaagagtacgaacttgagtatggaagagattgtctagagatgagtgtagaagccgtcaaatcggaggaacgagctctcatcatcgacgatttagttgccactggtgggacactctctgcttccattaacctcttgggtaaataatatctttctactttcattagctagaaaatgaatgctacatgctaaacaagatgatttatatatttacgcttaagaagttgtatattatatctgagtataattattgaactaaaagtgagtctcttctatgcactttagagcgtgccggggccgaagttgtagagtgtgcatgcgttgttggtttgcctaagtttaaggtactatatgacctactttgttcgtttgcataagttgaaggtcttttaaattcgcgtcaataatattttgggctttaatgggcgctataggcccatacatttgaagataataaaataactcattgtctacgatatgtaggggcagtgtaagctgaagggaaagcctttgtacgttctggtggaaccaaaccagtttgatgaattaaccttataaaagccttttctattcaacgattatgacaaataatgtaatcggtttaatcgattttgtaactaaggatttgtttgttttctattggctccatgtggaatgattcatgctagttactatgaaattcggaatacgaaggtatgcagtattatgcaccactgttcttcagatgaatgaattcaagtcgattttctagtgatttacatggcagaatttataaataatatacatcatattgtttgttagataactttactaagggggcaaaaaaggaattatcagataaacaaaatatttgaaaaaagaaaaaaacgttggcagggagtttcacgcgcaacgcaacgcgcccatgtgattaacaaaagtacgagaaagcccctgccgcttaaagatctgtatataaaaagggtaaaataaggtctcctggcctggcctttaagataaagaaaaggaaacccaatcgaaaacctaaaacccgattagattttcttagatacgaaacctctcttacgacgctccttcctcaatctctctcgatcgtcggagattctttcttcaagagtcatcttcttcttcttctccttctccctaaaccctaatttatcgcgtttggatcgaatcagctgtcaattcttgttttggttttcacggccagggccatg

SEQ ID NO: 27977 - DNA, 3000 bp, Unknown; identical to SEQ ID NO: 27976
  misc_feature (1)..( 3000): 2750-1469P.txt file - cDNA_ID_2993306; gDNA_ID_1971801; Annot_ID_175693

SEQ ID NO: 27978 - DNA, 3003 bp, Unknown
  misc_feature (1)..( 3003): 2750-1469P.txt file - cDNA_ID_2993312; gDNA_ID_1621124; Annot_ID_56344
cgacgaagaccgaagcgtcacttaacgcctagctagaatcctacaaaaaagcaacacaaacataatttatttataactaattaacaataaaataaacactatagtgagccacttgaaccatgaacttcaacgaccaacagcaacacaaacttgtggacaagaataatttatttatatgtaatatgtggacgtgaattatttgttgaacctccaagactagtgataagaacattttactagtaattctgaccttaagaagttcatttcaccacaaacgacataaaatctaatataatttggttaaatgtaacatacagtatgtaactatgggttaggaatggtttacgcttaccaaaccaatttagtcaactgacagttctgtgaggtttattcccaataacttcactagaaccactcatttctcactagaaattcttttgttgcgggctataaaagggataatgctagagaaattaaagcacatatacaagaacaaaaataattctataaagaataaaacgtttagagtaagtaagcttgtagaagtaaacaaaaaaggttggtaatttccgccacctgaattcgagtagcattagccatcagagttcgagtaaaacgtttagagtaagtaagcttgtaaaagtaaatagaaagggaggtaattccgccatctaagttcgagtagcattggccatcagagttcgagtaatttaacatggtttctccagacttcaaaattagtctttagagcatggtcataggtgatactcataaagtatcattaagaactttttagtattatttataatgtttgtttaataaatatattttatttctttttagcaaatgcgacaaattaagagatgacatgtcagatgatactggtatcaaaaatatcactaagctgatactgatcaaacttattttaattatttatcaatataaaaataatttttggacttatgatattttagaaatattacccgtatatatggtattaggtatataaaatttttacgatcacctaaattataaaaagaaaaaacaaaacaaaacaaaaagtaaaccgaaaagggtcttgaacggtaaaaattatctctttccttgccttaaggtccaattccagattaaatccgagccaaaatccatcacaaaactggattaattaaggcatgtgctcgatttagcgtttctgaattaaactcttacgtgtatgatatttggatgtgtatataatgtctggggtgagtaaaggaaaccgaagttgaaaaaacaaacaaacttgacaaaagttaattagtttaatggttaaatcatgaaatgtcaccaccgaccacttgatctcccatgctgtagttgaagaagtttgcctcagaccactttagtagcatacaaaaaagaaaataaataagagggtgttattcagttatggatttttctagaattgaaatgcaacactaaaataaacttttaactcaaccgatccatatatgtagatgagttcaaaaccaacaaaaactaaaaaaaaaactatagataaattggtcgcatattaaaagattaaaaaaacatggtgaattaagtatttatctacaaattatactaaatacaacattttttatgttcaaaaaaaattggactgtcattttatctgttatatatatcggaaccacgatatgtaaaaatttaataaaatatcaatttatttttaaattatactttttcttaaaataaaataatcaatcatgaattattctattctcggagtctaaaaaagtaaaatttaaaacaatttaatttatgtagaataatgttttgtatgaaactaattttgttgtctataattaacaagatcgtttatgtttgcaaaaacaaaggaaattttttttttttttttttttaatatctcgaagttcaagccgaaaggcctacatctccgagatgcaggatccacaccagattttcaacaatggaggaatataaaatatcaaaacgacattcatattaagctatgtattatttaagtttataattaatgattttagttaaccaaatacagttgatttatataaaatttggattatcctattgaaaattatgcatgtccaaaacttcttatgagatttatatgtataagtttatataagggtttatataattattaattattttttacataaaagcctaaccagagacaaacattttttttcttctaaataatctatcaattattaatttctagaggttaaactaatgtatatacataatgtgggtgtgaatttttgttggttttgttacattcgtttatttctgttttctttatttttttcagttaagctagattgctaaggaataaaatttgaaattagtttagctcatttaaacaaaatatcggttagattcagacagttcaacctattttgaaaatctattcagttttttttttttataaaatgaaaaatccgaagctcatttctcagtattatagtagagaagtgattttttttgtttaaattagtttagcataagcacacacaaaattgttttacattacatcacatgtgatgatgatgtggataagtgtatcgatcatccgccaatatttactgattactgtaatataaacattaaaatttcttcaaaaatcaaagattctattgtacctttctatttcctctagagatttcctaatgaagaaaaaaccagcaaagtcattatcaaattcgaccgtccattcgaagacgtacacgtctttgtagtcaacaccatttacctaacttcctagaaaaccacgtaacattgcatgtgcctagtttctcttatataaccccaatcaatatatatatatatgaatattgaagataacatcgttaaattgcttttaggttctcattatatcatttctctttaacttcgcaaacttctcctcgataaaatttctctctctaaaaaaaaacaattagaatcttgccttttacagagtaacactacatgccgacaatg

SEQ ID NO: 27979 - DNA, 3003 bp, Unknown; identical to SEQ ID NO: 27978
  misc_feature (1)..( 3003): 2750-1469P.txt file - cDNA_ID_2993312; gDNA_ID_1621124; Annot_ID_172201

SEQ ID NO: 27980 - DNA, 3000 bp, Unknown
  misc_feature (1)..( 3000): 2750-1469P.txt file - cDNA_ID_2993324; gDNA_ID_1621170; Annot_ID_57236
tacaagttcagtaaaagagtgtgtctttctttgatgaattggacgattacgcgaaaatattaaatgagctaaacgatcaatcgtcgttaccattattccagtttacgacatatctttactgcatgtaaatgtttcagttgatttccttgaatcaaaccttggagacgacatcttcatcatgatccagtgccataaatgtatataagtgtgatatatttatgattacattttgaggtatgtatataaatagatatatagtggataattcgaagtatttgtatttgtcgctggttactatattagctgaggcaccgacactcccaaacgttacaaaaatatcgaatagttggaacttggatcctatcgacattgtacgtcgtcgttttgtgctacgaagagacgtggttttgtttttagtttagttatgtgttgtttttgtctttgttatataaaactaaatgacaaaatttgcacacaagaaagaaaccaaaagattttagatcctctcgatcggacgtacgctagaaggttcttccgtaattttcatataaatgatctttatcgtgtcattgcaacgttaaattcgattgagacgtgtcaaattaatttcttctaactatgcggtgtcattatattacgaattagcaaaaaaagatgaaaaatgcatgtgagatctacctaagatactgttctaaaatatatacggttttcttgcgcgattagagatcaacatacgattagagatcggcgattaaagatttgctggaaaatgactcatatatatttcccaatcctcgcagataaaataaaacggcactttaccgttttctttagaagttagtcgaagacaagtattctaaaaattcaacaaaaacaagaaacgaaaagtaaactacaaaatgttagaaaagactcacatgaaacactcactgtgcctctctaatcaaatggaaaaaagtggagagtttaaacttataagtatagtatagatgatagaaatcttctaaaaacgatacccgtgaactaagttgatcctgtgatcttcataatccatacaatttcaacagaaaaatacttttttgtgttttaaaaaatactgcgaaaagctatataaatagtaagataaattggtttaaatccaaaggtatgataaaattctttctcaaaaacgtcatatttggttagtagtactcttaatcgagtggttcatcaaaatgtatcggtttatatatatcagatcttgaataatttgcaaaaactcaaaatttcttacaactaatagcaatatatcatgtatcatatagctaggtaaaagtaaaatcatacgttttaaaaaaactgtggtagggaattatatatgaagccgtttataatagcatgcatgtgcttaacatagcaaaaaaccatatgattagtatcggggtacatgaaagaaaagggcagataaagctagattaggatttgataacgtacgagaaaaaatcgagaaaaaatgtcaacccttggtgggagatttaggcgaattttctaatctatcttcctcttatttttttcttggtggccaataaaactagagtttttagagggtaacgaatccaaaccccacactcacatgcatcgaatccaatctgtttctccaacccattcattaccaaaacagcagataaattttataattcatcaagtctaccaatattaattatcttctcataatcataaacttggttctctttatccaatattatcttctcataatcataaacttgattctcaaacattattactaaatctatttttcttttccccttctaatattctttactttaacaatacaaatacaactccttttaagacttttttttatagtaaagagttatacataacatgtttggtaacatagtaaaatagctaatataatagaccttttctaaaaattgtcaaaatacaataagtgtaattggtggataacatgtctactttaaaaaactttttagagtattaaaattgtcgtcccataaactatataaatgatcatcataaatgtattacaataacagcatatcaagacttgacggttatcagccaaaatcattaaattttggaattagatgttaataatatacaagtgtcatgtcgatctcttgtttacatatccaaacatctctatgtgtgacgtgagttactacttactagaatatggagtaagataatatgggcttcctaaaaggcctatacagaaacaaagcccaacaacctaaaacccagtgtgaacgtgaaggacttgaaatattccaaagttgagtgactgatgaaacctttcacgtgacagtgacttgattttattcgtatacgggcaaagttcttccattactgcaaaaactcttctattaatgaccaacttttcataaaagaaagtacacgtgtctgtcattagattggtaggtacatggagactacactaaagtcattcacatgggattctttgacccattaggagccaaataaaaatcttctctttttagtcttttttttccatcttaattaaaattacgagatcacgctttcttttttagtacgagggatcagcatcttaattagatcacgaattaaaatcacatattttatacaaattgcgacttaaccggaatacctttagaccggataaattcttaccaacaaccaatatctggaggttcaatatggtttggtacctaattttgtaccggaaattgcagaaatcatcgtattcgagtgttggatttgctatgatattacattcaaaattttggtacatattggttgatcatgaaaaccggaaaagtaaaaccaaaccggtagcttaccgtattttgctaagtgttgtcacttattaagattggtaatagagtacttattgtctgttcttcttcattcattacaacaaactctttgagacctaaagagagagagagcgatagtgagatttagatcaacagatttgaatcgatttctgaaaacatg

SEQ ID NO: 27981 - DNA, 3003 bp, Unknown
  misc_feature (1)..( 3003): 2750-1469P.txt file - cDNA_ID_2993328; gDNA_ID_2214627; Annot_ID_135996
cccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatgagaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatgtttctatcggcatctatg

SEQ ID NO: 27982 - DNA, 3003 bp, Unknown
  misc_feature (1)..( 3003): 2750-1469P.txt file - cDNA_ID_2993328; gDNA_ID_2214627; Annot_ID_187851
atgcaccgggaaactgttcccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatgagaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatg

SEQ ID NO: 27983 - DNA, 3003 bp, Unknown
  misc_feature (1)..( 3003): 2750-1469P.txt file - cDNA_ID_2993328; gDNA_ID_1620626; Annot_ID_162469
gatgcaccgggaaactgttcccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatggaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatg

SEQ ID NO: 27984 - DNA, 3000 bp, Unknown; identical to SEQ ID NO: 3106
  misc_feature (1)..( 3000): 2750-1469P.txt file - cDNA_ID_2993331; gDNA_ID_1620626; Annot_ID_47135

SEQ ID NO: 27985 - DNA, 1826 bp, Unknown; identical to SEQ ID NO: 13455
  misc_feature (1)..( 1826): 2750-1469P.txt file - cDNA_ID_2993331; gDNA_ID_2214627; Annot_ID_135997

SEQ ID NO: 27986 - DNA, 90 bp, Unknown; identical to SEQ ID NO: 6826
  misc_feature (1)..( 90): 2750-1469P.txt file - cDNA_ID_2993351; gDNA_ID_1621108; Annot_ID_56012

SEQ ID NO: 27987 - DNA, 3003 bp, Unknown
  misc_feature (1)..( 3003): 2750-1469P.txt file - cDNA_ID_2993353; gDNA_ID_1620619; Annot_ID_46973
tgaactcattcaaattgatgttattgtgaaagaatgtgactggaaaaacagactcgaaaatttgatctttaccactttcacagtcagaagtgacactccattgtcagccagttcatcttcatacaaaactacctgaaggagtagagaataagtacatcaaagggcccagaaaaatgtgtgtttgagtttgtatcgataaggtgaccaacctcatcatagaagagaataggttctttaagtgagagagcagccaaatcaatctgatcttcacagttctcccactgaagagtagcttccccctttggattagcttttgcctcaacctgcttcacattaaaaaagcatacagcaatgagcatgaaagtcacacttgattgattatcgtgtgacagacagaaaaagagtgaaaatgagagcaaggcgaaccgtttctttgtctttctcaactacttcacttccacagtatggcgttgtaaacgtgtaatcataatctagtatcacctgctgagacggcttgctgcaagtagatcagagtggtatcagatacaactatcaagcaaagcttccctattgaaaagaataatatcttttgtgatatatttttcagtcaaatcctgaaacttacctcctgaatttccattgtgctgcagcaggaacttcaacaggtggaagcccttcctgcttccaaccagctagtgcgtcaaacgcattaaaatgaatcttagtgttgctacctaagtgtttaaggactaatgcattctcgccaaaaaccatttcaggtaagtgagatgtcttaagctttttttcccacctgtgttacaatcaaacatcacattcgtgaatctcagaagatgctatttacatatttgagataaacagagagctataccaggaaatgtgatgagcagagatcggaacaactaaaatcagtaaccacaaaaactaaaccaaagcaaatacgattttgattttttcacagaatagatcatacactccaccaaaaactaggaaaaactcgaaatcaaggacacaattctgatttccttcgatacgttccactaatacggtgtacacgagctcaaaaacccaaactacactactcagttcatcaaattaacgacgagcacaaatacaaaaccgtaaacacaaatatcacctacaagtaatcacagacaccaacaaattcatcatatatgatcgtatcttatgaggtgagagagatagagattaagtactcttcgacagcgagagaagtgagaatcgtgccgcggagggtttcgatctcccagtcatggatgcgtaaacctcgacgtccgtcgggaagaagctcagccccggaagacttcagaacatctttatcgaccaccgtctccatctgaatcgccggctaatattggcactaccttttctcctccgacgatgtcacttgtgtgaccaaccggactatccaaccaagacatttgacttttgatgggccggcctagtttcattttagtttgaaaaaagaaggtcaatttgattttggtccttaatgggctttaagtttataacgtaggcctttttcataataatgtaatatagctagaatttcatgcttttggaacacactataaaaaaggtcaatattcaatgtttcttttttcattattagtagatttggctaaataaacctctagaggacctagaccaggtttgaaacctgacatggtggaacaccactagcccacttgttctctcaagctcaataatatccatataaatcatcaaaagatgaatcaatcacaaaaattcacaactaatttgcacgatacacctcatgaacaaaatattcgtcgtcattgccactattaacgattcaaagtggtaaaaaaatcaggaagcagtgaaaggtgaaacctcatgaatctctagactctaatgcataaacatatttcattatatatcgtagtagaatactgagacacattgacatatataagtatcaaacagaaattgtataatggtatctttattttattaacacatgtgtgcgtcaatgtgaatcagatagaattagacacactatctttttaatatttaaagttggagccgttttggtcaaaactaatttatgtgcactactcatttatttataggttttttaaaaacacaaaaattgtgaaaaagcttctaagccaggtggcgggttttggtgcaaagtctttgatatgttcggagttgctgcttcgtagagaaaaaacttttctgataacatcggagtaaaaggaaagtaagtcggagtttaatcatcttaagatttgattgaatggctacgctcactgaaatagcaacccttgaggagaagtgagttttttcttttcaccttctatttctatgtgtatatcttatctactcttttgaaattaagacagaaaagttagagatgtgttcgtaggattgggtttttgtctgaaagactgaaactttgtaaataccttttcttaaaattgatgagtttggaggaacggtttcagtaaattaggttgtgtttcgattctgttgtttttgtcggtgttcttcgtgagaatttgtctgaatttctgcatcttcctttgattgaggattgttttttgattctgttctatagcttttgctcttaaggaatcaaagaaggcaagtttttttgtcaagtcatggctttttttctgtttcggggtgcttattaatttgtttaattctgggttatttagttataatgtgtgctaagtgattcctctactagtattcaagttaatggatttgattcatctttggttttaggtatatcgaattgtgcaagatgcatggaatcctacccaacactgccattttatctgctttctttgaggtttgattactttttccttgtccagaagatctgtttagcttaatcttagtgttagtctgagtataaactacgattgaacctgatcaactgaattttaggcggaggttaaaaagtcaaggaatcaaagatgcattatg

SEQ ID NO: 27988 - DNA, 3003 bp, Unknown; identical to SEQ ID NO: 27987
  misc_feature (1)..( 3003): 2750-1469P.txt file - cDNA_ID_2993353; gDNA_ID_2926207; Annot_ID_141777

SEQ ID NO: 27989 - DNA, 3003 bp, Unknown
  misc_feature (1)..( 3003): 2750-1469P.txt file - cDNA_ID_2993357; gDNA_ID_1620628; Annot_ID_47191
cttctgttacttcgacataacagagattgacggcgtcaacaccaacgagctttacaatgccgtccagctttacctcagctcctctgtctccatcgcaggtaaccgtctcagcctcacacgcgccgtcaactcctcctccgtcacattcggtctctccaacaacgactccatcgtcgacacgtttaactccgtcaccgtcgtctgggaacacatcgttacacagagacaaactcaaaccttcgcttggagaccaatgccggaagagaaacgtggcttcacgctccggatcaagaagaaagacaagaacttgatccttgattcttacttggattacatcatggagaaagctaacgagattcgtcggttgaatcaagatcggcttctttacacgaattcacgaggtgggtctcttgattctagaggtcttccttgggaatctgttccctttaagcatccgagtactttcgatactctcgctatggatccggttaagaagcaacagatcatggaggatcttaaagatttcgctgagtgtcaatctttttacgagagaactggtcgggcttggaaaagaggttacttgctctatggacctcccggaacagggaagtcgagcatgatcgccgccatggctaactatctccggtacgacatctacgatcttgagctcacggaggtcaaaagcaattctgaactgaggaagcttctgatgaagactagctccaagtcgataattgttatcgaggatattgattgttctatcaatttaacgaatcgtaacaagaaacagagcacagggagctataacgaaccggagatgttaaccgggtccggtttaggtgatgatttgggtgatgggaacactataacgctttcaggtttgttgaatttcactgatggactttggtcttgttgtggtagcgagaggatttttgtgttcacgacgaatcacattgagaagcttgatcctgcattgcttagaagtggaagaatggatatgcatatacacatgagttactgtacgttttcttcggtcaagattttattgaggaattacttggggtttgaggaaggtgatcttaacgacgttgttttgaaggagttagcggaagtggttgatagggctgagattacaccggctgacgtaagtgaggctttgattaagaatcggagggataaagagagagctgtgagggagcttttggttgatttgagaagtagagtggagagaaatgagaagaatgggaaatcgagggttcaaaatgtgagcttggaagagcaagagaatagagctttcgacagtctttacgcagaagagaatggaggagaagaagaagagattgaggataacatttgcaaaagtagtgatgattgttcttaattaggttttctaacgtttctatgttctacacaatgtgaaagttgtgtgacctttcttatgtttctccttttttgggtagttaactttttgaagtaagccaaagtgaagaagaagaaggagagaaaatagaaaagaggtagagagttggttaaaataagcaagtggtggtgattaagatttttgtatgtggcgatcgggaaatgcaaagagattcattggttaccattggcatatgatttggtgttactataaatttataatagtttcgttacacttttgacatagaattccatattattttttaacaatagcatccaattctttttaaaaagaaaaacttgtgtgtttttagagggtacggttgtctttcatcttcaccaacattggataagatcaatgcattccttgtcaatttttaaagtacaaaaaacaggacaaattgtttagccttaagaccaaacactgaagttgacatgttttgtttgtttactggattttcttagcattgtggactttctagactcacccgtttgaaattgtcataatatggtgtcgtcgcactgtctcttatatatttcttactttattcgcaatataaacaacaaagtctatgcttatgtcaattggtcaatctgtccatcgactctattaattgagttatgagtgtattgtgcatagattaataaaaataatacagtgagtatgttatggatagatgtggatctctctctctagtcacattaccacaaagagaataaagagttgaagtttccgaaagagataaaacaacaaatgtataatgtcgtgaaataataattgtgtagaagaaaatatcaaaaaggaaagattttgatattaatacctttttatggattcggtgagaaattaaagaaagatttgattaagaagtgagttggaagtgatgcatgtacattattaggcttttgtcggaaaactataaaaaagacttcttaagcccattttaatattcacttttttactttctttcttttttgcattgcaattttccattgtagtttaagatctgaccctactttgtatatgattcgaattatccattgtttaagataaaactaatagaaatcaattcgattgtccggtgagtaaacggctcttcgctaacagaaaaacctaacttgaatagcttgagtcaaaacaatctaatttttaaatagttcccaaaattttatcttaaattactcgtaattacactagcaatccaaagtttatttgttttaataaaaactattttgggtcgtcaaaatggcccataaagcctaattaagaagacccaatcaatttaaaagcccaaatcagtgtgacgtataatatacacgtcacacgtcaattctcagcgtcgttaaagtatgttaacaactccgacaagattcgttgctctaagaatcccattccgatcttccaataagattccgatctccattgctccctctcccaaagtttttcctcggaaaccagttatcagagttccagcaagtctccgatttgtagcgacgatgtcgacccctgccgccgccgtcaacgccaccgtcacagtcaccgatgccggcagaggatcgatcactcacgtcatattcgacatg

SEQ ID NO: 27990 - DNA, 3003 bp, Unknown
  misc_feature (1)..( 3003): 2750-1469P.txt file - cDNA_ID_2993357; gDNA_ID_1620628; Annot_ID_162567
ttttcttctctcaccttgttttagccgtaaagtaatcaccttttcaacttctcaaaagccctctgtttctctcatctccctctctctgacgatgaaagagtattggacatctttggcttctctactcggcgttttagccttttgccaaagcctaatgaattctgtattcccaccagagctccgtttcgccatctcgaaactcttcaacaaattctttaaactcttctccaccttctgttacttcgacataacagagattgacggcgtcaacaccaacgagctttacaatgccgtccagctttacctcagctcctctgtctccatcgcaggtaaccgtctcagcctcacacgcgccgtcaactcctcctccgtcacattcggtctctccaacaacgactccatcgtcgacacgtttaactccgtcaccgtcgtctgggaacacatcgttacacagagacaaactcaaaccttcgcttggagaccaatgccggaagagaaacgtggcttcacgctccggatcaagaagaaagacaagaacttgatccttgattcttacttggattacatcatggagaaagctaacgagattcgtcggttgaatcaagatcggcttctttacacgaattcacgaggtgggtctcttgattctagaggtcttccttgggaatctgttccctttaagcatccgagtactttcgatactctcgctatggatccggttaagaagcaacagatcatggaggatcttaaagatttcgctgagtgtcaatctttttacgagagaactggtcgggcttggaaaagaggttacttgctctatggacctcccggaacagggaagtcgagcatgatcgccgccatggctaactatctccggtacgacatctacgatcttgagctcacggaggtcaaaagcaattctgaactgaggaagcttctgatgaagactagctccaagtcgataattgttatcgaggatattgattgttctatcaatttaacgaatcgtaacaagaaacagagcacagggagctataacgaaccggagatgttaaccgggtccggtttaggtgatgatttgggtgatgggaacactataacgctttcaggtttgttgaatttcactgatggactttggtcttgttgtggtagcgagaggatttttgtgttcacgacgaatcacattgagaagcttgatcctgcattgcttagaagtggaagaatggatatgcatatacacatgagttactgtacgttttcttcggtcaagattttattgaggaattacttggggtttgaggaaggtgatcttaacgacgttgttttgaaggagttagcggaagtggttgatagggctgagattacaccggctgacgtaagtgaggctttgattaagaatcggagggataaagagagagctgtgagggagcttttggttgatttgagaagtagagtggagagaaatgagaagaatgggaaatcgagggttcaaaatgtgagcttggaagagcaagagaatagagctttcgacagtctttacgcagaagagaatggaggagaagaagaagagattgaggataacatttgcaaaagtagtgatgattgttcttaattaggttttctaacgtttctatgttctacacaatgtgaaagttgtgtgacctttcttatgtttctccttttttgggtagttaactttttgaagtaagccaaagtgaagaagaagaaggagagaaaatagaaaagaggtagagagttggttaaaataagcaagtggtggtgattaagatttttgtatgtggcgatcgggaaatgcaaagagattcattggttaccattggcatatgatttggtgttactataaatttataatagtttcgttacacttttgacatagaattccatattattttttaacaatagcatccaattctttttaaaaagaaaaacttgtgtgtttttagagggtacggttgtctttcatcttcaccaacattggataagatcaatgcattccttgtcaatttttaaagtacaaaaaacaggacaaattgtttagccttaagaccaaacactgaagttgacatgttttgtttgtttactggattttcttagcattgtggactttctagactcacccgtttgaaattgtcataatatggtgtcgtcgcactgtctcttatatatttcttactttattcgcaatataaacaacaaagtctatgcttatgtcaattggtcaatctgtccatcgactctattaattgagttatgagtgtattgtgcatagattaataaaaataatacagtgagtatgttatggatagatgtggatctctctctctagtcacattaccacaaagagaataaagagttgaagtttccgaaagagataaaacaacaaatgtataatgtcgtgaaataataattgtgtagaagaaaatatcaaaaaggaaagattttgatattaatacctttttatggattcggtgagaaattaaagaaagatttgattaagaagtgagttggaagtgatgcatgtacattattaggcttttgtcggaaaactataaaaaagacttcttaagcccattttaatattcacttttttactttctttcttttttgcattgcaattttccattgtagtttaagatctgaccctactttgtatatgattcgaattatccattgtttaagataaaactaatagaaatcaattcgattgtccggtgagtaaacggctcttcgctaacagaaaaacctaacttgaatagcttgagtcaaaacaatctaatttttaaatagttcccaaaattttatcttaaattactcgtaattacactagcaatccaaagtttatttgttttaataaaaactattttgggtcgtcaaaatggcccataaagcctaattaagaagacccaatcaatttaaaagcccaaatcagtgtgacgtataatatacacgtcacacgtcaattctcagcgtcgttaaagtatg

SEQ ID NO: 27991 - DNA, 3003 bp, Unknown; identical to SEQ ID NO: 27989
  misc_feature (1)..( 3003): 2750-1469P.txt file - cDNA_ID_2993357; gDNA_ID_2926188; Annot_ID_140870

SEQ ID NO: 27992 - DNA, 3003 bp, Unknown; identical to SEQ ID NO: 27990
  misc_feature (1)..( 3003): 2750-1469P.txt file - cDNA_ID_2993357; gDNA_ID_2926188; Annot_ID_200777

SEQ ID NO: 27993 - DNA, 3000 bp, Unknown; identical to SEQ ID NO: 4214
  misc_feature (1)..( 3000): 2750-1469P.txt file - cDNA_ID_2993367; gDNA_ID_1620691; Annot_ID_48601

SEQ ID NO: 27994 - DNA, 3000 bp, Unknown; identical to SEQ ID NO: 4214
  misc_feature (1)..( 3000): 2750-1469P.txt file - cDNA_ID_2993367; gDNA_ID_1620691; Annot_ID_164781

SEQ ID NO: 27995 - DNA, 3000 bp, Unknown; identical to SEQ ID NO: 4214
  misc_feature (1)..( 3000): 2750-1469P.txt file - cDNA_ID_2993367; gDNA_ID_2926159; Annot_ID_139637

SEQ ID NO: 27996 - DNA, 3000 bp, Unknown; identical to SEQ ID NO: 4214
  misc_feature (1)..( 3000): 2750-1469P.txt file - cDNA_ID_2993367; gDNA_ID_2926159; Annot_ID_198629

SEQ ID NO: 27997 - DNA, 3000 bp, Unknown
  misc_feature (1)..( 3000): 2750-1469P.txt file - cDNA_ID_2993375; gDNA_ID_1620745; Annot_ID_49713
aagattcgtcaattggaattgaaacatttcgaagataatggattcgtgtccattttcatctgcactggaaatgaattttgaagataatggattcgtatcagtctttgtgatctgatgccgctgaaattttttggaagtaatgaacaagtttgatcattggttaaatgttttggattagaatttgatttgaatctgtacttttgaagcattctggtttaaatcagagtaatcatcgttttgtttaattgttcagggtgattcacagtcaaatgatccagttgcttacgataatggggtgacttatatgtttgtacaacatagtaatgtatacttgatgatagcatccaggcagaattgtaatgctgccagtcttctcttctttcttcaccgcgttgtcgatgtaagtatggctggtcaattctttagtttttctcttaaggttccatctttttcctggatatttgatgtaatggcaatggtatctgttatctggttataggttttcaagcattacttcgaggagttagaagaggaatcattgagggataactttgtggtagtggtatgttaagcttctgtcatcgctcttttagtactatttcgcaatatatttttctattacttgggcaatcaaaaagatccttaaaattttggaaaagtatttgtcattgttagatgctgaaattgattttttggtgctggcagtatgagctacttgacgagatgatggactttggttaccctcagtataccgaagcaagaattctcagtgaattcatcaagactgatgcatatagaatggaagttacacagagacctccaatggctgtgacgaatgctgtctcctggaggagtgagggaatacagtacaagaagaatgaagtgagtgccattgttttcgcaagataggaatatgtttctgatgtttcggtttgcaaataatgacaacctgcttctttttccaggttttcttggatgttattgagaatgtaaatattcttgtcaacagtaatgggcaaattgtcaggtctgatgttgttggagcgctgaagatgcgaacttacttgacgtatgtcaacacatcaaatttacgatatagttcctaatcagccaaagcatgttaaatcacgtccctttttgactattttgctctttgatccattctattgcagtggaatgccagagtgtaagttaggactgaatgatagagtattgctggaagcgcagggacgagcaactaagggaaaagccattgatttggaggacatcaaatttcatcagtacgtctttaagtttttattatattgaaacttggaaagtcttcactgatcttaacccttctattttctttttgttcaaaaagattatatacttgagttttatgtattctcttcttcaacaaccatttatttaatgcaggtgtgttcgattggcccgttttgaaaacgataggacgatatctttcataccacctgatggggcttttgatctgatgacatatagactcagcactcaggtttgacatgtgggatatagcatctactggaattgttccacgtcttcaacaagtaaatatcatgatttgtttcttttatgttcaggtaaagccacttatatgggtggaagcacaaatagaaagtcattcaagaagtcgtgttgagatgctcataaaagctagaagtcagttcaaggaacgaaggtaaatatattctatggtatttgtgccactttccttttctgtcttactgtcatgcaaagatcctgattgatcagattctttaaacctttgatcacgaacattctttttgtagcaccgcaacgaacgttgagattgagttgcctgtaccaaccgatgcatctaaccccaccgttaggacatctctagggtctgcctcttatgctcctgaaaaagatgcgttagtctggaaaatcaaatctttcccggggaacaaggtataacactaacaaggttcaataaactcttaaattcagttgaaacagtcagcaatgtagactatgtagtatcaatgctaaccttcagaaaaccaatataggagtacatgttaagggcagagttccatcttccaagtatcactgcagaggaagcaactcctgagcgaaaggctcctatccgtgtcaaatttgagatcccttatttcactgtttcagggattcaggtaagcttgtgcttaataataaatggttactgtctcttccacaatgtcatatatataatatatatgttctttggtgtgtaggttcggtacctaaagattattgagaagagtgggtaccaagcacttccatgggtgagatacataaccatggctggtgagtacgaactaagactcgtgtaatgcacatttagtttcatcgtctatgtcaattgtgattcccacatccctcaaggaattgcctgaatcaaagaagcaaaacgaaacaggacaaaagtagagggaaaagaaaacgttttgaaacattttagctgatcaaattttcctttaatttgttttagaagccatattcttgtgaatttgtctttatggtgattctattttattttacatgaggctctctgtaacctttcacgacatggttcattattttcctttagactgctacatttctgtctatgtgttcgttctgcgatcaaaattgttaaacgttgaggttttggttttgttttttggggcattcgtctatgtttacataggtttctctcgagttatgatcaaaatgaaactacataaacaaattatgcttcaatagagtgaggtgagagagccttacaatagagagaacgtatattttggtgtttctcatattgtttaactgatatagtatgggccgaaatgaaataatcgtcaggcccattaaaaagcccataatcaccatactttctcctccaattctgtttcgagcttgggaagtgacagtgaattagggttttactcaaaaaaccttctcgttgtcgttgtttactgctccgacgagaaaatg

SEQ ID NO: 27998 - DNA, 3000 bp, Unknown; identical to SEQ ID NO: 4927
  misc_feature (1)..( 3000): 2750-1469P.txt file - cDNA_ID_2993375; gDNA_ID_1620745; Annot_ID_166642

SEQ ID NO: 27999 - DNA, 3000 bp, Unknown
  misc_feature (1)..( 3000): 2750-1469P.txt file - cDNA_ID_2993383; gDNA_ID_1620753; Annot_ID_49855
ccttcccattacgtcttgacgtggaccctgtccgtctatttttagcagattaatccaacggttcttattctttcttcgacccttcacgacattgcctcaaagccgtccgattctcatctcacgcccaatggaccacatatatcaccagtactccgcaacttagctgtcgtgtaggatttcacgtggcatttatttgttctagtttgtagtgcaaacattgcaagttgatatggtcccctatcgatcaccgtcgtctctttagcttcacatcgagattcttctttctttcctacgtgtaatagcatttttgattttgagaatttctttagaaccgttggatctctcatcgttggttgatccatccatccaaatgggacctgtgtgtgctccatccagggcatatgatcccaaagccaaaagagtatttccaagtgctttctttctttctttctttctttcttactaacctttttttttcttatgctttagactaagaaatttattcggccatatccacttttacgaatatacttcttacaagatctagatttttttgagttaattcggtgtatataacattggcatagactgcaattaagtaaatgataatgtgataatgatgcgatgtgttgttatcaagtagtataatatagatggctaaataggtaaacaaaattacgtgttatatgtacacaattaggtagaaccgtagaaattaaactgaataaaacctttattaattttaaaattatatggtacagataaatacggaaaaacattcacgctttacgtaacaattaagtggaaagtaaaattatcccaaaaatatttatatcacatcattgttatatttctaagttttttttatttctctaatggtatatgttttacagattgttttttgggaaaattcttaaagagacttgaagaatgttttttttttattttcttgaaatgtttgacacttgaaaccgtttaaaaactaaatatagtatatatcattgttggtctcataccttgtaattcaccacatatattatcaatggggaagatttgaaaatttttgggggatcacaaaacgaaggaaagagtacaaaaagagaaggaaaagatagaagatatatgtttttaacttcattggtatgacatcaataaataaatagttgaatgtactttagtttctcttttggtttaatgcacatcatctcgatcaattgtcatcatcttacattgaattatacgaccagatctgataacaagtgaattcgtacttgcccttccctttcttctcatacgtccttctaactaattttgattgtaacttataattatataaccatatttaattttattttatctaaaaccaattgaagcaaattaaaatatcataaatcttgagtcccacatgaagacaatatataaaactcgtgcaaatttgcttaaaatgcttctatgagaccatgaccaagtgagattaataagcgattcaatgtgcaaatcaaaagagaaaagaagctaatgggtttaaatataaccaaacagaataataatgctatgtttagtttttctaattgaatcatacctttgtgtccatcacctacttaccggtcagaataaagcaattacgtctgcaaccaaaaagcactaagactttcggtcagacatgatctctaacatcggacgaaccctaagataaccaaaataaactatatcttatattcaaatctctgtttattttatccatttatgttttctttctttcccataattttttttgtgtctcatcagactctcttaccaaactgaatttatcaacatggttttttttttggccacatcaaaatggtggtttataaagtagactaatacaaaagacatttctgttaatttcactaacaaaaataatcttagcagtactatagattggaaaaggaaaagcaaatctagcagtaagatttatcaaaactagcagtaagagttttagatatcatgaaaacatcacaaacgagtagtgttttactttacatttttaaccaatcacaagggtagttccgtaagttgggaaaatcgtacgaggcttcacctagttaaggttaggtcacatgattccctgaactcgattttataagtaaaaaagaaaaatttataaaatcaaaattttttatataaaaaaatcaggtggatttatcagaccctaccatcgagatgtcgacacgtgtccaaactcattcattgccctactattttctgtttagggttgcaatcactcatcgcacacgcgccatctccaccttccattattaatctctcattttcaacatcacactcttacgaatcatacgattttaatatctctgtctctctcaacgtattaaataaaaatggttttaaatgttagggttttttgtaggattttcaattattaatctctataattcgatgaactaagtaaaaaagcatcaaactttcttggcagaatcacatttttctctaaactaaatatggactgaaattgaaaaattaaaccactagctagaataaagtgttggtgagagtggaactctaatttctctcctttactaattatgtataaacacaaaaatgcaccaaatttttaggtttgaaaatatctaagcatggatagggtaattaacattttttctttcaattttgcaatatttgaataaatcctatgagggtctttggtacacaataattggagggtatatagttgagtctgagagtatattagaaagagaatatttcaagtaatgaagctgacatgtttatatgtactttgagagaagtgttgtgagatttgtacaaatgtatatgtacactttaaaaagcaatataagatagataaaaaaaatataaagaaaaaaagaaagaaagaaagaaagaaagagagaggctcatatatatatagaattgcttgcaaggaaagagagagagagagattgagatatcttttgggagaggagaaagaaaaagaaaatg

SEQ ID NO: 28000 - DNA, 3000 bp, Unknown; identical to SEQ ID NO: 27999
  misc_feature (1)..( 3000): 2750-1469P.txt file - cDNA_ID_2993383; gDNA_ID_1620753; Annot_ID_166849

SEQ ID NO: 28001 - DNA, 3003 bp, Unknown
  misc_feature (1)..( 3003): 2750-1469P.txt file - cDNA_ID_2993386; gDNA_ID_1620775; Annot_ID_50268
ccctaagtaccttctttcgtcggagcttccattaggagtgaagaagccaagctcaaatctctgaccagctgaaacaagagtctctccatggctgtcattgatcaatgttgaacctttgaacaatgttttggagtcttgaactgcaacaaaacaatctaatcgacgaatatgcagcaaaaacatatagaagaagacagaaagaatcattctctgaccagtactagcttttttttactcatctgatatctccattatttctgcttaagaactcaactcaaaacgtgtctaacgaaaaaagaaaaagtttgcctcaacgtcaacgaaagacccacctgaaaagtaaatatgtggaacgcagctaatcatgtgttttaagatgtttccaagaaaaagcagaacaagtctcacttgagcatctgaaccaaaagccatgaaagtagtagatactatttacactctcttagccactgtatgtagatacacatgtgaccaattcacgcactttgtgtcaactttttccgcgatggatctctaaatagttcaaaaagatccaacattttttgaataatacgtacttttagagtattttttgacaatgagagagacataggggtacctaaacgtgaattactggaaaaaggggacaatgatgttgaagaagtcaatcttttgtccttattggtgctttcgaagaagtggagattgaccctgcaaacattgttaaccaacttttttccgaaattattgtgagattcgaggagttttgacaaatgtaggacttttgtcgttcaaaagaaatgttttcatctaaaacgcgtaaacctgtaaaaggcagcttcagctctgattaaacaaagagacttgcaacaatgtcactatgagacattactgtttaaaaatagattcagaaacactaatcagttttcacactaaaacaactttgtcttctgccttgtttgtttattcctctggatgtttcatagatatacctttaacagggtatagcagtttcaagttcatagatgaaaccctttcgctcacaaatattgttttaaagccttctttatgagagttggattggttcaccacatagattctctaactcctcttccaggagtttatgcaactttgcttcagttcgccgatatatccacgcattagcatcacggtcccagtcaaatctagaagggccactgcaccgagacaaaaggaagaatgaagattacattaatgtgaatctaagatgtggaagcacaaagtcaagagcaacaacactatacagtcataaacagtttcatttctccaaatatcatgagtacaaaaatcagaagagagagcagaacatgataatccagatgcgaaattcaatctaggcgcctaaagttagcaactttcaaaaggcaagaaagaatctttacctcacaggtgaagacatccagatttgtcgatttggagtttgcttattcagtacataagtgcctaaagatccaagcttaagggtaagaacttcattctgttggaaacagccaaaaggactgactataataagtacacatagatttccagaaatatgaacaagatcttaaattgcttaaaagagtttaatccttaccccataatctatgtcgaaaccatcaatctgaacattatcaccataatcctgaacatgaatcatgcaagtagaacatagtgtaagctattgcaatctcaagtaaaacgaagaaccctagagagaaaaaggttccagcttcaaatacctcaattttctcaagaaggtgattaattgtgaagttggctaatttgtgaaactcttcctcctgcaaaaccgaactgtttttttcttccactttgttcatattctcatgaaattaacgattcagatacaataaaggagatcaaaatggagaatattaaagtacctgtaatcgacagaagcaggaccttgagaagagaagcttctggtagtcaaagaatcatggcggattcgagatcctattctccagaaggaatccaacggttctatggaatcttgaatcagattgcttgaaactcttacgccattgctacggagaagagttggagacagcttgagaaacctcggcaatttccgtagaagaaaccttgaagctgtagccatggcggttctgtcacaagaaacattcgacgcctctcttcttcttattccttcgttgtccaatttaggcccacaataaggcccaaatttagatttacccggttcacgtatttcccatgttccggtttactgaaaccggtatggttctcaagagatttgtcatttgtgtgcgaagaagagttttcttctcctctcataagaaaaaaccagaattttgaagaaggagaaagaaaaaaatctgggtttttgggagctgattaggttttgttccttcaatctctgggaattttcgctatgcactcaggtgaaattcgttttttcctctatttcaatctctgtcttcctgcgagtttacgtgagagaatagtttttaatgatcccgagttcgtcgaattacaatgcaactcccagtttttgtagttttaattagcgaaattcatcaatggcattggaaattttaagccttttttggtttgttttatggtactactaattattcaagctaaggaattccaaagttttcgttcgttttgattgggtttagaagtatttggctgatgagagaaagagccataattctgaaattaaacccttttatgtgaagcttgtgtagatgttttacctgaatttcggaattactagcaacatttctaaatacacaaagcatgattgtaaaatgaaattgattttggtcagggctttgcatctcttggttattgaatggtgtccgtgtttcactattatcttcttatgtttttgatttttatgtgctattttcgatagattcaggcgaagcgaccgctgatggcgataaagcttctacagaaaacagcaaaaaacggaagcttaagactcctatgcaagttatg

SEQ ID NO: 28002 - DNA, 3003 bp, Unknown; identical to SEQ ID NO: 28001
  misc_feature (1)..( 3003): 2750-1469P.txt file - cDNA_ID_2993386; gDNA_ID_2926205; Annot_ID_141694

SEQ ID NO: 28003 - DNA, 3003 bp, Unknown
  misc_feature (1)..( 3003): 2750-1469P.txt file - cDNA_ID_2993390; gDNA_ID_1620783; Annot_ID_50374
aaaattttaatggggccatcttagccgtccaactcctttttctttaatcagcttttccactggcgtacctttccagatggtgattacgtgtctataccaatctttatgaaataaaaattagcaatttggttacaaattcaaaaatagcgatagaagtttgatacaaaattgacacttcaatttccttccaataccgcagacaatatgatccgtccctttgaatacgatagtccttttcaactttttaacatagtacttaatttttatttttgacatcacatagtacttaattaaactactatatttatcatgtaattgagtatcatttgtgaataagatttgactctctttcttttccggaaaataggtccgatattttcttttatattcttgatttaatgaaatggcattttctaattttaaaattaattgaacagtttgaaaaaaattaacggaaaatgttatgcactgcgttcatcactttttggtgaagaacttacaaaacattctgaaaattttgaaaatcctattaagtttagataaaaatttataaagttttcgtagttttcaataatagtaataaattcaacttaatcaacaattttcaataaggatgaagaaaaaatattaattataaaatgaaatttttaaaaatttgcattgaacatccttctcataaaaccagttaaaatttttttttagtaagcatccttttcatactttctaatagacagaccctgaagagttctacaccaagacgaaactgcggtgaggattttatctgacggggcaaatcagaccggctggtatgtggacccactttcaaatggaatcatacgtggcatacagtcacgtgtcagcgatcggaaacaacttgtcaccacgtcattatttctgactcttatgggtcctacccaccggcctattacttgtcgtcaactgtccacgtagatttttaacatggaaaagatcaaaaactgtaatttaataacaaaatcagtgacctaaataaaatgctgggtaaaaaaatagaaatctcaaagccagaagaaaaaaataatttcaggatactggatactcaaaataaagaaggataaatatatatagtttgttataataatgcgtacaattataaaatatttatataaatgtaaaattatatatagaacatataaaagttctatcgtatacttttaacaagcttataattaagtggatatgaaaacgattaattcacgagtgactatgactcactaaaatgtcattttcattctacccaaattcaaatttctgtaattggttccatatatttcccttacatagaaaatcagatcactaataactaatatttacctctatgccgacttatgaatatattgtggtcaatttcatatatatgtttcactggatacaaacaaacatatattcatatataaagtatgtactattcgctacttttgcggttttacattccatgtgatatcttatctggatcagtaaataatttgctttgtacaatgttaagcaaacgcaaaaatccaaatgctagagtttataataaggatccatttatgatatatcgtgttattttgttagttgtttacactttatatcactcacattctatctcaattcatacaaaaagacgtagatattaattaattctagctttaaaatgatcaatctatatagcaatctaagaacagttatcatctgtgacaccaacattcttaataacattaccgactataagtgaataaatgatcacctaatcttctatgaatgataaaaaattccaaccaccactttcaccgaaattgttactcgagggatcaacttctttttgtgactaatttgaggctaaaactagtaagaagaaataaacaaacaaactgtatttctatcaaaaaaacaaaaccaaaacattgtgactctttaacactgttttaatgtcttggtagaattcgctgatgctaactaaggtttaaacgttttaaaaaaaaagaagtttaagttgttaaaacattaaatcgaccatgcacgatccgagatttgatatgattttttagtgggaagaattgatgaaaatgatttgatattgttcataaacatgttaatatgtttaatatcatgaaaaaatattgttcataattaaatggcacaaagatttacctattgttttgagttctattttagccaattcaatcggtgttcctatattttaaccaaaatacaaaaaaatcgtatttatgtcattatattgttttcatgaaacatattttttcatatccaacctcacttatgataatcagtatctaacacgacatctagaattatgagtttctatacatttttataattaaaatttcagattttttggtatagtgagaattgtagtgcacggttaaatcaacaactagactaaagacgactccatatcattaacattctcattcattgcaatactgtttctgccatcgattttctcctcaccatcatcactccttcaaatattcattttaactatagtttgttttcatgctataatgattctatatttctatcaaacaatagttacagaatttctttgcttaagaaaataatatatatttaaatctataatattcacgactaatagacgttaattgcaagtggtgtaagatctgtatatgatatatattttctttcacgatcacaaactgtacatgatgtttctttctcaaacatctatacaacaaaagcttcattattattgccagagaataattatgcttaatatgtgattttgttttaggattttttttttttaaatatatcttgaaaaatgattctaaagctttttttttttttttgataaaggtgtatttgtttctcctataaattaagccatcttctcaaccaaactcttcactcaccaaagcatcacataacactcacacacacactttctcttctcttattttctcagttcttttaactcttttctctacatatattcaaatg

SEQ ID NO: 28004 - DNA, 3003 bp, Unknown; identical to SEQ ID NO: 28003
  misc_feature (1)..( 3003): 2750-1469P.txt file - cDNA_ID_2993390; gDNA_ID_1620783; Annot_ID_168028

SEQ ID NO: 28005 - DNA, 3000 bp, Unknown
  misc_feature (1)..( 3000): 2750-1469P.txt file - cDNA_ID_2993392; gDNA_ID_1620803; Annot_ID_50518
aattgtaggattttacgtgataattttagaaatctgtttagaatgggcacatacaatagctagaccttggcgttgatgctgaatgggtgggtcattcaccatggagatttatataataaaacacatgagaaacgatttttctgcccttgtttgaattgtagaagactagaagacaatctttgttcgtagtccttgtgcaaagataaccattaatcattatttttggcattatccaaaacctctggtcaaactcgaagccatgccgatatgtggtggtcactggaagcctcttcaccttcatttttggtggagtattgcgaaaatataatatatttttttggaatcttattaggtttgttacctgatatgctttaaagaaggatatttccaggtactctttaactcatcaatttaggatagtcaatcgtgagaagaagttgttataatattcgggaacaatggccggttgcgttattaatggaccatattttaacaattgcaagaaccaattattcagaggcaaagtcaacggtttgatataagctcgctttcatatttttttttcacatttgagcatttacttggaatcatgcatgggaatatcatagtttcgtgctagtttctcctgcctgaagaagatgatgaaatggaccagttatagctagcgcgccagtactagaaacggtgttgtactttctggagaagaatggtaaagtatcagattcaatacaccaacacggcaacactcaagatgcagcttgtttttggtaaatacaaaaccgaaacttggagagaatgatcagaaagaaatgaaatgatggtaattgatccaatctgagcttttaccctattccattgaaaaccctttttcttttgtgaaaaaggtttgtatcggaaaagaaaaaataaaggtttgttaaaattacttatctgagcaacaactcgagtccggtcaccggtgaagctgaactttggaattccgaacacaccaacaatcccgtgcttgtgaccgtgagcatgcacgtgcaacccgagctcgtctccatgttatagttatttactatttagacttctgaaagaaagcatacagtaaaatgtttagacaacactctctttgtctgagcttatcattctctccgcccatcacatacgcttggcccatcctcattagcccataagcccagagaatcgttttctcatggaggcaaaccaactttgtcgatttaaaaacgatttcatctaaacacaaaattttcgattggtcgtcctttaccaggaccctaggtctcgcatctaccatcatgaaccaaagcacaaaccgtccaacaaaaccaaagttaaaactctgatcgtttacacattaaaaacaacattacctacacctacttttttttgtttgtttgtgtgacaattaagaagttcagacgtattacaaagatatgtgcagcgtcatattagttacctattgaactcctacactatgtttgcatattgataaatttttaaggacatcagatataagtaacagtaagattactattcgccaacacatcccggccctattaagttaagaaaatctaagtaatcgattccaaataatactatagatctcgtaatctttataaacgtatatataaacgtacggttgtgtgttttgaagtttgttagggtgacatgatcaaggtgagaggatacgtgatgttgcgccgaatttaaattatacttaaataacaatgatgataagaataaaatcaagaataaaacagaaaataataagacataactatcaattatatatatgaaagctgaaaaatgccgatttgattggttggttaaggtttgatatgaacaatctgtaaattgccagcctgagtgttgctgtatactgaattgcatgtcaacttgttcatgtttacatcataaactctttttgtcctttttccttttctttattagtttactatacaaaataataagtattttaaacattttgtcaacaaaaagctttactgttacatttaacttaaacattcagttatttcaaatatagagttttcataagaaaattacatatgtcaaaactggaaataaaataatgtactagttttcaaattccataaagttttgaatactctttatcaacaaataattccaaaaatatattcggtgtgggaagatgttctgatgcaattaataagaaagacaaaaaaaaagtgtatcaaaaatatcaaaaactattattattagaaaaagagataaacccaaaaatggcaaaagatgaaagagaagtcaaagcatggtatagcattaccacgcccacttcatcttcaagtcatttgtacacgttaatgtgtgcgtctgtgtgtgtgtgggtatatagtagtaaggtttaatcttataaatttaagtaatcaagcaaatacttaatttaattatatcaaatcaagcataactactgcattctaatccaatgaaaggggaaacagaattgcccacatgcaaatgtctcgaaatgtcttaaacctgaaagaaaatgtgtgttagtcttacatgtgctgctgcaacattaatttaatgttttctttttgtcattatgatcctataataagaatttttctgaaatttgatttgattctgaacgccaatggtgattatgataattcgaaaatttagaaacaaactaatcacttgggaattcttgaacggagccaacgtcagtcacatgaattccttttttaacattttaaatagattaagacatttatttacgaacattctttagtaaacaagacaaaataaatccatgatggtggactcttttctaacgaagatcaatcagagcagaggtaaagagccagcttgtctacaactcattttgtaaagtacctaatttacccctcccaacctgtcccacccaacctctacctctatatatacaccactgacacatatttaatatacacacactaatcagtaatcagaagtataaaacacaacatg

SEQ ID NO: 28006 - DNA, 3000 bp, Unknown; identical to SEQ ID NO: 28005
  misc_feature (1)..( 3000): 2750-1469P.txt file - cDNA_ID_2993392; gDNA_ID_1620803; Annot_ID_168731

SEQ ID NO: 28007 - DNA, 3000 bp, Unknown; identical to SEQ ID NO: 5890
  misc_feature (1)..( 3000): 2750-1469P.txt file - cDNA_ID_2993403; gDNA_ID_1620823; Annot_ID_57830

SEQ ID NO: 28008 - DNA, 3000 bp, Unknown; identical to SEQ ID NO: 5890
  misc_feature (1)..( 3000): 2750-1469P.txt file - cDNA_ID_2993403; gDNA_ID_1620823; Annot_ID_169579

SEQ ID NO: 28009 - DNA, 3003 bp, Unknown
  misc_feature (1)..( 3003): 2750-1469P.txt file - cDNA_ID_2993407; gDNA_ID_1620835; Annot_ID_57974
gtaatactgcgagagaaatcttatgaaagaatcgaaatgtgttttaaaaaaattaaagttttaagttttttttttttaatattgttaattttgtttagtgtttaagattatataattatattataattgttaattataggttttttttccgtagcatatcatcctatgttataatccactcaaacccgtcacaccatataaccccgtcccatgaaactaaacacaaatttgtcattttattataaatttcaaatatgtataaaattataaacttcaaaaaagattaatattgacccaaacttcatcattgaattttgagtgttatatctaagatttctctcgcagtatatcgtctcatattaatatcttttatattttgagtgttatatataaaatttgaaacttaaaaaaatacaatatcgaccttgattatatttaagacttttcctgtaatatatatcgtctcatattaatatattttatatatatttataatgtttaaatttctttaaaattcaatttataatttttaaaactttataagttttaaaattataaatattcaaagaattttttaaagataaactttataaaaagtttttaaaattataatatttaacttttgataaagttataatatttataatttcttgaaacattttaaagtttcaattctttaaaataaaaaaacccgagtaaatcggataactattttaattttggacgcctgataaatcaagcttcctgctcattcgtaatcagaatcattttggtccttttataatatgggtctgaaccattgtccaatttttctaagcgatgtgggacattgtacacatattatttcttcataggttgaataatatatgtctgttttaaaaaatttaaattacatcatatgcagaaaaaaatataatattttattaactatatatattttatataaattcaaaataaataaagtataagatcaagtaaaagtgaaagaagaattatatatttatgtttaaattaggtagaaatattttaggaaattagttaaggtaaataacaaatatggttagtttagagatattgtttatattaaatttggtaattaaatcattaattttcgtttttaattattagtttttaggtaacttttccaaaaattaatgttatccaagatcagaacagaattaaacatgttatccaagatccgaacagagttaaaccgggtaaaacccacccatttgaattaattgttgaattatggctcaaatcttcaacattatcttcaaaaaacgtttacaaaaatgtatatatagataactacaatataatacggttttcatagtaacaaaaatatatatctatttatatatagatattttcgttacttttaaaaatatatcgtacaatgcagtttaatcttaattcaaaatactgcaaattaattaatgatacacaaataatcaaatgcttttaattagcctatcaatagagtattaacacattttttttccttttttttttgtgtgcaagctattatacatcttgatatgcaagctattataattaaaacaatcataaagttagatcatttctcacttctccaattatatatgtatatttcaaaagcgtaacttaatcataatttcgatattatttcatttacaattcataaatttggttatcttttcgttttaatattttctatagtaaaagaattatgaagaaatttgattagttaatgcttataattttgattttttcatttacatgtcataaatttggttatcttttcattttaagttttcctatttataaatattaaacagtaaaaggattatgtaatattttgaataattaatgctttcattcaatatcagattcacatgtttgttgtggaaattaaagttttaggaatattatgagatcttctataattaataatatactcattaaataggtttatatctgctgttggaaaaaatgtgaatcaaaaagaaaaagagaaagaattttggatataaatttaaatttatcaaaatagttacacaaaaaaagaataacgccgttgatgaatggtgaccaattgaaaacggaagcttgaagatggagtcactgtcctgtcaaataaaaagactttgaaggtctttgtcatgttttttcttcaaacaaataaatacttaaggaaaacaaaagttatctatcaaaccatatatattaaaaaaaactaagaaccctagttgaattaaaaaataaagaaaaaaaaggcaaggtaaaggggaacagaggagagagaaaaaggtgtgaacagttaatggcggagcagtataaggaatcgcttctctctagaaatcttttgccatagctggatttcatttttttgatctctctctctctcttctcttgtaataacaaagctcacaacataaagaaattattacagaacaagcaagcaagaagaagaagaagaagcaataaaaattagtgcttttttatttagtgagagagaaaagctctgaagaagaaggaagttgttttcgagatgcgagctagtaaaggaaccttctctgtacttcttctctttctccttttgattctcattctgcccagtctttaattttttttcctttttcttcttcttctttcttcttcttcaatttcactcttgttgggtaagtcaagaatcgtccaaagtctttttttttttcttgggttgtttggtattggatctgtttcttggttcttttaaagattggctaatactttgattttggggggttttgatttgatctagggtttctagttagagtctgaagacctttggatttgatgtaggactttgttttttgttctaaagttaaaaaaagaagaaaaaaagaaaaagaatctgttttctcatccaaatctacccaccatttttgttgtgggaggtttttttttttattattacaaaaagaaaaatatagagagaaggagagatttgttttaaagtaaatattttgattgtttatg

SEQ ID NO: 28010 - DNA, 3000 bp, Unknown; identical to SEQ ID NO: 9621
  misc_feature (1)..( 3000): 2750-1469P.txt file - cDNA_ID_2993443; gDNA_ID_1972163; Annot_ID_179640

SEQ ID NO: 28011 - DNA, 3003 bp, Unknown
  misc_feature (1)..( 3003): 2750-1469P.txt file - cDNA_ID_2993456; gDNA_ID_1620386; Annot_ID_155462
ttgattctttctccctaacaatgtgggtcttcgagcttggcctctcatgtatgggtaagtcgtacataagtgcaacacacacactttattttgtatgggtaaattcatgattcatgtacctgccataagtgcaaaactgtgtatgatttaagccctacattaccaggaggtggcttaagtcaatatatgtatcatataggattatgtgtgatttgacataatagcatttcagagaaatcttaacataatatatacatgatttggttctaaacttataaattataagacatgctaaaagaagcttattatggtacatttaaacataatcctataaccacaacaaaaaaggataataatgaacctacaatgatgtagagcgagcgagattgcctaccaatatgcttttgctttgcccatttgtgtcggcaaattctggttggtttggatcactttggtatgatgctactttcacgtaatcagtaggtttggccattcagatataaaaacatccatatctgaatacttgatttagttcatttttcttttcatgcatagccggaaatatatcgttaatagattttttgtaaactaaatagaaatttgtttctacagtgataaaataaattttctttaagcttcatgaaattttcaaaaaattattcaatattttagatgttgtacgcttgctactgtagagtattattttgtgtccataactattttaacaatattataaatgagtgagaatacgaatggagagaaacgaaaatcttcaatagataaagattggctggttttgaattctagtcaaaaattagctttattgctgagtgattactcctacaatggttttaaaagcagagattcttcgtaagaagcaaaatatgtaaacgaaagtcacttttattttgggcatcgttctaaagccaaattcaaataaaatatcgacatttctccttcctttgaaatcagcatttacaaaaacgtttgtagaaacacacaaaacatgactaattttgttttcaaaggctatatatgtttgtggctattcattatcaaagatatataagcggtcaccaaaagaattttgcaggtcgaaatgtacttcatatatcataaatgattaaaagtgataactaatcatttttactagcctgaattgaagattattgcaagaaaactttttgtgcaagggaatactaaatttggtaatcttttttatatataataaattaactcgccgttaaaataaaaataaaaaataactcagtaaatttgtattagagagagctatttcagcttggagtatatattgacatggattaatgaaaacaaaagggtaaaagaattgtcaaacgacagcatatttatcattcaagtactcatcgtatagaataattatataacgtattatctgcgccacctaactaagcacaaacttcacgcatgatcgtgatgtatgaaaattccgatctctaagtactaattaacatcaaacaagcttttgttaaacctaatgcatcactagcaactttaatgttataaatatcataatttcttacataaaatactaatatgattcatgccaaaagttatctaattcatatatcatgcgcttggaataatataaatattttcacaacacactttcgtgattgttacgaacatagatcaaacagaaaattcaacatcaaacaaagaaagaatattgaccaaagaaaattgagtatttttggaaaataaatttggtaggaagataagtgggtgaacaaaaatgaagtagatataaattacaaagtgatttaacaatgacataaatgaagtaatatcactaagaatgtttttgcaatattaaaaaaaaaaactttggatattataggaattaggttaatccgcctaataaatgtttggtccaagtccaactaatccaaaactatgttaaattgtaatttaaatttgatacatcaaaacctgtttttggaaattaacctttttcgtcaaaacaagtttctttttggaaaccgttacacggttctggtgattaatagacatgggaactagaatccaaaatgcaggtgttacatcaaacttaagtgatatcaaaaaaagcaaatttcaaaaagagaagaaaaccactaaatcactatgatagtacacatgtcacacattcacaactatgtccaaaatataaattacataatttcgttcatcttatcaaattctgccgcgccgcatcatataacacgcagcatacactatagtgccttttcccaaaaacatactatagtttatttataactagattacatttgataatttgtgataaatattgtgtcaaattggtaggattatgttaatgatattgcttagtagaaaacagttgtatctttttagccttttaggcaagaagatgatgaaaatatgagagaattgagcggtaggcccatctctcttctgttcataaatgagaatcatgctttactctctctccctttttctcattcttcttcttcttccccatttacagcccaattccactatcttcctcatcatcataaattcataatactattgcactaatctcgagaagataaagagacaacaaacacctctctatctctctctttcttttttctttcttccgtttcaaagtttcttccttttgggcgggttttaaggaaattttggaatttctctctttttggagacgtttctttaatttctgggcttcttctagttgtgggttttgttttctacttgtagctactgtgtcacgcttttctctagcgaatactttgatgcttcttcatgactctttaacaagattattctgagcttttcctctggccttctaattattaaagtcttcctttttatctattgttaaggtttggcttcgttgtctcttcctcttacctctgctttttggttcagagtatttgaattttggggaatattaaaaattgcctgatactgaaatcaatctcttgctgtctagtgatg

SEQ ID NO: 28012 - DNA, 3003 bp, Unknown
  misc_feature (1)..( 3003): 2750-1469P.txt file - cDNA_ID_2993460; gDNA_ID_2926261; Annot_ID_143229
atgtagctatttttggacggtcactatttcaacttaacattgtgtaatgcatttatgagtttgggatctgtctgaggatatttatgaagaacttccacatggagaaacatttgtttactaaatgttgatatgactattcttgaaacttaacttttacacaaaagttaaaaactaaacaaaattcaacaaacaatttgtggttagctgcaagatctaccagaagttaggggattaaggaggatgagaggggtaaaaatataatttcgagtgggcaatgaagtggcacgttcacctgtcggcacagtggagaagagaacaacaaaccttacttctctcttgttcacattcataatttgatgaacagtcttcttctctgatgcagaaaccctctccctgaatcttgattctctcacaatcaagatttgaagcaaacgttttgagaaaaatcttttgacaccatcaagtaagtttttatctttcttatgttttttgtggtgtacctgcattgtgcctagttttggtacttgaatcatctattttggaatctagagtattgatctggagtatgattagtcaaatctaggatttttaaggaaaatggtactgagagattgtattatttgcacatatcaggtgttcagtggtagtgatttgatatgatttggtcattgtttgaatgaaagttggattattgttcagatttggttggcggattgtgggaggaattccagagcaatatagcaggtgatggttgtacaacaatggctaagaagaagggcttgttcactgtattgaaaaggatttttatttcagaagttaattcagaaaaggtgaagacaaagatgttaatctcattctaatgctgattgttgtttctgcatcttgtttgattcttcttgtgtacttctgcagaaagagaagagaagaaaatggacattttggaagcttaggattaagaaaagattaccttccattacagcacctccagagcacaggacaagtcatgaatcgcatgaggaacagaaggaggaaattgtgtcagatgtgggtgagatcagccaagtgtcttgtagtcgacagttagattccatagaagagtcaaaaggttcaacatcaccagaaactgctgatctggtagtccagtatcaaatgtttcttaatagacaggaagaagttcttgctgctactcgcattcagaccgcctttcggggtcatcttgtaagcttgtcttacccttttcttatgaagctactgaaagaatcgactcattttcatactggagttatgtagttaccttgtagctgtgttgactatagttgagtaggttaggtagagagctaagacgttgaaagtaagtttaggcagaaggatttggggattctgaattagtttaggatcttggtttgggcagtaatatatacattttgtctcctgtgtcagtcacctattaagtcttttgagaaccagatgtgaatcttttaaagcgatttctcttcttcttttattgctggattttgggttgatttttcaggtgacatgctgacaatgtttttgaacttcattgcaggcaaggaaagctctacgtgccttgaagggaatagtgaagctccaagcatatatcagaggtcgtgctgtgagacgccaagcaatgactacactaaaatgcctgcaatctgttgtgaacattcagtcacaagtctgtggtaagagaacacagattcccggaggtgttcacagagattatgaagagagcaatatattcaatgataacattctcaaggtatgtcttctgatctaaaaatgtaaactcgttgccaacagtgcagcagtttattagtatgtattgttttcaggtggacacaaacggtcaaaagagatgggacgatagtcttttaacaaaggaagaaaaggaagcagtggtaatgagcaagaaagaagcttcactaagaagagaaaggataaaggaatatgcagtcacccaccgggtacttcctatgcacttgtttcatttggctttttattgctttacaagtttcctagtattgacttgaaactgatactttgtcaacatcagaaatctgcggagtcataccagaaacgaagtaacactaaatggaagtactggttagacgaatgggtagatacacaactaaccaagagcaaggagctcgaagatctcgacttctcttcgaaaacaaaaccgaaagacgaaactttgaacgagaagcagcttaaaactccaaggaactcatcaccaagaagattagtgaataatcatagaagacaagtttcaataggtgaagatgaacaaagccctgccgcggtcactatcactacaccaacttatatggttgcaacagagtcagcaaaggcaaagtcaagatcattaagctccccaaggataagaccgagaagttttgacacacagtcagagagttactcgccatataagaacaagctatgcctgacgacatcaatgatgagtgaagcaccaagcaaagtaaggattgccaacaatggcagtaacactagaccaagtgcataccagcaacggtctccagggttaaggggatttaacataggccctttgaaatcatgcaataataataatactctattgaacgatctcagcattaattcagaaagatctctacctagctggaacaagcagagcagcttgagatgagtggatattgaaccctgtatatatacatactacatacgttccaatgtttcttttgacttttgagggtcacactcacatatgtgtatcatcaaatattgtttcgtttttttgtttacacttgtttgtttatctcaacttcaaaattggctaatcataagatattgtcattttggttgagtaatattacaagacaaaacataggttattgtaaccaaaatttggtaatctattggtttcttctattaaggaccagcgtggctcaagcgacaccgttttggtaaggaagaaagagcaaaaggttggagaaggaagatatg

SEQ ID NO: 28013 - DNA, 786 bp, Unknown
  misc_feature (1)..( 786): 2750-1469P.txt file - cDNA_ID_2993463; gDNA_ID_1564533; Annot_ID_149617
aaaaaaaaacmaataaataatcmaattttactgaaataaattgtaatgatcaaawawatttaagcattgaatttttttgkgtagtccyaaagktkaatyttkaaaggcygctgatcytaawttgtcyttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatttatttatatatttaatgatgaaaattgtaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactatamcagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatg

SEQ ID NO: 28014 - DNA, 3003 bp, Unknown
  misc_feature (1)..( 3003): 2750-1469P.txt file - cDNA_ID_2993463; gDNA_ID_2684240; Annot_ID_192556
caaacattagtttacatataaaagtaaaacaaaatttcaatagtaactctaaaaatagtcttcttgtgaatacttttatccatttcctctttttctaaccaatcaaaattttgttacctaacaaaaaaaataacggaaattttctattgggtttcaagtaaataagagaagctgaataaattttacaaaaggaaaacaaatgtttttccctatatatgtactaacgaactaaataaatcaataattgcgaggagaataaataatgatccgagggaagatctcattggcatacaaggcacaataagaataagcaaggaaaggcagtcaaaagaagtcgaatattatttgtctgttagaaagcataatcctaagttcccatcattggctcatagagaacatataatctttctccaatgatttgatgtctcacactcactagtcactacttttacttttcacattttatatgccatttgcttgcgcaaaaatacactgcgaatgaagtggttgtaatttgtggtttcattagtttgatcgatcgacataaaacgatttgtaacaatagatccaaaacagttgcaagtcgatcgataactagtatgggttcaagtccatgaaattcaatcacagctttgcggaattcaattgcttagatttcttgaagagttttgttaggaatttcatgtctcaacaagaagaaacttaaaataacacataacgaatgttagctaacataaacatattcacgttgtaaatgcattacgttttaatcttagaaattcatgaatgtctatattcttaaagaataccataaatttatcagtacagattcgacatcccatcaatcattcgcatagttatagctctaaagatctatccagtacaatcatatcaaacaaagaaggctaagacatacgaatggacatgatagaacatgaacaacaaaattttgttttccactagagcatatgttctcatagcattaaacctttcgaataagcatcttctcaatactatttagcctcacgagggttataaattctcacatttccctactgacttctcaccaaacaaaaaaaactagaagaagaacgatacataaactatgctcacgcaagaacttgcgcgcattatggggggtgacgatgatgagtattggtgaggaccgggtaatctgcatcctgaggtttaaagcttaatttacgcaggaaatttgtatacgcatatacgtatgtgtattagtataccttttagtcctcgggatgcggattacctcgttcttacttacaatacacgtactcggagacacgattactcatcatctagaggttggttttgatcctccatttcttctaagtttaaacatcattaataagatatttaagactgaatatcaccacacatatatagagtcagtctcatagatgatgaattggtaatattatatgacactactgacttaaaattattatcatataatattactaattatattaaagttttttttcgtcaacatacacactagttaaaaatttgaatttagaaaagttcaattgatgactcatttcaggaatgctcgaaacaatggcaacgacgcttgtgtatgtttgaattagtgatatatccgttttattcatacttaattaaactggtaactctaactaatacgctgtatatttacctttttgtctagtgaataaaaaaaaatcacgacgacctagttttatgtcttttatctattgctcaaaggtcgctcattgcctttgactaatatgtttagacttgtgatttctgctattcaattaaattaattaactgcgtttattaaatttcagttaggtgactcataaaaagaaaacatagattaattaagttatatatatagtataatgatgtacatacaaattcaaaagtactatggatcttgctttgaaaacgagtcagtcaattgattttgtagatttattcagttttcatagatgtccaacactggaataattgttgataatttcaggaaaagcatatgttaaaataatgctaataacaaaaacaaagctagtgatgtgtatcaaactaccaattgtgcagagacaaaaacaaaacgccaaaatgctgtgttgtacccttttttgtcaactgcgtatctgtttttttttcagtataaaaaacttaagaaatctctaaacctaattattgagagtaaaaaaaaaaacaaataaataatcaaattttactgaaataaattgtaatgatcaaatatatttaagcattgaattttttttgtgtagtcctaaagttgaatcttgaaaggctgctgatcttaatttgtctttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatctatttatatatttaatgatgaaaattgtagtttgataaaaaaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactataacagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatg

SEQ ID NO: 28015 - DNA, 3003 bp, Unknown
  misc_feature (1)..( 3003): 2750-1469P.txt file - cDNA_ID_2993463; gDNA_ID_2684240; Annot_ID_137757
ctttgaaaacgagtcagtcaattgattttgtagatttattcagttttcatagatgtccaacactggaataattgttgataatttcaggaaaagcatatgttaaaataatgctaataacaaaaacaaagctagtgatgtgtatcaaactaccaattgtgcagagacaaaaacaaaacgccaaaatgctgtgttgtacccttttttgtcaactgcgtatctgtttttttttcagtataaaaaacttaagaaatctctaaacctaattattgagagtaaaaaaaaaaacaaataaataatcaaattttactgaaataaattgtaatgatcaaatatatttaagcattgaattttttttgtgtagtcctaaagttgaatcttgaaaggctgctgatcttaatttgtctttttttttttgttcgtgcaaagctgctgatctttgttattgtctcatatgtaagtggttagcataaaataatattaatttcttgaatatgcgttgtatattttggtgaccatatacaactacttacatcgatcttgtaagaattgcacatagtaaagtaaatatatcacaaatcatatgtccgataacttcatctatttatatatttaatgatgaaaattgtagtttgataaaaaaaataaaaaaaataatgatgaaaattgtagaaacgaaagtattttaatcgtaaaatggaaaaaattgttagatttttattgatcattttttggtagttgctatactgtttataggttttatatttagttgtggaaataatttataactataacagaatagattattcatgtaatgacatagaaacagttgttttcacttttcttgttttgtcttggtgccgtggtagattttgataataaaattagagtgttgattaatttatatttgccaaaacaaaataaacaaataaataatttcaagttgaccaattcatatttcttgatggaaaacactgatctcttctcttctattctttctttctcttatgaggaattttcacaatctttgatcatcttctcctttattctacggaagaaatctatatattctatatatggaaaacatcaaaaaccctaaaaacgcagatgattgttccgatagcatatcaaaaaacagtcatcaaggcgttgatgattccctgaaccagtcaagatcttacgtatgcagtttctgcataaggggcttctcgaatgctcaagcactaggagggcatatgaacatccacagaagagacagggctaaactcagacaaaagcttatggaagataataaggatgatgtcgtcgccgagagtgatgcatccgaagttgtgtctctagaccttaatgaacaacaacaacaacaaggagaagctttgacatgtgatgatcacgatcaatatgttgataacgatataagtcctaaacagaaattagagttttgggttcaagaaagcaagcttgatactaatgatcatggaaaggtcacggaggctagcatagatggttcgagttcgagtcatcatcgtgatattgaagtattggatctcgagcttcggttaggccaaagcgtcgtaaagaagaagacaacatagtctctgaacgatgaatcatatattgattgcattgtatcaatgggaaaatccctatgaaacaccaaactctctaatccgtctattacaaatggattcgtggctcaaattgtattgtaaggtatgcatttgtatcttattgctaccattatcgttgttgtaccttgtattgatatttgtttccttgcttgggttaatttcaccaacaacttttgtaaatgacatacacgtccaaacaaacaaacatatatatagaaattatatatatttggtgtttgctttatagttgtttagggaaaatgaataactaataagcttaacttagctcaacattattgatctggtcatggtagagactattcaaacttgttcactgagaaatattgttacagttgagttatatattggtagtcgtcctcagattttcgagtaagcatttgccaattatgactcttatattcgagattagcactcaacatttaattatatgttagcaaatagtataacattagctagcaaacttataaacgataaatttgaccaaaacaacataaaccaaggtcactttatctactttttgttctctgaattctgaaaacgaatttgaatatcgtattctaacagtgaatattgcatttatactaaaatttacgatcatagccataaataagtagttatgtatagtcaaactatatgtagttatacagtactttaagacgtttgaaccgctaagattcccataatctgcatgataatataatgtatgtaaactgatacatgcacaattgcacatgataaatataactaaattgatacatgccgatttgcgcatgataattataattatatgctctataacatgttaggatttaaaatgaaaagagcaaatggttcaaggctgcaacttggtgacgccaccaatgatgaccttttacgtcttaaccacgttccggtttggttcgagaacttgtttgagatccgctttggatctaaattcagattggttttatttgagatgccgtggaaaattggataatttccaccagagatatatgatttaattaattggattttggattcgattatagtaaaccgataatagtgaggcagtaacgaacaaaacaacttcaaccggatcattgggttggtttagtttactaattgaaccggtttgataatgtttaaaaaataaacaagtgacaacgaagaccagcaggtccagcacacgatcctaaatcctgtgagcatcgtctccatcgctggtcttccattattgacgaatctctttgcctttttttcttccttcttaaacaaacccaattcgatttcaacgaacgcctcttctctctcactctctttcgatttgttctttgccggagctcgtagtgtaagcgtgatccgcggcggagagatg

SEQ ID NO: 28016 - DNA, 3000 bp, Unknown
  misc_feature (1)..( 3000): 2750-1469P.txt file - cDNA_ID_2993532; gDNA_ID_1621100; Annot_ID_55830
ttttcactgagctctctctcgggtgcaaagatagcaactttttaaaggttacagctttatttttataaacagactgcatgtcgttttctatttaaataaacgtcaagcagtgcggttactaaataggaaacgacatagagattgaaatttggcgacaatacaggttgatgcatcgctggatttgctggaaaacaaaccgtcaatctccgtctttatagagaaaaaaagattctcttctcttctcgttctcatcatcgtcttaaagaaggaattcgatttttcgcctgaacctgcggatttttcgattcttcaaattcaatgtcttatgcttatctcttcaagtatatcatcatcggcgatactggtaactccttctctgctacgttatctttcttcaatccatttggaattgagatgatcaaaacctatatatgtttcgttgcgaaaattgaaaagcgaattgatctgaatctgtgtcatatccaactttttttagtggatttaggggtcgagagaagctttggtgatgttgatttttgtatattgattctgattttcaggagtggggaaatcatgtcttctgcttcagttcaccgacaagaggtttcagccggtgcatgaccttaccattggtgttgaatttggggctaggatgatcaccatcgataacaaacctatcaagcttcagatctgggatacggtctctttctccttacttcttcaactttcatgatgtatctctatcttgttttcatgaatacctggattggtttgtgcacatcatcatatatgctttgattttctttgactaggcgacttggctattctgaagtttcatatcctttgtcttggctaatatctctctgtaatgacaggctggtcaagaatcctttaggtctattacaaggtcatactatagaggagctgcaggggcattgcttgtctatgatatcacaaggtaaatcatttgcttctttctgtatgtttatcaaaagtagagttgatcagggaagcaaattattttttttgtgtaagtagtaactagacgttattcttcttttctagattggagttcgactcctaaagatctgaaccagaattagatttgtgtttttgaatttataactgtttcagtcaagacacttacgatattttttacctccgttttttttgcaggagggagacatttaaccatctagctagctggctagaagatgcaaggcagcatgcaaatgcaaatatgacgataatgctcattgggaataagtgtgatcttgctcacagaagggcagtgagtacagaggaaggagagcagtttgcaaaggagcacggtcttatattcatggaggcctctgccaagactgctcagaatgttgaggaggtaaacccccatacgttccaatgtggtatatttgccaattacccaattacttaacatgatttcgactggtgttgtgattttttgctaggcattcattaagacagctgcaacaatatacaagaagattcaagatggtgtgtttgatgtgtcaaatgagtcatatggaatcaaagttggatatggaggaattccaggaccatcaggtggaagagatggatcaacctcgcaaggaggagggtgctgcggctgagatgggaaaaatatgtctatgtcattatgtaaaaatgatcacatatgatatagcaaaaatgtctctgcttctttctatagttgtaaatcgttttggaattcgatttggtgactgtgttgtggttggttttggaacggtttgacaatacacgtgtatgcctattcatatatctaaaaattaagatgtgtttgcgtaaggatctaatggaggtaggaatgtagcccatttgcattgtactggaaaaggtagtaaggatataaatcatatcatgaaggtaagttcagtgtttgtggagaaaattgtattggctgcatgtggttccatttaccgtgttatacaacaaataaagtaatccctttagcttttgtcatgatgaacgatgccttccatgtctttcatggtttactcgtttaacaaagccctccttcccgctatttcgtgtctaggtttttgcagttgtttcacatgatttcttcttcttctttactagagtctattggcttttgttccgcgtgctgtcttgtctttcaaataaaagcctaccaaatactgaaacgccagcaagtttgcaatggtcgacaatacaggttgatatttctctggatttgctggaaaaccaaccgtctttgagtgtgaaccagaacagacgacaacgaaattgaacaagggggtaaaatgagctcaagcaatcataatattggaccagaaagacatgcaaattgagaaaaggaacaaaaagccaaagtcacaaacaaaagaaactgttttatcttacaacttacaagggctatgacaagttattcggaggcctgaggcaaaatttatattaagatttttaactaaattttgccaatcattattaaacttttttttgttagatctttatctattttatgattaaaattataaaatcactaaaaattgattatcatttatttttaaaattgttaatttagctaactagaaaaataatagaggataatttttttaattttctatatttttgtactttttgttatgttgaaatttattaattatatattaaattttatcaaaggacctttttttttttttttttgatccaaatcatgggaccccaaataagaggctattgccttatttaagaagaaaagaaatggcacgtatcaaccttcacaacagactcatcaatctccaatcattgtacaatcatcccaatggtgagacaccaaatctctaagtgacacaatctagaagtttctaagactctatagaaacattcaaaaacgttaaaagtgaagacattgtcggattcttgaccttacccatcaggagaagaagggattcgtttttgtctgaacctacggattcagattcgtccacttcaatg

SEQ ID NO: 28017 - DNA, 3000 bp, Unknown; identical to SEQ ID NO: 28016
  misc_feature (1)..( 3000): 2750-1469P.txt file - cDNA_ID_2993532; gDNA_ID_2926167; Annot_ID_139969

SEQ ID NO: 28018 - DNA, 3003 bp, Unknown
  misc_feature (1)..( 3003): 2750-1469P.txt file - cDNA_ID_2993537; gDNA_ID_2684224; Annot_ID_191900
tagtgggaattaaagcttttatttggggtctgtaataagtaggcgagataagttactcttactctttgaaatctcaaaaccaaaataaaaagtgggaacttaattatgacaatatacatggttcataaaaatgattattcttgataaatgaaccaaccataaaagaaggaactaacagtattccacaagaaaatcagaaatcaagaaatgaagaaaaggagccatgacgtgaaggggaaggtagggttaattaggcggcgtagatgtggatgtgaagggcgatgagggagatggtgatgaaggcgaagaagaggagagtgtggatgacaatggaggggccgcttgtctgaaacccaccgaactcaaccgctttgctctttccgggcagctgaaacaaaactccagggctcaacacgatgaagaaaattaccgacattagcaccggtccccagtccaaccccatctttgttttctgtttcttctctagctataatatacgtctctctataaacatctaccactttattatgtgcttatatttataatgtacgcgtaaatgtgagaatgaacttgatgtcaatacgattaattaataatatatatgtggcttgggctggacaaaagtggagggttcttctcaagtttgtgggatgaaggaaagaactattctctgatatagtattttaaattatctgtacaaaaaaataattaaatatctagatcgatagtattttgcttgttttgaaggccaagcatatgattctcctcctcttcaggcatttcaattcataagcaagcatatgattctcctcttaaggcatttcaattcataagccaacatataacaccttacgttcttgctccggttctgagtttaagggaagtccatccgcttctgacggatgtaataatattcatgcaacatatataagtcatatatatactgaagtaattttaaaacgtcaatcgcaaaaataatacacaatacactaattaacgccataatttttatttttttaacaccataattttattatgcactaacgcggttattaatcaaatcacgtagtattagtaatgaaatagggataagatccacatgaggaaagcaaaagaatcgaaaccaaaccaataaacgcaatcaagtatcaaacactttaactttatatacatagccactaaatgtatatatccatccaacaagaaagaaagatactggtcaagtctcaatctgccttcttttgtcatccttaaataatctcaatagtttctgaatttcaaaaaagtacacaaaacacacctattatcacacgtacaatatatatataccaagtgcattaatacacttgtgtgtgtatatgtaatattgttccaagtagtgctttgacacctaataagacgatcaaatctttttggagctctaattgaggtagatatgggaggagcggactgggggccggtggcggttgcggtggtgctgttcgtagtgttatcgccggggcttctgtttcagttgccggcgaggaggagagtgttggagtgcggcaacatgaccacaagcgggatctcaatattggttcatgccattctcttctttgctattatcacgattttggtcatcgccattcaaattcacattcacatctaacatctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaaatg

SEQ ID NO: 28019 - DNA, 3000 bp, Unknown
  misc_feature (1)..( 3000): 2750-1469P.txt file - cDNA_ID_2993537; gDNA_ID_1972047; Annot_ID_178260
tgggaattaaagcttttatttggggtctgtaataagtaggcgagataagttactcttactctttgaaatctcaaaaccaaaataaaaagtgggaacttaattatgacaatatacatggttcataaaaatgattattcttgataaatgaaccaaccataaaagaaggaactaacagtattccacaagaaaatcagaaatcaagaaatgaagaaaaggagccatgacgtgaaggggaaggtagggttaattaggcggcgtagatgtggatgtgaagggcgatgagggagatggtgatgaaggcgaagaagaggagagtgtggatgacaatggaggggccgcttgtctgaaacccaccgaactcaaccgctttgctctttccgggcagctgaaacaaaactccagggctcaacacgatgaagaaaattaccgacattagcaccggtccccagtccaaccccatctttgttttctgtttcttctctagctataatatacgtctctctataaacatctaccactttattatgtgcttatatttataatgtacgcgtaaatgtgagaatgaacttgatgtcaatacgattaattaataatatatatgtggcttgggctggacaaaagtggagggttcttctcaagtttgtgggatgaaggaaagaactattctctgatatagtattttaaattatctgtacaaaaaaataattaaatatctagatcgatagtattttgcttgttttgaaggccaagcatatgattctcctcctcttcaggcatttcaattcataagcaagcatatgattctcctcttaaggcatttcaattcataagccaacatataacaccttacgttcttgctccggttctgagtttaagggaagtccatccgcttctgacggatgtaataatattcatgcaacatatataagtcatatatatactgaagtaattttaaaacgtcaatcgcaaaaataatacacaatacactaattaacgccataatttttatttttttaacaccataattttattatgcactaacgcggttattaatcaaatcacgtagtattagtaatgaaatagggataagatccacatgaggaaagcaaaagaatcgaaaccaaaccaataaacgcaatcaagtatcaaacactttaactttatatacatagccactaaatgtatatatccatccaacaagaaagaaagatactggtcaagtctcaatctgccttcttttgtcatccttaaataatctcaatagtttctgaatttcaaaaaagtacacaaaacacacctattatcacacgtacaatatatatataccaagtgcattaatacacttgtgtgtgtatatgtaatattgttccaagtagtgctttgacacctaataagacgatcaaatctttttggagctctaattgaggtagatatgggaggagcggactgggggccggtggcggttgcggtggtgctgttcgtagtgttatcgccggggcttctgtttcagttgccggcgaggaggagagtgttggagtgcggcaacatgaccacaagcgggatctcaatattggttcatgccattctcttctttgctattatcacgattttggtcatcgccattcaaattcacattcacatctaacatctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaaatg

SEQ ID NO: 28020 - DNA, 3003 bp, Unknown; identical to SEQ ID NO: 28018
  misc_feature (1)..( 3003): 2750-1469P.txt file - cDNA_ID_2993537; gDNA_ID_2684224; Annot_ID_137535

SEQ ID NO: 28021 - DNA, 3000 bp, Unknown; identical to SEQ ID NO: 6891
  misc_feature (1)..( 3000): 2750-1469P.txt file - cDNA_ID_2993545; gDNA_ID_1621111; Annot_ID_56092

SEQ ID NO: 28022 - DNA, 3003 bp, Unknown
  misc_feature (1)..( 3003): 2750-1469P.txt file - cDNA_ID_2993558; gDNA_ID_1621144; Annot_ID_56701
ctatcaaaatctctaaactaatctctatgttcagtttttgatggtttattatcaagtatgtgtctttgtaattatcttctcttctaagattgaatcatcacaatgtttttgaattatttgattttcattgaatatttcaaccaaccaaaatgttttcgttctagaaataaagtcctaaagtgacgtacattcgttttctaatgaaaatgctatttcataagttattcctttcattttttttgggtcgtcaaaacataagttaatattctttttttatttgactaaaactacttttccaaaattttcaccggggaaaccttctcaaagctttatgagcttaaacatatgcaaagtgtctcattaacttaaataaatatagagtacaattaatttgttcacaacgtttttaataggaaacttagaatatgttctgtgatgcactatatgttgcttcgtaaggaaattgcatgcgaaaatctagtggaagaaatttagttaaacggcaaaaatcttcaattaatcgtttcctttatctacattaccaaaaggttgcgaacattatgcgacatatggtggttagaacttaatacactaatgtttttcaaagatgctatttgtggagttgataaagacaaaacatatttgaagaaaataattttaaacatgtagtgtttaggaacatcacggcttcatagatatagagtcaacttaatatgttacaatgatattgaaatatgttctctaaactctaaaaggttctacctgattttcttaaacaatgcatcttcgaaagataaagaaaatatatttttctattttctctttacatgtcaatgcttactatatcatcttacgatatactataaacgttttattcataagtaaaagacaagtggcagatacgttaaattttataatagaaataaattagttaaatcttaaaaagttgctgaaaatagaaagcaaactacttatcttaaagcaaacgtaagtctctttaagaagaaatacaaaatgaatatatatcggattaaatcaaaaaacaaaaagatacacttttgtttttctgaacaaatgaaaaatgatatacacaagtggcggacaatccatctatctcattttagcgaacaattaatcttgtctgcgactgcgacctatttttttctacatcacatcttttgtttcgtatgaacactaacatgattgaatgacaaaatttactaacaattcttatagtactgagctctcctgtccaatatttaaaaatgcatacatttttttgtgtgtaactaaaattagtagaaaataaatgctagtcgttaaaaagtgcatatagcagatttcgagttttttttaattgcgatttcgattatcaatggtcgatcgtagacgtcttttttagtaaacaaatctgaaatttctatgaaggttaccaaatattttggatttcaacctaagatgaagttaacctatggacgtgtagaacagtggctgaagtctgaaatgataagataaagttcaatatgaatacattactgagatgttacaaaaaactacatcactgaataattcctttattttccagtttggacagtagaacctatcgctaattatttaattaccaattaaaagaaaaagaaagaataattcctacagttgttaggctatggttataagtttcatctttgaacttaagaaatgctctaattagtggtaatggtagttacatctatatatgttgatgcaatgtcaaaaagaaaatctctcaaattagcaaatccatacctatttatagacgcataagtatatataccaattatcctggtcgtgcaaatggatggttagtatttttacaaccaaactaatgtctaattttaaaaagtaatcattattttgctttagatttttaatagttaatattatatgtatagatagattaccgtatgatataattgtttcaagacactagatactatctcaattataaaactcacttttccataatatggccgcttgtttataaaaaaagaagagaaataaaacaattgatttggtttatattatttaattgcagatatcttgtacttaattcattttgagataattttgcgtatttgagttcggacattggtaggtatggacgatgaaaataactgccttcattctacatgtttgagatttgtttgtcgaccatataacacaagcggctagaaaaataggtgactattctcaaatgtcctggttctatctaacctgaaggatcccttgttctacctggtataactacaagaaaaggctgttttataaaatatatcatttcttctatgatttctatctcaactttttttttagtttttttcttttagaacgttttcgctttcgaattttttaagaattttttttttctttatatctctaaataatagttttaaaaacataacaagtgatactgtaatttttttttctctataaacttggcggtaccctacttttttcttatttttattaataatcttactttgttatgataaattatgttaatatatggcaaaactaaatatatatgaaactactgattactcattatcataattaatatctttgtataaaagtaaataatatttagtcgagagaggtatcttgttaaaggaaataaatcaaaaattagtggctaccaagtgggagatataatttggaatatttccagtgtattagtgtggtgggtttggaataccacaaacagaaataaaaagaaagaaaaatatgaaataagacgacaatgtgtgatgtacgtagaatcagttttagattctagtacatcaatagacaagaaaaagattgtggttatgatttcaccgacccgagttaatgcaaatccgaaacagtataaatatgtgtagagggttcatgcctatgatacaaattaaagaagcagaaacaaaaacaagtaaaacagaaacaatcaacacagagaaaccacctgtttgttcaagatcaaagatg

SEQ ID NO: 28023 - DNA, 3003 bp, Unknown; identical to SEQ ID NO: 28022
  misc_feature (1)..( 3003): 2750-1469P.txt file - cDNA_ID_2993558; gDNA_ID_1621144; Annot_ID_172944

SEQ ID NO: 28024 - DNA, 3003 bp, Unknown
  misc_feature (1)..( 3003): 2750-1469P.txt file - cDNA_ID_2993569; gDNA_ID_1620742; Annot_ID_49641
cggtttaaagaagcagtggagttcatggaagcactcgcaggaacttggccctcttgctcatccttcatgtaaagcattccctcttacctgaaggctctcacagattatcaagttcttctcttattgttaacaatccctgatatattatttttttaacatgtccataattttcaggtatacacacaattggtggcatgttgctctctgttacttagaaggagggtccccaatgagtaaagtagaggagatttatgatcatcacatctggaaagaattggagaaagacgatgctgttcctcctgaagtaatcctctttttgattaacaaatttatgcttttgcgtcatctattcaatattcaactgtctgcaactctttaggtttatctcaatgcattgggcttgttgatacgtttagatgtaagagatgctcttgatggttttgaagaccgtctcaaaaaccttgcagttcgtttaactaatcaggtaagccatacactagttttatatcatcccaaaacggttgcagttatacgagttatcttgttgaataagtttttatttttcggccacttgctttaacatttcaggcaaactggtatttggagtggcaccttgatatattgatagtttgggcactagcaaaggttggagagacttcaagagctcatgaattacttgagggccttaagttccggttagtgtgactttcttttattctgcagtttctaaatgataccgaatttgtcatgaacttgtgttgttcttgcagattatcaaagaagaacaagaagaagcaacaagtgatgcagaaagggattcaggtttgtttattccccctccctctttgatcgtctttctttatcattgtaactagtactcaatatcagtcttgttttcatataagcttggggaagctgtgtatgaatacgcaaggggtaactacgaaaaggctctagaactactgggttcagagttcaacgccattggttacaaggtaaaccgttcttcagcgacttgctcaaaatactctgaatcaaacacatttctggtggatcttttaaactgttttatggttaataatagatcgttggggcatcagacgaacaaatagatgttttcaacgaaatgtggtgccagctgctgctaaagacaggccaatcctccacgggtaaggcttgttgtagagtcttactaatttggatactcgtcttgcttagtatgatgataaacaatcgtggttctgatgtatgcagccaaagaagtaatcagagagaggattaaggccagagatggtattcctttcatgtggcgtttgctggtatacattcaaaagcagaacatcactttgttttagtgtactatatgtgtttttgctatgagaaaatgatgtcgttgtggttgcaggagaaaagttactccatggaaggcaatgcagaggctgagagtagtgcacgagagagagctaagaaacttgaatcttgttatttctaactttgcttcaaaaatccaataatgacatgtgtgtatacatgtttttaaataagtatagaataaaatattttgctactcgtgtcctacttttttgtttaccaaaaggtaaatgaataagggggtgtattgaaagtggaagtttaagagatttgtgtagaatttataaatcctatgttattcaaacatgaattttaaaaagtttcatgaaattcagtgttattgaactaatgatttaaaaatccaccttaaaatccactgttattaaaaacaatttgtggatttgaattttaatgattttggaggatttgagaggatttctttagttaaaaatacagaaatccaaattccatggctaccgccagtggtgtaacaaactgtggaatgctgtcagatttgcgatgatgaagcttggcgatgggtatactcctcctgtgcaaactctacgccctaaaaccatgaccttcagctgccaatggattctttctttactaacaatatcgaagacagtggattccttgaatgcgtttgcattatcggatgctgccaacagtgtatgcttggtggcaataccagttctgtgatgtatttatcgaggcaattaagccttatttttctgctgacactcaaagaaggattcatgcacaagatgctctctgggtgtgtctcgagactggtttgagattgctgcatccatttatgccttatattacagaagagctgtggcagcggttgccttcatcgcaagactctgaacgaaaggcgtctatcatgatatgtgactacccatcttccatagagatgtggacaaacgagaaggtggaaactgaaatggacatggttctagcgaccgtgaaaactcttagggcactgagagctgcagagtcgctaaagagacagagaaatgaaaagttccatgcgtttgctctgtctggaaatgcattaacactggggattgtgaaaccacatgagctggagatcagaactcttgcaaatctctcatcctttgaggttatgttgaggggagaagacaaagcatttgtagtgtgttgggaggaaattgaaatttggattagttacaatgtgctttattttattttatgtaaactatgtccatcgttttgaatatgacggattcgatcatggaaaagcaaacttaggaatttccatgtttcaaaaagtcaatgcatccatacaaaaagttatactacatgaattaagaagtgttgtgtatgctttagcactaactatgttgtaactaaaagctaattatgctttagccgacaaaagaaaagaagaagcttactaattctctccattgtcacgaaaagaatctgtctttcaaacttattttaacattgtggcattagaaatcgaaattcttgacgttttcggtttgtataagagccatgtcgctataatgtaatctttctctccgggttcacgtaaagaatttctctgcaccttttccatctttcaaaactttaatttcgaagaggaaataatcgaagatg

SEQ ID NO: 28025 - DNA, 3003 bp, Unknown
  misc_feature (1)..( 3003): 2750-1469P.txt file - cDNA_ID_2993581; gDNA_ID_1621084; Annot_ID_55344
ttttaatccttaaagagataaattaatttactctttaaaattttatttctaatggcatacctatgtaattacttacaaaaattaaggttacatttaaaatgtacttcccaaataatatagtaggatataaattataatctactgatcataacgcttagtttatagtacttatttgtattagactttcattgtacatgggaaataaaatcttaaaacaatctctaaaccgttaaactctagaccaacaacgaacccaaaaggccaaatgcatttatatgaacaagtttgattactagttccaccaaatttctacaataagtttccttgagatattccatagtaatttgaagttgatttttaattgacatttgttgcattataaatgagtaagatacgccatataattgttgaaagacctaaagcgagtttgagatcattaagataaagaggtagtcataaatcgtttatcgtcaaggtcgacgaaaaaaagaagtaaagtggtcatattcgatttctgataggtatgtaagagagagattaaatgctttctaaaattttatacatgatttggacctcttatctaatatcattcactcaatttatggacgagaacataacaaaaatttaaatacttatcgaagaaggaagaaaaaatatttagcaacttggctttaaaggttattccacttgtcactattcaaagattcgagttttgagcctttgagtaataccttggtcacccttatattgcaaccacgtggtataaagattgtaacgctttaattccaatgaccccttattttgtggacttttgtcatcaattgtaccaagtttataaagatatagaaactgagggcgtatgaattgtttcaagctagacatcaacaaaaaaaatgttatccactttctcaaatctatatatactaaaggatgtgtatttaatctagtagtttaaattatttgtgtaaaatttacaaactttatgttatttaattatagattttaaaaactttaatgaaatccaatgttattaaactaataatttaaaaattaactttaaaatcaattgttattgaaaacagtttgtggagttgattcttattcatcttgaaagatttgagaaaacttctttagttacaaatacacaaattcaaatctcatggttttagatagaatttgaaaagatttctataattttaagaaagttgatgtgattaattgtacaatcttttcaaattccatctacaatcatgagatttgttttcaataacagttgatttaaaagtaaattttaaaatcgttagttcaataacacttgattttaatagagtttttaaaatccatgattgataaattttacacaaatcacttaaaatactagattgaatacacttctacaaaatcatcaaaatcatataactacttaccctccccctcccacccccctctaaattaaccgtcattttaacaaaaactgcatgtaacaaaactttcaaattttaccgaatgtgacaaaactttcaaaactgcatgtaacaaaactttcaaattttaccgaatgtgacaaaactttcaaatgggacaacactttcaaaaacagcaacatttaccacatgtcacaaaactttcaaattttacttttatactttcacgtaatctaattctattaccactttgttagcaaccactccttccccatgatctcaaaatgtatcctctcctctaaactttcttccacttttttttttataagtaattgtaacagtcaaacagatgcattaacttcttctttattgctcttctttctcacaaactcagaagatcttccattttttttttcaaaatccaactaaaggcaattatgttttattttgccaaaatattttgatatatgatgtaatttggcatttattttgtatcagcatagcaggggcggccataatcttagtatatgcatataattgaggctgctcttaaattttagcgtatttatattgtagtgaattctttgtcttgtataatattttggatgtaggacctgaatgttggtacatgaagacaatctaatatttttaaagcagttatcattaagcatttaagcaagtaatgaaacacaacaacacggtagaaatttaagcaagcactttgatgatctctctccttaactcaaaacatctttatagtattgttgtgtttcattatttgttctatgttaattgctttacaaatattacactgtgtccttgtacaaatatttaggtctaatgctaaaactaatttttcttttgattcgcaacactcaaaataaaaaactgatcgaaagctaaccttatgttatactctctgagttctgacacaaacaagagaagaaaagagaggaaagtgatttagatgctttgatcgatgatagaatgagaagacaaaagcttgactttatagctaaagatcaacgtctatgccataaagtcaagcataattcacacaatatataagttgaacatgctatcaaaataagcttactacattggtgaaattatgcatgtgtggatatctcaagaaatatgcatgagatgcattactcttcttttacgctttgtgatttaagatattgtatgccaaatctatgtgttgccaacattgatttctataccaattggttgatacaatgactggaatttatcctttgatttgccaacattgatttctataaaagttaaacaaactaaaaataaaaagggaaaaatatttaataaaaaatgtacaatattaaatttccataaaaattttatatggttaatgttttggattagcattagtccccaaatcccatattaagtaaatccattttgagttttgttctcgcaaaccggtttaacccaagaacccaaagatctctctctatttgtttgccttcttctttctttctgactcaaaccctcaaatcaattctcgcgattaagcaaaaccctagatttattctactcttcgaagtcgatttcaatg

SEQ ID NO: 28026 - DNA, 3003 bp, Unknown; identical to SEQ ID NO: 28025
  misc_feature (1)..( 3003): 2750-1469P.txt file - cDNA_ID_2993581; gDNA_ID_1621084; Annot_ID_170460

SEQ ID NO: 28027 - DNA, 3003 bp, Unknown
  misc_feature (1)..( 3003): 2750-1469P.txt file - cDNA_ID_2993585; gDNA_ID_1621084; Annot_ID_55351
ggggaaagtcagcatcctaaatgaatgtcattgatatactgctttcaaatacagtgctttactacactgagactcagctaaataactgcaaaactggtactttggtacaaagtacatgcatacaaaaacgcacctagactgaaaatttgttttcttctcctttttaaccaatctctagctatcttgcttaaatagttctgtcaaagaatagatttactagtccgaattacaggtttctaacatctttcagttattagtttgtggtgccacctatcgatttgatgttatgaaattatgaatgcgtaaattatattaactaaaaacacataccacaacacagttattaccggaagatgcaagattctccatatcttcaacacggtttaatgctctgtaaagaagcattagaagcgtgtctattccctccctcactgggagagttaagcccttctcacgtgatatctcgaggtacctgtcgtaacatgtaacgttatctcattatatgccaactcagaccacagagaacagggatatctacaaaagctgtagaggaaaacaatatacataaaaagtgtaattgtatcacctggttatgtttttaattgctgaatccagtaaatcagctctactagggggatctgagaaaaactcttcgtcaaccggagtgtccattcctgcttttctaagaaaattggctctctggatggccatcagcccattatctacaacatcttcgaaaggagctgggggaggatgcagtccccagtatctgtttcttggaacctgaaaccaagcaaaaattttagttaagcagagtgcagctggacaaggcttaagacatcataaagttcgggttcgctacaagtcaggcaatgccttgagtaaggaaaataatgaactgtggttgataatcagtcaatttttagaaacaaattagagtatataattaaaaaccagctgacaggaaaaaaaattataccaccaaagaccagcgattaggatcccgcatgataaaaggaaaaacttcagaaggttccattttttctgacttcaaaaattgattcacagcttcctcaaagcgcaaatcaaaaagcagtagataccctatttgagcatgaagaaacgaaagcatgtctttcgaaatttccccctgtgagtcaagttcctccaccaaggagatggtttctctatatctctttttcctcaagaggtctttaatctgttcttcataaggcactctccgataaaaaataagctgaaacatcacaatgaaagagtcaacaaaaaattcttgactattttattaacaagatatactccaaagaaatgaagatagccattatcaggataaacacctttgacaaggtagtgacaaccaaaaggtttccgtctcctgcctcatctgcggccaaaagtgaaggcccacatccttgaggaccaaaactaactgattgaacacaagcaccagacttcttctgatgtatttccatttttccatctccaacagtcaccaagtagaaagacaattctccaacagaatcaggcctcctccgaaacacaaggctccctccaataggctgaccatttgtgtccacaacaactccaacattgtccaccaacaacaacactttccactctttacagagcaatttaagcagcggcggtccagaaacatcaggcaatgtgaaaataaccccacttagaccagtgacacacgagatcaaactataacctttaacagttcccgcaataacataatcatcaagccaaaccaaagttttgatcccaccaattcccagaatctctttcaaaacaacaaaggaaccacttaatccttctttttcagcacattgaagttcaatcagcaacattctctcaccaatagcaacagcgaaaacatagtgaccttgttggactctctcatgtctagaatcattacctctaacatcactcacaagattcccagcaccaagcaactgaagaaacttcttactcgagctagaatccgttgaaatctcagaaggcaacaagtcagtactcgacgaatcacgtcctcttactctcttagcaatcacattgatccctttcaataaaccacccaatctcttagctggttgagaaagaagcgaatccaataagaacaagtaaccattgcagagagctagaactctccctctttcctcgccgagtacaaagatagactcaacaggagaagggctcagcgatacacttgcgagacgcgagacggtattagttaaagtgtcgagagataggagaatcagagatccggagtaggttccgaggtatactagggtttgagaatcggagataggtgagagagataaagctcggatcttatcgtcgccgccgagatcgaaacgagcggtgagctccacaactgcccgagatttggacatgacctaaaccagatatacgatgtacaatggtagtgatcggatttaagtagaagaaagaccgcgattgaaaaactccggtgatcagtgtcgccgcttaccggtaaagtaaagagtcagacacgttcgagttattttgacttaccattacagcttaacaaacactaaacgctgtcgtttaaagcatcgttcaattataatatttgtttttgttttttgaagccaaaaacttaattttcaagttaagccctaaacaaatcaagttccttaaaatgttattttctaaaaaaattttgtttttttgtctgaattaattggttgcaaaaaaatttgatgcgaatatgcgatataaattcaattttcttgaatttttgatttgtagttttttctggaagaaaactaattttaatttcgtgatcctaagaacagatagacacgtggcgctctagatcgccagaagcccatccgaaaatacgatacttggcaagaacaaagccgcgccaatccaaaagcccaaactgagatggcactgcttcaatccaatcttcgtcttcatcatcatcatctccattaaagctgcttaagaatg

SEQ ID NO: 28028 - DNA, 3003 bp, Unknown; identical to SEQ ID NO: 28027
  misc_feature (1)..( 3003): 2750-1469P.txt file - cDNA_ID_2993585; gDNA_ID_1621084; Annot_ID_170470

SEQ ID NO: 28029 - DNA, 3000 bp, Unknown; identical to SEQ ID NO: 7131
  misc_feature (1)..( 3000): 2750-1469P.txt file - cDNA_ID_2993590; gDNA_ID_1621128; Annot_ID_56422

SEQ ID NO: 28030 - DNA, 3000 bp, Unknown; identical to SEQ ID NO: 7131
  misc_feature (1)..( 3000): 2750-1469P.txt file - cDNA_ID_2993590; gDNA_ID_1621128; Annot_ID_172409

SEQ ID NO: 28031 - DNA, 3003 bp, Unknown
  misc_feature (1)..( 3003): 2750-1469P.txt file - cDNA_ID_2993598; gDNA_ID_1620744; Annot_ID_49675
gagaaccggtctttctcatctctagtcgaaattcagcatttatctaagtgtaacaacaatttcataattatttcttattaggtttttcggtgagtttgaaccgggatatatattttgtaaaaatttatactatatatcttatcaatataagaaaaagaagaagaaggatatgtatctcagaagattagttacatctagctattgatgctttcaaagccataacaaaaaacgaaagccttggacttgttagacttataataaaaaagtttatcattcaaagatccatttctttataatttttataagaatctttgtaggagtagtgaattattgcaattttggctgattatatgagtactgtttgtggttgacaacaaaataagtgaactgtttgtgatgtatatatgtttatataaagacaaaatgatggtgtagtttagcaaaataaagaaattaaaggaccattggctgggataattttggagaaatgaaataaagagagaaagagagtgacgtcgtaggaatgtgggggaggaattaaagagataaaagggaaaagataccgaatcttctcatggttttgcaacttggtcggttccaattatttttcacacccactttaaatcataatattgtagggaaataatttcaagctacatattgtacattccgagttccgacagtactgcattccgatattttaattgattcaagttttgattacattttttctttttgctgatttggaaaaaaatcttgattttgtatcgtcatcaaacggttgaatttagagatttattgtattttatatattctatataaacttaacttttctcgtgttcaagtagtagctaggtcgccgaccttctgcatgaatcacatgtctcgtaagtttagagtagtaagttaaaattcattaattgtattgtctcaagaaacacgcatgatacaatagtatttttaaaaaaagaaagtaaaatttttattttattttattgttttcatatatttcaggatcgaccatgatcagaagttttctagatgatatcgacacgaaatgtcagtctatagaaaccgttagcagtgatcagtgatcacttatatagttgctaaattgaccgttacttgtcatcgttttatgttttatcttatcacccaaactgttttttatcccacagtaaacacaattgatgacaactaaaccaaataatatacgtgtttcaaacttaaaagaagaaacagcatcgtggaagatagcccattcccagagtggctattttgtaattaatgaagttttccatgtcctcgatcaaaacaactaagcgacaaaaaggaccgcccgtactaactcgtgagatccaaacgctgctactttcacgcgcctctactacaaattcctctttgcactaacccaacatttaatttctcagattattgatgtaaatgatttaattaccagtttcaagctaataatcaacggtacataaccactttagccaaatcggtctggtttgatttatccaaattattttacacaaaccgatcttgtaagctaaccacaatgcaaatagctaaatggagagtataggacacgcgctataaagaacgtgtgtgggagtgggaatagttcatattaataccaccactaactataatgttcgcttcgtcatatctgactaattactcattaatttataaggtttttatttagtttcaattaaattataaaaaggtttgtcgtactattccactagattcctattaaaacctctgacacagaaagaagggtttcaatctcattaaagagaaaagaaacgattagagaaagagaagagggtagagacttcttttctttgtttctgtggaggctcttcttcttcttcttctctgtctctgtctctgtctctctgtaatcttctgtgctctccacaaatttgtctctcctctctctcgccgactccacaaattttgagcttctttttttgaagttcttgaggtaactaaatctcactctctttatagttttactttgtttgattttgtcaattttgactctttgaattctggggttttccattaaaaaaactcagaaagttctaagatttatctctgaattgagtaagttctattgaaattggcgtatggattcgacagatttttgagcacgatgtatgttttaaatttcgatgtcgacgcaccataaattttatatatatgaaattgaaatcttgataacaacagatttggtctcatcttcttcaagttgttgttgttgatgtggctgctgcttagagtaatgtttgttgctgcaagttggcttattgtctaatccgttatattattattttattttatttatatacagttgtgtttcgatttgtaacattttagattccgtctttgaccaattaaatctttcctccaaataaaatatttattttcttgctttcatgtttttaattttgacagctactactactaagttcgttttaagcatcaattcgtttatgcaaatagagagaatatcatgtcatgtcttaaaaaacaaagttgctcagaaacaatctttttttggttttgattttcaagttagtagtaggaggaggaggagatcttttaggaatctattcctctgttttttttctttggttgagaaggacccagagaaactcttgttttgttttcagagaatctctgtttgtggtctctctttatgaaatctttatctctatcttctttcagattctgcttcttctgtctagttacttagtggccaagattcacttatttgactcggcaggcaaaatctaccgaatatcttatcttcttgcaacttgtttatagacttaaagctgtgtacttactttgttttgttgcttcttcttatcctttgtcttgttctgtctcttggtcgtgatatgaattagttctttcttcttggttaaattgcagaacaagtgaaagagcttaatatccacaagactcttgtttctttcttaaatg

SEQ ID NO: 28032 - DNA, 3003 bp, Unknown; identical to SEQ ID NO: 28031
  misc_feature (1)..( 3003): 2750-1469P.txt file - cDNA_ID_2993598; gDNA_ID_1620744; Annot_ID_166580

SEQ ID NO: 28033 - DNA, 3003 bp, Unknown
  misc_feature (1)..( 3003): 2750-1469P.txt file - cDNA_ID_2993602; gDNA_ID_1620744; Annot_ID_49685
ttttgagcttaagattctataggacaacatgatgaagcatgtaaacaaagcggacccctcataccacccacacacttactatcatcaataaaatcaccaaaatggtcaacatgatgttgacttttttgtttctcatgatgtttttggactcatcaaattaatgtccattctaaagaatttatttgggagattctatcattttcctctagctcacgtgtgtaatcatcagcgaaaccgacgcatggttttctatttttttcttccattactaaatccacaacctttattaacaaaaagagttataactaattagttgctttcaaaatatcaagttttgtcctaactatcactctgtatctgctcacgtgtattttatataactaaggatcagtgccagagaaggagattagcttcagagacgcacttaaggctgcaccacaggctacggcagccggtggtggtgcttccatggaggaaggagccgccggaaaagacacaactccggtggctgcgattggcaagcaagaaatgccaagtgcaattgtaatgatgcgcctcatactaacagtcgtgggccgcaagctttctcgaaaccctaacacttattccagcctcttaggtcttgtctggtcacttatatccttcaagtgagtcaaaaaataactcaaatatcaaaatttcaactataatcattgaatttgtttgttatataactttaactcatattttattttgctaaataatgagcagatggaatataccgatgccaaatatagtggatttctcgataaagatcatttcagatgcaggtcttgggatggctatgtttagtttaggtatgaacatgttcttataaacctgcataataaataaaattatgtataacgtattctaacaaaattaaactataggcctgtttatggcgctgcagccaaagatgatcccttgtggggcgaaaaaggcaacaatggggatgttgatcaggttcatctcaggtcctcttttcatggctggtgcttcccttcttgtcggattaagaggttctaggttacatgctgctatcgtacaggtaaactattcagagtttaccttgatttggcccatatatattattgttggaaaattaaagaaaacatacttggtgatggagaaagtgtttaagattttgggagtgaattaggaagtttaacatatagaagggactaattagttaaaaaaaaatgaaggatagatatgttcatagctttcaaaagtacaaatatctatctcatataaacctaatatagtctaccattatatctagacttatatgttacaaagtatctagatattatgaaaatatctagatattttacatgatgcaattctcctgtattagtctaaggaggtattaatattttaagatggttctaaagagactctttaacttgtttcaagttttgcgtttggtccaagaaattaatgatacctggatcattgacacataattataactaatccaaaatcaagttaaatatttcaaaatataaattacccgtggctataatttaaacttcgtttcttataaaagttttcgattaacttatagtagagatatgtacatctaaatttgatgaagccgatatgttcttttaggctgctctaccgcaagggatagtaccatttgtgtttgcgagggagtacaatttgcatccagacctactcagtacattgtgagtctcttgctcttctttttgttgttcttcatttacatttacggttgaacgtttcaaaatgcggtattatggtttatgtgaaatctctgttcttggtgattttttgttttgttttcagggttatctttgggatgatagtatctttaccagtaactattttgtactacgtcctcttgggcctatgattcacacaacacactgaagaaaaagattacaccggagaaattaaatgatctatgaataaagaggtctggaaatagagaaatgtgagctcttaagagttgttcttgaggagcttgtgagaaagattaattaacggttaattacattgttgaatcaaattactggtaaatggttaggtgaataatttaattttatgtatttgatatccaacattgatcgacgtacgtacgtagtgaggtagaggcttaggttaggaatcaatcgtgaatactatttcaacgttgattcccgcgagctgaatattttttgtgatgtatagtaaaacgcatatgattataggaatcatcataaagattcttgtcatgaagaacaatattaaaccaaattatgcattacgagcaaaataattatacaaaaatactgataattataacttgggtcattgtattttctgtgtaatgtctactatcccttaattagtcggtttaaatcaggaaaaagtataattaatgacactcataattgtatcgttaagacttgaaagtgacggccaagaatacaattaagagccaattagtgatctttcataactttaaaaatctcacaaaagtagaaaaaaaaaattccaacttgatgaccaagaataatactattaaagagctatttaagatgaaaccgcccgaaaccaaaagcattcgatgggtacaccgattactgcttttagcaacaccacggcgtgaccatcaagactaattaactaagaccacattttaaaaaaactattaataattactacaatttgtaattaaaaagatcaacgagaaatgccacgtggacgaatactagcaacgccaagtggaaagagcgttcgagagaacaaggcaaaaccaaatacgcccctagtattctacagatgtcgactggataattacaaaagatttcaataaacagtactaattaatttctagtggtgagtttttgtaaatatctacttcttccaattaccagctgctatataaatccccttctctgtttctcttttcttacatcacaatcacacaaaactaacaaaagatcaaaagcaagttcttcactgttgataatg

SEQ ID NO: 28034 - DNA, 3003 bp, Unknown; identical to SEQ ID NO: 28033
  misc_feature (1)..( 3003): 2750-1469P.txt file - cDNA_ID_2993602; gDNA_ID_1620768; Annot_ID_167384

SEQ ID NO: 28035 - DNA, 3003 bp, Unknown; identical to SEQ ID NO: 28033
  misc_feature (1)..( 3003): 2750-1469P.txt file - cDNA_ID_2993602; gDNA_ID_1620744; Annot_ID_166595

SEQ ID NO: 28036 - DNA, 3000 bp, Unknown
  misc_feature (1)..( 3000): 2750-1469P.txt file - cDNA_ID_2993606; gDNA_ID_1621202; Annot_ID_57697
ggcacagaatgaaaaagaactaattgctataaagagttgatcaaacttacagacgcttcatcaaccaatatagaaggaagtttcttttcagttgcaatgacaactccatttgaagctgcataaagaaaacaacagtcatgattaccaaagacaatgttccttaaaaatctcctctcgaatttgattagatcattgaaaaaacctttaattccaagtgatgtttggcctgatccaacagctgttagggcatgttctatctgaaccagcttccctgatgggctgtttcataaaccacaacatgaatcaaaccccgaagaaaccgttccaaatgctcagaaagagataacattgatatgataaacaaagttaatacctgaaggtggtgagagaaaacgagtactgactgtcccccattgaaaaccaactaaatcaagctgcaaaaaatgcgaaatagtgtcatctctggaaatttagaaacgtggaagctaaatctgttcttcatcaacaatgttcaaacttaaatgaaaagaaaccacgtctgagcaagtaagtagactgaagcgttcaaatctgacaaagcttaaaaacccggaagagtctcatcgccatgggcaatgtgtaaggaaaacgatgaaaaagacaagatataccaaccctaattaagaattgtgagtgaatcaaatcaaacacaaactcaaactcaaagatcagctcttagctcaaactcagagacgaaaattgaaaacttttcttaaaccccaaattcaatatatttaaagttatcaatttaaattcaacaaaagaaacccattcaatcaaagcaacatacctttgatatatggatcgaacggaatggtcgcaagagaagagagagagaagagacccaagtgaagaatttttaagctctcaaggtttcttgcacaaagggtgagagtctgacgccagaaaacgagagaaacaaaaaaaccaaaacggcggcgttttaacaacttcacagttactgtatcttacataatagtccaatattttatatctcttttcagtttgaaccacattatttatttactacccctagtcccctactctctctcgcttccacgcccgactcggactcaaacctggtccgaattggctgtgtctctctccatcgcctccttcttctctgacaaactctcctccgttggtcggagtttgtttcttcgctcgttcatcacaagcttcgtgtactggtaattgttccattttttctagctatttcggaaaattggatggaagaagcatctgaaatacgcgtgtaaatgtcgctgattgtgtcgttgaggcagagccattgttgattcttagagaaaatttgctcctttatttctccagtttgttaaactctcgattacgcccttgaaatgcattcgaccgggaagagaaatttcttagctgttatcagattattgtttactagttcgagcttggtcagaaaggctggttgtagaaatctcatttctgctacctttaccaccaggtgttcgacgttatgcctgaatgaatctgaagaatgcattgaggattctgatctatcgtctaggagaaaaaaatttgattatgttggagaagttggtgaaaaagagaaagtgagagatattactagtagtcctttacaagttttacgaagatggggttgtgatgatgatgaaatatccaagctttttactcgtaggcctgctttgcagagagccaatgttgctcagttagagtttaagttaagccttcttaagccactgggaatcacgtcttcagaccttgtgaagattcttaactgtcgtcctaggttctttagttgccgtcttgtccttgatgaaaggatcaactacttcatggagattttggggtcaaaagaggtgttgcgcagagtcattatccggaatccgtcactcatgttgtatgacctcgatgacaagatcaaacccgcgatagaatactacaaagggttgggctttagccaacaggatcttgtcgcaatgttgatatcgcgacccacgttgattccaagaacaaactttaacaatgagaagtttgaatacattgagaaaactggagtcaccagagaatccaagatgtttaaatatgttgcagtcatcatcggggtctcgaggatggagacaatcgaagagaaagttagaaacttggaaaagtttgggttctcggaagaagagatttggcacctgtatggaaaatgcccaatccttctctctctctctgttgagaaagttcagagaaacatgactttcgtcatagcctcgatgaaacttccagctcattccgtggttaagcacccttgtttgcttctcctcaacctcgagtctcgtctaaaacctcgtgcggatctcgttaagagagtcttggaaatgcgtctaaagccattgataaaagaagtgagcattttcagagcggtaaggatgagcgagaaacggttcttgaaggtttatgtaatgtgtcatccacaagatattgcaaccgagctgatggagttttacgagaaatccaaaaacatgaaacgtttagctgagaaatccaagaaatacatccgtaaaggattccccttttgaatctctttttcatcttttgtttctttggatatgttcattaaagatgtaacattgtgtagaattttccagctttatcaatggatacttttgaatcggttcatgttttggtttagatcagattagttaaaccggaatagaaaaatatcaaaacacaaaacgcgaagaagcacgtttggtgaaacgaaacgccaaagacgccctagacgtgtctctcttccagacccgttcgtggcggcagtgacaaaatcctctttattgataaaaacgtttgcaaagttgcaacctttttgggtttagtacttgaagagaatcaatctgacagcaaatagttttggcgtctttctaactcaacccatcatctctgttgcattttatcgagagaatatttgaggtggatatg

SEQ ID NO: 28037 - DNA, 3000 bp, Unknown; identical to SEQ ID NO: 28036
  misc_feature (1)..( 3000): 2750-1469P.txt file - cDNA_ID_2993606; gDNA_ID_1621202; Annot_ID_174957

SEQ ID NO: 28038 - DNA, 3000 bp, Unknown; identical to SEQ ID NO: 8247
  misc_feature (1)..( 3000): 2750-1469P.txt file - cDNA_ID_2993610; gDNA_ID_1621202; Annot_ID_57700

SEQ ID NO: 28039 - DNA, 3000 bp, Unknown; identical to SEQ ID NO: 7148
  misc_feature (1)..( 3000): 2750-1469P.txt file - cDNA_ID_2993617; gDNA_ID_1621129; Annot_ID_56429

SEQ ID NO: 28040 - DNA, 3000 bp, Unknown; identical to SEQ ID NO: 7148
  misc_feature (1)..( 3000): 2750-1469P.txt file - cDNA_ID_2993617; gDNA_ID_1621129; Annot_ID_172429

SEQ ID NO: 28041 - DNA, 3003 bp, Unknown
  misc_feature (1)..( 3003): 2750-1469P.txt file - cDNA_ID_2993630; gDNA_ID_1620621; Annot_ID_47042
caacaattggcgcgccaggtaggggggaatataaacaaattttctctaccctcctttaatcaaagcaagcatggttcaaatcgtcatcgaccccatcattcctccagtcaacgatgatgggacggaatcaagtctcctccacggaggagatccaccatctaccgtcgaagtagcggccaaaacgaccgtgaatcaaccaacacacggggagacccctatcgactcaccatctttctcattggaggacatcaaagccatcctcacaaccgtgacgaaagatctctctgaatcagtcatggagactaatcgccgactcgacgagctgccaaaaggaaggcggctggggtcagaccgcgccaaagccgtccaagacgaggtcgagcggctcctaaaagccggcctgattaaagaagtacaatatccagaatggctggccaacccagtcgtggtcaaaaagaagaatggtaagtggagagtctgcgtggattacaccgacctaaacagggcttgccctaaagacagttatccactgccacacatagatcgcctagtcgaggcaacgtctggaaatcagcttttatctttcatggatgccttctcggggtacaatcaacgaaaaacctatcttctataccagtaaagccctgaatgacgccgagaccagatatccgaccttagaaaagctggcgttggcggtgataacggcagctcggaaactccgaccttatttccaatcacattccatagtgttcactgatcagccactacgcacagtgctccacagcccaaaccagtctagacgaattgcgaaatgggcaatcgaactgagtgaatacgacgtggaatatcgctctcgcccgagcctcaaatctcaggtcctagcggacttcatgactgaactatccccggatgtgattgacgttatcccggacgaaaactggatactctactcggacggctcctcatcattacaaggctccagcctcggaattctacttcagtcaccaaccagagaaatccttgaacagtcacttcggctccagtttaaggcatcgaataacgaagcagaatacgaagcacttctcgcaggacttcgactcgctaaggggctcggagccaaacagatcaaagctttcagtgactctcaactcgtagtcagtcggttcagcggggaattcgaagctaagaacgaaagaatgcgggctcatctttcaatggtccacgtccaaggacttcccagaatggcattgtagattggttccgatcttcagaaagagatcagcgatcttcagatcgcattggttgctgtaaaagagcacgggaagagggagtgcaacaggttgcggaatgaccgagctgctaaagtcgcccgtactacaaagaaagcccaagctcgtcttgatagagtgaaggcttatctcaaggagcaagaggacctcgtcgggccaaaggtggatgctgagaatcaagccagaggcgctgaggagatagtgggcatccttatgcagagaggtgcgaagattgcggcatctgaactcagcggccttaaggagttaaccaaaagggcgaccgacgaagttaatgccttgaacgttatcgagctcggggacgatgatctgaacatgtccccagatcagctcggtttttcgaggcaaacctcccaagttgctccagtggcggaccagcacggctcaaatgtcgacctcgttagcggaagtgatattcgacgtgtaagcgttgaagaaacgaaccagacgacctgaataggtcgtctttgtaatctattttgaaatattgatcgtggacccaattttcggggcgatctcaaaactcttatttaaccgtgaacccactttcggggcggtttttaatttttacttctacgtcagggtcgacctcgcgtcgtatgagcgtccgttctcggggaggaaaaggatgtggacggagtttcctggtagattttttttaaatagatagggtaaagatatgtcgatcccgattagattctcatagctttttcttttgttgcagatcgatacaggcctagtccggattttcccgtcgagttcgaaggagttttagaggcgatcttccgagctcgtcgtcgtacctggaaagacgtcacgaggtcgcgcgtcaacaggataatggggaaggtcaggaaatccttcattagcttttaaacatgccacctcccccagctcccatcgaagaggaaagacagcctttagacggagaggcggctgcgtcaaatcctcccgttagtgctggcccttccggtggcgaactggtttgaagtttggatccttattgagcttatgacaggttacctccggggcgattcctgtcatatccttcgtagaccaagcaaaagatgacgacctcgatttcaggaaggcgatcagctcttcctttatctctccttctagctcgcttccgataccgaccgtccgagatggatccgactcgtcgatgttgacctggataattgttataggaaaactgaagtcaagctatagcgttcaggggttaatctggcgagctggaaatatgaagtcagggatgtttagcaaagcacgtgttgtgagctggcgagctggatatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacactggtatcagagccaagcgtttcctcggaatcaatg

SEQ ID NO: 28042 - DNA, 3000 bp, Unknown
  misc_feature (1)..( 3000): 2750-1469P.txt file - cDNA_ID_2993630; gDNA_ID_2926201; Annot_ID_141531
caattggcgcgccaggtaggggggaatataaacaaattttctctaccctcctttaatcaaagcaagcatggttcaaatcgtcatcgaccccatcattcctccagtcaacgatgatgggacggaatcaagtctcctccacggaggagatccaccatctaccgtcgaagtagcggccaaaacgaccgtgaatcaaccaacacacggggagacccctatcgactcaccatctttctcattggaggacatcaaagccatcctcacaaccgtgacgaaagatctctctgaatcagtcatggagactaatcgccgactcgacgagctgccaaaaggaaggcggctggggtcagaccgcgccaaagccgtccaagacgaggtcgagcggctcctaaaagccggcctgattaaagaagtacaatatccagaatggctggccaacccagtcgtggtcaaaaagaagaatggtaagtggagagtctgcgtggattacaccgacctaaacagggcttgccctaaagacagttatccactgccacacatagatcgcctagtcgaggcaacgtctggaaatcagcttttatctttcatggatgccttctcggggtacaatcaacgaaaaacctatcttctataccagtaaagccctgaatgacgccgagaccagatatccgaccttagaaaagctggcgttggcggtgataacggcagctcggaaactccgaccttatttccaatcacattccatagtgttcactgatcagccactacgcacagtgctccacagcccaaaccagtctagacgaattgcgaaatgggcaatcgaactgagtgaatacgacgtggaatatcgctctcgcccgagcctcaaatctcaggtcctagcggacttcatgactgaactatccccggatgtgattgacgttatcccggacgaaaactggatactctactcggacggctcctcatcattacaaggctccagcctcggaattctacttcagtcaccaaccagagaaatccttgaacagtcacttcggctccagtttaaggcatcgaataacgaagcagaatacgaagcacttctcgcaggacttcgactcgctaaggggctcggagccaaacagatcaaagctttcagtgactctcaactcgtagtcagtcggttcagcggggaattcgaagctaagaacgaaagaatgcgggctcatctttcaatggtccacgtccaaggacttcccagaatggcattgtagattggttccgatcttcagaaagagatcagcgatcttcagatcgcattggttgctgtaaaagagcacgggaagagggagtgcaacaggttgcggaatgaccgagctgctaaagtcgcccgtactacaaagaaagcccaagctcgtcttgatagagtgaaggcttatctcaaggagcaagaggacctcgtcgggccaaaggtggatgctgagaatcaagccagaggcgctgaggagatagtgggcatccttatgcagagaggtgcgaagattgcggcatctgaactcagcggccttaaggagttaaccaaaagggcgaccgacgaagttaatgccttgaacgttatcgagctcggggacgatgatctgaacatgtccccagatcagctcggtttttcgaggcaaacctcccaagttgctccagtggcggaccagcacggctcaaatgtcgacctcgttagcggaagtgatattcgacgtgtaagcgttgaagaaacgaaccagacgacctgaataggtcgtctttgtaatctattttgaaatattgatcgtggacccaattttcggggcgatctcaaaactcttatttaaccgtgaacccactttcggggcggtttttaatttttacttctacgtcagggtcgacctcgcgtcgtatgagcgtccgttctcggggaggaaaaggatgtggacggagtttcctggtagattttttttaaatagatagggtaaagatatgtcgatcccgattagattctcatagctttttcttttgttgcagatcgatacaggcctagtccggattttcccgtcgagttcgaaggagttttagaggcgatcttccgagctcgtcgtcgtacctggaaagacgtcacgaggtcgcgcgtcaacaggataatggggaaggtcaggaaatccttcattagcttttaaacatgccacctcccccagctcccatcgaagaggaaagacagcctttagacggagaggcggctgcgtcaaatcctcccgttagtgctggcccttccggtggcgaactggtttgaagtttggatccttattgagcttatgacaggttacctccggggcgattcctgtcatatccttcgtagaccaagcaaaagatgacgacctcgatttcaggaaggcgatcagctcttcctttatctctccttctagctcgcttccgataccgaccgtccgagatggatccgactcgtcgatgttgacctggataattgttataggaaaactgaagtcaagctatagcgttcaggggttaatctggcgagctggaaatatgaagtcagggatgtttagcaaagcacgtgttgtgagctggcgagctggatatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacactggtatcagagccaagcgtttcctcggaatcaatg

SEQ ID NO: 28043 - DNA, 3000 bp, Unknown; identical to SEQ ID NO: 4481
  misc_feature (1)..( 3000): 2750-1469P.txt file - cDNA_ID_2993638; gDNA_ID_1620708; Annot_ID_48945

SEQ ID NO: 28044 - DNA, 3000 bp, Unknown
  misc_feature (1)..( 3000): 2750-1469P.txt file - cDNA_ID_2993642; gDNA_ID_1620396; Annot_ID_155786
cttgagcattcctacgttgtcgtccgtgacaaagtactcgttgtccacaatttcaactcccttctcattaaaccggcttcggtcagaagatttatctaaccaagtggtttagaataaaaagtggaagggtaaaatagtaaataaacacctgtttgcgggcgaaatcctctgcacctgagaaagcaaggtaagagtggggagatttgtccatgacgagacgagcaagagatataggatttttcacggtggttatccccgaaacggcaccgcatcgtctcttcgtaccgtccataatgctagcttccatctcaaccgttcctttttccgtcaaagcagatccacggcctgaattaaacagaggatccgtctccaattctctaatctgtgttaatcaatcgtttagtatataattcaacaagaacaccgtaagaaatcattgtggggaaagagaacgtacgacgagctcaacgacgtcaatggcggagacattggaacgcaaagctattatgccgaggttgagacaacgagttaaaagctgtttagcctcttcttgtctctccgccggaagattagggtcgataccggcaccaccgtgtactgcgattgcccacccacccatattctctctctttctctttgttttatttatgtgtttcacagttaaaccgagaatgatggaagaaagaagagtcgcattaggtcattatataggccttttacgagcaaggagagacccacattttcttatttattgatttacctcttaatttttaaaaacattttttaattaccccatctgattttatttgttttgtttagttttttttttcatatgaaggaagaatatactttccgtatatttttctttacttttcagttattttgtcaacatttcccttttcaggttaatatttaaccaatttgggatttgttttaccattttctttctttgatttgattcgaccaagatgaaacgttattaaactgtaatgcttttcataatttcaagaaatctgcactacattttgtaatatgcaattttttttgctatgacatactatctcaaatgaaacaaaacaaagtagtcttgggaacttgcagttagctgtttatgttgaattccacgtcaggtctataacatgcatgaagggagcgataactattggttgttaattgttatgcattcttttatttgtcttattatattgataaaatgtggtttgggagaaataactgtttctcacaacttgtgaactaaataaattaaaagtttcaagttggcttgcaatttccctttttgtttaaacaacttctcttcttttcccgttttccttatgtttatctcgtcaattttgtgctaatctacgttattagaagatagattatatacgtcaatacacatagctcaatattatgtgtaaagtctatcttgtcgattatttgggtccaactcgacaggtatatcacaattttcctatttttatagtaaatcttacgtaatatttttctttactcaaatgtatcggttatgatttttcctatcatatgcaccgaaacatttcctcatatgcatcggagtctatagaaacctctttcttggaaatagcttagacaaatgttagtggattagtggtatactcattcccaatgtatagttcgattctaatatagtaatatgtttttaagagaagttgtaaagtagctgcgacacgcatttgctagcagttagcaggatcctatgcattaggcattagcaattgttaattatttaccgcaggattttgtgtctaaatatgtttatttattgttggccagtcgcatctttctctccacaagtttggaatctccgagattttctcttcatgtgttggaaaaggacagagcctagtgactttggtttgtggattccaataagattccgtcacgtgacaaactccaattagaaagacgtctattttcttctctctttgttgcctctcccatttcttaggggtcgtcaattagatccccacactctcgtggaatcttgtcctctcaaacatgttttgatgaccccacttctcctcttttttatacgagattcattacaaaatgaatcttgattcactacttcaaaacgttgctcaaaaaaaaaaaaaaaaaaaaaattcactacttcaatttactttttatagaaaaatcattcaaaacctctaaataactactgcaaaacgaatttttattttatttcaaattctagagatactttaaactatttttagactttcaaaaatggtttgcaaaaaaccttttagtgtgattttgtccatttaaggtgtcaatgatagtaacgaattacgcagtatagaatatgtggatcgattatatataacaagtaattgttagtgttggattatcctaaaaatcacactacactgccaattatgttaaattgtgaatatgttacagatggaatcacctggccatgactattgcctttcctctctacattcacatatgtaaatattagcactagtcgaagccaaatgagacacaacggtaatcgaacttttctttttggatgggttaaaattaactatttatgttgtgatttttttatatattttgtcgacacctaactcctaagatcagagctcaaattaaaagtggtggtgattcacaaatctatctataacgtgattcagggaacttgccactggctggagtttttagtaaacctaaaaaactattggggttttttccaaaacaaaatcataaagaaggggccctataacaaaataagaagacacgaaatattttagttaaaaccttgagataaccttatcctactagattccacgtggcattttccaagtggcgtaagaaaatccccgggaggaaatcagttgccacgtgtcagaagaagatcaaaactcgactcattgtgaccaaaggctattatttcctacacaaaattcccactcaccacacacaacaaaagaatagtgatcgaagctcatg

SEQ ID NO: 28045 - DNA, 3000 bp, Unknown
  misc_feature (1)..( 3000): 2750-1469P.txt file - cDNA_ID_2993652; gDNA_ID_1620675; Annot_ID_48220
aatcgaatagcaaattctgatttcttcttgttttcccagtttgtttttccagcgtatgttaagatcatatcaataataatctactttagctgccatgtttatttgtagtctttagttagtacggtgaaagtaatatgtggttttatttgattcaccttttcagctgaatgttttaaggatcggactgatgttcagtgtcttcatagatggcaaaaggtcttgaacccagagcttgtgaaaggaccgtggtcaaaagaggtgattttgtgaattgctttatatgctttactcggtttgagtctaatacaccttagcatttgtaatgtgttccatgacattacttttccatgttttgaaggaggataacacaataattgacctggttgaaaaatatgggccaaagaaatggtctactatatctcagcatttacctgggcgcataggaaagcaatgtagggaaaggtaatgcaaaggctctcaacttctttccgataaaatgatatttacatacattgggtggtacttcaacgcacataaacaatattgtgggtgatgtaggtggcataaccatcttaaccctgggattaataaaaatgcatggactcaggaagaggaactgactcttattcgtgcgcatcaaatttatgggaataaatgggcagagcttatgaaatttttgccaggaaggtaaatatgtcttttccatgggtcctagtataacaacataggtgtaacatgtccgtaaaattggtggcctcataaatgaaataataggtttttgatgctggtagttgtggtctatcgttcctgctttggtgatttgcttattttttcttacgttcctgtaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataaaatcccagtcatctcattctctgatgtctatagctgtaaggtgcaatgtctggtacatggttattgagtctattagtgaacttcttgttgcttaacacatcatctagtatgttgaattctcttcatgtgagatcgtatcaatcacatttgctcaaacagatagcatctagttatttcagctgtctttgtagaggattatagttttatagttggtctaaatctccataacgtaatcttataagctttaatctctaaatctcttacttgcccttgtaccaggaccaagaaacttctggaagtttttttgagttacgactgtgttctcctggtatg

SEQ ID NO: 28046 - DNA, 3003 bp, Unknown
  misc_feature (1)..( 3003): 2750-1469P.txt file - cDNA_ID_2993652; gDNA_ID_2926203; Annot_ID_141583
gtaaatcgaatagcaaattctgatttcttcttgttttcccagtttgtttttccagcgtatgttaagatcatatcaataataatctactttagctgccatgtttatttgtagtctttagttagtacggtgaaagtaatatgtggttttatttgattcaccttttcagctgaatgttttaaggatcggactgatgttcagtgtcttcatagatggcaaaaggtcttgaacccagagcttgtgaaaggaccgtggtcaaaagaggtgattttgtgaattgctttatatgctttactcggtttgagtctaatacaccttagcatttgtaatgtgttccatgacattacttttccatgttttgaaggaggataacacaataattgacctggttgaaaaatatgggccaaagaaatggtctactatatctcagcatttacctgggcgcataggaaagcaatgtagggaaaggtaatgcaaaggctctcaacttctttccgataaaatgatatttacatacattgggtggtacttcaacgcacataaacaatattgtgggtgatgtaggtggcataaccatcttaaccctgggattaataaaaatgcatggactcaggaagaggaactgactcttattcgtgcgcatcaaatttatgggaataaatgggcagagcttatgaaatttttgccaggaaggtaaatatgtcttttccatgggtcctagtataacaacataggtgtaacatgtccgtaaaattggtggcctcataaatgaaataataggtttttgatgctggtagttgtggtctatcgttcctgctttggtgatttgcttattttttcttacgttcctgtaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataaaatcccagtcatctcattctctgatgtctatagctgtaaggtgcaatgtctggtacatggttattgagtctattagtgaacttcttgttgcttaacacatcatctagtatgttgaattctcttcatgtgagatcgtatcaatcacatttgctcaaacagatagcatctagttatttcagctgtctttgtagaggattatagttttatagttggtctaaatctccataacgtaatcttataagctttaatctctaaatctcttacttgcccttgtaccaggaccaagaaacttctggaagtttttttgagttacgactgtgttctcctggtatg

SEQ ID NO: 28047 - DNA, 3000 bp, Unknown; identical to SEQ ID NO: 11978
  misc_feature (1)..( 3000): 2750-1469P.txt file - cDNA_ID_2993656; gDNA_ID_2214526; Annot_ID_134157

SEQ ID NO: 28048 - DNA, 3000 bp, Unknown; identical to SEQ ID NO: 11978
  misc_feature (1)..( 3000): 2750-1469P.txt file - cDNA_ID_2993656; gDNA_ID_2214526; Annot_ID_184758

SEQ ID NO: 28049 - DNA, 3000 bp, Unknown; identical to SEQ ID NO: 1414
  misc_feature (1)..( 3000): 2750-1469P.txt file - cDNA_ID_2993663; gDNA_ID_1620399; Annot_ID_155881

SEQ ID NO: 28050 - DNA, 3000 bp, Unknown; identical to SEQ ID NO: 4395
  misc_feature (1)..( 3000): 2750-1469P.txt file - cDNA_ID_2993676; gDNA_ID_1620703; Annot_ID_48815

SEQ ID NO: 28051 - DNA, 3000 bp, Unknown; identical to SEQ ID NO: 4395
  misc_feature (1)..( 3000): 2750-1469P.txt file - cDNA_ID_2993676; gDNA_ID_2926174; Annot_ID_140262

SEQ ID NO: 28052 - DNA, 3000 bp, Unknown; identical to SEQ ID NO: 8005
  misc_feature (1)..( 3000): 2750-1469P.txt file - cDNA_ID_2993690; gDNA_ID_1621182; Annot_ID_174312

SEQ ID NO: 28053 - DNA, 3000 bp, Unknown
  misc_feature (1)..( 3000): 2750-1469P.txt file - cDNA_ID_2993708; gDNA_ID_1620743; Annot_ID_49666
ttcatatttagtattaaaataatacttttaattagtttgttaattttcttaattttatttatttaaacatataagtaaatctaaaagaagtcatcgaagaaaattataagtaaaattattttttaatttaataataaaatatttgttatgatcccgacaactgcctagtagttttgtgaggacataaaggagaacagtgtggacaggaaatgaaaaagaaaaaaaaaaagaaatatagaagttgaaaattgtacgtgatcttgaaaatatctcttacgacgcaacttatgacttatgattccatattcttaagattattttaactagttagaagcatgaaacatgtgtagttgtgtacatcaatatgcaaacagctatctcatacgttttttcttttggttacagatagccgtaaaaaagaaatatatatccatcaagttggtaaaaattggtgagttttctaattcttgattcgatcgtaatttgtgagttttctaattcgtgattcgatagtaatttgctttaaacaaaaactacggattggttgaaacaaaatcactccattttaactagtatttagtctgttgccgagagactttatgatttcgtaggctttgaactaaaagaagcagagagtcataagatgaatttgttggaggtaagtcctcggtcataaaccaagcacaagagggaacaaaatcaatattcaagttcttaatgaaattagggttaaagcttacaaaatcttagaattgtatatgtatttgttgtttaagacaggtttcattttttgttattaatatgcataattactagaaccaaaactctttttaatccagagaaaagcaaatgttcttgcaaactttctcgtaaaactgcttttcagtcttatgactcctattgatgctaccattgtttaagcttttggtcttttaaataaatacggttggtcaatctatatatttatcaaccatcgaagggtctacaaatcaacaagtcatctctgtaaatggattggctaaacctttgactactttgcaatttgcattcgattatatggttagatattccatgttatgaaactttaatttacattggtcaaataattatttgattttgggccttataattgttgcagtggtccttaatactattcatttactataattaagactagcaactgactttattttaattctgattttgttaccaagttaagcacaccatctccaaagttccaaaaaggtaaggaatttattattaagaaactaatataagcatttgattgatgcttcatgcgatcgtattctaatcatgattctaaattgtaattgattttattattgtacataattagatacgatataataattaatgtgtaaactcacttatgttaattttgaaaaattatggagtgtgtgtgttatatgtgtctataaaatttgttttcgtgttattttagggtatttcttttaaattattgaccaaaatcacttggctttgtctcaattgtgatcatgtatattagatgtgcaaaataacccttacttaaataattaactctatctctcgtggtctcatctaaatgaaccgcaaggatgctcgccgcgacatcaagtttatatcacttttcgtggagaacagctacgccacaacttcgttagccatctcgtggaagcccttaggcgaaatgcgatcaatgtgtttatagacaatgatcaagagcttagaggtgaagatatcagcattcttttgaagaggatcgagtattcttgaatctccattgttgtgttctcgagcaggtacacagaatcgaggtggtgcttgagagaggctgtgaagatcaaagactgatgtaattttaccttacttgcctttcttgcctgttggcacaatccattagtcaagtttgatagtgaaagcaatgccaatgatcatcgtcatgttacttaagtcatctcgtatcgttcgattcaaattagttgtcgtttaagtttttgaagcatatactaaaaaaacatttaagttttcagttgtcaattaataataataaaaaaaaaaggaaaatgatgatgggtgagttttataatagttacggtgaacttggtcacattggataatttgtcattgttcttgggcggaccaataaaagcctctcttttgaatcccccacacagatctatcgcctcttcttccctcgtgtctgccagaatttttgtttcccgttgataaaggttaaacctttcttcttcttcttcttgtttcgatttcaagttcttctctttcgtgacctacggtgccgtttcatattccctaatttgattgaaaagggttgcgcaagggctttgaagtgaaacacttttgattcttgttgttgcttcaagttttcatttttatcaattgggttttggagaaaacactatgagctgtgattgaattgtctagctcgaagaatcttgattttgtttacacagagaattggtttcttctttcttgatgatagtacaattggattctgaatgttgtgtagagtttttggaattgctcattggtgtatgcttttgttatgcagggtttatctttggtggatgattagtgaaactttttaaggagataatagttcacatgttttagttaaaaatggcagcttcaagcggctctggtttggaaggttagaaacatgacctcaatccttttgttgttatgtattctttgtgtatactgactttaggaagttatatcgagtttccatttctttatttccgtttcttagagtgttttgcttttacgtttaactttaaataagaatgaggtcttgtttctgagactcatcaatttagagagctttatagggtagctttgagctttgtttattggctttgctgaggtattttgtttgtatgtattgttttgatttgaataaagaagagcttttgggatttattctgttttttgctcttgactatatcagctgaggagggggaaataagtatagacatg

SEQ ID NO: 28054 - DNA, 3000 bp, Unknown; identical to SEQ ID NO: 6950
  misc_feature (1)..( 3000): 2750-1469P.txt file - cDNA_ID_2993716; gDNA_ID_1621118; Annot_ID_56226

SEQ ID NO: 28055 - DNA, 3003 bp, Unknown
  misc_feature (1)..( 3003): 2750-1469P.txt file - cDNA_ID_2993716; gDNA_ID_2926161; Annot_ID_139717
aatctaacatcagcaagaaattcaaagagaccataaaaccaagtcaacaacactatgaaaactatacctcccaacacgattccctaaacgcgttgtaaagttattcaaaaccagttctggttgatggcttgtaggatttccgtgattctgcagttacatttaacatccaattcagtgatcactaatctacactcgatgtagagaagagtaatggttagcttacataccttaatatccttccttagaacaagatttgacaatttgaaatgagcagtaggaccatttggcaaaccgatgataagaagcgcatctacatatgaaatagcaaaagcttgaaacaaagcatatacagtagagagcacaaaacttgaaactcagtgaaaactaaccaggttctctacgatttgtatgaacaacaataagagatgtaaaatctttcttcgttgcgtattctacaatctgcagaaccatatctaacaaggttatatagttgcaaaaagactaactttatagagaaacaaggaagctatgaaacttataacaacaccttcttcaaatcataggttcctctcttttgataatgagagtttggtatcaccgaaagcaactcagatattaaagcaggtcctctctgcaatccaacaacattacttgaatcagaaaaccacaaacaaatctgtagaatctcttatgaaacaatggtaccaaaaaaaaaagacttacagtggaattgaaacgacatgttgtgagcaagaccttaggtgcaatctcacgtctcagaactggattaaactcatcagcatcaatatccgcaaacaactacaaactcaattacactaaattagcaacacgacaatgaattgaattcaaaaattgagatgaatcaaactttaaatctaaacatacttcttcatcgtcaggtctgcaaacagtttcatcagattctcttgtattctcaatcgtcttcggaatcatcttttgtggaggctacaaacgaataacacacaccaaacttaatatctcaaattcataaacacctttaaaaaatccctaaaaaagcttctccagatcgttacctcttctccaagctctaaagctcgtttctcagcagcatcacgagctctaatcttcttctgcttctccaatttcttctcatgcttctgcttcgcatacacttttgatctcttatctttgttcttaatcatcgaaggaagtatcacattcctcttctcacccccactgaaagtagactttccacgaacatcagattccatttcctcaccatcaccatcatctttcttcctcttgaaccccatttttacgacggacggcgaacgaagcctctctctctttaatcgatgaaaacggcaaagctgagaatgaagacgacggagactaacttagggtttatcgactcaaaattgaaaaacctatacaaatgggcctatgcttgggcccatctttaagcataggcctatctatctttataatattcgttaaaccgtcgccgtatcagtctattaacgggcttaattctgggccttgaagaaacattatactatggcgtttcattataacgatattaaacgacgccgtgtatgttagctatcaatttcgtttctcagtggtcactatgcgatgcgccatggaagaggaagcgccgtatcagctgcaatttccggtctatcaccggcgaagaattcaccgtttccacagctctgcaatgtccttctcgtcgcgtctttgtccaagaccttgtctcagtccggtacacgaagcctcgacgcgaattcgataccgatttcggaacctgtggttctccagatccttcgtagaaactccatagatccatcgaagaagctagatttcttccgatggtgttattctcttcgtcctggatacaaacattcagcgacagcttactctcagatatttcgcactgtttgtcggacagggcttctcggagaagttcccgatttgcttggttcaatgaaggaagatggagttaacttggaccagacgatggcgaagatacttctagattctctaatccgttcgggtaagttcgaatcagcgttaggagttttggattacatggaggaattaggagattgcttaaatcctagtgtatatgattctgttcttattgctctggtgaagaaacacgaattgcgtcttgctctgtctatattatttaagcttttagaagcttctgataaccatagtgatgatgatactggtagagttattattgtaagttatcttcctggaactgttgctgttaatgagctcttggttggtctaaggagagcagatatgaggtcggagttcaaaagggtatttgaaaagttaaagggaatgaaaagattcaagtttgatacatggagttataacatttgtattcatggatttggttgttggggagacttggatgctgcattgagtttgttcaaggagatgaaggagcgaagttcggtctatgggtcttcttttggtcctgatatatgcacatataacagcctgattcatgtgttgtgtttatttggaaaagctaaagatgctttgattgtatgggatgagctgaaggtgtctggccatgagcctgataattcgacatatcgtatactgattcaaggatgttgtaaatcttaccggatggatgatgcaatgaggatttatggtgagatgcagtataacgggtttgtccctgatactattgtgtataattgtcttttagatgggacactcaaggcaagaaaagtcactgaggcttgtcagttgtttgagaagatggttcaagaaggagttagagcttcctgctggacatacaacattctaattgacgggttatttaggaacggaagagctgaggctgggtttactctgttctgtgacttgaagaagaagggtcagtttgtcgatgccattacgtttagcattgttgggttgcagctttgcagggaagggaagctagaaggagcagtaaaattggtagaggagatg

SEQ ID NO: 28056 - DNA, 3003 bp, Unknown
  misc_feature (1)..( 3003): 2750-1469P.txt file - cDNA_ID_2993732; gDNA_ID_1621153; Annot_ID_56916
caaggatgtcacgtttgggaatcacagaatcaagaaagtaagaaacaaaaagaacaaagatcaaataccaaatcagcaataacagcaggatttcgaggatcatcctcgggaattccctgctcaactttcccaacgagatctgccccaacatcagctcccttagtatatattccaccacccaactgagcaaataaggcaacaaacgaagcaccaaaaccatatccgacaagaagaagaggtactgtaagagaaacagaaaattcaatcaataaatcttacaagtttaatagctccactatcgcccatgcaaatgcaaattctggtcaataaatcaagagaattacatatagggttcactgaaaatcttagaactgtattggtaccccacctcaatcaagattaatacaagtcatgacatatttaagaaaatactgctcatgtctgaaaatgatcctttgaaaagataacaataactttttgaaactcagtacaatgattatagaatatacacacaagacgaaaatgaatatttttcataaaaaaaaaagagcagaagacttacggtcagtaacattcattgagcctggtgaacccacgcccaaccacacataaaatgtagaatagaggatggcgataccaatcacagccataccaacaacaaccagggctgaaaacccaccagcacgaacggctatctgcattatatctgccacttagtatttggaaacgtgtacatgacatgttaccaaaatagctaaactaaagaagaacctgcaatgcttctctcgcagatcgtctggcagcactggagacccgcacattagcacgaactgacacccacattccaacatatccagcaatacctgagcatagagcccccaaaagaaatgcagcaacagtaatataagcagacatcgccctgcagcaaaatagtaatatggctaagcttcattcacaacaattcaaaagataaaataaatcttgtgaatgtaatcatgtatcagcaccttcctaaaccagcagcctcttgctggggagttaagctacggaatagatatatgcaaagaatcacaaaagctagcaaaatggccatcttggatatagtgctatactgcgttctgaaaaaaccttcagctccatcacgtatagcatctgatatctataagtaagagaattacctcacaaattagaattacaaatttttgatgagaacaaagaaggaaaaatgtcaacatcatgactaacaccacataatctgagtgagcttacctcaaccatctctggaggtccttcatctttcgctaaaacccacttggttagatatattgacaaaaggaagctgatgatgcatactgtgaagacgaacacgatgatgggagaagtacttgcccccatgtaaaagattgctccgaagcagaaaagcagaattatcgaaaggacacggacatttaatttcctaataatccggaatatctgccaaaaaacaactaaactttatacaatttcaaagaaaatgaaaacgagatgctcaagaaactaagatgctaaacgaaatagaaggaaactagttataatacgcatctcagtgatctgatgcaagcaaaaagaaaagcactcaagaaagagaggaataaaagttgtaccagtggactataggttttactacgcatgttgggaaaagccctaggcctgtcattgaaagacatcaaactggcctgctcaacatcttcatccatcatcatgttttgagctgaattagcccttcggactatgtgtagaggcgtaaagtcaatgctatggggcaactccgccccagaactcggacgctgaattttaatacactacaactttttcctccaaacgttaacaacagcacatcacaaaacgagcacaagttagtatgaaccctcttaactctagctatatctttgattccagcttcttcaaactttctcagtagagttgccacaacaagtttccaccacaatcaaaatttctgaaaaaaatagaaaagtatgaaaagttgtgatgtttctctttaccaaccaaatagcatttttaaatgaaatataatcagagtaaggttctacagtaaagtttagctataactttcatcatttcccatgagcgtaattgcttctacgatcaattccccagaaaagtgcgattaacaaacagacctcaagatctaatcgactaagatttcagtgaataaaacgcaagggactttgcattccgagtttaatgaatcaagcaccgttactttaatttagatctgagttctgttctaagagaaattcacatgatctctagacaggaaatggatacgtttccagaaacgaatccaacgaaaaaaaaaaagcatacgaagagtttatccggaaacaaaccctaaaaatcggtaaaacagagaagatgacggctccggtgagagtgatcagaaggaaaccgccattagcgaaagcttgttgtagccgaagaagcgctctatcctctcgctgtctccgttctaaatccgaagacttttcacagaactttccgaatatttttttcctaaattaatttttctacctttaattttattttcactcctcagtggttcaatactaattttatgacacatcctatccaatgagtcgttgacacttaatcactattctcacttaaaaagttaaaaacttaaaatcatcctcgtttgttaaattatatagatcgagttaaattatcaaaaatacccatcaattttggaatattaacatttgaatattatatgggcctagcccaaaattatgttttgccattcggcccatataatagacaatctgcaaagtgaagaagaagaagaaccactaacgttatcttaccggcccgatcacggagctcacctttcatcgtcaatctccggcggacgaatttctcttcgtagccgttacttctcattatttctttgaaactttcttagaaaattctctgttttggttaggacaatacaaacagaggatg

SEQ ID NO: 28057 - DNA, 3003 bp, Unknown
  misc_feature (1)..( 3003): 2750-1469P.txt file - cDNA_ID_2993732; gDNA_ID_1621153; Annot_ID_173321
attgtaaaaagaatgaaaggaacaagacaatcaatggttatgtgtgacaacattaccgcgccaaatgttataacagctaatataattgtcagagaatatcctttctgaagtacagccattggatcctctaccggagatttcacactagcatcacgtgttcccttgattgatagaataccaattgaggatataatcaagtcaaaagaatgaacaactagaggaaaaaggataaagcctgatggatctgcataatagagaaagatttgagtaagtatcaagcatgaacaagaggtttaataggatgtttatcagcgcatatctaacaaccactgctagaaatgggtaatgttattgaaattttttgactgcagccaagtgtagcttgctgtcatgaaaagtagtcttccttcaattttcacacaatgcatagcaggttcgtacaaggtgcttcaaacaataactctatacaacttatgtcgactttttaaatcctaacaagtaataatgtaccctcaaatcctcaaggagtgaccaaaacatgcaataaagcgtagattattctgtatacagaatgtaatttacgagcttgaactctctatgcaactcttcctaagtttgcatttcagattataaaatcctagcagttcatttaattttctcggtatgagtcaggaactcacaccataagttatatatttgcatataccagaagtaactttaaagagagatggtgcaccttcaattttgcacttcttagccattgttccacctagtatcattgcactgatgatttctgcagctatactttcaaataaatcagcacctctagcagcacagtcccccacattgtctccaacctacaagaagatgaaaatggctttaaatgcctaaatgacgaaaacacaagcaaacccttgtagagtgatatatgccccaaacaaggatgtcacgtttgggaatcacagaatcaagaaagtaagaaacaaaaagaacaaagatcaaataccaaatcagcaataacagcaggatttcgaggatcatcctcgggaattccctgctcaactttcccaacgagatctgccccaacatcagctcccttagtatatattccaccacccaactgagcaaataaggcaacaaacgaagcaccaaaaccatatccgacaagaagaagaggtactgtaagagaaacagaaaattcaatcaataaatcttacaagtttaatagctccactatcgcccatgcaaatgcaaattctggtcaataaatcaagagaattacatatagggttcactgaaaatcttagaactgtattggtaccccacctcaatcaagattaatacaagtcatgacatatttaagaaaatactgctcatgtctgaaaatgatcctttgaaaagataacaataactttttgaaactcagtacaatgattatagaatatacacacaagacgaaaatgaatatttttcataaaaaaaaaagagcagaagacttacggtcagtaacattcattgagcctggtgaacccacgcccaaccacacataaaatgtagaatagaggatggcgataccaatcacagccataccaacaacaaccagggctgaaaacccaccagcacgaacggctatctgcattatatctgccacttagtatttggaaacgtgtacatgacatgttaccaaaatagctaaactaaagaagaacctgcaatgcttctctcgcagatcgtctggcagcactggagacccgcacattagcacgaactgacacccacattccaacatatccagcaatacctgagcatagagcccccaaaagaaatgcagcaacagtaatataagcagacatcgccctgcagcaaaatagtaatatggctaagcttcattcacaacaattcaaaagataaaataaatcttgtgaatgtaatcatgtatcagcaccttcctaaaccagcagcctcttgctggggagttaagctacggaatagatatatgcaaagaatcacaaaagctagcaaaatggccatcttggatatagtgctatactgcgttctgaaaaaaccttcagctccatcacgtatagcatctgatatctataagtaagagaattacctcacaaattagaattacaaatttttgatgagaacaaagaaggaaaaatgtcaacatcatgactaacaccacataatctgagtgagcttacctcaaccatctctggaggtccttcatctttcgctaaaacccacttggttagatatattgacaaaaggaagctgatgatgcatactgtgaagacgaacacgatgatgggagaagtacttgcccccatgtaaaagattgctccgaagcagaaaagcagaattatcgaaaggacacggacatttaatttcctaataatccggaatatctgccaaaaaacaactaaactttatacaatttcaaagaaaatgaaaacgagatgctcaagaaactaagatgctaaacgaaatagaaggaaactagttataatacgcatctcagtgatctgatgcaagcaaaaagaaaagcactcaagaaagagaggaataaaagttgtaccagtggactataggttttactacgcatgttgggaaaagccctaggcctgtcattgaaagacatcaaactggcctgctcaacatcttcatccatcatcatgttttgagctgaattagcccttcggactatgtgtagaggcgtaaagtcaatgctatggggcaactccgccccagaactcggacgctgaattttaatacactacaactttttcctccaaacgttaacaacagcacatcacaaaacgagcacaagttagtatgaaccctcttaactctagctatatctttgattccagcttcttcaaactttctcagtagagttgccacaacaagtttccaccacaatcaaaatttctgaaaaaaatagaaaagtatgaaaagttgtgatgtttctctttaccaaccaaatagcatttttaaatg

SEQ ID NO: 28058 - DNA, 3000 bp, Unknown
  misc_feature (1)..( 3000): 2750-1469P.txt file - cDNA_ID_2993736; gDNA_ID_1621153; Annot_ID_56941
aaaagctaaaatcgtgaacaatccaccattggagacgtgccatcttcatcctctgagatgtggagattctgcttcttcttatcgttactattctttgatgttagcgcggtgaaatctgcagaatcgattttcctcccaagtcaaatcggagttgaagattcccgcgtctttgaatctcttagtcttagtcctgtatgctccgcggctgatccaaacctcaactacaagccggtcatcgggattctgacccaccctggcgaaggtcgatgggacgctcgtcttcactctctgaaaaactacgcctacgcgacgaacatatcgtacatcgcagcttcgtatgtgaagttagctgagactggtggagctcgtgtgattcctcttatctacaacgagcctgaagaaatcttgtttcaggtttactctgatgattttgctcttatggattccgttcactatgtagccttctttaatcactaatcttacaactatttattctacttgaacttggctacacctgatttgtttacatcacataaacaggcaatttgaaataagttcaaggttgatgttaccatgttattgttttggctattgcttgtcaaaattagttcatgttatcttagtgaatttcatttttgagttgcagaagctagaattggtaaatggtgtgatattcacaggtggttgggctaaaacagggttatattacgatgttgtggagaaaatcttcaatgtaagttctcattatgcaaacactctctgttgctttcatgtgttagctgagctgtacaacgtaatagtcttttgaaatccttatgtttctcacagaaagttatggagaaaaatgatgctggagaacattttccggtgtacgccatgtgtcttggattcgagattttgtcaatgatcataagtcaggtcactcttttggcttcttgcttcttttgttgcttaagtaacttccatatatgtaaagcaatgtttcacactgcctaaaatttaaaagagctttaagctgcatatcttgagctgagagggatatgcagtttccatcctaaatttctgacgattttgtgtgttttgaaacagaacagagacattcttgagaggtttaactcagtaaactatgcatcaagtctccagttttttaaaaacgttaatatcgaagcaaccgtgttccaaaggtgcatatatagctatgctttaaacttttcagtgatccaaagaacaatatcccataattgtaatgtttcatatttgcagatttcctccagagctgttgaaaaagctcagtgcagactgtttggttatgcagaaccactatgttagtatctctctaattttctgcagaatatgaatataggctatagctctcaccttttgttgctcttaagtatactttgattgctgttttcttcttataagtatctttaatcctatacagttacacaattttatatttcctgttttcttgttcatgaatgatttattatattctctctgcttttctgaaatgaaatgctattgtttcccagtttggtatctcaccagacaactttcaaggcaatccttatctgtctagtttcttcaatatcgtcacaaccagcgccgataaagacagcaaggtatagttaatatgttcctatacaccgattatacaaattccacaagctgacaatttcaatgaagggataaatttatcttttttctttccagacttttgtttcaactattcgatcaaaacgataccctgtgaccgccttccaatggcatccagaggtattacacacaagttaacttgtgtctctcattagtcttctcaatcctttgttaacttatatcttttactatgctatatgctttataatggatatatgtttctaaaaagatccttaaaatatactctgcagaaaaatgcattcgaatggggatcatctgaaatcccacactctgaggacgcaattcaggtgactcaacatgctgcaaattatctagtcaggttagttctctattgatcaatgttggaaagtatcattaaaagaattatgtagtggttcaattttcttatttgaatgttggtgcagtgaagccagaaagtcaatgaacagaccatcttctgagaaagtgctgagcaatctcatctacaactacaagcctacgtactccggatacaaagggtacaacaaaaaaaaagccacttcataattggagtccaatccttacagttcttgctgtatgttaacaaatattggatcatgtatgatcaacctcgttgggtttttttttgcaggagcggtgacgacgaggtttatattttcacgtaacaaagatcccttctctgtgtgttttcgccaaaacatagcaatttatattagttactaagagcaatacagtgtttctccttatccaccattgattgtaagttgtaaccaaggtgttgaactataatttaaaaaaacacagtatagatcacatgaggcgtgaggacgcaatcacttgttcccatatcttcctctaaaacctaaatcctaaaaaatcccttttcaaagatcaagttttaaggcaaaaaagcaatcatgattttggccagacacagcgaaaggaccttgtctgtttcgaaaaactcatttaatcatgtgttattaatttattattatcaacaatacaatcgtactgggtgaccaataatgagacgcacccatcaaattgggccctccacggctccaccactgagagggatacacgaaagtcgttttacaaaaacacctattaaaaataaatgtgcataaaaatctattaccacgtgtacggtgaagattaggttctcgattttgtataagaaggtcgaagtgtgaagaaatcaaaaacccaaaatcgtgaaagttcatttctcctccattgatctttctttactcagatctttcctcttcctctgagatgtggagctacgtttggttaccgttggtagctctatctctctttaaggatagcatcataatg

SEQ ID NO: 28059 - DNA, 3000 bp, Unknown; identical to SEQ ID NO: 4408
  misc_feature (1)..( 3000): 2750-1469P.txt file - cDNA_ID_2993740; gDNA_ID_1620704; Annot_ID_48839

SEQ ID NO: 28060 - DNA, 3000 bp, Unknown; identical to SEQ ID NO: 4408
  misc_feature (1)..( 3000): 2750-1469P.txt file - cDNA_ID_2993740; gDNA_ID_2926206; Annot_ID_141717

SEQ ID NO: 28061 - DNA, 3003 bp, Unknown
  misc_feature (1)..( 3003): 2750-1469P.txt file - cDNA_ID_2993752; gDNA_ID_1620618; Annot_ID_46966
tctagcgttacacataggtcgatatagctagcacaagaatgaaaactaactttatttgtcttgggaacaagcgaaagatcgaaactccgacagacgtaatcttaattcgctgagaggcgtgtgagaattgcctttttccttgaatataaaatgcactcccataatgtaatcaaacaaaagatataaatagaataagaaaaataacaactcagcgtaacggagtccgattaacggagtgagaaatcatctggtttctcgagagttctaagccaatgataatcgaaggaaacgaacggtgttgtgtgtgtgtggttaagaaaagaacaaactcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatg

SEQ ID NO: 28062 - DNA, 3003 bp, Unknown
  misc_feature (1)..( 3003): 2750-1469P.txt file - cDNA_ID_2993752; gDNA_ID_1620618; Annot_ID_162156
tcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatggggactggagattctgcttcgagactgattctctggttctgcttagggtttttgattctaggtgttggatttgtgcaatgtggagttacttatgaccggaaagcacttctcattaatggacagagacgaatcctcttctctggctccatacattaccctcgaagcactcctgatgtaagatttaacaaaagccctaaacttttctcttttttcttcttttgggtttaacaaaaagaccctatgtttctttcctttatgttctgttttatacaatttatcaaaaaggttttagctttattaattttaactgttgttcttgttgttagatg

SEQ ID NO: 28063 - DNA, 3000 bp, Unknown
  misc_feature (1)..( 3000): 2750-1469P.txt file - cDNA_ID_2993752; gDNA_ID_2926211; Annot_ID_141977
agcgttacacataggtcgatatagctagcacaagaatgaaaactaactttatttgtcttgggaacaagcgaaagatcgaaactccgacagacgtaatcttaattcgctgagaggcgtgtgagaattgcctttttccttgaatataaaatgcactcccataatgtaatcaaacaaaagatataaatagaataagaaaaataacaactcagcgtaacggagtccgattaacggagtgagaaatcatctggtttctcgagagttctaagccaatgataatcgaaggaaacgaacggtgttgtgtgtgtgtggttaagaaaagaacaaactcatacgagacacgtgcaccgaagctttttcccacgtgccaaagagtttcgtcttcgttcacacagaaccaagatgggtggtaacgaaggtaggaccctaaagcaccagcctacaacacatagatgaaatagtatatgcgtttacatggatttgatgaattgttgtgtttagtatataagtatattgtttagaattatcaaaaagtatactttataaaaagagtggtggtaacatatttagtttctgcaccaatataaaaagaaatatggtgatgtctaaagaaaaaagagagaaaacttagccaccaacaaaatattagaagaagatttcaccatgtgaatggaagggtaatgttttttttctttctttattttgaaatgaagggaaggaagttgttataaacaaattttcgaaaaggttaatgatttaaatctactataacctttttgatcctttagtttggaacaaaagaaagtttcagagttagcgatattttagtggaaactagttgttgattctccaactaaaattcaaccaccattagcataaaacatggttattttggcgaagtagtttactttgcaacatctatctgtattttactatataaaataatacttaacatatacaaataaatagaaattaacattagaaccaatagttatatagtttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggagatg

SEQ ID NO: 28064 - DNA, 3000 bp, Unknown; identical to SEQ ID NO: 3679
  misc_feature (1)..( 3000): 2750-1469P.txt file - cDNA_ID_2993752; gDNA_ID_2926211; Annot_ID_202619

SEQ ID NO: 28065 - DNA, 3003 bp, Unknown
  misc_feature (1)..( 3003): 2750-1469P.txt file - cDNA_ID_2993756; gDNA_ID_1620832; Annot_ID_169710
ttcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgactcttttcttctagggtttgattatgttggtttagggtttctgttgttggagagagatagagagaagaagaatctgaaacggaagtaggatttgtgtgtgttcgagaagagtccttgggaatgagcgagtttgttcagtaatttcgtagtacttgtcaactttgaacttaatttgaagagacatgcattgactctataaaaaaaattctacttttgcattcatgactactcttattccatgaatgttttaacattccatgaaacagtactttagtaagaatctttggtaacctatcataataaagatccttcttgacttcgcgcgctcaatgcttttgtacgtacgatggagaaaaacacttactaaaaaaaaaacactttttgttttgacatttgacctttctaagttactttttttttttgtcgtctgaaaatttattatagagattccggtgaaatacaaaagtgaaatataaagccggcggttaacaagtaacaccagaaaactaagccgacgattaaaaggatagtcttggaagcaaaacccaaaggaaagggagacaacaaggcaaaacaaaccttacaaacaaagcaaagttgcgaaactgaaacaaagaagcagaccaaaacaaccaaaattttaaacacaacatctcgtcaaccacattaccagacaaaggaaaggcagagctttacaacaagccactccgtaggagacaaggaactcccaaccaaacggacagcggtgccacctattacgatgaagactaccttacatagaagagttccaaggaatccataccggcgagaagaactaggccaaagacgacaagtcacacctacactcccggaatcggcgaattaaagaatatgattgtttagcgcctcgaaggaaaccagccaatgaacagatgagatctcgatcagatctttagagtagagacaaggagagaaccaaatcaattcggaccacaccgaaaaagaaaaacgggaggagatcgaaccggacagaaacgaaagcaaccaccaagcctggtaagaggctaaacgagaagaaggctaaaacatgaccggatcaagaggcgctactagcaacatagaccaacccacaaaaacaacataagccatctaagaaccattcgaaaatccctacaccacaacgcacataaactaagtaaaagcaacataaactttacaacagagcaagagacgcatagctccggcgctatggaagccaccaaagccagccaacgcaaactgagatctagatctacttttagagagaatgaagaggttttagagtcctccattctttacacaaattattattaatttgatctttctaagttactagtatataaaatatataaccatcaatattcacgaaacaagaaagctaaagaaatcaatttccatgattgaagttactttgacagtataaattacttcatcctaaactatattaacatgcacttttttcttttagcttaaaaaaccagagcaagtctgatcttgcaaatgcatgaaaatcaagagttggatctatcggaatcctttattatatcattgactttttttgcagtaaactgccagtggatctcatgaatctaaagaaaccatagttaaaacttaaacctgaaccgatcaaaaattaaactcgttagtcttttgtcacggcgaggggataataagaagaaaaaaattatatcagaagagtgttttttttcggataaagaactaatatacttgtcaatgagcttaatttgtttttgtttgctttacactacggacggctctgaccgtacgaacaaaattattaaggaaaatcataattaagaggttgacattgcattttagatattggtgtaaattatttgttatatatactttattcaaaattctctatgtatgtacatgttaacgatcctttactggaaaacttaaacatcttccatgccatgtttaaatttgttttcacgtttttttattttgagctaaactgatatttctttgtgtattctgaaatatttttggattttggtattggttaaggttataattttccagctgaaaaggatgaattctctaaaagttttcaaagatagggtatcatttcaaaatacattttttaaaaaggtttgcttctcctaatttcatattatctttttgacgtcaccactcaccactattgaaaaagcatttcttaattttctttaacaaatggagttagtagaatattattatctgcacgttttccctatctaataacaggggtaatttcgtaaatcccccttcaacaactaattaatgtgccggaatcgcaacttcttaaacttctaccaataacaatacgccacgtcatcattcttccctgtcatcgattacctcagacggtgtcggagacgtttcattctccggcctttagtggcattttctcgtaaataaattcataatctgtgggcgaacctttggcgtcgtgtttataataaagtccaccgcgaaatctctattattcgccacaacaacaacaacaacaacaacccaaaacccaattttgttacctcttctttcctcaatcctaaagtcaaaacaaacaaaaagcttccattttttttctttgattatcttcaatcggaatttcaggtaacgaaaaaaaaaatccgatctttaatcatcaaatcacctaactgggtcaactatttgatcaaatcgataactgatggattgatttggttttgcttatcgtaacttttgattttcaggtgtgagagatg

SEQ ID NO: 28066 - DNA, 3003 bp, Unknown
  misc_feature (1)..( 3003): 2750-1469P.txt file - cDNA_ID_2993779; gDNA_ID_1620774; Annot_ID_50245
catttggggtgctagcccatacattatatttgatgctcttatgcacatcatcttcactgtacgacttgatgataaagaacttagcatctttatactcaactggaaaatcgtctctgttgcactcttctctatctggaagaacgcatgttacagtctcctcagtatttgattcatcaaacgtctgctttttcacctcctctgagctaacctcttctgtggccttcgtgcccttggctctagggcccctgtttagttcattcaagccatcaatgttctcatttccatagaagtaactgttaccccttccccggcttctatatttgttgtctgtattgagccatcctctttcatttgttcttgaaccatatccagaagaaccataacccataccagacctcaccgtgctaccatactgaccatatgacttgtttggagacactctgtcgtagtaaccctgagctgcataacctgtcatggatgcaggctggtacatactctgccaagaatagaatgaggctatcagatacagggattcagatagagaagaagacttatcatacaaaactgacttccatatcataccgtgtaatgcgaattggagctagagttttgattcctagtcgcaggtacattgttgttagccttagaatatgaggatgcaactccactgccagaaacagacctctgcacatctgagaagttagagccatcgtgccatgacacaggagtgtaaaacccatcatagctatacctggggtcctgataaccagcagcaagaccacctccaagagcactgtttccatacagtgcactctgattcaatggtttaacaggagctgatccattcattcctttagggataccagcagatgcagagttggctgctttgtttgtagagagcttgctctgagtagaggcaggaacagacgaagcgaaaggcccactactggctgtgagaggaaaaggatactggtactgctgagcaccatacaactgtccatcaccaccaagttgtggagcagggcttgttgctggtgagtaaggaaaggcagcatacccgtatccctgcggataaacaagagatgcattctctccgtaagctccctggagtgattaccaaatgactaagtagggcaaaaggtaaaagagaggctaaatagtctggacacgagttgcttataagaaaatattaacgcacgtactgatgtcatatcaacactctcggaattggtataacctgtgtagtcactcccataacctgaaagattatacaaacggttgtgttatagatattacaataattctagacagtagaaggctgaagatatataaatgaaacttaattatcaccataatagtagggctgctgatacacattaggaacatagaaaacagaaggatccaaggcatcactgggtagcataggtgacaaagatcgatcaaaagaaggaacttgaccattcgaatccatagctccatactggtaaacacccgtctgcaaagataatgatgctatgagaactctgcttggagtaacaaaatgtgcagagacattaaaagatgtaactttaccttcttagtaggctcagggatctccaaagtcctagactttgaatctaaagacagtttcttcaatacatcagcagcttctgaaaaaacaatgtaagtgaaggaaacaaataggtttctatcttcagcaagactaaaaaattgatttttctaatcaatttattcactttgctagctacaggaacagtcaaattcatcgagctaaaacaaacagaacaaatggaaatgacatcatttcactatatgaatcgaattacgatgaagcaactagattcatgaacgtagatcacaaaagaaatgaaggagaaaagaaacaaaggcaaaggatacgatcagcaggaggagcaacagtagacatgagaacagagttggcagcgaagactgataatagatccttgtcggatattgaacaataagagtttgagacaaacacaaatatcagagcaaaaaagaactcagaaggaatctagggtttaagagattgaatcgtagccgcaagagaagagagaagaagaggaagaggcaaaagtggttttgttcgttcacctcgatttgattcaaatacctccaagatcccttttttatatttttctattatttttgtttacctttttctccatcgttttttttttaaaatacttcctttattccagccacattaatattatactagtcactacgaaatatctcacaaaataatactataaatattatttcctcgaaaatttcgcaattaatcgggaaaaaatcaatttttaaaataaatatcactgattccaattccattgttaggaattaaggagcaagaataaaggcccaaataggcccaatataaatctgatccaggatccgaagagttgaatccaacggccaagattaactcaaagcttgaaagaggtaagggaacgttaaaagcaccttccaagcgagagtaaggagataaacctacttcctttccttgcttcagctccccttttcttatccggaaaccaaaaacttccggtgataaaacctccttcgtcatctctctacttctgttagtttcttaatccttactcttggaatagtttatcctctgcattttttagtgccacagtttatgtgtgtatgttttgtttggataagaatttgttgtaagcttttgaaaacttgtattagttcattacttccatgattttgggtgttttgtaataaaatttatggattagtgtttcttcagattgtcaattgtgttcttattgagctctgctttcgaaggtgtcgcctttcttctggtttgttgtgaaaatttattactttagcttactgggttgttgtttctttctgttatattgattgtgttaaccgtatatagatgaaaagaagagtcttttttatatctttgaaatcttatctaagtgctgaattttgtctgtctttgaagtggataaaatg

SEQ ID NO: 28067 - DNA, 3003 bp, Unknown; identical to SEQ ID NO: 28066
  misc_feature (1)..( 3003): 2750-1469P.txt file - cDNA_ID_2993779; gDNA_ID_1620774; Annot_ID_167632

SEQ ID NO: 28068 - DNA, 3003 bp, Unknown
  misc_feature (1)..( 3003): 2750-1469P.txt file - cDNA_ID_2993791; gDNA_ID_1620658; Annot_ID_47910
tttttgacattgagttgtaggaaaaagagaagaagtcgagaaccaaattgtgcaccaaatggaactcgcctttcctaaaaaaagaaagacagtaggatgtgataattagaataacttaattcctgagcccacactattctttttttttttttgaaaagtgaaaattcagatattcatgcattcccatgaaacatactctagagattgggagaggagagtatccaggtaccacattgccggcactgttaacaaggacaacggacttaaccaacgccggccaaagaaaggccattaatgcaacgaaataccctgatagaggaaaaaatatatatacaattagaggagtatcttaatcatttgtgccattttaacgcatatattacatctcaataacttagggtgcataccaccgattgaattccctacgcaatgtgctggttccccaactacttcagccatgaaatcccgcagtaattcagcccacaaaagctcggtgtaaatgatatttggcttctctgattttccaaaacccaagactgtgatggtccatactcgatttttgctatttacgatgttgtctacattatcgcggtaatgctctagaaaagcaccaaagccatgcacaagaagaacggcaggcccttcattaccaaccactgtgtactgaaacaaggaagtgacttctattaaaattccatagcaaatataaaaagatcaagcagtgggattacaaaaatggccaatgtaggccattggacttggagaaatatgagtaataacagaaacctgaataagatatcccttccatctccaaatccttatagcgtgccttttttcatcaatcctctctctacttagagccaggagataataccactgccaaaacaaatccaacatcttcaaatattttcgaaaagaaagtaggagcatagatatatcatgtctatgagttattgtacctccatagagcatacagcatcagttgcagcagacactgtggcagctgaatatccaaaaggagaaataaatccagcattcctttctttttcatactcgattgcttcatagtggacacttcttctggatacgataccaagacagaggacaggtccaaaaagtttgaaaaatgaagctccgggcctagtctcggcatcacgaagtctcgcatggaccctggtcaacatcaaaaccaacgcccatcactcttcaacaagatataaaatataccagattcattccataataaccactttcatatggaagcatctgggaagcacaataacgccagaattaagaataaccacgtactcttgccagtcatctcgacttgtaccctccaagtacctcaagtatcctgctagagcattcagtacaacctcatttccacctccaacagtatctcttttacttgtgacaaaaacagagttatcaaccttcttccctaaacttccatcaacaattggctccatactgctttccttcaagttaccaagcctttccattaatactctttcagcagatgcctgtgccatttccctccaactattttctatttcccataagctttccttcaaatagtccttcaggtcatcgagcgttggcacagaacctggagcatgtttcatttaccatttcccctagttaaaagagtcacaaattagatatctaaaagaactactcaagcaagagatccaactccatgaatattgaagaaaaccttaccccactgcaattcacttcctggagatgaaaattttgctgcaggaactggcaaagtgagaggcagcttcagtttcttaaactcctcccaagattgtggtagatctgtcaaattctggaagaacaaaaatgtgtcacataagtaactggttctgaatcactacgcagtaactgatattgtaaaagatacgtacttggctctcgtaaaaaggagtacgccaagcaacaatcctcggtgattctccagataaagaaacaccttccaatttattctttacagcgtctaaaacctcacacagatggtattctacctcttcttccacaaagacaaaaggagctcgcacctgttacaatccagtacatgcttgtgacaaatagaatcttgccttcaaattgtgagaaaaatgctcaaattatactcggtgaagttacctctttgacaagatcttcaatgacattctctgcattcccatatctgagcataagatttgatccttgcttcttcaaggtttttctcaaatcttccaatgctataatagctagctctaaagtgtccgttgtgtatcctacatacatataagcccgttggattagatacccaatcaagtaacgcttggaaatggagtcctatggaagaatcctagctacttgatctatgcaaaaccattccactctcctacaagctaaaacgaagcagaggttcatcaactagagagatccgaattgagctcaggtaaattcgaatttgttccgctaatcaatccaacatttggaatgtatataaacttactcgatagaatgcgacgatcgaggacgtagagaggtatgacggctctgtgcttagacgcagcgaggaggccaggatgatcatcaacacgtaggtcatgtttaaaccacacaaccgccgtggaaccttcattcgttgccgaagacaaacaacatttgcatcggtttttccgatcattccgccggagacggagatgcaggaaatgcgggagagcgaggaacgccatgaggacggtggaagaaaaccagaatcagtgggttagtactagtagtatccatgaagtcgaagcagagagagagagagggattgtggtggagaagactctttccaagtgtgtggtcaatactcagtcccacagagaaacacctaacattcaaaacgacgtcgtacttcacttttttctttctttcgttttttgtgttcaactgtgactgtcttcattagatttgagactatctatttacattctgattatttcttaagaagaagcggccatg

SEQ ID NO: 28069 - DNA, 3003 bp, Unknown; identical to SEQ ID NO: 28068
  misc_feature (1)..( 3003): 2750-1469P.txt file - cDNA_ID_2993791; gDNA_ID_1620658; Annot_ID_163716

SEQ ID NO: 28070 - DNA, 3003 bp, Unknown; identical to SEQ ID NO: 28068
  misc_feature (1)..( 3003): 2750-1469P.txt file - cDNA_ID_2993791; gDNA_ID_2926187; Annot_ID_140836

SEQ ID NO: 28071 - DNA, 3003 bp, Unknown; identical to SEQ ID NO: 28068
  misc_feature (1)..( 3003): 2750-1469P.txt file - cDNA_ID_2993791; gDNA_ID_2926187; Annot_ID_200703

SEQ ID NO: 28072 - DNA, 3003 bp, Unknown
  misc_feature (1)..( 3003): 2750-1469P.txt file - cDNA_ID_2993795; gDNA_ID_1620627; Annot_ID_47159
cttacatctgcataggattttgtgataaattagatttgtttattgccacaggaagctatatcggtaccatggaaaccgattcctcggagaacagcaaagctctactttgctatgagaggtagttactagttactacagctgatttctttattactttccacaaatgaaaattgagatcccaaggcagatacatacaacaaaaattcttcactaatctttggcattctcatgaaattttcagtaatagaagtgtttgaagagagtgaagggcgtaaacatggagaatgttcgctactcgatcttgccagagtcttggaaatcaaaaagcaactctgtgaggcaaacgtaagtgtgtttagttgttttatcattatttagaaatgtcactgccaggttcactgaataactgaatattgtctctcagtctgtgagcgagagccatataccagatattctcttggagagacttatcactggtactactgaattcccgccagtttgtgccattgtgggaggaatattagcacaggttctctctctctcactttcactctcttatcgcattcgaatcttctcactagaaacttgtaatttgacaagaaagattttttgatgtggcaggaggtgatcaaagcagtatcaggcaaaggagacccgttgaaaaacttcttctactatgatggtgaagatgggaaaggtgtgatggaagacatttccgactcttttacctcttaaacaaccagtgggccttgatttagtttaaactctataatctctgagattccatgtatatctcaatcgtttgttttttgccttcacattatgaacaaatttaatgcagaatttagtggaggatcagttgtgattttccttcggtaaaatcattttcagttattgacatttgaattgttcaatttcaaatttcaaatattataattcaattcaaagactagctaagtttttaaaagtaattagtgagagatctcacagtgatataaaccacattcattttaattcatagcaaagtaaatggtaagaaatgaaaatggaagaaagagaggagagtagttcacacgaacatctgaaggagaagttgagagagcttgaggaggaatggacagccatgaaaacaggtaaaaactcatctgcggtttcatggattaccgtggaagatgctcttgagtatgtcgaaaactctcccagaaacctaatgctctctctccaacacaaaccaaaggcagagatgatacaagaaatatcgccattaaggagaaaactctttcacgactctgatgatgatgatcaaactaagaagacgacattgctttctcattcatcttgttggtcttcgaatgtgacgagttcgagtgataccacgaaagcaaagaagaagacaacgattagaagatttgtttctgttacaatggtgctgcttttgtcatgggttttagttgtgttgatgaaccactttgatcatctctccatgaatacacaaatcattactttggttcctacttgatatttttatttattttggtttgagaatgttcatcaatctcaataaataaaaaaagtttagttttgtattattacctctcgccttctcttttaattcattgaacctcttcaactttggctgtaactatgttggttaaaacagtataagtaatgtatgtatttatggttttaggaaaatcttacaaaataatactctatcattggatgaagaagcaaaaactacacccctctacatcttttctattcataaacttttttggggaaagaactacattggtggtgattaggtgcatcggtgacactaatgttgaaaatatgttttgtgtaaaattagtatggttaaagctaatcatttagttgagcaaaaaaagatgctaatcatttaaatagaaaatggactcaaacaaaagaaggccacacattcaattgttacatctttattgggttttcatttttggaagctatttttatgaatttgcagtgttttgttgcccaaaagaaaaaaagcataattccaagtatatctttcattttgaatccatcagtcatatgttttacttgaatcaactatttgttgggttttacgaagttacttgttaagaagattcaaaatatatataattagactatcaaaggaacaaaagaatgtaattgggtcataactttttccgaagcttacgtgacttgggagaaaatcaaacccattagtttcacccttaatcaaactaatcacaaattttgaactttgcaaagaaggtaaaataataatcagcaaaaagattaataaaatgacaaaagtatctctttaaaagattaataaagaaataaagaaatgacataagctctcaccgaccgacgtcttgtcttttttattcttaaggtcggtgccatgtcgacgccttcaagcttagaatctcgccacgtgtgggataaactaaccgaacccaatcgaaccagacagaccaaagacagaccagaccggactagttgtatgtcggcatcagcgttctagtacgacgttaattaaaaaaataaaaataaaatattatttatgatattccaccaataagagccaatgaaaagtgtgtgaaccaaccaacttctgtagcaaaccgtaccatttctctcttagatacctttaccttccttctataaattaggttcttcctttcacatttctttgtcttcttcttctacataaaattgattcgcctcgaaatttacacagacttgtcgctctctctttctctcttatttcacagagcccctaaacatttccaaaaatcttgcaaaggaagaaaaacaatggacaaattttggactttcctcactgctcttcattcaggcgctgggtaattattcttaatcttaattttccttccattatgtttccaaaattagttactttttgatttcctctgtttcgatttctaatccaaaccgtaatcgatttgttggtaatgtatatgcaggcctatcgtgatg

SEQ ID NO: 28073 - DNA, 3003 bp, Unknown; identical to SEQ ID NO: 28072
  misc_feature (1)..( 3003): 2750-1469P.txt file - cDNA_ID_2993795; gDNA_ID_2926186; Annot_ID_140804

SEQ ID NO: 28074 - DNA, 3003 bp, Unknown
  misc_feature (1)..( 3003): 2750-1469P.txt file - cDNA_ID_2993802; gDNA_ID_1620678; Annot_ID_48294
taatcagtataaggtaccgaggtgcgtgagcttcacacctatcatggagctgcttgactctagagttgtgtctgctcatttcagcccttcgttgccgcattggtcaccagaacgacgtcgttagataaaactttatatgaaagatatcaaccggatgatgtgcggttttagaatataaagctctgtttctgatgctaattaagactccctgttagatttcttattaggctttgtgaatcgtacaataaaatttgaagtacgtaccgatgtttttttccttcatcttctgttggaatccagctaataactagctttggtccaaaaaccagatatttttaaaatcagcatttaattattactacgccctaaattttctttaaacacggaatgttaatcaatgtgccctaatacttccaacataaaagtttggaaactaacattagatcttaaattattgttagatcttaaatttcaactgtgtacaataaattagatcttagattgtggactaccccaaactcgggcttctctacttagatcttctactaaatatttgggcttctacaatgggttcaattactttccctctcagggcttttaactagtttcggcaattcacaattgtaaaactgttgcaacatggctcattcagagataaagcccaatatcagtattggtaaatacacaattttattttttacttctttttacacgagtttctagaaatgaatagtttttgacatgcaaacaattagtcaaatctcttgtcgaacaaattcagtgcgaaagcaatgtatacgaatcaatagatatgcccagaagataaaatgacaagttatcatgaaacgaatttgaaccagaataagaggagcacacacaaatgcttcgttaagcatatatgaacaaaacaaggccccacaaaaggaataaaaaattccttggtatgtgacatatcagggaaaccacactaactaaaatatttttacgaccttgaacatgttgaataattttttttcctttgaaattttaagatatactgcaaaacattatgagtacttgtataagatatatacacaagaaaaagagcataaaaaaacaaactacaaaaaaaaaggattatatattaaatgaagttatagataaattcataatgcaatgtctccttttttttttagaatgtttctatttgacttaacaacaccttaaaattttaatagaatgcaacttaaccgaactattgtgactcaaattaaatttattttggaaacaaagctaaaacttcgaaagttactggagaaacgattggaaaacaataaattaaacaacttaatatggcaaaacaatgaaacgtgattttaaaaataagattaaagtaattgaccagaagagtaaattaggctgagatgacaaaaacagcgattagaaaaagactatagaagcgaagctggttcctcgctgtcgctccaagactaaccacctcgactaaaactacttctggtggcaattttttagcattttatttagatcgtggttttacgtgcataatggcttttggctcaaaggaaaaaaaaaacacataaaaatatatttcgacatgtgcaatcaaatctttgacaaaagagatttgctgatttgcaatcgcaacgtgaactattatatattaccatggaccataatgtattatacatgaaaggttagttttttttaatatatcaataagatattaattaagattaactaaatgtataaatatcgaccgttatagacagagtgaaataacatagaactttttttcacaattttgacatgagctccatgcgctctaagacaagcttttcttttttttttgcttgtcgtttatttttcttttgttgaaaatgtcttttaatgttatagtctctccatttcattatatgtatagtttcagaaattttcacatatattatattaagaaaagaaaaaattggtttttgtccttacgatttttttcattgatcaaatacttaaaattaacagagataaaactgaaacaatattttaaattaaaacaacatttaaagtgtaacgaaggaagtaaaaaatgtttaccaactatatttgtcctatctttcttaaccaagctagcttatcttcactaattcaaagttgtcacgttgtctgtttgatttaatactatttcgagtaaaagcaaaagtatcttatggaaatatctgctaatactcgcaataaatatatatgggacaaatgtaaagaaagatgtagtatggttttaaacttttaataataacaactatatatatacatatatagacatttttatcattaaaaccttttcacaccatgcaggatggttcccattctagaccggtgaccctataaataatatgataatttccttgacaccatatcacaaccaaattccttagagaaaaaggaagagaaaggtcaaagatgttttactatgtgattgtccttcctttagctctctttctcttggcttacaaattattcttcacctccaaaacgaagcgtttcaacctccctccctctccaccttactctctcccaatcctaggccaccacaacctcctcaagccgccggtccaccgtctcttccaccgcctctccaaaacacacggcccaatcttctccctccaatttggctcccgccgtgccgtcgtaatctcctcctcctcactcgcaacacaatgcttcacaggccaaaacgacatcattctctcaaaccggccttgtttcctaaccgctaaatacgtcgcttacaactacacaaccgtaggaaccgcgccttatggcgaccactggcgtaacctccgccgcatttgctccctggaaatcctctcctcgaaccgtctcacaaacttcctccacatccgtaaagacgaaatccaccgcatgctcacgagactctcacgcgacgtcaacaaagagatcgagctcgagccgctcttgtccgatctaacgttcaacaacatagtaagaatg

SEQ ID NO: 28075 - DNA, 3003 bp, Unknown; identical to SEQ ID NO: 28074
  misc_feature (1)..( 3003): 2750-1469P.txt file - cDNA_ID_2993802; gDNA_ID_2926213; Annot_ID_142080

SEQ ID NO: 28076 - DNA, 3003 bp, Unknown
  misc_feature (1)..( 3003): 2750-1469P.txt file - cDNA_ID_2993806; gDNA_ID_1620721; Annot_ID_49208
tcatccataaccggcgtgaactctgttgctatctctcccatcgttttagaagagtgagtgttccgttctttgggggatgaatctttttttatatgtaagatcttgattgatactctatcgcaattattgaattttgatgtttatatccattaaggaagtctgtctttttccactaatatttatactattttctcactcgcatgttattactgaaataataaaaatatacatggcttgtaatgtttgaattttttgtagaagaaagagaataaatcagagtggaaaacgacaagtgatggccgatgggtcaagtgtgtaggagggaaaaaacagctaagacgatacatagttttgtaatttcaaaattagacaaaggaagccaacaaaaaaagagtcagattattattaatagattaatatacagaagcataagatatatatgaaacgtcgaaaaagaaaacaattggttttacttgttttcactcgagagtataaaaataataatgcatctggttgtaatgggtaacggagttcacggcacaaatgtggtgtatattaaatattattcaatatttaaaggtgttaaattcgaatactgatataacaacggttcaatcacattccattagattatttatgtgttctaacttctagtcaacgaaaccaatatgattatgaatttgtcatcaatggtgaagaatctaaatagactgaaataaatattttggtgatcattgccattccagctgtacacaaatttattgtcaccgaaaaccttgtatgtatctaactagaccgttaatgatatgtaattagcaatatatacattgaataattgattttagcaagtgtcaatgaaacttttattctaacggtaataacaagcaataaccttatggtcaactttggttagagatcacatcaaaactgtataaatacataagtcggatattaattcaaaacaaagacttttgggtcagtatgagtatttcgtcgtcttctaatttataaatggatcggaacacccaaattattatcgggaaaaacgtacggcaacttgtttatagaattcaagttgctactaaatcatgcgccacttgatatatttgcagtcgcaggtccactcttcctagtttagtaccccatctaggcacatatatcgaaatagtttaataaattgaatcaaatactgaattgttactgatatatatactctgtatgtttctcgaaaatacttaaatttggtgtcatggagttgataaatttctgtaagaaattgaacgtctacagttcttatggtttagggtttctaagatggatccaaaaaaatgcaggaaccgaactatatacggcttttgagaacttaggttatcctttagacgtgactttcaaataagtatgtcgatgatttgataagacatgtcgttttatgatatgtagggacagggaaataaaagcacaatgtgaattaagactttagattcaaaaagatgcttcatgcttgtagaaatgatgacgattgcgacttgggacaatggacaagtgctatgtcattacatatactgatacacctaacctaatgaccaaataaggactctttacacgggttaactaaacaaatatatcccaactaacatttccaacaaaataagccgataaatgtaacatgtaccgaacaaaacattattaatcatcgtaacttttttttaggtttgaattaatcattataatttaaaaccctaaaaccaacttataagaaccataattgatcagaatccagtttaagtaaataacatagaaaattttgagtcagataaaaaagaggaaattgtatggttagcaacatttacattttacagaatatggatatggtaaatgagaagtgtgtggatcacaagaagtgaatgtgctttttctgctttttaaaggatgaatatgaaaacgaggctaccctcgttattttatttaatgtgaccactgtttagctggaaatcacttggagacgactttaaagtaggctccaaaatctaaagctagacaccagacaaaagactttctatattgtttgtcttaagataattctaaaaatatcagcatcgttactttattgaatgaatacttataagaattgacagtgaaaatgaaactagtgttgaaaagagatgtttggtcattaaaatcaaacaccgaccttaaactaaaaaagaatatcacttcatcggctcctccttttttcacaacttatatacaatatacacacacacaaactgagaattagaatgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcgatg

SEQ ID NO: 28077 - DNA, 3003 bp, Unknown; identical to SEQ ID NO: 28076
  misc_feature (1)..( 3003): 2750-1469P.txt file - cDNA_ID_2993806; gDNA_ID_2926191; Annot_ID_141057

SEQ ID NO: 28078 - DNA, 3003 bp, Unknown
  misc_feature (1)..( 3003): 2750-1469P.txt file - cDNA_ID_2993813; gDNA_ID_1620726; Annot_ID_49283
tacttgatgctttggtacgtaatggtgatgatgttcgttatgattatcttgttcagcggctaaggaagaggattggttaggcccttgtggatgttggtgttgatgttcttgagcactgtttgggagattgtaaaacacatgtcgtttgtcggatctatgttctacattcattgctgacattgttacatatacaaaaccaattccaagtaaatcacaaatagaaatcagcatataaaatcaaactaaaccaaaatgttttacaaaaaaaaaaatttgaactgatatttatttataacggcattgtttaaattattttctatgcaaaataaaccggatcgaaatcgaacaaaacccaaaatttggtgaaaacaaatactatattactatttcaaaagtaagatgaaagaaaaagtgaggtttggcaactggaccgaaatattttggcttcaattagactctcaactcctaaaaaaacaaaatagctgatccgaatcgaaccaaaaatatcatatggctaccctaaataaaaatggtatatggaaaattagtacatataacaaatggtatcaaagctgaggttaatacctcttgggagcgccggatctagattatctggatgatcattagaagcagcagaggattttaaagaagcctcgtcggttatgtaaactttcaagccgagctcacctctcacacgagaaaagatcccacgtctctccatgggaaagtgaagaacaacagcatcagaatgaggaacaaaagaggtccctgagagagataccttgccaaggaaggaacgtccattagtagatctgttgtgactataagcttgagcttcaagattgagatagtgaagacgagatggatctgagatgttgaagaagaaactctcgttccaaaccgggtttaagtctcgatctttgatcgttgttcggtgcttttgaccatcgaagtaaagctcaacgtaagcgttcgatgttccttgcccatcttttgggaagagattgtgtgctccgatcacgtccacgccgagttttagattgctcatcatcatgaccgtcgatcttttgatcgaacacttaaaagtgaaagagagacttagagtagaatcaagctcacaacttcaattttgataaagggtcttggaactatatactacataataaaattatatgcacatgcatgtgcattcataagtatatgtaagttgtggagaaaaattgaataattatggtaagaccaacttagatttcaagtaagggcagacagagtttcttgggattttcttaaatgtttctcatcttgaaaaattgaaaaaaatccagaaccgaccttaatttatacatgtacaataatgcatatttttgttataaattaatatgatatggtgtgccttaacatattgacatgagttataaataggatatggtgtacctcaactaggacctcaacccataattttttttcctttgtaagtaaaacaaacttacaaaaaccaaatctattttacagagttataaattggaatacaagaaataaggtcaactctttagtctctttttgttgattggatgagatggattcaggaaaaataatgaaaaaccatattattatctccacacataaatgcagatgcgtataaaagaggtcaagagttcatgcatgcatatatctaaggtaaagatcctagaaaaacgcttatgtcacatgagtttctttgacttatataaattgagcacatagctcttactacttaagatctaaatttccaccaatagaaaaactactagctaggtctccgcagtaagtgatacgattattaaatgctatatatatttatacaaaatacatgtgtgtgcatgtatttatacacgtattttagaagtggggtctctatctttttatggattcccatgattcacaatttcacatacaaggatttaactactatcccatcaaaatcctaatctgaagactaaacctctgatcttgattcacatgtataaggagaaagatgggaaagcttttaattcatttttgcctccgtttccaacattcaagctttgaacttctcacttttttactagagagagatagtgatggcacgatgaacgagggttgaaatggaaatcgcagattatgagatttattttctatacatcttgattcatataataaacacagtactagttgataccatgctatttgtagatttctagataattattgtttttagtaaaattgactaatggtaaaaccgataataaatagtgtattttgtgtgtgaatgatctaagcaaaaccactaaccggatataataacataaaatttgttaactaacacgtccaaaatctatgttccttcaaaaaaaacatactagataaataaaaatatacaatttggctcgaggtctcagtcaaaatcaatagtttagttatcaaccctatagtcctgaatccataaatgttggataacaagtttgcaatgttatataataaaaaaaaagattgcaatggtaagaattaacatcataagaattttattggagattagttagctgtttagttcatatataaaatgctttttagtgaagaaatagtcaactatcatatgaagatttaagatttaatcagtgatcattatacaattctatttctaacttgatttagattctctgccgatcttatctcatctccacttgttctctttctcaccttgttttctaatttctagtcttctagagaagtcaacgtaaacaaaaaatgtacatggactaaaggaatgtgatagttttatttatttagataagcaatgcacgacgtttattgtgcaataaaacagcgtggtgttctttttttctagctccgtgctgtcttctcgaatctgcaattccctgtaaacagagcaaactgaaatccccaaatcaaaaccctaaaccctaatctctaatttgagaaattaggttagttcacctttttgtcgattcctcttgcggagagatg

SEQ ID NO: 28079 - DNA, 3003 bp, Unknown; identical to SEQ ID NO: 28078
  misc_feature (1)..( 3003): 2750-1469P.txt file - cDNA_ID_2993813; gDNA_ID_2926153; Annot_ID_139391

SEQ ID NO: 28080 - DNA, 3003 bp, Unknown
  misc_feature (1)..( 3003): 2750-1469P.txt file - cDNA_ID_2993825; gDNA_ID_1620629; Annot_ID_47217
agccgtaaaccggactaaagattatggtttgccgcaagaatgtctccataaaaccagctgatcaaaatctaaaacaaaaaagttggaactttggaagtaaatacctcagaagctgcagaagcatatacatatacacacggcagaatcattcaagattcattgccaaatcgattctttttgaaaggaataatcttgggttttgagttaggtgaaccatcagtcattatgtaagcaaaactctatttgttaaattcaagccagtttttataaagatcgtaagttaacaatttattcagcatattatctaatctcttcctctctctttattttgcttgaatatttatatatatcatgcaacatacatttcaaactattcataatcgatctatttaagcttcactcaatctgcacccaagcggctgagcttggtatacctgcatgcaccagaaatatcatatagtatcccggaggagcaatctcagccgttgatggacccaatgcactgactctataagaatttgttagctggtcacgcgtcacagagagtagcttcaagattaccatcctctgattcatcgcaaaggagtgtgtagtgaaagatggtgcaactatcctcacagagagaagatcaacggtcagaaactgagctatggagaaatccacgttaaacaatctcttgtaactcaatactttgtcgcttgtcaataatatcttgggacgtattgggtcggatgtgaaaaatagatatggtggagaataagcctcgaggcttaaatccgttggatactcgacgttggtaaagttgtaataaacgtgaggattacttccaccaactaaaacccgaccgtctggtaataaaatcgctgaggaatggtacatcctaggacgtgatggtgtggacataacggtgaagagatgatcaaacggttgatatatcacaggttggataatcgggtcacgtgctttctcccaaccggccgtgccagctccggctccgtttacgatgatgacgtcacctgttggtaagagtagcatgtctcccataacacgtggcaatggcatggtttccatttcccaacttggactctgatcggatagttttagcctcccgcatgtggaggtggcacgtgtgaatccacgtgagaagccgcctttaggagagcctccacataccattatctcaacttctacgttagcatcgttggtatcatctaatggaaatagtatagaagaaccactgcttggatagttccttggatcaccacctggaatctctggaaactctttcacgattcggttctttttgtaatcgaacacaatggatcttgtgttagcgaagacaaataagtttccatcaggtaaaagatgtatgaacggatataagttgttctcgttacttccatctgaagtttctctaagaaactcaagtcttgagcttctagaccgagaatcatgtcggggaaaaagttcatagttgaactgtcttcttcctccgaccacaatgatccgtccatcgggtaatatttggttggtggcataccatctacgttgggatagatactgaggaaactcaatccaatcacatgtatcactataaccacaagggctaaacattcgagcagcacgctcaccatcgttgtatccaccggtttgaaccaatgttccgttgggaagaaccgcaccagaagaacaccatgtatctgtttggacattcaaaggacggtatgtgttggagacaacatcgtagagaactgagtgtgcgctgcaatcgaacttttctgcggtgtcagtagggtcgtaacgacatatgcctccgggtagagaaacatttgaggtaccgaaatcggtacggtcgaacattataaccatgccgttgtggaggagttgcatgtgcatggcggatataccgatgctcggtagcaacatttcccaccgatcgagttgcaatagaaaagggttagcttgaccttcggataatatggccatggagaggcataagatggttgtagcgacgatgaatgtatttttggagttgatcatagtggttggtggtttcttcctttgttcttggtttgatggtgaattttaagttagaggttggtttatctattttcttgttgaagagtagtatggttggagtaatacgtccaattatatattctttcacataaaattgttatttttattagattgacgattcttgttttatatatttaatttggaattttggacaagcaaactctttgactctactacattcatgccggagttttagacagtctttaagaaaacgtagtagaattgcatcaaactatagatagttttaatcaaattaaaggatgtaatattttctttctaaattctggtatcatcactctttgaaattgtcgtaatatttggaaataaataagtaaggaacacatataataaataagtatgaaatgaatagagaaaacaatgtacacctgcatgatgatttctataattccgcaagttgcaaagagaatgcccaaaaaaaaaaacttaagaaattatcagacaaatatttccttattcttatatgtttataaatcaaaatgacaaaaatatcactcacttacaaaaatatcaccttaagaatgtctccatagaccggctgatcaaaatctaaaaaacaaaaaagctggaactttgggagtaaattgctcagcctcaagaatgtctccatatatacatactcggcagaatgtctccgtaaattttgaattacagcattcaattatggcatgttaacaaaacgctgactttttaaattcagtttagttcttgctttgtgttaagaccggttttagtctcggtttaaccaaattaatttcattacatatttcatgtaaaggtcaaaatggtcattttagttcacctgagctcagtttgaaaaaaggtcttcctcaggtttccccatactcaagtgccggcgaaccctaagacttttgatacctcttctcttctctctcttcgaagatg

SEQ ID NO: 28081 - DNA, 3003 bp, Unknown; identical to SEQ ID NO: 28080
  misc_feature (1)..( 3003): 2750-1469P.txt file - cDNA_ID_2993825; gDNA_ID_1620629; Annot_ID_162622

SEQ ID NO: 28082 - DNA, 3003 bp, Unknown
  misc_feature (1)..( 3003): 2750-1469P.txt file - cDNA_ID_2993832; gDNA_ID_1620715; Annot_ID_49101
gaaacactgacagggaaagaacatcttctcttttatggaagacttaagaatctcaaaggccatgatctcaaccaagtatgttatcattatcaatcttacttctatcttatattagtgcaagagtcttaaacgtcaattcatggttaaatattaggccgtagaagaatcactaaagagtgtgaacctatttcatggaggagttgctgatatacctgccgggaaatatagcggaggaatgaaaaggcggcttagcgtagccatttcacttatcgggagtcctaaggtacaaaattgtatcttactcatctcctaacaaaaaacttattgaagcccttatttgaatgtgatttagagagctaaagtttttcaagctttaacaattatttttggtttttatattaaataaaaggttgtttatatggatgagccaagcacaggacttgatcctgcttcaagaataaacctatggacagtcatcaaacgcgcaaaaaaacacgcagcgataatcctaacgactcattcaatggaagaagcagagtttctctgtgaccgattgggaatttttgttgatggaaggttacaatgcatagggaacccaaaagagctgaagggcaggtatggtggatcctatgtgttaacgattacaacatcaccagaacatgaaaaagatgtggagacattggttcaagaagtttcctcaaatgcaagaaagatatatcacatcgcagggactcagaagtttgagttcccaaaggaggaggttcgaatttcagaagtctttcaggccgtggagaatgcgaaacgcaatttcactgtatttgcttggggatttgcggacacaactcttgaagatgttttcatcaaggttgctaaaaccggcctttaactaatgtcttcttttgaatacttttaagattattagttatgtctgttccacgtcaatattttgcttgttcatgtttgataaattgataatgcagaggtttgattcatgtacattgttggctcttcgcctgcaagtttgcgaattagtctgaggtcttgtattagtttgtttgtggatgatgcatgtaaccacaatttttttatttaaacgtggctatatttaattgtggataaaccactgaatatgaaattttatttcatctaccattcagatcctaaatgtatatcttaccatttaattcatatagggtttacgatttaaaatttagaatttcgaaaatagtatctatattaaaagatagtaattaggtctttttttcattgaattttacttaaacattggtaaaatttcatatgccatcgaaaaaagaaaatatcactgaaaactatgttagctgccggagacaacatttctaaaaagaaagacaatttttaaaaaagactacaaaatactctgttgttcctttttgtttgattgtttagaaaaaaaatttgtttttaagaaattaattttttaagttttccatgcaatatttattggttaatattggtgaattgtaattttcaagaaaaatagttagttatcattggtttagagttataaaaaattgtaaaacactaaaaataatacatttataatcaaaatttaatatgttttcttaatatatgtgtttttctaaacaatataaaaaaaggaacagagggagtataaatcaaaactgttaaaccaaattttttaccaattaaatcttaattatatcaattggttcttctccgaaataagaaattgtcttgatgtctatgaaaatcacaaatttcactaaaaatttatggaggattcctaattaactttagaccaggaatttttcaaaaaataaatttaaagatgacattatcatgaacacattcaaactgaaatcaaaccaaagtaaatttattttccctgtaatggaccatagagtataaagtatttaaaactgctacttattaaatcaaagacttttgtgttttttattgtgtgcaaagactttttatgtttgaaaactgaaataagactgctagtaaaaatataaactgaaataagaatttttcttaggacatcataacatttttgcttcttgtccaagtaactgccacattggaaaaaaatgtttagatttgaacaaatctttttaaaatggtcaaaaaattatcatagtcaaccaaattacccgacacttttacgtgagacattaaaatagactagtttaatcgattatgttcacacgtgattacgtctgagatgacgtatgaatcatctttatacaaatacaaatatacagtaaacaaataattgaaactcacctcttccactagtcgaagaatctattggtcgtggcatcactctccttcgcagcttcctaccaaatttacattgaaaatattctccattgtcactttctcgatttcgtaaaattacctttttgttatttgaccaaaagaataaccccaaaaaaacaatactaatatattcgagaaaaataactaattaaaggtatacttaacgagaaattaaagcgtgtgcacaagggtattactgtaatttcacattccgtatctgatctctgttcttctttcctccgcctgctataaaccaaaaggcggtgactcgatttgttccttctaagttcaaaaattgggtttccattaggattcaatttttactaaccctaaaaaacagaatctaatacacagagaaaagcgaaggttgttaccttcatcaatggcggatcctggtcctgccagtttctcaacgagagccaatgccttgcttaggaaaaacttaacctatcaggtactttttccgttttcttttcctctacgcaatccaattatacacatacaaattttcgtttaatgtgagtaagattctgttctgggattttcgtttaatagatcagtttccacaacaaaattagtggctgatttattgagtagattctgttctaattatgtctttgtgtaaattgtgtgttggtgtagaaacggaatctatggagcaatatacggctaatcatg

SEQ ID NO: 28083 - DNA, 3003 bp, Unknown
  misc_feature (1)..( 3003): 2750-1469P.txt file - cDNA_ID_2993836; gDNA_ID_1620715; Annot_ID_49103
atattacattgatcaaatcatttactccaggaaacatccattgttcttcctcctacaaagcacttccaagaagaaacaacacttctctgacaacaaaatatccaaagttgttgtagagatggaaaagccagatgtgtgtcgagaggtaatgaaaaatacaatatgaagataagtttcattattgacaaggctaagtaagatttgcatgcatcttttttggtgtcagagggagaaagtagagcagtgtctacttaaatcaactagagactctgcggttttatgcaataatctcaagaaggtgtactcgggtaaggacggtaatcctcagaagctcgcggttagaggattatctcttgctttacctcaaggagaatgctttggcatgcttggtcctaatggagcaggcaaaacctctttcatcaacatggtccgtataaacaatatcatacctattgatcttttgtctaatgagtcaatcctcaatcttctagtcaacctctttgacattctaatgttctgtgtagatgacaggaatcatcaaaccatcgtctggcacagcatttgtccaaggtcttgacatactaaccgatatggaccggatatatacaacaattggagtctgtccacaacatgagtaatctataaatataacaatctctgtttctttctttactttaaggctgccttgtttcttagtccattactccatttcattgaaatttctgcagtcttctgtgggagaagttgagtggaagggaacatctactgttctatggaaggctcaagaatctcaaaggttctgtcttaacacaagtaagtgtttgttttaacttttaacgtggtcggtttgtgaatggcttatgcaaaaactgatgagtttttaggctgtcgaagagtcgcttcgcagtgtcaaccttttccatggagggattggtgacaaacaagtcagtaaatacagtggagggatgaagagacggctcagcgtcgctatttctcttataggaagccccaaagtaacttgaaacatctcttggtatctatgttctatgatatgtaataagcctaatttgaggaaatttgtcaaggttgtttacatggatgagccaagtaccgggctagatccagcctcgaggaagagcttatgggatgtagtgaaacgggctaagcgaaaaggggcgataatactcaccagtagagtcttctaagcatcttatctcctttttgttctgccttataatgttttcatacacaagaaaacttcagctttggtcttatgcttcagcacattcaatggaagaagctgaaattttgtgtgaccgtataggaattttcgtcgatggtagtttgcaatgcattggcaatccaaaggaggtaaaactacaatacaccttatactcaatcgttagaaacagagtataacagtatgaacttgagccaatattaactgaaacattaatgacagttgaagagtcgatatggaggatcctatgtattgactgtgacaacctcggaggaacatgagaaagaagtagagcaattagtgcataacatctctacgaatgcaaagaagatatatcgaaccgcggggactcagaagtttgagctgccaaagcaagaggtgaagattggtgaggtgtttaaggctttggagaaggcgaagacaatgtttccagtagttgcttggggacttgcagacacaactcttgaagatgtctttataaaggttgctcaaacttcttaactaacaactcttttgaatgattccttcagatcaatctcaatcttttctatatcttatgtcaagctcaaaatcacaaactatatttcatataactctctctagccacttatgctcttaagaaaatcatttatttccgtaaatagttaatacgagctttcgagtctaaaaagggaaacaatggatagacttcatttagacgtaattttattccacaaataataaagagtctcttaatcttatccctttattctcgctttctttactctgcttttgctcctatcctattcctatgctttgtctattcttactttttcgaccaaactaaaaaaattactgtgtcaaatcttctttctaaaggataatgagacaaaattactttttcgaaatcttcttttaaaaggataatgagacaaattacttgttggaagagtgactaaaataggatttgcaggagctaagttctaaaagtgaatagtagaaatcaaatgtacaaaacaaaacgtacaccaaagaattaggggcataactctccaatgttatatcatggttaaaattttcaacgagtggtttccaatataaactaatttactggtctaattctacaatttagattattccttttttggtcaaacctacaatttaatgtactatagtcttttcaagcaagagaatttagctcgaatcaaattcaagaaactcacccaccagaagagagaaaaatcaaagtagtctactttttgcaagttggtccgtgggtgggtgcatttaagaacgagggacattgttcgtgaccacgagagcacgcacgcataccaaaactcaatgaaatgacaaaagacatataaacaagagagaaaaatgtatacacacaaatagaataacaactattcgtgaaagatagaatagaaaaattcaaaatatacaccttaaatttcatgtttctacccacaaaaaaaaagaatgtagaacattcaaaaacttatttttttgtatatttctgttaaaaaacaactgtaatatgaaaagtcctaaaataaaaggtcaagactaaaaatatcttataaaaatctaaaattacaaaacaaggaaaatttgtttatcaaagtttgggataatagtcttatctctttcatccacactaatataaataggatacatacacaacacattacaagaagataaatccaaacttttctttctctctctttcgtttcccattttttctcttattactcatagatcctgattgatctgaaaaaatg

SEQ ID NO: 28084 - DNA, 3000 bp, Unknown
  misc_feature (1)..( 3000): 2750-1469P.txt file - cDNA_ID_2993844; gDNA_ID_1620715; Annot_ID_49109
aaacaaactcaaaaacaagaatctcccctgaagatactcaaacaacgttttttttaatcaatcttataatctgtattttacttagtcttctttactagagaaatatccggcttatataccagactacttctccttcttcccttctctcatttcccaaaaaccattaacacacagacacactaacgcacacatctctcattttcaaaatcctcattttcatttctcaattctccagagtctcttgttctgttcccatcgaatgagcaatacaaaacacatccacaaagggttacaggagaggcttttagatcttctcttgatcgctcttatagtttacatgactcttaaaggcggcacgagtggggcttgtgccgcgtgcaagtaccaacgtagacgctgcgccgcggactgccccctcgcgccttacttcccagccgaacaaccgaaacttttccaaaacgttcacaggctattcggcgtaagaagtatcgtcaagatcctcgaaaaactagacgaaactcagaaaccagaagcaatgaaatcaatcatcttccagtcttatgtccgtgaccgttctcctgtccacggttgcctcggcgtcacgcaacaacttcaatacatgatctggtttgctgaagaagaactcaaagctgtcaattctcaattacaactatatcgctctcaaccacaaaacggtcaaaatcaaaaccaaaaccataatcataatcagatgattcatgagcttggtagtgatcataataagcagcaagaagatgttacatcgcagcagcttgacttgggtatgggacttaacgttaacaataatcagagcaatgtcgttacaccattctttagttcattattaccagtttccgaaacacaacagccacaaatgtcttacacttatagctgcagtgaggttaacaacaatggctatagtcctcctgcttataatacagattcgggcaaggagattctgaccaacaataacaatgtttggggtgatcagaatcgatttctgtataacaacaacaatggaggaggatacagcaaccaaaacgagagctgtcatgagatgaagagtaacggtgtaatggcaatacaatcacagctcgtaaatctgcaaatggtatcaaatcatcagcgagtggaagaagaagaagctgatcatgaatacgatgaactccatcagtttcttgatatcattgacgataggcaatcatttggggattctaaagaagcgtaggcctcaaggtaggggttttttcctttgtaaaactatgaaatatgtattttcttcttcttctgtagatatggtgattgaattggagtatattggtggttgtagctctggtggatcgttgaaggaacagattgatgaaattggagagaatgaattgagaagtgcagctacttgtttcagtctaaccagtgtgaataattgaattgatttctcaattcgtgatccctaattatgctctcgaaattttgttatacttttgttgacattttattattatcttttagtcagagacttaaaggttatgaattcagagtttctctaattttaataatatatctttttggagtctctaatgaacttgaatattagtgcaacgtaactctatttgctttatttttcttgggtttttaacttgttattcaagggacgcttctctgctaaaatctaacatggctgagtgaagaagagagacacaagacaaatgttaatgatgcattagctcccgaggatactcacattactcaggtaattatactagacttccacttatttatgaaactcaaaaatgtaatgttgatcttgtgttgaaccttgaggaaataatcaagaaactgtgtgtgttagtaggttagatgttggatcccgaactaatacctaaagtatcatgctccctagaagctgaagccatgttcataggactacactaagttttggaaatataggctacaagcatgtgattgtattcctcgaatctgattccaaagagatggttagagcagccctacgaatggcttcagccttcagcttaaaattgtgtcacattcagttggttgtacaagaactctagtaatcatggcagaatattctcgagtgtaatggttcaagaataattgatatatccatacgtgcgttagaaaaaaaaaacatgttcgatagtatatcagaatattttaactaatgattttgaaaatatcttcaaattatctgttatttttttttttatcaatagatattgtttaggactcaaacgagataatgtagagggaagttgtttacattatttagaattttttgtgccaaattatccgctttgacatttacattacgagaaattaaagataaagaaaaagaagtgaactcttccttatcgctctgaaactcctccaaatacgctgaaaatgctggccatttggttgggaaagacaccatcttcattaggtctgaacagtctgtgaaaaacctacttcttggttgtcggcaccaatcatacacttcattgtccagaataaagcgtcgacttcaaattatctgttaatgaaaacatttacactatttctttgaattttgcatttaaattattttgttaaaaaatcaaaagtcaaaaacttaaatcttttagatgataattcttgatattaaaataaaatgtcagaacaaaatttatgaaattcactcaaaattcatagaaaaaaaaaacactgaaactattcaatatattttatttgttttgagataggtgtcaaatgttttattcgaataacacgtctagttaacgtgaaaggtgaagccatgcactaatcacatcgttaatatcccctaatactatcctaatactatacactagaatttttcaaaacgacagtgtttttctgtgacaaggtaaagagaaagaaatatctcccaacctgtcaacacttaaaaaaagacataaaagtctgtggcgaccaaaagaagtgagagagaaagagagagatatg

SEQ ID NO: 28085 - DNA, 3000 bp, Unknown; identical to SEQ ID NO: 28084
  misc_feature (1)..( 3000): 2750-1469P.txt file - cDNA_ID_2993844; gDNA_ID_1620715; Annot_ID_165629

SEQ ID NO: 28086 - DNA, 3000 bp, Unknown; identical to SEQ ID NO: 7257
  misc_feature (1)..( 3000): 2750-1469P.txt file - cDNA_ID_2993855; gDNA_ID_1621135; Annot_ID_56546

SEQ ID NO: 28087 - DNA, 3000 bp, Unknown
  misc_feature (1)..( 3000): 2750-1469P.txt file - cDNA_ID_2993859; gDNA_ID_1621140; Annot_ID_56621
aaaaaaaaagatagcaaaacatgagcaatatataagcaaaacataatcatttttttcattatatacataatatagacttgaatttgagacattaaaccacataatgttaattagttttaggaaaatgaatcaactaaaagaagtttacatgttcttcaagcttttccattgccattcccctctttacgttgatttcccctctttatgttgattcatctataaacgcatccttccctcttcacttctttacataatctcatttctatagtaaaataaaactgtttgcaagaaaaaataaagaaaaatgtcaacaataggtgggatgataaaatgatagataagtactttgccgctgctagaaatacgacgagaacatgatcaagcgaatagctgaggatctaaaagtagtggagagcgaggtccaaagagaagcaaataaaatcaacaattttggatattactaaaattgcattgaaaatgtaaaacgccatcctttttgaaagaaaaagactccaaaacgatattttttatgaaacggatgaatttgaatgtgtttctgttttttttttctttataacaaattgtatgattctcgagatgagtgaaaaagcaaattttttatttgggggatcatactctttcatagacatgagatatcaaactttggaaataagaagcaactctttcatagagaaaaattcgtgaaacgaaagattttgtttggggatcatactccattagaccctcggaataacgatgcgaaatgaggatcttgttggtcttgcatatcacactggccgaaccacacccaaaagctattaccttggttttgccgttatgttctcctgtgagccaatagagcgtcccgttcacggaaaatatctagcacgtctttttagataaccattttaatgattaacatgtcaccacaaattttcttgttttacatggatagaattaagattaacttatctcaattaatacaaccaatcatcttgagaaaaaaaggaaactcaaacacaactatatatggttgagccatccacacctgtggcggtttgcaagaattagaagatcctgctctcacatcgccgtttccgcggtctcgtaaaatatgatcacctaacaaagtctctcgaaatcttttacagacatccgtgtgcttacagaaagttacttattttcaaagtttgatatcttatctataaaaaaccctactactactactactccttttgaagactttttatttgcttgcatccatacttggaaaatgactagatctccacaataagaggtctcttagcactgtcgtacagacaaatttggttctcaagttcgatctttgaacactttttcatcttgtggctttttggttttgatagatttcatactctctatcggcttcgttcctaggatatgactgaagatgacacatgcataatccaagttagtagaatttattattttatttataaatttgaagttagtagatttggtttatggtggtttgactgggttgcgctacctgtaaaatagtagtctatttagtgttgtttatgtggatgggacgtgacatcgatggttgtcattccgtccaagtagcttatgtggagtggagtgtcatgtatgtctggagtctggagatgtgcttttgcatggtcgacgcgtctctcaatgctcgttggtgtttggtttgtcccgtagagaattctatgcacgtttgagatgctttgctagcgaatgtacgttgtgtccaggagttggactcgtaagacccatatgaagattaaatgactaatacatgtctctttgaagcctctataaagacaatccggtgttgatatatcttgttggatagaccttgttgggagtagtttcgttgatgtggtgtccacttgttatatgttagttggctttctttggctacccgaaaaaacatctctatttgattttactttaaatctttttccatttgttcgtatagggaatgttttatcgaattaaaatattttttagcagtaataataaaatttaaaaatattggataatttaaaaatttaactgaatatataggtactacaacatgctttttttttttacttagattagttttttgtgcatttgagtttggtaacctaagtttgtttgtttcaccgatgatacctctttgttatttcgaaaaacagtttagtattgacaaagtatttgttattgaccaagaaaattttatatgagtcctaaagtcaggaacttgttaacaaaagataaccaaactttatacttaatttcgttataaaattattaaaagatcaaagtaggcttttatacaaactaaatttagtttcgattcaaataattttgaacttaagttatattttttgtgcgcatgtcttcttttagaccatagaataatattgggtttattcttgaattacggaaaacatgttttattagtgaggcaaagtacacgcgttcttccactttgggtttttgttttgtctatattcactttaggtatttattccaaaagctgttacaatttgaatgaaagcgactattaaacctatattcattcactttgaaataattaaaaagttcatattcattcacatacaaaaagccatctcaactcaaagtttataattaattagcttattaaacaaggaaaaaaacatattaattttgtcattaagaagaagacgaatttttcttcaaacatgattaatatataaataaaaagctagcaaccggaaacaaagaatcaaaaaggcaaaaagcaaagagagagagagagagaagaagaagtgagacttgtgttcttacggtgtttatagcttctttgttttgtcttttaggttcttgcctttttccgatcaatcagaccaatccctccttcacttttagcatcttattctctttcgttcttcttatatttctgggaattttcttcaatcgattcctctttgttgtaatctcacaattagagagagagatatg

SEQ ID NO: 28088 - DNA, 3000 bp, Unknown
  misc_feature (1)..( 3000): 2750-1469P.txt file - cDNA_ID_2993859; gDNA_ID_1621140; Annot_ID_172802
ctttttgaaagaaaaagactccaaaacgatattttttatgaaacggatgaatttgaatgtgtttctgttttttttttctttataacaaattgtatgattctcgagatgagtgaaaaagcaaattttttatttgggggatcatactctttcatagacatgagatatcaaactttggaaataagaagcaactctttcatagagaaaaattcgtgaaacgaaagattttgtttggggatcatactccattagaccctcggaataacgatgcgaaatgaggatcttgttggtcttgcatatcacactggccgaaccacacccaaaagctattaccttggttttgccgttatgttctcctgtgagccaatagagcgtcccgttcacggaaaatatctagcacgtctttttagataaccattttaatgattaacatgtcaccacaaattttcttgttttacatggatagaattaagattaacttatctcaattaatacaaccaatcatcttgagaaaaaaaggaaactcaaacacaactatatatggttgagccatccacacctgtggcggtttgcaagaattagaagatcctgctctcacatcgccgtttccgcggtctcgtaaaatatgatcacctaacaaagtctctcgaaatcttttacagacatccgtgtgcttacagaaagttacttattttcaaagtttgatatcttatctataaaaaaccctactactactactactccttttgaagactttttatttgcttgcatccatacttggaaaatgactagatctccacaataagaggtctcttagcactgtcgtacagacaaatttggttctcaagttcgatctttgaacactttttcatcttgtggctttttggttttgatagatttcatactctctatcggcttcgttcctaggatatgactgaagatgacacatgcataatccaagttagtagaatttattattttatttataaatttgaagttagtagatttggtttatggtggtttgactgggttgcgctacctgtaaaatagtagtctatttagtgttgtttatgtggatgggacgtgacatcgatggttgtcattccgtccaagtagcttatgtggagtggagtgtcatgtatgtctggagtctggagatgtgcttttgcatggtcgacgcgtctctcaatgctcgttggtgtttggtttgtcccgtagagaattctatgcacgtttgagatgctttgctagcgaatgtacgttgtgtccaggagttggactcgtaagacccatatgaagattaaatgactaatacatgtctctttgaagcctctataaagacaatccggtgttgatatatcttgttggatagaccttgttgggagtagtttcgttgatgtggtgtccacttgttatatgttagttggctttctttggctacccgaaaaaacatctctatttgattttactttaaatctttttccatttgttcgtatagggaatgttttatcgaattaaaatattttttagcagtaataataaaatttaaaaatattggataatttaaaaatttaactgaatatataggtactacaacatgctttttttttttacttagattagttttttgtgcatttgagtttggtaacctaagtttgtttgtttcaccgatgatacctctttgttatttcgaaaaacagtttagtattgacaaagtatttgttattgaccaagaaaattttatatgagtcctaaagtcaggaacttgttaacaaaagataaccaaactttatacttaatttcgttataaaattattaaaagatcaaagtaggcttttatacaaactaaatttagtttcgattcaaataattttgaacttaagttatattttttgtgcgcatgtcttcttttagaccatagaataatattgggtttattcttgaattacggaaaacatgttttattagtgaggcaaagtacacgcgttcttccactttgggtttttgttttgtctatattcactttaggtatttattccaaaagctgttacaatttgaatgaaagcgactattaaacctatattcattcactttgaaataattaaaaagttcatattcattcacatacaaaaagccatctcaactcaaagtttataattaattagcttattaaacaaggaaaaaaacatattaattttgtcattaagaagaagacgaatttttcttcaaacatgattaatatataaataaaaagctagcaaccggaaacaaagaatcaaaaaggcaaaaagcaaagagagagagagagagaagaagaagtgagacttgtgttcttacggtgtttatagcttctttgttttgtcttttaggttcttgcctttttccgatcaatcagaccaatccctccttcacttttagcatcttattctctttcgttcttcttatatttctgggaattttcttcaatcgattcctctttgttgtaatctcacaattagagagagagatatgtataatcagttggcgatatcttcgtcttcttcatcttcttcgtactatgaatctttgaaggttttggaagctgatgttcaacacgctaattctttgtaagtcctttttctgggtttcttctaaagtttaagactttagtttaaaattgtttgattagttgagctataagagtatagttagtgaaaaaattgaaaacccagatgataattttaggtcattctcttctctgtgtgtaatctcttctcatcaaaattgggttattttaggaaactccgataaatttttagtttagttttagaaagctttcacaaatagaacattctggaaagttgttgttggttttgatattctaatttaagcaaatttagtagcttttttgtttttgttttggctcaaggtccctaaactttgttattgcacatgttgtgttcgatgaattgtgtatgagaactttgaggtttatatcttttcagggcagaagcaattccaatg

SEQ ID NO: 28089 - DNA, 3003 bp, Unknown
  misc_feature (1)..( 3003): 2750-1469P.txt file - cDNA_ID_2993863; gDNA_ID_1620654; Annot_ID_47808
aaacatcttaatggttttcacctttgaatatccaatttaactaccagcaagcactacttacatacatctatctacatctttcattcttttatattgtcaaaatttgtcaccaccaaaaacattgatttatattcaaaatttggaaagtaactcaaagtagttgagttttgtgggtaccttcagaatgtccatttgattatcaatcaaaaagaagtttttagctggcgcatgaaaccgtcgttggaaactttgaaacggatgcttcactgtataaacgtactattattatttaatttttaataacgaaaagtaaattgtagatgaattctttttatttgattcatttttagttagtgctagccattatttctatctttaactatattcaaaattgttttttcatactataaactattattagaccattttcttgaatgaaccatactttctagacactatttctaaaatgactataaatcacaccatgtagttctatatttgtattattgtagtttattgatttaacattgaaaatttaataaattatacaattaaaaaattaataggttttaatacgtgtaaaattataaaacaaaatttataatgaaacagagagaatagtaaaaacatttatgagaaaaatatgtattggtgtcactaaagttattttagacatattttcattcaagaaatcagttgaataatagtcttactgtgacaaacaatttaatagataaaacattgagtagtattaactaataaatgaatcaaacaaacaaagtctaattgataaaatacgccatataaataaactataagtttctttaaaatatacattaaatatacaaaacgacaaatttatgaaacaaaaaagtgaagtcataagattaaaactattgtgaaatggatgacaaattcagtttcttctttattctttaaaccctaagtttaaattctttcaaacacaaatcgtagtatttgtaaaactgttattttcttgaaatataatttaacgttacattaacaaatcaaatggatgacatattacttaaaatttagattaccaataaaaaatcataaattcttcttttaaattgtaagatttaagtcttcccctttacatttagcaataaatagtttgctgcactggtttaaatgcactaatgcattgtttactgaattgtcttttgtttcatatatttgtctctactatacttttactaactttcccacctccaattaaaaaaattattacgaaataaacaaagtcatatctctctccacaacataattactttattcaacaaatattaattcctagtcatattttagctcctcttcttccttatatattacatacatacattttctttagaagtcattaccatcaacccatcccctagaaaaacacagagaaaaacaaatacaagaatacaaaaaccctctcgacgaaaccgaagtatcgaaatgagaaacaagaatggtaaaagaggtagcgttgagccctcggcgaggaccgtggcgtcggtggttgctaatgggaggtttgaaggaagatcaccatcgagcgacacatcatcatcacaaaactcgtgcctgacgaggacggaggaagtgaaggaggaggttgcatcgtcgtgggttgatgaagaagaggcgccggagatggtggtgatgggatgtcgaagttgtatgatgtatgttatggtcttacaagaacgtcaacgttgccccaagtgcaaatgcaccgacttgatcttcttttagagaatttgttttaagttattattcaatttggacttttgagtttgagatgatgaatttaattttctttgtaaagtcctctatataaatcatattgtttaaattataatctctattttaatatgttaaattgacagacagatcatttctgtttgtggccgtccctcttggttcattttgttaagttgtccattttcatgttttagtactatggaagccaatgacatgaacgaggatggattttcatcggagttgaattcgattgtttcaaacgctagttatggcgtttgcgtttatatttatttatttgtatactccagagaaacatagtttttcaatgtaaatgaaaaacgccaaaaaaaatagaaagtttatttttaaaaattacaaaatataaatttaaacacaagtaaaaaaatcgacacgtctcgaattagggtcttaagaatcaaattggtagtatgctaataatggtattgctttggtttcatcggcattcaatccgatgaaattttcaataattaaggttaaaagttgtatcttcatcaattaaaacgttatttattcaaaacaattcaccatcaaattcaataaaatttaagaacttttacaaacttcaaatattaaattatttaagaaaatatttttaaacctaaatttagtgaaaaagtagcaactaaaatttgttttaatgtattttatgacatttttctatttataagtactaaattttcaaaaatctaataaataattaatttctgtttttcatatatattaaggcacatgcgacgacatatatacgtgacaacattttatcctaaagttttaacatgatttttgaaaaagaaatttacattttacgataatttagttgcaaatcaagcgagttttaatatttcaataattttcatgtatatagaaattttgcattgctagttaaaataataacaaatagatgttgtcaaaactcgaaaataaaaggggtgtttctgtagttatcataatttaaggaattatatgatagaaaaacaaatttgggcggtaaatttgaaaaaaataactttttccagtctccccaaaagtacccgatttgccaaatttgaccctcccattttagctttctgtctattcaccagattctctctattcgattctccctttacttcttctcgtctctcttctctgctcgtcagatctcaaaatcaatcggatatcgaaaccacaacttcatcaattatg

SEQ ID NO: 28090 - DNA, 3000 bp, Unknown; identical to SEQ ID NO: 4364
  misc_feature (1)..( 3000): 2750-1469P.txt file - cDNA_ID_2993867; gDNA_ID_1620702; Annot_ID_48796

SEQ ID NO: 28091 - DNA, 3000 bp, Unknown; identical to SEQ ID NO: 4364
  misc_feature (1)..( 3000): 2750-1469P.txt file - cDNA_ID_2993867; gDNA_ID_2926189; Annot_ID_140949

SEQ ID NO: 28092 - DNA, 3003 bp, Unknown
  misc_feature (1)..( 3003): 2750-1469P.txt file - cDNA_ID_2993875; gDNA_ID_1620724; Annot_ID_49252
tgaccaggagatctgtcaagagcatgcactttttctgtctagtttaattggaatttggagttgtgtcagtgtcttggcgcttttaacactgggaagtgaagtgttgcatccttataatgccatccttctttgttacttggataactggatttcgcttagatccttctatgtatgaagaggttcagcttttgttgctaacaactcgataacagatcattttatctgttgatgccagtaccgtctgtacgtcttttctcggttcctcagcacttcttctttgtttttttgtgcaggcttattgctccaccagttcaaaatatatctgtacaggctagagtcaacgcaaaggtaacttactcatgattatctgttaggttgcattagactagcttcttagtatctctcccttggacgagtattcgttttgatatgtttatgggggaccataagatgtgcattttagccttctgctgttctgcatccgtagctatatctgcctgttgatggtagggagtatctgaaaggtttatgaattgaatgtggttgtaaatctttatgggtttgtaaatcccagaccatggaatgtgataggggcttgatctggtaaatgcttggtgtgataactgaatcgaatatcactatatccaataactttatactgaatgtttggagggctaataacaattgatcttcttaatctgcagaggcatgaggtagatcagaaagtagaacacagaggagggaagaggaagacactggactctcgctttgcaagcatgaaagagcagagaatgacgattaacaactatggtgttacagtgcaagttccaagattaccaccatgggttagagccagaagattttcccaatgagaaaccacaaagcttttacgggttgttccagtttagaatttggcttttgggtttagaatcttgttaagcaaacactaagcaatgcaattcttttgtaaacatattgacttttagtatcatgaaagaattttttttgagtcttggttcattatatagtcgcatttccacatttctgtcaattacatgtttgcctctaagtgagtacgcgtcgtcaagaagaaagcctatcagccaagtatgtcttaactcttaaggaatgcttcctgtataatctagacaaatagagttgtaacatttaaatcttcaaaattgggggtgtagctcatatggtagagcgctcgcttcgcatgcgagaggcacggggttcgattccccgcacctccaattttgttttttgttatttctgtatcttccgttccttgtatatgtggcctcagttaattcaggcgaaagaaactcgcaactttctctgtttcctccattccactttttcgaagatgtaactaatttacttaaggaaaacaataaattatgatctttagtaaatatggcctattccaaaaactgaaccaaacaaaatatttatgtttgattttgagttaattacacattaaatttttaatcacacacccagaagcagctaaaagacttcgacctaactccatcatataattatcttttgaatttatcttgaagaccatatataattatggcccaaagactccaaactgactctttgtttttagtgtgacctaatcaatatcactttcatatgttgtccaaaaaaactatacgacatacaactcgttctcatattttacagtgtacacttaacactttggtcacacgtattacgtaccgacatatttatatgcatagcttgagtatggagactgcgtcaaaaacaataaattaactatatttaaagaaacttggcaatcatctagtataaaaatagtcgattttttttctcttgtcaatccacgttaattaatctatgctttattatcaagtgaattaaagaatttgacgtaaaactggtgtattcaatggattaacattgaagcttattcacaaagtggtcggctattgatttactccttagacttgctctaattttctttcttaagctttttaattttggtacgtcacttagtttgacaagcggagctgtttaagtgaaccacaatatattaattctctaaacgggttattgtacaatatattaaatcaaaggaagttacgatgaccaaattaactttcataagaaaggaaaacaaatattaatttggagtttcaagcaatattacatctatatacctttctattggtttcttataatgttcacgagaaatgtaggaaaactataaagtataaactgaaaacagagaaaaagttgataaaagaagaaaataaatatcacacatttcttggctcatcactcaagtcacggaaagtctttggagaagtgtagctaccatttttgttcattttattttggatagaaatttaacacacacttaatgatatggtttgaggaaatagcttatattaacttacctttccatgtatctatttatattttgcttaataataatgtaaacgcaataacatatattaaaacaaaggaaataaaatcttaatatatacctaaagttacacacaatcttagaatgctagcatactcaaatctcgtgaccccgaattttctggaaaaatcaattctacttcttctacctaaacagtttaggcttacaaatccatccaaatttatccattcgctttgttaaatcttaattgagcctaataaaataacatttgttaccaaaaaaagaagatcaactatataaatacacttccattaacaaaaacgtcaaagggtaattaagacaattcacaacattccggtatattcgcaaccaaaccaaatcctgccacgtagcaattatttcctcttcatttttctctctgtctccctcgaagaaacgtagaaatcagaaagtaaatcatacagtcaaaaccgcttcttctataaaaccctttttagctcaatcccaaaacgcaataaaaaacaaaacgctctccagaatttcgaaacttctaagatattttgttttctctcttaacgatg

SEQ ID NO: 28093 - DNA, 3003 bp, Unknown; identical to SEQ ID NO: 28092
  misc_feature (1)..( 3003): 2750-1469P.txt file - cDNA_ID_2993875; gDNA_ID_1620724; Annot_ID_165899

SEQ ID NO: 28094 - DNA, 3003 bp, Unknown; identical to SEQ ID NO: 28092
  misc_feature (1)..( 3003): 2750-1469P.txt file - cDNA_ID_2993875; gDNA_ID_2926184; Annot_ID_140703

SEQ ID NO: 28095 - DNA, 3003 bp, Unknown; identical to SEQ ID NO: 28092
  misc_feature (1)..( 3003): 2750-1469P.txt file - cDNA_ID_2993875; gDNA_ID_2926184; Annot_ID_200486

SEQ ID NO: 28096 - DNA, 3003 bp, Unknown
  misc_feature (1)..( 3003): 2750-1469P.txt file - cDNA_ID_2993889; gDNA_ID_2926197; Annot_ID_141349
gatataaccaaaccaagcgtttggagaacacaatcagaagaactctcattcatatactagttgttttcaaatgtttgtatatgattggatatatacacatgtaaagtttatcagagacaccataaaataaaataagtaactggtgctacaaatttcatctaattcgacaaatgtaaattacaaagctaaatgactcgtctaaggtaagtgataatgttagtgcaaacatttagtattatttttgaactgcaagatgattaagtatttttctaaatcatgactatggtagtactatttaataattaaatgaaactgtatattcgaaagtagaaagaagaggtgtggaattggacaagagaagagtataacagagaaaagtttggtgtaaaaaaggctgcaaaggagttggttaaaaagtgagtgaactcgataaacgcgtaaccctaaaggcaaagcgtgcgttactctttccccaattattttaccttttaaacttttttttttctttctcttagaaatgattacggcatttttaaaactagttatctcatttatatttataacgactacaatatctcatgacgatggtaaatcacatgaataaagtaaatatgattcgactacttggacgagttttgaagttgtccacaattagttttggataataattgtagtgagtgcatggttactgtactcacatttcttctaaattacaaatgtctcacaaaacctagaattttaaaccatgagagctcttcaacatactatagagattaatttgtactctaatccggaatcctctggatactaataaaattaatgaatacttgatcacctctttactttcgttgcttataaatttattcatgtagtttgtagtatgaaacatgaaagtatgtatagtcgatactccatagcattattggttctgaaaaattgaatctcacgtaaagtacagtattaagtttttcgtagacatattgcaatgatgagaggtaacaaatgaaataaggacaatttgtttggtgtagaagaagtaagagtcatgtagcacaaaaagattgtctattaaatggtctctgaatttattgggtcggctcgcacatcggcacatgtgatgaccttaccattcttgtctctgcatttaatattctttatccaaataatgatacaagtgaagttggtaacaaaatcgatcgtcaatgttttgtaatttctttccttgttccaaaaggatgtcaagttgtcgtgcagccattggctattttgatttgttataattcaagtttagcgtttatcttgcttcgatggaaagacatttaatcaaaattatgatctttgtatcaaggaaatgaattcgtaacacttatgttacgttcttttcaatttgtttccggttcttctaatagaaaagttaaaacgttattttcaaaatgattgtgacactttggattgtatttcagttccaaatctaaaagcaagactggcacatgatcgatgatacattaaacacacataagctataacagtttgaagtaattctcgtaccttcgagtcagaaagatcaaactcgtagaatttatatgttcaaccttttcatttacttcaaagtgaagttctatgttacaattgatttccaaaatgctaactacaaaataaaaataaaagagcttttggatcggcgtaaaagagacagcagagagataaaaaggcaaaatacgaaaaggtgaaaaagctttttgagtcgattccttttgcagggattgcgtgtgatttacagatatttcgtttttttaaaacaaaacaaaaaacccaacgaatacaaaaaaactcacacgttttcaatagcgcgtgacatacaccgatcaccacctaagctgatcacgagtcagaaaaggcactcaagcaattatcgtacacgcgccactttaaaacgcgtgaacacttttgtctcattactatgactagattcaaactttaatttcgtcatcaaaactttattagttgctacctttttctttttttccccacattcatctaaacttagtaatttaattttttgcttttttccaaacgttttaattagtagtagtaaacatcaatatcaaatttctaatcttttccatataaagtttgttctcaaccgtatagcagcaacttacaaaaaaacgttaataaatcttcttccaatcttgtgcatgaacttgttgtagtcttgatgattatttaaatagtaacactaatatctcttctaaaatacgaaagatgacactgaaaacagagcatcgtattcgccgttttaagacctatatcggtattcatttagtacctatttcgagttttaattctctgtcatcacaattcacaaataatttaatcttaataattgggtctcaatacttaagtagatgttaattggtctagaaatgaagaaattaagcaattttcaaaaccaagttaatgactttgaggctcaatgcatggttactattctctatagccgcagacacaaaaggacactatcgtaatctcctcaatgctccttataatatttggcgtcgaataaattcaaatagatacacatagaaagctataataatgagagagtttataagttcttgtgaaggcaaatgatccaatctttccttttcttctcctcaaattttctttcttttcccacgcgcttacacacacactgcaaaaaccacagaaacacagagaaagagaaagacaattcaaacaaaagcttcgattttttacctttctgtttgatcggctttttgtttttctgtaaaaagccatcttttgtgtttgatcctttctttttttttacctgattaaacaacttttctcctctgcattttttcgtgacccttttaaatatcttgtggccggtcctaaaagttctttatgcaaaggtttcttctttataagataaacaaaaggtgaagaaaccacaaccaaaaaaaaaaacttcttgttgagaaaagtttttttgagatg

SEQ ID NO: 28097 - DNA, 3003 bp, Unknown; identical to SEQ ID NO: 28096
  misc_feature (1)..( 3003): 2750-1469P.txt file - cDNA_ID_2993889; gDNA_ID_2926197; Annot_ID_201565

SEQ ID NO: 28098 - DNA, 3003 bp, Unknown
  misc_feature (1)..( 3003): 2750-1469P.txt file - cDNA_ID_2993893; gDNA_ID_1621125; Annot_ID_172243
ttccaataacgctaatgggaacaggcaaaatcatgccaacgggtagtgaaggtatactgaaccatgggaatgtgagagttatcatccataaaccaatacatggaagcaaagcggatgttctttgcaacgaggccagaagcaagattgcagaatcaatggatctctaagctgatctcagaagttgtcttttgctgcgtctctgatgaacattgagaagctttaatttttacatgtggaagaattaaatgttgagatcttttttagtcaaaaattgtgatgctccctttaatgacatttaaaagaaactatcagtttttggtttattataaaattttgtatatttcgttgtatctcgcgaattatcgtacgtatcacagtcttggccgcattgtcacgcctcccaggaaacagagtccttcccagtccgtacgtgatttccgacttgtaatcccagaagacgtctccttccaaattccaaatctcatgtgagttttattgtatctcttttgttgaactgtgtaatttcggtctgttgaatgtatcgagttgaatcagagattcctgtgttctcagtgaaactgaagcaatatatactgaaatagttgtgcttataattcttgttgattctcccatagatgacagtagatcatctggttatatttatgcagaattgaaggctcttattctagttggaggattcggaaccagattgaggccacttaccttgagcatgcctaaaccacttgttgattttggaaacaaacccatgattttgcatcaggtaggttagcttcttcttcttcttttgtatttgctcaagttttcacagtttcttttgttctcattatgatgcattcgcagattgaagctctaaaaggtgctggagtgactgaagttgtattagctatcaatcaccaacaaccagaggtacatacattcattgtccttaataacgatacgataacaattgaaattcttccgtgtcatcctccttctccttgtgtgtttggtattactcaggtcatgttgaactttgtgaaagaatatgagaagaagctagagattaagattacattttcccaagaaactgaaccgcttggaacagcagggcctctcgcgctggctcgggataagctggtcgatgaatcaggccaacccttttttgtactaaacagcgatgttatctgtgaatacccattgcttgagatgatcgagtttcacaagactaaccgtgctgaagcatcaatcatggtgaccgaggtagtcaaacaggagcattttctgcattttgtgaagtttatctttcatctgttaatagcattttctgatattaacaggttgatgatccttctaagtatggtgtggtggttacagaggaaggtacagcgagagttgaaagttttgtcgagaaaccgaaacattttgtggggaacaagatcaacgctgggatatacctcttgagcccatctgttcttgacaggattgagctgagaaggacttcgatagagaaagagatattccctaagatagcttcagagaagaagctttacgcgatggtactacctggtttttggatggacattggtcaaccgaaagattacataaccgggcaaagaatgtaccttaactctctaagagagaaaactccgcaagaactggccacaggggataacataatcgggaatgttctcgtgcacgaaagtgcggttataggagaaggttgcttgataggacctgatgtggtgattggtccgggatgtgtgattgattcaggtgtaagattgtttggttgtactgtaatgcgcggtgtgtggatcaaggaacatgcgtgtatctctaatagtatcgtgggatgggattcaaccgttggaaggtgggctcgagtttttaatataacggttcttggcaaagatgttaacgtcgccgatgcagaggtttacaacagtggggttgttatcgaagagcaaggtctgtgaaaccagagcctagacctagattagttagttccactgtttccagagtcttatgaaccgcaatattcttacaatttaaaacagatacaaactctatggtaaaccatatcataaaccggttaaaaatggtattcgacaccaatagagaaaaacgtttttcagatccatccctaagcaagttgtgtatatttctttcgtaaatgttttgagacattcttataagggacatataaattattgtagataaagcctatgtttcttaaacacgaaactgtgatttattaatagactatagtttggtgtatgtaattaacgttgagaaaaatgaaagacgtgacggcagagagagagagagtggacccgacccggacggcacggagacactttcagtttcttcttcttctcttctgtctttgtgatatttctctcaaaatcaatattttttcatctgtgaaacgacttcgtctcctcccactccattgtcactttcttcttcacccttctctcgtctccgtctgatttggcgtgtaacttctttctaccgtaattctccttcgtcttcttctctggtatatctcttgcattccctcctaatttcttagccaattactgtttggaatgatcttcattttgtacttcccattgcttgattttggttgacacctttctcgtttaagatcgtctcgttttcatgctgaaaactcaagtatttagttttttcgtttgtacccttttgttgatgttttggtttggggagaaaatgtggttcctttcaagttttttccgtcaatttgagttctcaggtcaacgaaaatggatggatgttcttaacccattaaccaagtttgatttttagagagattctgtaaacaaacaataacattttttgtgcttgaattatttttatatttattgcaagtttaggattttgctgcttgaaatgattttgatcataaatgtttattacattttcttatgtgtgtaaaaacaggtttgggattcatgagttgagtcacaaggaaaaagcatg

SEQ ID NO: 28099 - DNA, 3000 bp, Unknown
  misc_feature (1)..( 3000): 2750-1469P.txt file - cDNA_ID_2993893; gDNA_ID_2926198; Annot_ID_141370
caataacgctaatgggaacaggcaaaatcatgccaacgggtagtgaaggtatactgaaccatgggaatgtgagagttatcatccataaaccaatacatggaagcaaagcggatgttctttgcaacgaggccagaagcaagattgcagaatcaatggatctctaagctgatctcagaagttgtcttttgctgcgtctctgatgaacattgagaagctttaatttttacatgtggaagaattaaatgttgagatcttttttagtcaaaaattgtgatgctccctttaatgacatttaaaagaaactatcagtttttggtttattataaaattttgtatatttcgttgtatctcgcgaattatcgtacgtatcacagtcttggccgcattgtcacgcctcccaggaaacagagtccttcccagtccgtacgtgatttccgacttgtaatcccagaagacgtctccttccaaattccaaatctcatgtgagttttattgtatctcttttgttgaactgtgtaatttcggtctgttgaatgtatcgagttgaatcagagattcctgtgttctcagtgaaactgaagcaatatatactgaaatagttgtgcttataattcttgttgattctcccatagatgacagtagatcatctggttatatttatgcagaattgaaggctcttattctagttggaggattcggaaccagattgaggccacttaccttgagcatgcctaaaccacttgttgattttggaaacaaacccatgattttgcatcaggtaggttagcttcttcttcttcttttgtatttgctcaagttttcacagtttcttttgttctcattatgatgcattcgcagattgaagctctaaaaggtgctggagtgactgaagttgtattagctatcaatcaccaacaaccagaggtacatacattcattgtccttaataacgatacgataacaattgaaattcttccgtgtcatcctccttctccttgtgtgtttggtattactcaggtcatgttgaactttgtgaaagaatatgagaagaagctagagattaagattacattttcccaagaaactgaaccgcttggaacagcagggcctctcgcgctggctcgggataagctggtcgatgaatcaggccaacccttttttgtactaaacagcgatgttatctgtgaatacccattgcttgagatgatcgagtttcacaagactaaccgtgctgaagcatcaatcatggtgaccgaggtagtcaaacaggagcattttctgcattttgtgaagtttatctttcatctgttaatagcattttctgatattaacaggttgatgatccttctaagtatggtgtggtggttacagaggaaggtacagcgagagttgaaagttttgtcgagaaaccgaaacattttgtggggaacaagatcaacgctgggatatacctcttgagcccatctgttcttgacaggattgagctgagaaggacttcgatagagaaagagatattccctaagatagcttcagagaagaagctttacgcgatggtactacctggtttttggatggacattggtcaaccgaaagattacataaccgggcaaagaatgtaccttaactctctaagagagaaaactccgcaagaactggccacaggggataacataatcgggaatgttctcgtgcacgaaagtgcggttataggagaaggttgcttgataggacctgatgtggtgattggtccgggatgtgtgattgattcaggtgtaagattgtttggttgtactgtaatgcgcggtgtgtggatcaaggaacatgcgtgtatctctaatagtatcgtgggatgggattcaaccgttggaaggtgggctcgagtttttaatataacggttcttggcaaagatgttaacgtcgccgatgcagaggtttacaacagtggggttgttatcgaagagcaaggtctgtgaaaccagagcctagacctagattagttagttccactgtttccagagtcttatgaaccgcaatattcttacaatttaaaacagatacaaactctatggtaaaccatatcataaaccggttaaaaatggtattcgacaccaatagagaaaaacgtttttcagatccatccctaagcaagttgtgtatatttctttcgtaaatgttttgagacattcttataagggacatataaattattgtagataaagcctatgtttcttaaacacgaaactgtgatttattaatagactatagtttggtgtatgtaattaacgttgagaaaaatgaaagacgtgacggcagagagagagagagtggacccgacccggacggcacggagacactttcagtttcttcttcttctcttctgtctttgtgatatttctctcaaaatcaatattttttcatctgtgaaacgacttcgtctcctcccactccattgtcactttcttcttcacccttctctcgtctccgtctgatttggcgtgtaacttctttctaccgtaattctccttcgtcttcttctctggtatatctcttgcattccctcctaatttcttagccaattactgtttggaatgatcttcattttgtacttcccattgcttgattttggttgacacctttctcgtttaagatcgtctcgttttcatgctgaaaactcaagtatttagttttttcgtttgtacccttttgttgatgttttggtttggggagaaaatgtggttcctttcaagttttttccgtcaatttgagttctcaggtcaacgaaaatggatggatgttcttaacccattaaccaagtttgatttttagagagattctgtaaacaaacaataacattttttgtgcttgaattatttttatatttattgcaagtttaggattttgctgcttgaaatgattttgatcataaatgtttattacattttcttatgtgtgtaaaaacaggtttgggattcatgagttgagtcacaaggaaaaagcatg

SEQ ID NO: 28100 - DNA, 3000 bp, Unknown; identical to SEQ ID NO: 28099
  misc_feature (1)..( 3000): 2750-1469P.txt file - cDNA_ID_2993893; gDNA_ID_2926198; Annot_ID_201608

SEQ ID NO: 28101 - DNA, 3000 bp, Unknown; identical to SEQ ID NO: 7076
  misc_feature (1)..( 3000): 2750-1469P.txt file - cDNA_ID_2993900; gDNA_ID_1621125; Annot_ID_172255

SEQ ID NO: 28102 - DNA, 3003 bp, Unknown
  misc_feature (1)..( 3003): 2750-1469P.txt file - cDNA_ID_2993900; gDNA_ID_2926198; Annot_ID_141361
cactatctttcttttctcatcagaaccaatttggtacacaagaatctactgcaagtgcatattcctcaaaggattttgttttcatgttaatttattggcgtatctcggtctaaatgtaaccagcaaactatctgccttgttcaatatgtacttccactaaactattttgcattccattggaaagtgacctccatgaaatgccgctcatgaatactcttaatcaatcatccaccaaatgttgcaggatctttttcgcacagaaccagaaaatgttgcatatctcattctcatctcttagtccgcactccacaccctacgccactcactttggagtctgctcttaaaatgatgttatgacatagtaagatatgaccaacataaaccctttcacactcacgacatcttcttatattgcttatttcttaggatcatgaatgaattgtttcgacaatactgagaacgatacacgtcttcaatattctgcataaaggccaacatggaagtagctatattttatcgtggaactagccataatgcttgaaataaacaatgttatactcataatatcaattaaatgtttgtgatatactactatataattaaccactagtaacttcatcatcatcctttttattatttttgggtcaactatatcattatccttattcaaccaattttattcttatataagaggaaaatcgaattaggtaaacggaaaatgcgattactttctgaactcaaaagaaggaatcgaaacaatttttgttataatattaacaattttcgtgtggtctttatcaaattacgatcctgatttatgaacacgtggcgctaagttagttcagtttcattcattgagcttttaattgaacaatgagcgttaccaattttgtgttttttttctcgcaaaatgattttttcttgttcagaaggacacgaagtgttcatcatcttcttacatggcaaaagtacgaaaacatctgagattgtggcacgtgtgttaccctgacgactctcttctcgtccctttttcacttttccagtttcaagttaacacgcggattgggcccggaggtttcttgattcgtcaatcgttagccacacacaagttttattctttaaccttttattttctttagttagtttcattgtaaacaatttttttttaaaaacaaaaaaaaacagaggttgacctagaaaagaaataaatgcagcggtattgaattgttttcttctcaacagtcatcatcatcatcaataaaagaaacatcaaatcaaatagttgaatcactgtatgaaattaagagccagaatttcacagctcaattgcaactttgcaaccgaatggctaaaaacccttacaaaaaaaaagacgaatgattgcaaacttgcggaattaaatgcaaatgcacttataacaagccgcagtacttaatcatcagtattagagtgacgctaaaaaatttgtatttgaaagaattatgttcattctcattaaaataagagtaggatacatgttatctctagacctaacatgtaacctaattttataactaatgaattcacattaaagcacgtacaagtcaatacaacatctccataacattcaagacatctttaatttggatctttttagggttgataatcacaacttttcgatcaaaaagatatatagatcgttcgttaattacaaaaaagtatgtaaagagtataatggaaacattttaagagtaaatttcacaattaaaaaaaactatagattatacaaaatgaagtgtctagagacgtggtaggttgtgtggcttgtgatgaaacttccccacgtaaattctcatcccaccacaatctctacctactaactgctaactactttacgtccagcgccctttcgctgttttgcttttattagttcttctcttatattttctcctagtttttctacttttttttatttatttattttagttttacaaatcttgaaattctatattatagttaaattttagaaagccacctttgtgtgagttttgcttatgcaattgccgaccgaagtttgttccattctggcgttctcaaacctaacaactgtaactacatctttcattcataatcagattgttttaataatatactcatatctaacaatatcaggagagttccagcagttttattcatataactggtgtagtttgaacgataaatagaacttattatagaattaccatcacccaaattttagtattgaactattcgatgagaattttgacatattcatggagctaaagaaatatgacgacgcatcacattttgatatgtacagtctctacattttttcaaatacatttttttctttttcaaatctagtatcaagtacaaacgaatgtctaaattcgcttggatttattaaaaaagtatctttaagtttggtgtacagtttgggttaaagtactgtgtaatataggtggattgttttgaaaaactttgaaccgatgccgatatctaattgattttcttgtttttttttggtaatttgaaaaccattttaatttatttggttacatatatttgtagtattcagtaagtaagaaacaacataagaagattggaatttgatattagctggtgctactaattttggagtgtttctgaaagaagacacacgttccaaaattgtcaacacgtaaacaaaaaccaataagggattgacttgtggatattggataaccaagcaattaattaagatggtttagagacgtaaaatgattaattaagaaatagtactaatactttattggaaaataagagatgaggtataataaaagatgagtagctgggaacgtgcaacagaaaaatagttcacccaactttctcctattaatacttgcctcttctctcttcctacttctaaccttctttttctccttcatcacacacatatacacacgctttcgtttaaactctctctgtttcaatcattaatcagaaagaagcaacacaaatatg

SEQ ID NO: 28103 - DNA, 3003 bp, Unknown; identical to SEQ ID NO: 28102
  misc_feature (1)..( 3003): 2750-1469P.txt file - cDNA_ID_2993900; gDNA_ID_2926198; Annot_ID_201597

SEQ ID NO: 28104 - DNA, 3003 bp, Unknown
  misc_feature (1)..( 3003): 2750-1469P.txt file - cDNA_ID_2993912; gDNA_ID_1621099; Annot_ID_55792
cttctatttaaaaaaaatatagacaaaagtttttaaagtaaatttaagtaaactaataagatctacgaattgtgaaggtttatagaattaaatctcaaaattaatttataatcttttggataatttatactttatttaatagagttacatcggagttttcttcgaatatgatataaaacttctaacaatatttctatataaattttgcaattttaaactaccaacttcataataataaagtatcggaagatacatcttttcctaataatttaacaaaacaaagtttactcaaatctcaactacacacgttttcgaatttaacattgcgtatcaaattcgtcgaatcgtcaactaattctagagtaaacaagatcattggcaatactcttaaggaaaaatggatccatttgattatgttacaagtgataagagttttgaactcgttttgtgtcaaatgttccggtctccaatatgtaaaagtggaaggtttctcatgcttctcttttgtttgttccaatcttcttcctagtattgccatggaaaacatcaaccatatcgtcaaaatgacccgttaaataactaaatattgtaaaaactatttttaagttttcctttcatttcatggtaacaaatatatattttccagttatttctgtttaaagaaagtttcatttgagatctgattggtgggaaatagaagaaaaaaaactcaatctgattttaaacctttaaaagcataattcggttgatttttattttattttattctgattgatagaaactggaaagtaagatgaattggacattaaaaaaaaaaaaaatccctttaaatttgagctaattatagcaactagtcagatccttcttttttttctttgaacagaaaaagaatcgccaaaaaaagaaaaagatgtacttatttagcgaaaatatttttcgtagtaaaaaaacttctttcaatatctttgcttgaatgtgaccatttctattgcacatacaaaaaaacgactataaaaaggacccacagtgattatgaaaatcagattgacgaaaagtttgtgtgtctgattccaatcatattgatccaattcattcatcatattcgatggttgtcaaagcatatagctggattaagtggggcacaacactgaaaacgtttctcaaccgtatgatgtcatttcagcctttggttttctcaacgtttaatcggtgaccgtcaatttcttttcaatctctataatcatttcttcttttggcgtgtcactgggaccttcactgtcaatgctgaattaatctcctttaaggatttgaaggcaagaaaaatcttgttgcaactaataaaaggaatcgattttgatgctcattaatcgacctttatgaccaaaatgggtctatatgaaataattatatgatttgacaagtaaccatttgatttacaaattattcaacgatttagcattacaaaaacatctaaccatgcttaatgtatgatgttattcattttaaaaagtcgaatgaaacccatgtttatctcaatgcatgatttaataattttattatacatgcacataattctacatttttaattaattttattagtttaataataataattaattttctttttttacacttgttataggtgagaaatgaaagttatcataatacaaaacatcagtttttataaaaccaaataaaactcaaaaatcattcagacaaataagtttatggacttatggtatatgatgatactctctcaacatcctcattaacatcatcactattaagttaacaaaaagaaaaagaaaacatcattataagttattaataagtttaaatagtagtattttatattctggtacaatgtactgtttttggtcattaagtggttcaacgacaaaagtaaaactcatgcggtcgacccatgcgttagaagaagaaaatctgaaaagaagtttgaattctttaattttttcataaaaagaagtttgaattcaattcaaccgtttttgtttagttcttctttaattaactttatcactaatgtttaaaagtaaaaggtttttaaagtgtgcaacaagcgtgactctttggcctttagagtcatcaagaagggtaatcattttttttactctttctcgacaatagcaatcaaattatcattcccacttttaataatctcataaaataaagtcaatcatagttaaaatttgataaattccatggaaatgataaaaatttgattttactattgttggatgtgcaattgttcatggtaacttactaatttatatgctttattagttgcagatagtgatatatatcgaaaaatgaaagatctaattccaataattgtcaaagaggatttctaaatttctgtttgactaggtcatatattctcacgactcaacgatctaaccaatcacctacaacagaaaatttggttgaaataaaacgaaaagtgataagtccaaatgtttaaaacaaaaaaaaagtaaacaaaaggcaaaataagataactacgattagattttgttctcgccttatgaatatcctaaaaattatctattagtgatagtttgataatcatctttgactgagaaaattgatgtcacataaacattaatatagtatcaacattaatcattaatgatgcgactataattattattttatcacaatttcttagatttgataatttgtttaggtttgagagagttatatagagggggacaaagaagcaaagtttgtgattataaaattatttccattgaactaaagttttcaatagtttattcttgactttaataataataactattttgcccccagctagtcacatactcatgattgcaaaatctctctctctctctgcctctctatatattaacctttcttcttcctttactttctcatcttctatctctcaaaagaaaagcagacaactttatttgcaaaaacagagtttttttttcttatcttgagaaagttcaacagaagatg

SEQ ID NO: 28105 - DNA, 3003 bp, Unknown
  misc_feature (1)..( 3003): 2750-1469P.txt file - cDNA_ID_2993912; gDNA_ID_1621099; Annot_ID_171269
tgcaagtcttggtgtcgtatgagatctataatgtaatcgttaacaaagaggggatatttgatcataataatggtccgtcgatgtcctcctaagttggtaaatcgtaactgccagttttcaccagactctctattctttagaaaacagaaaaaagtaaatgatttaggaggttactctcttttttactatgtacttattatcttgggttcttttggcgtcgtcgttatttacttttctatggagtactaccgagtacaaataattggagaggagtcatgcatgattattgattagagaatgaagaaattaaaacccaaaactggaagtccaaatcagacaaaagcacctgtggcccacaaaacaattgaggacgatattacgtgaaggacaaatggtcatttgacggacacacctttcttttgttagacgcagtcccgttcgtggtagggtcagatccacgtgaagttcacatgctttccatgcaccgtttgggtcatcctgttggtcccgctttattaactagtctatttcctctattaggaaaattcaattttcgaaacaaaaatcaatcaaaacatgtataaacaaactgataaaaaaccacacaaaaaatatggtgcttttctgagggtatatatattttttgttttcgtctgatcttatattttaaatttggattttatattcaaattttttgtatattttgtggtcataaattgtccaagataacaattcgtgaccaaaaaaaatatatgtgattattttacagaaaacaaataattaccaaaaaaaaaatcatatcttccaaataaaatgtaagagaaaataagaagattatatatgtgagaactttatgagctaaataaaatgaagaaaagtcatagtttagccgcgtaggaaatcattcagaattcagaaatatggctcctcgctaatatttttcttttaaaggtaattgtttttcaacctaatttgagagcaatgtatatcgataggtttcacattagcttatttcgctcacatacatgattgtgcaaaaaaacagaaacgatcgttaactaattatctaagaaagtgacatttcaaaaaggctcatttcaatatagagttgccttcttcatgacatgaccttgatatgataaattccctaatgtaatgaatcaataaaacgaacttatagaacggtagaaattacgtacgtgaggatttatatcatctattaattaattaattgacaacaaaaacagaaggggtagtgttcacgtgcatgtcacgcgggtaatggtgtggacacacgagcctcgtacggtgtaaagaaggagaacagagagagtcgcacgagccgcacgtgggatgttgacttgtcgattagcttaaggggtatgtccatatactaatgattaagtacagtcgaatgaaaacatgccacgagccctagatctacatgtttattgtggttttttttttactcagtcacatccacatgattaatattggtccctgatattcatcttatatatttcacaagtataacaatcacccaaacattagtttttcttaaattgttttacggtgaaatgtttcactgtttcctctatgaataattaactagtggagtggaatttattcatttatcatatccacataattcatctttattttcatttgtgcatataatatatatcctttaactttctcatgcttaccatttaggctttttgtcttcctcaaccttcttaaactttaatatcccccttaaaaacagatgaaaatagtctttcctcctatgaattttcccaatcactttacaaattattaaaggtcttccaattaacctggtttcctaataatgttgagtgtaatcctttcacaagcttttcttaagaaaatgaaaaacaatcatatatgtacaatactagagatatataatgagtcatgactcatattaatcgcggtttttgtaatatcataaagctttctactttaggcttgacagtgatttaatacagtaacatatcacataaatatgagaaatggaggctctttaattaggcctttacaatatacatatatattagaaatagaaagaaaagaaaaaaatcgaccgacaacaagattggtgaagaaacgcaataattgaaccattaagtacagtctaatacccgcagaaaatattacaccacctactcttagtggcaatgctgtactttaacatattgtcgagacaaggagaccaggttgcgtgaaatcatgtagatgatgatgcataaacaatcaccaaagttcaccctatgaatccaagcccttctagcttagtggctatgatcatagccgacatctcatacagtcacattccatttcggagtaaatcatgcgatgaacaaaatttagcttgttctcattacaagataacaaattggatactatatatcaaaaaattgtgagtgttaggatttggatcaaatctaactattagagaacgataatataaaaaacatacatgatttgaagtagtttactataattttgatagatttagaatttggaaatagagaacgattatagattttgctagtagaatttggaaaaagaaatgctattaaaaaacagaatatattctttttgtttaacattttattaatataacaaaccaaaatatagtttccgatattggccagaatatcgtcgggctacaaaaccggaaatagacattacggataaagcttaatccgtattttcactctatttcgcgtttaatactttgtttgtttactattaagatcaccatactatataacaaacaaacaaaaaaggtcacacaactacaataaaatgctaacaagccgaaagtgtacggcagcagtgtgtaatcgaataagtatcattaaagaaggccatgctcgattcattactctataccattccttaatatattagtattacatgggcaacaacgaaacaggataaaaaagagagagtgatcagtgatgatggatggtcatg

SEQ ID NO: 28106 - DNA, 3003 bp, Unknown; identical to SEQ ID NO: 28104
  misc_feature (1)..( 3003): 2750-1469P.txt file - cDNA_ID_2993912; gDNA_ID_2926166; Annot_ID_139931

SEQ ID NO: 28107 - DNA, 3003 bp, Unknown; identical to SEQ ID NO: 28104
  misc_feature (1)..( 3003): 2750-1469P.txt file - cDNA_ID_2993912; gDNA_ID_2926166; Annot_ID_199170

SEQ ID NO: 28108 - DNA, 3003 bp, Unknown
  misc_feature (1)..( 3003): 2750-1469P.txt file - cDNA_ID_2993916; gDNA_ID_1621097; Annot_ID_55733
gtaatttgtccatagtttcccgcagcaagaatagaaaaacaaagatgagtttacctgcctgatgcaagccaaacttgggatgctcctccaccattgtatctatatcgataaatataatctgcctcttgtttctccttgtctgcatcactaagctctggtagctttgcaaacatcaagctgtctagatcaatctctgtatttttaggatccattcttacctgaataatgagtaaagaaaagaagggggcaattaaagaatccagcaggatagaatcaattactgaacaaatgcaaatatgacaagaaaaaaatcaacttcaagaacagagaaatatgacggttataaagccaagaaggcataaaaaatctttcaatcaaaacaaagcaaaaaaaatacaagaacagataaagcatttggacaatctgcataccatatgcaagattcaagaagtaagaagagcactggaagccataccttatcaaaattcactacaaatatggcacttggtataggtttatctgccgttgcggctgatccagaacccacatcaatatcaaatatatacgagtaaagctggttaaatgcggactccacttttattgcctctacgtcataggcaggtaagtgtcttccaaaatcagcctaaatccaaaaatatttttgaagattagtatcataaacattaagatgtagtttttacagctatgaaatccacattttcatcgacatatttttatatgtaattaggttcgttatgagaaacagttaaatttgagatgataaaattacagcaacctctagtgcagttccagcaggcaccatggcttctttcactgccttctccagagctattaattcaggttgcccactctagagaaagaaaaacaaagatgaacatttaggtcaatgggggaaacaatgaaattattggcatcagaagtcagtaaaacttaatattgagtgcaaaaaacttcatgtacaataataatcagctcgagacgcaaatgcaaatcagctaaatcaaatacaagaatccagaacttgaatagaaatcttatcctacatatataatatcggatgttgaagcaggtaaatcataaacaacacaaaattcgtgaagactggttaaaggtttataaaattactcacaggaaagatattataaacaactcgatgctcaatatcaagtggctcgcccgtctcttggcatgaaggcctatgtgttgaaaaactggctcttaggaactcttctagtttttgaggatccactgaatacctgtaacctccatctccattcaaacccacaagcactatattcacttccaaaggaacctgaaatggtacctaaacaaaacaagcttcatagtgtgaaattcaattctcgatgtgtcactcaaactcagccaatctaacaaccatatgcacgaaaaaagctatgatcatagtcgtgaagcaacaagaacgcttttaatttcacttcggtgattctacagaaccaaattactcaacgatttcttctccttcttcttctagctaaattcagactaactgatgatgatgatgatgattcacataatttaagctggagattgtacctcggcacgggagtgaagcatacggcggacatcggatcgaacactctctcgtacgtcaaggaaagcactgtgatgccagtgaggatgacctggctcgcgacggaaaggttgctgagccgagtcggtacgagaaacgagtccgcatagaaacaagagaaacgcgacgaataggagagaagaaaacgaactcgatcgtgaatccgatctcaactccatgactgaaaaaaaacaaccggagatttcgctcacctcccgattttggactggactggcgagagtcgctacaagtcgcttacggcgagggagcagaaatgggaaaattaaggctaattactaatttaccctcaagttttattattaaggtgacctgacctgctctgtctatatgtgatattgtgacctgctttgcctatatggctatatgtgatacctataatcacaaggatatttcaggtggagaatcagagaaagaaattgaagctgaataagacactatatgggagagattgaaaggaagctgttgggccattttggtgtagcgggtcgcaagtcgagcgtgagacttattgctgtgccattgcaggaatgcaaacagaggaaagatttcacaaatgggaaacggatacatgctcagatggttgttttgttgtaggaaatgcctttcaatgagtatgttaaacgctagctgtcctgtttaatggaccggtgtatgtcatcttgtcttgcactgtgtgagcacaacaacttgcaatgtttccattgatgctgtagcagtctctcacattaagctctggtttggatggctatgaacaagttgattggtagataagttaaaatgttgtgatttgaatctggaatgaatagaaagatgtgattggtactgatgtaaattcaatgctttagagaatgtatacaggcaataatataccaatcattatgtttattgctgactaagagccactcctctttgctgttgcaattcggcaatcgttctagatatggtttccatttcaaatcatgatatgcattgactttttccatgtggcgttcggaaatctttcatctatactacgtctacgttgcaagttttgcaaaatgtttaaattagtagaatctcacgtatataaaaactttagtcgccaaattgaaaatggagaatgaatggtaaactactagtttaccctcatattttagctgaaaaatatcgtcacagctgacgaagaaattagaaacaacaagcaacgtgtcacttctcatgtcgtcgttttccccaagaaatatccaaactaacacccaattacctaatgccacgtgtttactcacactcctttaaacaagctcgtaactgtttcatcttcttgtccccaaagtctcctcttccttatctcttggaaaccaagaagcatg

SEQ ID NO: 28109 - DNA, 3003 bp, Unknown; identical to SEQ ID NO: 28108
  misc_feature (1)..( 3003): 2750-1469P.txt file - cDNA_ID_2993916; gDNA_ID_2926165; Annot_ID_139875

SEQ ID NO: 28110 - DNA, 3000 bp, Unknown
  misc_feature (1)..( 3000): 2750-1469P.txt file - cDNA_ID_2993919; gDNA_ID_1620812; Annot_ID_57882
actttattttgctttttattgggtcaatcatcggtgttttgtttctattttaaatctataacattttggtttcagctcgttagattttcagaataaaataaagcaaattttgaattttttgattcattagtcgtttatttttgttggtataatactcccattttgtgtactttggaagccactagagattgtataagtataaataagaataacattactataatgggatctttcgttggaaagttcgtcattttgttttgtctattcccaacttgtttgttatatctaaataatatgctcgtagataccaagattcaagatataaccatgctcctttttttaatttaaatttttaccaaaatgtaaattttctatatataaaaaaagatatattaattgctacttgaaatttatacaagaaatttcacccataattgctacttgaaatttgaaaatgatattttccaccaccaccaatgactgattaaaaaataaactgatttctaacacaccttaccacccaaaacctaataaaaactttaaactgtacctctatttctaacacacccaattaaaagtgactgataagttgtcaaaacattattttgaaagatacattgatgatgtgattgtttttttctacaaaaatttcagtttcgaagtttacccattaacgtgttttttttttttggttttttttttctggtaaatatcctatattttattaaattttcttactatcaactgtacaaaagttttatcatccattatactatctataatggaattgtaattttattacacttagatgtaactagaattgtaaatatattattgtagcaaacatttgactattaaattaattacgtaacctggtttttattttgccttttaatgaaattataaaaattgtatagtttgaaaaatatgatactatgactatttcttatatcttaaaatattattgtcagataaaagagtttgggattttttgataagttgtactctacaaaatattcgaaaacagcctgtacagttgaacagaggcatgcagcaatgattaataattaatagttagataattagaatgttaagtggaaaattgttgtatttagctgactttccagtttccaatagacatcgcccatcgaatgtttatttaatcaacattctttaaaataatgagagtgttttgcttacttggcacgtgattaaagactactgacagaaaaaaacaagattaaacatctaacagaaataacatctttaaactatgattgcaagtagatatatatatatatatatatatatatatatatcagaatagttgaagaaattactgaagaatcaatcaatatacacaaacaaaattatagtttttctccttcgacaatatacgtttagaatttaaactaaacgagatccatatatacattttttttaatttatatttactttgattgcatatgagattgattgtacatgtacatatatgtttatgattattagttaaaactgatcgtgcatgtacatatataaactatggagagtggattataagattgtaaaaactcaaatctttctctataatatttaacacgtgttcatatttatgactgacacaattggacacaacttaagttcaaagagtcaacaaataacaatgcatgctgaggcatacatatatgtaaaaaaaaaaaaaatcgcaaaaaaaacagatatgtaaattatacattattgttaattgacaaaccaagttgcaaactgcaactaatcacatagagtttaaaaatgtgataattaacggaacgcttaagatggacatgtaattatatattaatgaactgaatcaaacaaaaactaaaaacatttattgcttatgtggttgatgagatatttgttttaagcaacatgatcaaatgagaatgtgaagacgtgttagtcacatatgaatatgatttataaaagaatctaagacgacataaatgactagatggtggaaataatgtgaggcatcttaatttccttttcatgcatcttaatttccatataatccataaaaaatgtatcttatatggtatttttctcaatgaacgttttgtccaatgggctagagacaaatatatcctccactctttataacggaacgggctaacaataaaaaaacgaaaggaaaatttgacgtcatcttttctattgtcacaagaaagacatcatattttctatcgttttgtagcatgttacgtttcagattgttttagactttgtttcttaacttgtcctaatagtttactctaattgtgtgagtcttttacgagttttacacgtacttataatattttttagtcaagatttctatattatattttcaaagttatgacctaaaactatcattttcgctatattaaataaagaaaatcacatttcagctaactacctaaaggaccttatgaggtttattctttctttttttaagaagacccgatcaatataatcaactttctcacgacgactttccaaaatatcattgaagtcaaccttcactgaagcaactaaccatatgcatcgtccagttcaagattctgcaatgcgattcaatcgttaccacaacttaagatcgaaaccggacattagaacccctttgttacttcgtcgtacattcgtcaactatatccttacctttggtatccttcgcctttgatacaatgataccaaaagaaaagaagaaataatcagaaataatcaattgttctggttttaggttgaccaaactctttaaccgaaataatcagaaattcgaaaataaccgaaacgaaccgacgtaagaaaccggatcgtccaattccagattttgaaaccaaaatccaaacacataaaccctaaaacattttcgcatcttctctattcaaatcctcttatcatcgatagaaatgatcatcactgggttcgaaattttctagaatcttcaagctttccttaccagtttctgattaaaagatg

SEQ ID NO: 28111 - DNA, 3003 bp, Unknown
  misc_feature (1)..( 3003): 2750-1469P.txt file - cDNA_ID_2993923; gDNA_ID_1620812; Annot_ID_57893
tgaatagatattttctcctctgcgtaaagccaaagatattagttaatgggaacactataattcaatctactttataatgctctttctttcctaaaataggaaaacaaataaacaaaggtacattatcaatcacgatggtagtggtaacataacaacattaacattcacattaaccaaaaaaagaagaagataagatcttctctggtctaaatttggaaagagtctgcactctcagaatcaatctctcttgttgaatctcatcttagcttcagtttctccactgtaaggagcaacgtgaaaagcgtactgttgaatgatggagaagacgatcatctcaagacatacaagcacattttgcagagcttcttcaagctgatccacctccaaccagaaatgatgcgacttaattaatcccaatcccaccaatatcttcaggactattccctgtgcaacacataattcccaaggtttaagaatggaacaaggcgaaaaattagacatgaatgctttaaacttgacccaatgtagcagtgatcctaaaatctattgagatgagacttttttgtgtctcaagtaccaaccaacaagctctaaacggttttcgttcgctacacaatcgaaagacttagattaaggagaaaaatctcaacgctcagaccatatgcacattacaaaaatcctagacaaaagagttcccctttaaaccttcagctctcaactaaatagcctacggtctgttgttgagctggcaaagctacaattccttgttaaagtagtcctgcaaaccttaatggtctaattcgtggcggtgaaatattataaggcgggaacccctaaaacatcttatgacattctagagactatatgtatctttccattgtctaaacagcagattgaagaaaaatttgaatgtttcctcatcaaactcagttagttgattgaagaaactagtaggcagagaacttgtgattttggcatttggcaggcaaagaaaaagttggaaattaagtatttacctgccaaaagcagaagaacactatccctttgacgcacatgaactttgtaagaggcttatgaggctccaactctttagcaaaaacatggtagaatttcaccaaagaatacaacgccagggaaaccgaaacattgagaatagcagtgaagatccagctcaaccaaactggataaatcccaaggatctgtaatgttatcatcaagatggaacacactgggcggataatacaaaactgccatgtccattgcttgagctgtttcagtgtgaggtaatccagatgtgtggtacggggcacgaaaagagtcattggaaacgaatggtggatttctcgccctttgaattcatctgggataatccgtgcactcatcgatatgtttacataactatacatcaaagccaagaatttagcaatgacctgaaacaaacagaggcaaatacaacaaatcaagaaatatccacacagagagagagagttaatgtagggaaaatgagacatgacagaatctagaaggaacctacaagtgcctcatagcattccttaacggcgtctagaaacatgaagaaaggtttgcttcctttagcatctaacaagcccacaaaagagttgatagcgtaaacaggagccataagcacaataataagaatggctctctgttcattaggtttcttccagtaaaacagatgctgggatacaagctgcatagtgaagtgcatcgagagcaaaacacagaacacggatcccatcaccgtgatctccgcaggagataaagtagataagtcaatcattctgcataaaatgaaacaagttaagtacacactgatcatcacgattcccaaaaaactaacaatggttgtgaattccaatcagatgtagcagctagcacaattatgaagtgtttctagactgaatagaactaaaacatcatgattcctgagatatagatactaattcagaaattcccagtacttaaatagtaacctcactactttgacatactttctttgtctaagtcacagatcttatactctagaaaccccagaatcaaatcattgacgaacgagctaaaagattccaaatttaactaagacacagcaaaatggggctaaaaggagtaactatacgccgaaaacccattactttcaagctcttcaggatcatcaaaatcgaaactttttgtgatactgaacttaagagatgaacaagaagaagaagtagagagaatcagaaggcaaaccttgattgaaacaagagggagattatcgaagaagacgattcaggtagagaacttcaccgagttgtttgttattgtacgattcatcaatggtatagatttgtttgattaaaagaattgtttttttgaccagaatctgttcatcattgaccggttcaaaatcagccgagtcctctttgcgaccaagaaatatacccaagtcctccgtcgttatttgccggccggtttggttttccgtttaaaagttcgaaccgaattgaaatttggttattcattaaaacaaaattggttaggacttaaattgcggtttggtttgatttattttgtgaaacaagcaagaacaaagaaaataacaagttaagaagatgcaaatgtttgacaagattaggcgttaattaaattattgtaagatatgccacacatgacacatggatgatgctgttacatactataagagtataaggaatgtgctttaactaataaattgacgactctttcatcttatgtttatactcgtgttctttttgtcaacttttatgaggaacgtatgagactcgcaatgtcttgcttgcacacaaactcaacatcatatatgttgcttccggttaacctaacttgtaagtccattcttgtctctctatttataatctctctgtgtgttttcttttcaaattcgatgaggttgttatagacaagagaagacatttttatacaaaagagtttatcattatataagtttcaaactttgaagatatg

SEQ ID NO: 28112 - DNA, 3003 bp, Unknown
  misc_feature (1)..( 3003): 2750-1469P.txt file - cDNA_ID_2993930; gDNA_ID_1620833; Annot_ID_57905
tataatagttaaaccaatgagggaaaaaaaagatgagcaatagaaggtgcttgttgctttaggaaaaataaataaattaagctttctctcctagtcctgattaccgaaaccaatcccctaccttcttttgctgaaaaaaaaatcaagtaatagaaggttttgccggcgtccggatctctgtttcaccattttcttttgcttcccaaagatctctgttttacattgcttttggtcaacttctcaatcaaccaagcctttccctcttaactcaatgtcggatggttattgatcagatgctagagttggatggaggttcccagaaatctcctttgggaagctatgcctactacttttctcgtgattttaaacctaggaagccattcttttacaacagtatctctttctttgaacttgagacgattttctttgtgttgctcagatctcccgattttggctctccctcaatctgcacaaatgccttttcccaccagaattcgccttcggtgacaaactaacctaatttatgtcgatgtcactagattggacattcctttctaccttctgggcttaggcccaattatcatattttcaaagctcaactccaaaaagtgtattccactgttctctctgcaaaagcccatgttttgcataaaacttttctgatcttgcttagcgaatttttgtgtcgactcatggaactgattgttaatggacgtcgattggaacataatcaaacaatcttgctatgctggtataaaacttatctgagaacatgaccattagaattacctaggggtaatactctctattttcaaagcttgaaaaacaccttatatgatagcttcctttatcaaggcttgttgaataggtcgaggagaaacggcattatgaccccgtctctaaggagcaatggttaccgtagcttcttcaaccccatatccatgtattccctgtttatcgagctcatatatgtacaattaccaacttctgggaccttttccatatgctcaaatccaataagctcatgtctgattatttttgttatgtgttaagtcgactaaaaactttgtgtgaaattcttaattttcatggtataatactccatgtgagagaggatccacctattatgttacaaccttatactctttttttacgaaccttggttttagcttcatataatatgttgtggtatgactttctttgcttgaaagactttggtctaatgctgttgaaccttcatgcgagagtttttatggtggcttgggaagcttgtcaaaggaccacccctcatcatgctcgcttaacgtcttcaagtcatacacctcacttcatgtttgctattgtttgcctaacctcaactttcattcggcatcaattctagcaaataaatccaagcaccagagcaccatcaccactacccaaacctttgtcaaagctctacttcatgtagctctcctcgtgccggcgagaatcatgtctttgaccccttcattaacgccacttcgtcttttgacagagacaatttgtttttcctttgaatcgctcttgaaagagtcgtcgataaactttgatctcacaagtaccataagcatctttgcttttggctcaaaactctcaaggaccctttgtcgattagccctatctatctttttatcatttttctggtaacttttggagtatgccccttattgttgtgctttaaactttggaactttttccctttatctttgtatttggcttctacattatggaatgaaaacaaacattgtccaaaaataaaataaaaaaaacaatgaggaaaaaaatcaaacaaaaataggagaatcatagtcatatttttggatttaaattcaaatctttttccatggtacataatctgcagcatttacagcaaaaatgaaacaaaatctgttagttttaaatttaaagatatgtttgcaccctataataatctcacataagttcttaaagattgaaaaacaaaaatggttgcatatgtcaagaacaactttttattggttcatatagtagttttacttctttttgttgtctcatcatatgcaagatttaatacgaaggttacaacagatgaaatatgtggcatgtgcgcacgcagagcagtcaatgcgtcattttgctatgagttcatgaaatcatccactcaagttgcaacattggatacttatgatctcgccaaatttttgatcaattatgattttcaaaacacctttgatctaataaagcatttccagtcactcacaaacagcacaaccgatcccagttctaagggttcttatgagctatgtttacatctttttaatcttatcaatcctcttgaaaccgcacttaaagctttggcaaccaatgactatgacactttaaacaggaatgttgatgctatgtctcaattcgcgatggaatgtgaaagcgagctgtcaagtgtcatcaagcctattccaaagctcttgaaaagggtttctatcgtcgaaaatgtatccgacattatttttgtaattgtggaatgttttttaagaaaagaagaaacttcatgtaaggaatcagtatcaaatctacaataataaattaataatcataatgttgtttggtatgatgttgccattaccgatttacaccgataattaattgttttagtgttaagaaaaatcgaaatccaccacaagagcataccaaatcacgaaaaagcttgtttgatagatcggattggaccggctttcgtatttgaaaaagtcatcgttcacctgtgaaaaattacgcaactccggcgaggactattttcaactatgggcctagccccaattagtccaattagtaaggagcttaaaatggttttctcaaagtacggggcaaaagtaaaagaataaaaaagtagtggaccttgagaaaagtcatcaccagctttccttcctatgccacacaaacgtgttcttctgaatatgagtcaaacacagagaagattaggagaacgtggaagaagaagccatg

SEQ ID NO: 28113 - DNA, 3003 bp, Unknown; identical to SEQ ID NO: 28112
  misc_feature (1)..( 3003): 2750-1469P.txt file - cDNA_ID_2993930; gDNA_ID_1620833; Annot_ID_169751

SEQ ID NO: 28114 - DNA, 3000 bp, Unknown
  misc_feature (1)..( 3000): 2750-1469P.txt file - cDNA_ID_2993936; gDNA_ID_1620818; Annot_ID_50667
ttaaaacataaaatttgactcatctattataaacttatatagttatttcaacacatgagatggccaaattggagtaataactagtgggtttagtggagttttagttttcctttctccaaaattggtttagctagtggagctcgtagaaacaataacattaataataaaaggaaggattctactattaacaattaactcgcactaatctaaaaggagggttgaatttagaattaaaatcacatcagtaataatatttctctccatctttttgtgtctaacttctctcttcaatttctatttctaattatgcaaagatatgagaagttgaagcaataaatagtggatttagtaaacctagtggaaacaatattcctaccatttggactgcttcgaaaaatcaatcggactgacacttgagaaatcataagtgattgatcttcgtttgtaaaaaatttcctgatttttgcgttcaatttccaaccaatttaaaactggaccaagatatgtgtgtagatttcatgtccgtcacaatagttgttccaaataaaaaaaacagcactaccaaacttgatgtgatgagtccagtaaaaggagcttatacacgacttaaagaccatatgaaagaagttcaaatttatatcatatatgtagattcagtgccttaaaagtaaggactcgtgggcactcatgagcatataggattccaatactgatataaccctcctacaaaaactaatgctaacattataaacattaaatgatttttattggctattttggtatatgcatggtagtttccatattatttggcatggccttgtttcagtgttggcgtcaaaacataagtgaactggtgtgcctaagacttgaggtcttagacgaaatgttaaatgtgtaatctctttttctttttgctacggtttattttaaaaaattcatgatcttttaatgatttttttatggttatcattagaaagcagtattctctaataagtaggtgatcaattttgtccaacaatgacacgttttttcaaatggctattagccttgttattgttacaacgaatcgagtatgtgtgcttttttcaaagcaaaacaaatataacatgatttttatatgaaatatattaaaaatgaataagattttatcggataaatgaaattttttacacaagataaaaaaaaaacattaactcgtaatttcattaatatggttaaatatcattaatatcaacttttacgagtagtattctaaaaccacaagtgaagagtgatcccaacaatcgccgagtaagtccccgtgaccataagaactaaacccatcacaataatcaccaccaaaaccacactctcaaactccagacatctcctatatcccttactgatctttaaataaattacacatggaaacactatcgaagtacaactactcaaaagtgcgcctataagtgacattacatatccaaacaatggcacaacaagtgcaaccaatattgttcctaaaaccagccccgttccagtcaacatccggaggcttctccttttatagtttgcttggatcaatcgtgtattgattgcttccatgatcggggaaagaattaatgcgtatttggttagcggactcacgattgtagtagatattgctatcaccgcgctgatattatgagttggaaggtttaaagtgatttgtgattgcacctcttctccatacataagatatccaaagattgccaccacagcatagattattgatgataaagcaaagcttatggaaagaatctgcatgtatactcaaaaagaaaacaaaaaccggtttaaaatgattgaagaaatttatataaattaacaaatcttgttagctgaaaatgttttgataaattaagtaccttagagaaatgttttttgttcttcatagaattgtagatggttgggaagacatgatgtgcagtgtagcaaacaagatacaaactaactgcggtaggaattcctgaccacttgaccagaacacctttgttcttaaatcccacaccgtcaatagcgccgatccaaagaatagacattacttgtatacaagaaactaggatcccaccggccgaaatatacgagagaaaatcttgtgtttccaaccacattgttggaacaacgatcaaagaagcaataacgataaacaagtgcttcgaatcccggcatgtgggaacatgtgatacatattgtcagcttctaatatcaagattgccgttgcgacaaaatacaactcgatgtatatgaagaaagagactaataaccgacctttcttcccaaacgctttgttcgctagatcagggtaactacgaaccatagggtcgagtttgaggcaacgttggagaagcaaaccggtgtaccaagttgttacaccaattagaaagaaaaacagaatgctaatccatccacttgaggaaagtgcataaggaatagccaatattccaacacctaacacatatataccatcaaaatagcaatctattagtttttcttataacaaaactaatactaaggctaattacgagtgataatcgactatagttatatatgaaactatatgtatcttagaaagttatacctgacaaagaattcaatgtgttgaaacaagcgtgaacagaggaaatgctaacatcaccgtcgttgccgccggaaaattccatcttaaatgttttgttttgttaaataaaaaaaagactagagtttttgaggaacttacttacacatcatgacttgtgttggtgtcagtgagagtgagtgtatgtatatatggaccaagtagataaaccggaaattggtttttgaaccggtttaaatgtgaaacccgtttggatttttgttttgtttttttatctcatcttcttcttcagaaaaacacaagataacagaattgccaccaaagctccatttttatccccacacagaagaagcttggggaatgagaagataagagctctcaaaattccccgaatttcgaatatg

SEQ ID NO: 28115 - DNA, 3000 bp, Unknown; identical to SEQ ID NO: 28114
  misc_feature (1)..( 3000): 2750-1469P.txt file - cDNA_ID_2993936; gDNA_ID_1620818; Annot_ID_169353

SEQ ID NO: 28116 - DNA, 3000 bp, Unknown; identical to SEQ ID NO: 6792
  misc_feature (1)..( 3000): 2750-1469P.txt file - cDNA_ID_2993944; gDNA_ID_1621105; Annot_ID_55963

SEQ ID NO: 28117 - DNA, 3003 bp, Unknown
  misc_feature (1)..( 3003): 2750-1469P.txt file - cDNA_ID_2993948; gDNA_ID_1971793; Annot_ID_58052
atagacgtaaggtggagacttgtacacatatggagacggtggtggactgtaggcgtatggtggtggtgaactatagacgtaaggtggagacttgtagacgtatggagacggtggtggactgtaggcatatggtggtggtgaactatagacgtaaggtggagacttgtagacgtatggagacggtggtggactgtaggcgtatggtggtggtgaactatatacgtaaggtggagacttgtagacatatggagatggtggtggactataggtatatggtggtggagaactatagacgtatggtggtggtgatggtggagagtatgggtattgagcacttgtatgcgcagcaacggcatacaaggccaatatcaccataagaagagatggccaattactcggattagccatgtcgattgaatgtgtttgctcttgtttctagactcaggttttgttagtatgtttcttactttaaacccgatttatttttgaatggattgtaatagaaagtaaacagtttatatagcttacattaggccaactagaatacttgtttattgaactttaaggaagcgtcttagagcaatatcttatattgtttaataagtcaacttaactagtttctgattttgtctataaatctgaagaaaaagtcgagaagaatatgtctttggtaactacctctaaccatactttaaatttaaatgtgtcaacttttgaagttgtcaatttaaattcaagacatttaagagtgtttctttctgaattatctatcaccgaatttgtacactagttctatattacatcttgtaattttaaatactaatgttatcgtacatgactcataattttgagtttttcttttgagttaatttttccaaatggtgataactttgacattttatttcgtaatgtgtataatacaactaccgattttcattttttttaaaaagaatattacttacactaaccatttgatttggtttagtcataatctcttcatatttcagccatctggtcgtcgtccgttatatggaccttttcttattctatcgttttaacattgtaattaccgattatcttttttgttgaataaattttaaatgcttaggacaaaactaatattacatgttgtggtttcggacctggagagattacaggcttcggcccaaaacttccttgtattaaaaaaaaaaaaagaataaattttaaattctaaataaaaaagatatttactaaggatttttgtgaaagcaatactaattgcattaacattcatacatgatttgtataattgtttggagttgggtaagatgctcgacttccacattagggaacaaacaaagctagattaatgcacgtctagtgaaagatccatccctttgattacttaacttcacattagggaaaaaacaaagctaggttcatgcacttctagtgaatgatccatccctttgattacttaacttcacatttagggaacaaacaaagctagattcatgcacttctaggtgaaggatatcaggatatgccacatttctatcaaagaatacggttaagaaagtctataggaggacaaaaatagatatgttttcccaaaaaagattcaaagctcaagttaaatggaacaatgagttagcaaaaaatggtttaacgggaggagaaatagtggtagtgtcaaccaagtcgccttggtccagtagtaaagagaggtaattcctgtcacatgggttcgagtagctttggccactgggattcgagtaatttaacatgggttttttcgggttccagaattagtctttggacctagaaaccctttaagatcacctgaattatcaaaaaatatatatatagtagtagtgttgtgtcctatgttgaaaagtaatatggatcagctttggaattctccaggaagcaatgggatcatgtgggatcaaaaagaataataaagagaccacgattgggcaattactaggcacttatgtcattgaggtgattagtggatcataagattatgcctactgttatcctcaatttgaccgtatactattttcttctcttttagccatccttgaatacctaaccgaggttcaagaatcagtttatgctttcatgttgggttgacctttgttaaataggttatctagtcatgaagagcgaatcaagccaaactcttttttttttttctctttaattaaaataggattgtctctaaaataaaattttacctaatccccgattttgtaattttacttttcatctcaaagaaatacaaattaatattacaaaataaaaaaaaatatgaaatataacccgtcaccattaccatcaagttttcaaagttttaacgaataatatatcaaatcaaaactttcgtgatgcagaattcaatctttagaattttaaacatctaatacatatgatcgtaataaattttagaatatacatataaaaatgcatattattttttacataataatatcgatttccgttgtttactatacacgtagcaagacctaaacagttttaatctgatatagcggaaactaattttggcaccttagacaattgattggtcaattcaaccctcaataagcccaagtggaaagacaaagaaatttagggtattttgtcgaatgagacataatcaacttgactgctccaataaactgttttcactagatgatggatagtagttctgttctaaacatggttaatagagatccaaaacccaatttctctatggactttattggtgcaactctttaagtgaaattgaaaccttacttcaacacatttcaaatgtatctacctaattaactctttatataaaattaaaaaaaaccttagtgcataagtgggtaggtgaacttgagtctcttggcaatatgtaaagaggcgaaatcaaagttgatcaacaattaaacacaaaaacccttaagttgacgtggctgtatctcttccaactcttaaaaatcaattactattatacccctcagaaaaatg

SEQ ID NO: 28118 - DNA, 3003 bp, Unknown; identical to SEQ ID NO: 28117
  misc_feature (1)..( 3003): 2750-1469P.txt file - cDNA_ID_2993948; gDNA_ID_2926143; Annot_ID_139022

SEQ ID NO: 28119 - DNA, 3003 bp, Unknown
  misc_feature (1)..( 3003): 2750-1469P.txt file - cDNA_ID_2993959; gDNA_ID_1620811; Annot_ID_50584
ccatatatcaatagacgggaatttaaaagtcttaactagggctaaccttcccacataaggtaccatataacaacttttcctataataaccctctggaagtttgatctggttgaacttttcagatctaacgtctaagctcattagtttgcgttccacttcaataccatcaccaacataaacagttgctccatagtacatgactccattaattagtatatgcatcccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaaatgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgacttcgttgataacaaggtttggtttctttcttttcctttatccaacaatttcaatttcttattatttctttcagttttcttttgatggaattttttggaacttttttattattattgttacattccaatgaatttatctttcgtgcatggattatcttggggatatatacttagatcgtcctatttgagtgatttatatatgacaaaaataaaagagtaatgttgtattacataatacgtggatataaactcggatgaagacacattaccaatactatcacaagctagtcaactcaggtctaatgaaatccagtaaatacttcttctagtagtagcatataagtttgttctggtatacattattagtcctagataatcatacattatttctaacataaaaatgtcctaattcttatccataaatttaaataagaatcatcaggcttacaagagaacgacatttgtttgattactctgacactagaccacatttgtttgtttgcgtctccgttggtgtttctatgctacggtgaataggattttatgatatagggacgcaattcaaacataaataaacaattgtagcttatatattattcaaaaactaaaaatgcagtggtttccggcgttgagaatggcggcgatcactaaatcggaagacgcaaaagcgaaagccatggaagaagtggaagaagggttgttgcaactcgaggatgcgtttgtttctataagcaaagggaaaccctttttcggcggtgaagcaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggagatcgaaaaagtagctgagtttctacaagaacttgaggttagagctcaatccgcagcttcaagatcttgagatcatcttagaaatgtattgcaatgcaattgtgttttgtgtacatgtaaaacgaaaataagttgaagttttaaagtgttgtgttcagtctatgctaggatttatgacgcggtgtatgggctacggactattttcagtttatgtttatcgaaaatataagggtcagcccaagattattaggggtcgtcccccctttaacatggaaatctatttaattcgggatcataattatttttggtaactgagataattttggaaatttttcaaaaatctttttaaaaaacttgctttaatattaagtttctattgggttttcacttttcagaccttcacatctttcttaaccaatatgagcccgccgggataatgtgctttcacatcgaaagttaaacgacttatcttgaccactagtacaatttgtctaatagtagtacttaattgaccactagtcctaattaatctactaatttttctgttttacattttaattaatctgctagtactaaattgtcctccatggaccctcttcattgcatctgctcctgataagccaaaaattttaatatcttgaaccaatcaaatttctctggtcagagagatctagtagcacgaatatatttattaacaaaaaagctaacaattattagagaaaattaagtaactaccaaaaagagtaacattgacaaatactttcacaaactcaaaaaaagaaagatatgaaaaatgagtaataataattttaaaataataaaataccttttctgtaaaatagacaaggtcccaaagacccagctcaagtccagctctctgtattcattaagttaccttctaaacattcacaccatctctttctctaacaatg

SEQ ID NO: 28120 - DNA, 3003 bp, Unknown; identical to SEQ ID NO: 28119
  misc_feature (1)..( 3003): 2750-1469P.txt file - cDNA_ID_2993959; gDNA_ID_1971909; Annot_ID_177048

SEQ ID NO: 28121 - DNA, 3003 bp, Unknown; identical to SEQ ID NO: 28119
  misc_feature (1)..( 3003): 2750-1469P.txt file - cDNA_ID_2993959; gDNA_ID_1620811; Annot_ID_169030

SEQ ID NO: 28122 - DNA, 3000 bp, Unknown; identical to SEQ ID NO: 8966
  misc_feature (1)..( 3000): 2750-1469P.txt file - cDNA_ID_2993961; gDNA_ID_1971952; Annot_ID_58633

SEQ ID NO: 28123 - DNA, 3000 bp, Unknown; identical to SEQ ID NO: 8966
  misc_feature (1)..( 3000): 2750-1469P.txt file - cDNA_ID_2993961; gDNA_ID_1971952; Annot_ID_177356
